US007041814B1

(12) United States Patent
Weinstock et al.

(10) Patent No.: US 7,041,814 B1
(45) Date of Patent: May 9, 2006

(54) **NUCLEIC ACID AND AMINO ACID SEQUENCES RELATING TO *ENTEROBACTER CLOACAE* FOR DIAGNOSTICS AND THERAPEUTICS**

(75) Inventors: Keith G. Weinstock, Westborough, MA (US); Craig Deloughery, Medford, MA (US); David Bush, Somerville, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/252,691

(22) Filed: Feb. 18, 1999

Related U.S. Application Data

(60) Provisional application No. 60/094,145, filed on Jul. 24, 1998, provisional application No. 60/074,787, filed on Feb. 18, 1998.

(51) Int. Cl.
C12Q 1/70 (2006.01)
C12Q 1/68 (2006.01)
C07H 21/04 (2006.01)

(52) U.S. Cl. ............... 536/24.1; 536/23.2; 536/23.1; 536/23.5; 536/23.7; 435/320.1; 435/69.1; 435/252.3; 435/325; 435/69.6; 435/4; 435/6

(58) Field of Classification Search ............... 514/44; 435/69.1, 320.1, 252.3, 199, 115, 325, 183, 435/252.33, 69.6, 69.3, 4, 6; 536/23.1, 23.2, 536/23.7, 23.5, 24.1
See application file for complete search history.

(56) References Cited

OTHER PUBLICATIONS

Boslego et al, Chapter 17, Gonorrhea Vaccines, Vaccines and immunotherapy, Pergamon Press, pp. 211-233, Edited by S. Cryz, Jr., 1991.*
Orkin, S.H. et al, Dec. 7, 1995, Report and Recommendations of the Panel to Assess the NIH investment in research on gene therapy.*
Lambert-Zechovsky, N et al, Clinical Infectious Diseases, Jul. 1992, vol. 15(1), pp. 30-32, (abstract).*
Haertl, R et al, Journal of Clinical Microbiology, vol. 31(1), Jan. 1993, pp. 128-133, (abstract).*
Matsutani, S, Journal of Bacteriology, vol. 173(24), pp. 7802-7809, Dec. 1991 (abstract).*

Shryock, TR et al, Current Microbiology, vol. 14(5); pp. 251-254, (abstract only) 1987.*
Mallea, M et al, FEMS Microbiology Letters, vol. 129(2-3), pp. 273-279, (abstract only) 1995.*
Blattner et al, EMBL sequence alignment, created Jan. 29, 1997, Accession No. AE000213.*
Oshima et al, EMBL sequence alignment, created Oct. 31, 1996, Accession No. ECD748.*
Carter et al, WO96/641172, Database Accession No.: W10941, Dec. 19, 1996.*
Blattner, et al, Science magazine, vol. 277(5331), pp. 1453-1474, 1997 (complete article).*
Koonin, EV (1996), Nucleic acid Research, vol. 24(12), pp. 2411-2415.*
Del Campo, M et al, RNA (2001), pp. 1603-1615, vol. 7.*
Boslego, JW et al, Chapter 17, Gonorrhea vaccines, in Vaccines and Immunotherapy, p. 211-223.*
Ellis, W; Chapter 29, New Technologies for Making Vaccines, p. 568-575, in Vaccines, WB Sunders Company, 1988.*
Rattray et al, Applied and Environmental Microbiology, vol. 61(8), pp. 2950-2957, Aug. 1995.*
French et al., Sequence and Properties of Pentaerythritol Tetranitrate Reductase from *Enterobacter cloacae* PB2, *Journal of Biothecnology*, Nov. 1996, p. 6623-6627.
Ehrhardt et al., Sequencing analysis of Four New *Enterobacter ampD* Allels, *Antimicrobial Agents and Chemotherapy*, Aug. 1996, p. 1953-1956.
Hou et al., Ribotyping and Random Amplification of Polymorphic DNA for Nosocomial *Enterobacter cloacae* Isolates in a Pediatric Intensive Care Unit, *Concise Communications*, vol. 18, No. 11, p. 769-771, Nov. 1997.
Deguchi et al., Detection of Mutations in the gyrA and parC genes in quinolone-resistant clinical isolates of *Enterobacter cloacae*, *Journal of Antimicrobial Chemotherapy*, vol. 40, p. 543-549.

* cited by examiner

Primary Examiner—Lynette R. F. Smith
Assistant Examiner—Ginny Allen Portner
(74) Attorney, Agent, or Firm—Buchanan Ingersoll PC

(57) ABSTRACT

The invention provides isolated polypeptide and nucleic acid sequences derived from *Enterobacter cloacae* that are useful in diagnosis and therapy of pathological conditions; antibodies against the polypeptides; and methods for the production of the polypeptides. The invention also provides methods for the detection, prevention and treatment of pathological conditions resulting from bacterial infection.

9 Claims, No Drawings

NUCLEIC ACID AND AMINO ACID SEQUENCES RELATING TO *ENTEROBACTER CLOACAE* FOR DIAGNOSTICS AND THERAPEUTICS

CROSS-REFERENCE TO RELATED APPLICATIONS

This application is converted from U.S. provisional application Ser. No. 60/074,787, filed Feb. 18, 1998 and U.S. provisional application Ser. No. 60/094,145 filed Jul. 24, 1998.

FIELD OF THE INVENTION

The invention relates to isolated nucleic acids and polypeptides derived from *Enterobacter cloacae* that are useful as molecular targets for diagnostics, prophylaxis and treatment of pathological conditions, as well as materials and methods for the diagnosis, prevention, and amelioration of pathological conditions resulting from bacterial infection.

BACKGROUND OF THE INVENTION

*Enterobacter cloacae* (*E. cloacae*) belongs to the bacterial family Enterobacteriaceae, whose diverse members are Gram-negative rods that are glucose fermenters and nitrate reducers. These organisms are found free-living in nature and as part of the indigenous flora of human and animals. They grow rapidly under aerobic and anaerobic conditions and are metabolically active, utilizing a variety of substrates. Most species are opportunistic pathogens (Kenneth Ryan, Enterobacteriaceae, Chap. 20, Medical Microbiology, An Introduction to Infectious Diseases, Second Edition, Editor, John C. Sherris, Elsevier, New York, 1990).

*E. cloacae* is an ornithine-positive, lysine-negative pathogen that can be associated with urinary tract and respiratory tract infections. The bacteria produces endotoxins which as aerosols can penetrate into the lungs causing fever, coughing, difficulty in breathing and wheezing (Fairley, T. and Gislason, S., 1986–1997, Environmed Research Inc). *E. cloacae* is becoming progressively common in newborns in Neonatal Intensive Care Units (NICU) (Shi, Z. Y., et al, 1996, J. Clin. Microbiol. 34:2784–2790; Cordero, L., et al, 1997, Pediatr. Infect. Dis. J. 16:18–23; Acolet, D., et al, 1994, J. Hosp. Infect. 28:273–286). A study at Children's Hospital in Michigan showed a four-fold increase in *Enterobacter* in patients with bacteremia between 1989 and 1992. *E. cloacae* accounted for 74% of the isolates. Twenty eight percent of the infected children went into shock and six percent died (Andresen, J., et al, 1994, Pediatr. Infect. Dis. J. 13: 787–792). An outbreak of multidrug-resistant *E. cloacae* lasted for 4 months in the NICU in China (Shi, Z. Y., et al, 1996, J. Clin. Microbiol. 34:2784–2790). Outbreaks have also occurred in surgical wards (Burchard, K. W., et al, 1986, Surgery 100:857–862) and burn units (Markowitz, S. M., et al, 1983, J. Infect. Dis. 148:18–23). *E. cloacae* has also been shown to be the causative agent in a case of gas gangrene (Fata, F., et al, 1996, South Med. J. 89:1095–1096).

Epidemiology of *E. cloacae* is not completely understood, although studies of infection and colonization point to the endogenous flora of the patients. Molecular typing results of 141 strains of *E. cloacae* from broad geographic areas in the United States (from the National Surveillance Program: SCOPE) indicated that although clonal spread of a single strain was observed within a given institution most of the episodes of bacteremia were caused by strains unique to the individual patients. Therefore, selection of mutant subpopulations within each endogenous infection can be caused by drug exposure (Pfaller, M. A., 1997, Diagn. Microbiol. Infect. Dis. 28:211–219).

Antibiotic resistance is a major problem in the control of infectious diseases. Strains of *E. cloacae* resistant to broad-spectrum penicillins and beta-lactamase-stable cephalosporins occurs at a frequency of $10^7$ to $10^6$ (Kadima, T. A. and Weiner, J. H., 1997, Antimicrobiol. Agents Chemother. 41:2177–2183; Lampe, M. F., et al, Antimicrob. Agents Chemother. 21:655–660; Lindberg, F., et al, Rev. Infect. Dis. 8 [Suppl 3]:S292–S304). Selected fluroquinolones have often been successfully administered to patients with urinary tract infections; however, *E. cloacae* has become resistant to many of them (Deguchi, T., et al, 1997, Antimicrobiol. Agents Chemother. 41: 2544–2546). Some resistance has been attributed to plasmid-containing *E. cloacae* and some to the *E. cloacae* chromosome. In Holland, two different resistant strains of *E. cloacae* have been identified. The Amsterdam strain (resistant to ceffotaxin and piperacillin) exhibits depressed chromosomal Class 1 beta-lactamase, whereas the Rotterdam strain (resistant to cefuroxine) favors the spread of a plasmid encoding TEM-2 beta-lactamase (Namavar, F., 1997, *BIO* 99–53 99–606615). Resistant strains of *E. cloacae* developed within 6 days in nearly 50% of the *E. cloacae*-infected intensive care patients with pulmonary complications treated with cefotaxime (Fussle, et al., 1994, Clin. Investig. 72:1015–1019). While several antimicrobial agents retain potent activity against the highly resistant organisms (Pfaller, M. A., 1997, Diagn. Microbiol. Infect. Dis. 28:211–219), constant exposure to these agents may eventually result in resistance.

*E. cloacae* has been shown to be beneficial to plants in the control of diseases caused by bacteria (Bacon, C. W., et al., PCT publication WO 97/24433). As a biocontrol agent, *E. cloacae* coated onto cucumber seed has protected the seed from a lethal infection of the fungus *Pythium ultimum* (Nelson, E. B., et al, 1992, Can. J. Plant Pathol. 14:106–114). Nutritional mutants of *E. cloacae* were also protective and it has been suggested that mutant strains would be beneficial for an environmental containment strategy (Roberts, D. P., et al, 1994, Plant Science [Limerick], 10183–89).

SUMMARY OF THE INVENTION

The present invention fulfills the need for diagnostic tools and therapeutics by providing bacterial-specific compositions and methods for detecting *Enterobacter* species including *E. cloacae*, as well as compositions and methods useful for treating and preventing *Enterobacter* infection, in particular, *E. cloacae* infection, in vertebrates including mammals.

The present invention encompasses isolated nucleic acids and polypeptides derived from *E. cloacae* that are useful as reagents for diagnosis of bacterial disease, components of effective antibacterial vaccines, and/or as targets for antibacterial drugs including anti-*E. cloacae* drugs. They can also be used to detect the presence of *E. cloacae* and other *Enterobacter* species in a sample; and in screening compounds for the ability to interfere with the *E. cloacae* life cycle or to inhibit *E. cloacae* infection. They also have use as biocontrol agents for plants.

In one aspect, the invention features compositions of nucleic acids corresponding to entire coding sequences of *E. cloacae* proteins, including surface or secreted proteins or parts thereof, nucleic acids capable of binding mRNA from *E. cloacae* proteins to block protein translation, and methods for producing *E. cloacae* proteins or parts thereof using peptide synthesis and recombinant DNA techniques. This invention also features antibodies and nucleic acids useful as probes to detect *E. cloacae* infection. In addition, vaccine compositions and methods for the protection or treatment of infection by *E. cloacae* are within the scope of this invention.

The nucleotide sequences provided in SEQ ID NO: 1–SEQ ID NO: 5662, a fragment thereof, or a nucleotide sequence at least about 99.5% identical to a sequence contained within SEQ ID NO: 1–SEQ ID NO: 5662 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 5662, a fragment thereof, or a nucleotide sequence at least about 99.5% identical to a sequence contained within SEQ ID NO: 1–SEQ ID NO: 5662. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 5662, a fragment thereof, or a nucleotide sequence at least about 99.5% identical to SEQ ID NO: 1–SEQ ID NO: 5662 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *E. cloacae* open reading frames (ORFs) within SEQ ID NO: 1–SEQ ID NO: 5662 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *E. cloacae* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *E. cloacae* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *E. cloacae* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *E. cloacae* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *E. cloacae* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *E. cloacae* genome. In the present examples, implementing software which implement the BLASTP2 and bic_SW algorithms (Altschul et al., J. Mol. Biol. 215:403–410 (1990); Compugen Biocellerator) was used to identify open reading frames within the *E. cloacae* genome. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features *E. cloacae* polypeptides, preferably a substantially pure preparation of an *E. cloacae* polypeptide, or a recombinant *E. cloacae* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the *E. cloacae* amino acid sequences of the invention contained in the Sequence Listing is also encompassed by the invention.

In preferred embodiments: the *E. cloacae* polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject *E. cloacae* polypeptide differs in amino acid sequence at about 1, 2, 3, 5, 10 or more residues from a sequence of the invention contained in the Sequence Listing. The differences, however, are such that the *E. cloacae* polypeptide exhibits an *E. cloacae* biological activity, e.g., the *E. cloacae* polypeptide retains a biological activity of a naturally occurring *E. cloacae* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *E. cloacae* polypeptide is a recombinant fusion protein having a first *E. cloacae* polypeptide portion and a second polypeptide portion, e.g., a second polypeptide portion having an amino acid sequence unrelated to *E. cloacae*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *E. cloacae* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *E. cloacae* encoded polypeptide exhibits an *E. cloacae* biological activity, e.g., the encoded *E. cloacae* enzyme retains a biological activity of a naturally occurring *E. cloacae*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *E. cloacae* strain, 15842, from which genomic sequences have been sequenced, has been deposited on Aug. 22, 1997, in the American Type Culture Collection and assigned the ATCC designation # 202023.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *E. cloacae* polypeptides, especially by antisera to an active site or binding domain of *E. cloacae* polypeptide. The invention also includes fragments, preferably biologically active fragments. These and other polypeptides are also referred to herein as *E. cloacae* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *E. cloacae* nucleic acid will include a transcriptional regulatory sequence, e.g., at least one of a transcriptional promoter or transcriptional enhancer sequence, operably linked to the *E. cloacae* gene sequence, e.g., to render the *E. cloacae* gene sequence suitable for expression in a recombinant host cell.

In yet a further preferred embodiment, the nucleic acid which encodes an *E. cloacae* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *E. cloacae* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *E. cloacae* polypeptide or an *E. cloacae* polypeptide variant as described herein; a host cell transfected with the vector; and a method of producing a recombinant *E. cloacae* polypeptide or *E. cloacae* polypeptide variant; including culturing the cell, e.g., in a cell culture medium, and isolating an *E. cloacae* or *E. cloacae* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 5662 or complements thereof. Alternatively, the nucleic acids comprise sequences contained within any ORF (open reading frame), including a complete protein-coding sequence, of which any of SEQ ID NO: 1–SEQ ID NO: 5662 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features a purified recombinant nucleic acid having at least about 50%, 60%, 70%, 80%, 90%, 95%, 98%, or 99% homology with a sequence of the invention contained in the Sequence Listing.

The invention also encompasses recombinant DNA (including DNA cloning and expression vectors) comprising these *E. cloacae*-derived sequences; host cells comprising such DNA, including fungal, bacterial, yeast, plant, insect, and mammalian host cells; and methods for producing expression products comprising RNA and polypeptides encoded by the *E. cloacae* sequences. These methods are carried out by incubating a host cell comprising an *E. cloacae*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *E. cloacae* polypeptide from the cell fraction, the medium fraction, or both. The polypeptides can also be made by in vitro translation.

In another aspect, the invention features nucleic acids capable of binding mRNA of *E. cloacae*. Such nucleic acid is capable of acting as antisense nucleic acid to control the translation of mRNA of *E. cloacae*. A further aspect features a nucleic acid which is capable of binding specifically to an *E. cloacae* nucleic acid. These nucleic acids are also referred to herein as complements and have utility as probes and as capture reagents.

In another aspect, the invention features an expression system comprising an open reading frame corresponding to *E. cloacae* nucleic acid. The nucleic acid further comprises a control sequence compatible with an intended host. The expression system is useful for making polypeptides corresponding to *E. cloacae* nucleic acid.

In another aspect, the invention encompasses: a vector including a nucleic acid which encodes an *E. cloacae* polypeptide or an *E. cloacae* polypeptide variant as described herein; a host cell transfected with the vector; and a method of producing a recombinant *E. cloacae* polypeptide or *E. cloacae* polypeptide variant; including culturing the cell, e.g., in a cell culture medium, and isolating the *E. cloacae* or *E. cloacae* polypeptide variant, e.g., from the cell or from the cell culture medium.

In yet another embodiment of the invention encompasses reagents for detecting bacterial infection, including *E. cloacae* infection, which comprise at least one *E. cloacae*- derived nucleic acid defined by any one of SEQ ID NO: 1–SEQ ID NO: 5662, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO: 1–SEQ ID NO: 5662, or polypeptide sequences contained within any of SEQ ID NO: 5663–SEQ ID NO: 11324, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one E. cloacae-derived immunogenic component, wherein the immunogenic component comprises one or more of the polypeptides encoded by any one of SEQ ID NO: 1–SEQ ID NO: 5662 or sequence-conservative or function-conservative variants thereof; or polypeptides that are contained within any ORFs, including complete protein-coding sequences, of which any of SEQ ID NO: 1–SEQ ID NO: 5662 forms a part; or polypeptide sequences contained within any of SEQ ID NO: 5663–SEQ ID NO: 11324; or polypeptides of which any of SEQ ID NO: 5663–SEQ ID NO: 11324 forms a part. Host animals include any warm blooded animal, including without limitation mammals and birds. Such antibodies have utility as reagents for immunoassays to evaluate the abundance and distribution of E. cloacae-specific antigens.

In yet another aspect, the invention provides diagnostic methods for detecting E. cloacae antigenic components or anti-E. cloacae antibodies in a sample. E. cloacae antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 5662 or sequence-conservative or function-conservative variants thereof, or against a polypeptide sequence contained in any of SEQ ID NO: 5663–SEQ ID NO: 11324 or function-conservative variants thereof.

In yet another aspect, the invention provides a method for detecting antibacterial-specific antibodies in a sample, which comprises: (i) contacting a sample suspected to contain antibacterial-specific antibodies with an E. cloacae antigenic component, under conditions in which a stable antigen-antibody complex can form between the E. cloacae antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 5662 or sequence-conservative and function-conservative variants thereof, or is a polypeptide sequence contained in any of SEQ ID NO: 5663–SEQ ID NO: 11324 or function-conservative variants thereof.

In another aspect, the invention features a method of generating vaccines for immunizing an individual against E. cloacae. The method includes: immunizing a subject with an E. cloacae polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an E. cloacae polypeptide. The method includes contacting the compound to be evaluated with an E. cloacae polypeptide and determining if the compound binds or otherwise interacts with the E. cloacae polypeptide. Compounds which bind or otherwise interact with E. cloacae polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an E. cloacae nucleic acid, e.g., DNA or RNA. The method includes contacting the compound to be evaluated with an E. cloacae nucleic acid and determining if the compound binds or otherwise interacts with the E. cloacae nucleic acid. Compounds which bind E. cloacae are candidates as modultors, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain E. cloacae 15842. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including E. cloacae, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO:1–SEQ ID NO: 11324 Use of the terms "SEQ ID NO: 1–SEQ ID NO: 5662", "SEQ ID NO: 5663–SEQ ID NO: 11324, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA—DNA, DNA-RNA and RNA—RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like). "Function-conservative" variants also include any polypeptides that have the ability to elicit antibodies specific to a designated polypeptide.

An "*E. cloacae-derived*" nucleic acid or polypeptide sequence may or may not be present in other bacterial species, and may or may not be present in all *E. cloacae* strains. This term is intended to refer to the source from which the sequence was originally isolated. Thus, an *E. cloacae*-derived polypeptide, as used herein, may be used, e.g., as a target to screen for a broad spectrum antibacterial agent, to search for homologous proteins in other species of bacteria or in eukaryotic organisms such asbacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *E. cloacae* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared× 100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has E. cloacae biological activity if it has one, two or preferably more of the following properties: (1) if when expressed in the course of an E. cloacae infection, it can promote, or mediate the attachment of E. cloacae to a cell; (2) it has an enzymatic activity, structural or regulatory function characteristic of an E. cloacae protein; (3) the gene which encodes it can rescue a lethal mutation in an E. cloacae gene. A polypeptide has biological activity if it is an antagonist, agonist, or super-agonist of a polypeptide having one of the above-listed properties.

A biologically active fragment or analog is one having an in vivo or in vitro activity which is characteristic of the E. cloacae polypeptides of the invention contained in the Sequence Listing, or of other naturally occurring E. cloacae polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as E. cloacae polypeptides often exhibit a range of physiological properties and because such properties may be attributable to different portions of the molecule, a useful E. cloacae fragment or E. cloacae analog is one which exhibits a biological activity in any biological assay for E. cloacae activity. The fragment or analog possesses about 10%, preferably about 40%, more preferably about 60%, 70%, 80% or 90% or greater of the activity of E. cloacae, in any in vivo or in vitro assay.

Analogs can differ from naturally occurring E. cloacae polypeptides in amino acid sequence or in ways that do not involve sequence, or both. Non-sequence modifications include changes in acetylation, methylation, phosphorylation, carboxylation, or glycosylation. Preferred analogs include E. cloacae polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the E. cloacae polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, |
| Methionine | M | D-Met, S-Me-Cys, Ile, D-Ile, Leu, D-Leu, Val, D- |
| Phenylalanine | F | D-Phe, Tyr, D-Thr, L-Dopa, His, D-His, Trp, D- |
| Proline | P | D-Pro, L-I-thioazolidine-4-carboxylic acid, D-or L- |
| Serine | S | D-Ser, Thr, D-Thr, allo-Thr, Met, D-Met, Met(O), |
| Threonine | T | D-Thr, Ser, D-Ser, allo-Thr, Met, D-Met, Met(O), |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to an E. cloacae analog, will ordinarily be at least about 20 residues, more typically at least about 40 residues, preferably at least about 60 residues in length. Fragments of E. cloacae polypeptides can be generated by methods known to those skilled in the art. The ability of an Enterobacter fragment to exhibit a biological activity of E. cloacae polypeptide can be assessed by methods known to those skilled in the art as described herein. Also included are E. cloacae polypeptides containing residues that are not required for biological activity of the peptide or that result from alternative mRNA splicing or alternative protein processing events.

An "immunogenic component" as used herein is a moiety, such as an E. cloacae polypeptide, analog or fragment thereof, that is capable of eliciting a humoral and/or cellular immune response in a host animal.

An "antigenic component" as used herein is a moiety, such as an E. cloacae polypeptide, analog or fragment thereof, that is capable of binding to a specific antibody with sufficiently high affinity to form a detectable antigen-antibody complex.

The term "antibody" as used herein is intended to include fragments thereof which are specifically reactive with *E. cloacae* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); PCR-A *Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; DNA Cloning: *A Practical Approach*, Volumes I and II, 1985 (D. N. Glover ed.); *Oligonucleotide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enzymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

*E. cloacae* Genomic Sequence

This invention provides nucleotide sequences of the genome of *E. cloacae* which thus comprises a DNA sequence library of *E. cloacae* genomic DNA. The detailed description that follows provides nucleotide sequences of *E. cloacae*, and also describes how the sequences were obtained and how ORFs and protein-coding sequences were identified. Also described are compositions and methods of using the disclosed *E. cloacae* sequences in methods including diagnostic and therapeutic applications. Furthermore, the library can be used as a database for identification and comparison of medically important sequences in this and other strains of *E. cloacae*.

To determine the genomic sequence of *E. cloacae*, DNA from strain 15842 of *E. cloacae* was isolated after Zymolyase digestion, sodium dodecyl sulfate lysis, potassium acetate precipitation, phenol:chloroform extractionand ethanol precipitation (Soll, D. R., T. Srikantha and S. R. Lockhart: Characterizing Developmentally Regulated Genes in *E. cloacae*. In Microbial Genome Methods. K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library.

DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire *E. cloacae* genome. Synthetic oligonucleotides are designed that are complementary to sequences at the end of each contig. These oligonucleotides may be hybridized to libaries of *E. cloacae* genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The *E. cloacae* sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring *E. cloacae* polypeptide. These ORFs may contain start codons which indicate the initiation of protein synthesis of a naturally-occurring *E. cloacae* polypeptide. Such start codons within the ORFs provided herein were identified by those of ordinary skill in the relevant art, and the resulting ORF and the encoded *E. cloacae* polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring *E. cloacae* polypeptide was recognized. The predicted coding regions were defined by evaluating the coding potential of such sequences with the program GENEMARK™ (Borodovsky and McIninch, 1993, *Comp.* 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

*E. cloacae* Nucleic Acids

The present invention provides a library of *E. cloacae*-derived nucleic acid sequences. The libraries provide probes, primers, and markers which are used as markers in epidemiological studies. The present invention also provides a library of *E. cloacae*-derived nucleic acid sequences which comprise or encode targets for therapeutic drugs.

The nucleic acids of this invention may be obtained directly from the DNA of the above referenced *E. cloacae* strain by using the polymerase chain reaction (PCR). See "PCR, *A Practical Approach*" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, NY).

It is also possible to obtain nucleic acids encoding *E. cloacae* polypeptides from a cDNA library in accordance with protocols herein described. A cDNA encoding an *E. cloacae* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *E. cloacae* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *E. cloacae*. With the sequence information set forth in the present application, sequences of twenty or more nucleotides are identified which provide the desired inclusivity and exclusivity with respect to *E. cloacae*, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Enterobacter* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *E. cloacae* nucleic acid from one strain from the nucleic acid of other another strain as well as from other organisms. Nucleic acid having twenty or more nucleotides in a sequence of the invention contained in the Sequence Listing can also have utility to separate other *Enterobacter* species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *E. cloacae* nucleic acid. These nucleic acids may also have utility as primers for the amplification of nucleic acids in other *Enterobacter* species. With respect to polymerase chain reaction (PCR) techniques, nucleic acid sequences of $\geq 10^{-15}$ nucleotides of the invention contained in the Sequence Listing have utility in conjunction with suitable enzymes and reagents to create copies of *E. cloacae* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *E. cloacae* and/or other *Enterobacter* species. The copies can also be incorporated into cloning and expression vectors to generate polypeptides corresponding to the nucleic acid synthesized by PCR, as is described in greater detail herein.

The nucleic acids of the present invention find use as templates for the recombinant production of *E. cloacae*-derived peptides or polypeptides.

Antisense

Nucleic acid or nucleic acid-hybridizing derivatives isolated or synthesized in accordance with the sequences described herein have utility as antisense agents to prevent the expression of *E. cloacae* genes. These sequences also have utility as antisense agents to prevent expression of genes of other *Enterobacter* species.

In one embodiment, nucleic acid or derivatives corresponding to *E. cloacae* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *E. cloacae* that are useful as reagents for diagnosis of bacterial infection, components of effective anti-bacterial vaccines, and/or as targets for anti-bacterial drugs, including anti-*E. cloacae* drugs.

Expression of *E. cloacae* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the contig from which each ORF was identified (numbered arbitrarily). Each contig represents a continuous stretch of the genomic sequence of the organism. The second column lists the ORF designation. The third and fourth columns list the SEQ ID numbers for the nucleic acid and amino acid sequences corresponding to each ORF, respectively. The fifth and sixth columns list the length of the nucleic acid ORF and the length of the amino acid ORF, respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon.

Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The seventh and eighth columns provide metrics for assessing the likelihood of the homology match (determined by the BLASTP2 algorithm), as is known in the art, to the genes indicated in the eleventh column when the designated ORF was compared against a non-redundant comprehensive protein database. Specifically, the seventh column represents the "Blast Score" for the match (a higher score is a better match), and the eighth column represents the "P-value" for the match (the probability that such a match can have occurred by chance; the lower the value, the more likely the match is valid). If a BLASTP2 score of less than 46 was obtained, no value is reported in the table the "P-value". Column nine provides the name of the organism that was identified as having the closest homology match. The tenth column provides, where available, either a public database accession number or our own sequence name. The eleventh column provides, where available, the Swissprot accession number (SP),(SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. Information that is not preceded by a code designation in the eleventh column represents a description of the ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 5662, SEQ ID NO: 5663–SEQ ID NO: 11324 and in Table 2 together with routine cloning and sequencing methods, one of ordinary skill in the art will be able to clone and sequence all the nucleic acid fragments of interest including open reading frames (ORFs) encoding a large variety of proteins of *E. cloacae*.

Nucleic acid isolated or synthesized in accordance with the sequences described herein have utility to generate polypeptides. The nucleic acid of the invention exemplified in SEQ ID NO: 1–SEQ ID NO: 5662 and in Table 2 or fragments of said nucleic acid encoding active portions of *E. cloacae* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae, Methanobacterium* strains or other Archaea, and Eubacteria such as *E. coli, B. Subtilis, S. Aureus, S. Pneumonia* or *Pseudomonas putida*. In some cases the expression host will utilize the natural *E. cloacae* promoter whereas in others, it will be necessary to drive the gene with a promoter sequence derived from the expressing organism (e.g., an *E. coli* beta-galactosidase promoter for expression in *E. coli*).

To express a gene product using the natural *E. cloacae* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual,* 2nd Edition, Cold Spring Harbor Laboratory Press (1989)), and other laboratory textbooks.

For example, a host cell transfected with a nucleic acid vector directing expression of a nucleotide sequence encoding an *E. cloacae* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *E. cloacae* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *E. cloacae* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *E. cloacae*-derived nucleic acid sequences. The libraries provide probes, primers, and markers which can be used as markers in epidemiological studies. The present invention also provides a library of *E. cloacae*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO: 5662. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 5663–SEQ ID NO: 11324 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *E. cloacae* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *E. cloacae*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *E. cloacae* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *E. cloacae* coding sequences may be synthesized by standard methods, isolated from natural sources, or prepared as hybrids, etc. Ligation of the *E. cloacae* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *E. cloacae*, *E.* coli, B. Subtilis, Saccharomyces cerevisiae, Saccharomyces carlsbergensis, Schizosaccharomyces pombi, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced E. cloacae-derived peptides and polypeptides.

Advantageously, vectors may also include a transcription regulatory element (i.e., a promoter) operably linked to the E. cloacae portion. The promoter may optionally contain operator portions and/or ribosome binding sites. Non-limiting examples of bacterial promoters compatible with E. coli include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant E. cloacae-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of E. cloacae-derived peptides or polypeptides.

Identification and Use of E. cloacae Nucleic Acid Sequences

The disclosed E. cloacae polypeptide and nucleic acid sequences, or other sequences that are contained within ORFs, including complete protein-coding sequences, of which any of the disclosed E. cloacae-specific sequences forms a part, are useful as target components for diagnosis and/or treatment of E. cloacae-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic E. cloacae DNA as template; this is followed by sequencing the amplified product. The isolated nucleic acid encoding the disclosed sequence, or fragments thereof, can also be hybridized to E. cloacae genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against E. cloacae The disclosed E. cloacae genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against E. cloacae. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed E. cloacae sequences with previously reported sequences present in publicly available databases is useful for identifying functional E. cloacae nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein:protein interactions, etc. These consensus sequences may be quite short and thus may represent only a fraction of the entire protein-coding sequence. Identification of such a feature in an E. cloacae sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. E. cloacae proteins identified as containing putative signal sequences and/or transmembrane domains are useful as immunogenic components of vaccines.

Targets for therapeutic drugs according to the invention include, but are not limited to, polypeptides of the invention, whether unique to *E. cloacae* or not, that are essential for growth and/or viability of *E. cloacae* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific Sequences:

Because of the evolutionary relationship between different *E. cloacae* strains, it is believed that the presently disclosed *E. cloacae* sequences are useful for identifying, and/or discriminating between, previously known and new *E. cloacae* strains. It is believed that other *E. cloacae* strains will exhibit at least about 70% sequence homology with the presently disclosed sequence. Systematic and routine analyses of DNA sequences derived from samples containing *E. cloacae* strains, and comparison with the present sequence allows for the identification of sequences that can be used to discriminate between strains, as well as those that are common to all *E. cloacae* strains. In one embodiment, the invention provides nucleic acids, including probes, and peptide and polypeptide sequences that discriminate between different strains of *E. cloacae*. Strain-specific components can also be identified functionally by their ability to elicit or react with antibodies that selectively recognize one or more *E. cloacae* strains.

In another embodiment, the invention provides nucleic acids, including probes, and peptide and polypeptide sequences that are common to all *E. cloacae* strains but are not found in other bacterial species.

*E. cloacae* Polypeptides

This invention encompasses isolated *E. cloacae* polypeptides encoded by the disclosed *E. cloacae* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding an *E. cloacae* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *E. cloacae* DNA as template; this is followed by sequencing the amplified product.

The polypeptides of the present invention, including function-conservative variants of the disclosed ORFs, may be isolated from wild-type or mutant *E. cloacae* cells, or from heterologous organisms or cells (including, but not limited to, bacteria, fungi, insect, plant, and mammalian cells) including *E. cloacae* into which an *E. cloacae*-derived protein-coding sequence has been introduced and expressed. Furthermore, the polypeptides may be part of recombinant fusion proteins.

*E. cloacae* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *E. cloacae* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an *E. cloacae* protein or against peptides derived therefrom can be used as purification reagents. Other purification methods are possible.

The present invention also encompasses derivatives and homologues of *E. cloacae*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *E. cloacae*-derived polypeptides for use in the present invention, essentially the complete genomic sequence of a virulent, methicillin-resistant isolate of *Enterobacter cloacae* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *E. cloacae* polypeptide sequences that are contained within the open reading frames (ORFs), including complete protein-coding sequences, of which any of SEQ ID NO: 1–SEQ ID NO: 5662 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *E. cloacae*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *E. cloacae*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *E. cloacae* infection, including use as markers in epidemiological studies. Non-limiting examples of such sequences are listed by SEQ ID NO in Table 2, which is appended.

The present invention also provides a library of *E. cloacae*-derived polypeptide sequences, and a corresponding library of nucleic acid sequences encoding the polypeptides, wherein the polypeptides themselves, or polypeptides contained within ORFs of which they form a part, comprise targets for therapeutic drugs.

Specific Example: Determination of *Enterobacter* Protein Antigens for Antibody and Vaccine Development The selection of *Enterobacter* protein antigens for vaccine development can be derived from the nucleic acids encoding *E. cloacae* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *E. cloacae* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *E. cloacae* Nucleic Acids and Polypeptides Based on the discovery of the *E. cloacae* gene products of the invention provided in the Sequence Listing, one skilled in the art can alter the disclosed structure of *E. cloacae* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *E. cloacae* polypeptides. Such screens are useful for the identification of inhibitors of *E. cloacae*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, SA (1983) *Tetrahedron* 39:3; Itakura et al. (1981) *Recombinant DNA, Proc 3rd Cleveland Sympos. Macromolecules*, ed. AG Walton, Amsterdam: Elsevier pp 273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (Science 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci.* USA, 75: 5765[1978]).

Cassette Mutagenesis

Another method for preparing variants, cassette mutagenesis, is based on the technique described by Wells et al. (Gene, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *E. cloacae* Nucleic Acids and Polypeptides

It is possible to modify the structure of an *E. cloacae* polypeptide for such purposes as increasing solubility, enhancing stability (e.g., shelf life ex vivo and resistance to proteolytic degradation in vivo). A modified *E. cloacae* protein or peptide can be produced in which the amino acid sequence has been altered, such as by amino acid substitution, deletion, or addition as described herein.

An *E. cloacae* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *E. cloacae* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *E. cloacae* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *E. cloacae* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, W H Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an *E. cloacae* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *E. cloacae* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *E. cloacae* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *E. cloacae* polypeptide, e.g., of cellular proteins, or of randomly generated polypeptides which bind to an *E. cloacae* protein. (The *E. cloacae* domain is used as the bait protein and the library of variants are expressed as prey fusion proteins.) In an analogous fashion, a two hybrid assay (as with the other screening methods described herein), can be used to find polypeptides which bind an *E. cloacae* polypeptide.

Display Libraries

In one approach to screening assays, the *Enterobacter* peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J.* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *E. cloacae* Polypeptides

The invention also provides for reduction of the protein binding domains of the subject *E. cloacae* polypeptides to generate mimetics, e.g. peptide or non-peptide agents. The peptide mimetics are able to disrupt binding of a polypeptide to its counter ligand, e.g., in the case of an *E. cloacae* polypeptide binding to a naturally occurring ligand. The critical residues of a subject *E. cloacae* polypeptide which are involved in molecular recognition of a polypeptide can be determined and used to generate *E. cloacae*-derived peptidomimetics which competitively or noncompetitively inhibit binding of the *E. cloacae* polypeptide with an interacting polypeptide (see, for example, European patent applications EP-412,762A and EP-B31,080A).

For example, scanning mutagenesis can be used to map the amino acid residues of a particular *E. cloacae* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an *E. cloacae* polypeptide to an interacting polypeptide and thereby interfere with the function of *E. cloacae* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in Peptides: Structure and Function (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *E. cloacae* Nucleic Acids and Polypeptides

This invention also features vaccine compositions for protection against infection by *E. cloacae* or for treatment of *E. cloacae* infection. In one embodiment, the vaccine compositions contain one or more immunogenic components such as a surface protein from *E. cloacae*, or portion thereof, and a pharmaceutically acceptable carrier. Nucleic acids within the scope of the invention are exemplified by the nucleic acids of the invention contained in the Sequence Listing which encode *E. cloacae* surface proteins. Any nucleic acid encoding an immunogenic *E. cloacae* protein, or portion thereof, which is capable of expression in a cell, can be used in the present invention. These vaccines have therapeutic and prophylactic utilities.

One aspect of the invention provides a vaccine composition for protection against infection by *E. cloacae* which contains at least one immunogenic fragment of an *E. cloacae* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *E. cloacae* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *E. cloacae* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *E. cloacae* polypeptide or fragment thereof or nucleic acid encoding an *E. cloacae* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *E. cloacae* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *E. cloacae*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *E. cloacae* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*E. cloacae* bacterial lysates, block polymers or saponins.

Other suitable delivery methods include biodegradable microcapsules or immuno-stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *E. cloacae* polypeptide in an insoluble form as fusion proteins. Suitable carriers for the vaccines of the invention are enteric coated capsules and polylactide-glycolide microspheres. Suitable diluents are 0.2 N $NaHCO_3$ and/or saline.

Vaccines of the invention can be administered as a primary prophylactic agent in adults or in children, as a secondary prevention, after successful eradication of *E. cloacae* in an infected host, or as a therapeutic agent in the aim to induce an immune response in a susceptible host to prevent infection by *E. cloacae*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *E. cloacae* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *E. cloacae* infection, some are useful only for treating *E. cloacae* infection, and some are useful for both preventing and treating *E. cloacae* infection. In a preferred embodiment, the vaccine composition of the invention provides protection against *E. cloacae* infection by stimulating humoral and/or cell-mediated immunity against *E. cloacae*. It should be understood that amelioration of any of the symptoms of *E. cloacae* infection is a desirable clinical goal, including a lessening of the dosage of medication used to treat *E. cloacae-caused* disease, or an increase in the production of antibodies in the serum or mucous of patients.

Antibodies Reactive with *E. cloacae* Polypeptides

The invention also includes antibodies specifically reactive with the subject *E. cloacae* polypeptide. Anti-protein/anti-peptide antisera or monoclonal antibodies can be made by standard protocols (See, for example, Antibodies: *A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *E. cloacae* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *E. cloacae* polypeptides of the invention, e.g. antigenic determinants of a polypeptide of the invention contained in the Sequence Listing, or a closely related human or non-human mammalian homolog (e.g., 90% homologous, more preferably at least about 95% homologous). In yet a further preferred embodiment of the invention, the anti-*E. cloacae* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *E. cloacae* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*E. cloacae* portion.

Both monoclonal and polyclonal antibodies (Ab) directed against E cloacae polypeptides or *E. cloacae* polypeptide variants, and antibody fragments such as Fab' and F(ab')$_2$, can be used to block the action of *E. cloacae* polypeptide and allow the study of the role of a particular *E. cloacae* polypeptide of the invention in aberrant or unwanted intracellular signaling, as well as the normal cellular function of the *E. cloacae* and by microinjection of anti-*E. cloacae* polypeptide antibodies of the present invention.

Antibodies which specifically bind *E. cloacae* epitopes can also be used in immunohistochemical staining of tissue samples in order to evaluate the abundance and pattern of expression of *E. cloacae* antigens. Anti-*E. cloacae* polypeptide antibodies can be used diagnostically in immunoprecipitation and immuno-blotting to detect and evaluate *E. cloacae* levels in tissue or bodily fluid as part of a clinical testing procedure. Likewise, the ability to monitor *E. cloacae* polypeptide levels in an individual can allow determination of the efficacy of a given treatment regimen for an individual afflicted with such a disorder. The level of an *E. cloacae* polypeptide can be measured in cells found in bodily fluid, such as in urine samples or can be measured in tissue, such as produced by gastric biopsy. Diagnostic assays using anti-*E. cloacae* antibodies can include, for example, immunoassays designed to aid in early diagnosis of *E. cloacae* infections. The present invention can also be used as a method of detecting antibodies contained in samples from individuals infected by this bacterium using specific *E. cloacae* antigens.

Another application of anti-*E. cloacae* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of B-galactosidase amino acid sequences and whose carboxy termini consist of a foreign polypeptide. Antigenic epitopes of a subject *E. cloacae* polypeptide can then be detected with antibodies, as, for example, reacting nitrocellulose filters lifted from infected plates with anti-*E. cloacae* polypeptide antibodies. Phage, scored by this assay, can then be isolated from the infected plate. Thus, the presence of *E. cloacae* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *E. cloacae* or other species of *Enterobacter* acid sequence using bio chip technology. Bio chips containing arrays of nucleic acid sequence can also be used to measure expression of genes of *E. cloacae* or other species of *Enterobacter*. For example, to diagnose a patient with a *E. cloacae* or other *Enterobacter* infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using *E. cloacae* Polypeptides

By making available purified and recombinant *E. cloacae* polypeptides, the present invention provides assays which can be used to screen for drugs which are either agonists or antagonists of the normal cellular function, in this case, of the subject *E. cloacae* polypeptides, or of their role in intracellular signaling. Such inhibitors or potentiators may be useful as new therapeutic agents to combat *E. cloacae* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *E. cloacae* polypeptide.

Screening assays can be constructed in vitro with a purified *E. cloacae* polypeptide or fragment thereof, such as an *E. cloacae* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemi-luminescence properties, for example, because detection may be easily automated. A variety of synthetic or naturally occurring compounds can be tested in the assay to identify those which inhibit or potentiate the activity of the *E. cloacae* polypeptide. Some of these active compounds may directly, or with chemical alterations to promote membrane permeability or solubility, also inhibit or potentiate the same activity (e.g., enzymatic activity) in whole, live *E. cloacae* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature,* 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae.* The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein—protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medications,* Dekker, New York; Lieberman et al (eds.), 1990, *Pharmaceutical Dosage Forms: Disperse Systems,* Dekker, New York.

The antibacterial agents and compositions of the present invention are useful for preventing or treating *E. cloacae* infections. Infection prevention methods incorporate a prophylactically effective amount of an antibacterial agent or composition. A prophylactically effective amount is an amount effective to prevent *E. cloacae* infection and will depend upon the specific bacterial strain, the agent, and the host. These amounts can be determined experimentally by methods known in the art and as described above.

*E. cloacae* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing *E. cloacae* Genomic Sequence

This invention provides nucleotide sequences of the genome of *E. cloacae* which thus comprises a DNA sequence library of *E. cloacae* genomic DNA. The detailed description that follows provides nucleotide sequences of *E. cloacae,* and also describes how the sequences were obtained and how ORFs (Open Reading Frames) and protein-coding sequences can be identified. Also described are methods of using the disclosed *E. cloacae* sequences in methods including diagnostic and therapeutic applications. Furthermore, the library can be used as a database for identification and comparison of medically important sequences in this and other strains of *E. cloacae* as well as other species of *Enterobacter*.

Chromosomal DNA from strain 15842 of *E. cloacae* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *E. cloacae*. In Microbial Genome Methods. K. W. Adolph, editor. CRC Press. New York. p 17–37.). Genomic *E. cloacae* DNA was hydrodynamically sheared in an HPLC and then separated on a standard 1% agarose gel. Fractions corresponding to 2500–3000 bp in length were excised from the gel and purifed by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores. The initial assembly was done at 6-fold coverage and yielded 513 contigs.

Finishing can follow the initial assembly. Missing mates (sequences from clones that only gave reads from one end of the *Enterobacter* DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify *E. cloacae* polypeptides the complete genomic sequence of *E. cloacae* were analyzed essentially as follows: First, all possible stop-to-stop open reading frames (ORFs) greater than 180 nucleotides in all six reading frames were translated into amino acid sequences Second, the identified ORFs were analyzed for homology to known (archeabacter, prokaryotic and eukaryotic) protein sequences. Third, the coding potential of non-homologous sequences were evaluated with the program GENEMARKTM (Borodovsky and Mclninch, 1993, *Comp. Chem.* 17:123).

Identification, Cloning and Expression of *E. cloacae* Nucleic Acids

Expression and purification of the *E. cloacae* polypeptides of the invention can be performed essentially as outlined below.

To facilitate the cloning, expression and purification of membrane and secreted proteins from *E. cloacae*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID NO: 5662 for cloning from the 15842 strain of *E. cloacae* are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *E. cloacae* DNA sequence. All reverse primers (specific for the 3' end of any *E. cloacae* ORF) include a EcoRI site at the extreme 5' terminus to permit cloning of each *E. cloacae* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the 15842 strain of *E. cloacae* is used as the source of template DNA for PCR amplification reactions (Current Protocols in Molecular Biology, John Wiley and Sons, Inc., F. Ausubel et al., eds., 1994). To amplify a DNA sequence containing an *E. cloacae* ORF, genomic DNA (50 nanograms) is introduced into a reaction vial containing 2 mM MgCl$_2$, 1 micromolar synthetic oligonucleotide primers (forward and reverse primers) complementary to and flanking a defined *E. cloacae* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA)(Current Protocols in Molecular Biology, John Wiley and Sons, Inc., F. Ausubel et al., eds., 1994). DNA samples are then subjected to electrophoresis on 1.0% NuSeive (FMC Bio-Products, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of E. cloacae Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation Of Competent Bacteria With Recombinant Plasmids

Competent bacteria, E coli strain BL21 or E. coli strain BL21(DE3), are transformed with recombinant pET expression plasmids carrying the cloned E. cloacae sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2–5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification Of Recombinant Expression Vectors With E. cloacae Nucleic Acids

Individual BL21 clones transformed with recombinant pET-28b E. cloacae ORFs are analyzed by PCR amplification of the cloned inserts using the same forward and reverse primers, specific for each E. cloacae sequence, that were used in the original PCR amplification cloning reactions. Successful amplification verifies the integration of the E. cloacae sequences in the expression vector (Current Protocols in Molecular Biology, John Wiley and Sons, Inc., F. Ausubel et al., eds., 1994).

Isolation and Preparation of Nucleic Acids From Transformants

Individual clones of recombinant pET-28b vectors carrying properly cloned E. cloacae ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression Of Recombinant E. cloacae Sequences In E. coli

The pET vector can be propagated in any E. coli K-12 strain e.g. HMS174, HIB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinan t E. cloacae sequences, 50 nanograms of plasmid DNA isolated as described above is used to transform competent BL21 (DE3) bacteria as described above (provided by Novagen as part of the pET expression system kit). The lacZ gene (beta-galactosidase) is expressed in the pET-System as described for the E. cloacae recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the E. cloacae recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), E. coli (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

Equivalents

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG1 | 31892515_f2_2 | 1 | 5663 | 432 | 144 | 264 | 6.0(10)-23 | Salmonella typhimurium | U94729 | [de:salmonella typhimurium oxd-6 operon, putative substrate-binding protein binding protein (oxd-6a), putative transmembrane protein (oxd-6), putative transmembrane protein (oxd-6c), putative atpase (oxd-6d), and putative atpase (oxd-6e)"] |
| CONTIG1 | 32542792_c2_6 | 2 | 5664 | 231 | 77 | 92 | 0.0016 | Plasmodium falciparum | P09346 | knob-associated histidine-rich protein precursor (kahrp). |
| CONTIG10 | 22066424_c1_4 | 3 | 5665 | 490 | 163 | 262 | 3.2(10)-22 | Escherichia coli | b1006 | [pn:hypothetical protein] [gn:ycdg] |
| CONTIG100 | 30752167_c1_6 | 4 | 5666 | 267 | 89 | 390 | 2.7(10)-36 | Escherichia coli | b4162 | [pn:hypothetical 23.5 kd protein in psd-amib intergenic region] [gn:yjer] |
| CONTIG100 | 15735381_c3_7 | 5 | 5667 | 393 | 131 | 542 | 2.2(10)-52 | Escherichia coli | b4162 | [pn:hypothetical 23.5 kd protein in psd-amib intergenic region] [gn:yjer] |
| CONTIG101 | 3222031_f1_1 | 6 | 5668 | 675 | 225 | 797 | 2.1(10)-79 | Escherichia coli | b1047 | [pn:hypothetical protein] |
| CONTIG101 | 6261469_c2_6 | 7 | 5669 | 647 | 215 | 621 | 9.3(10)-61 | Escherichia coli | b1045 | [pn:hypothetical protein] |
| CONTIG102 | 4535155_c2_13 | 8 | 5670 | 924 | 308 | 1137 | 1.8(10)-115 | Escherichia coli | b0433 | [pn:ampg protein] [gn:ampg] |
| CONTIG103 | 19719827_f1_1 | 9 | 5671 | 1005 | 335 | 120 | 0.00079 | Human herpesvirus 6 (strain Uganda-1102) | AF015297 | [de:human herpesvirus 6 (strain uganda-1102) ie2hom mrna, complete cds.] [pn:ie2hom] [gn:ie2hom] [nt:similar to the immediate-early 2 protein of human] |
| CONTIG105 | 24245287_c1_5 | 10 | 5672 | 1170 | 390 | 1142 | 5.7(10)-116 | Escherichia coli | b4261 | [pn:hypothetical 40.4 kd protein in pepa-gntv intergenic region] [gn:yjgp] |
| CONTIG106 | 15104766_f3_7 | 11 | 5673 | 756 | 252 | 518 | 7.7(10)-50 | Escherichia coli | P06615 | resolvase (protein d). |
| CONTIG108 | 35269762_f2_2 | 12 | 5674 | 951 | 317 | 131 | 4.0(10)-6 | Bacillus subtilis | yojN | [pn:hypothetical protein] |
| CONTIG109 | 7240778_f2_2 | 13 | 5675 | 519 | 173 | 224 | 1.1(10)-18 | Haemophilus influenzae | HI1415 | [pn:hypothetical protein] |
| CONTIG11 | 29877090_c2_8 | 14 | 5676 | 345 | 115 | 191 | 1.2(10)-14 | Cloning vector pCMVLacI | U64448 | or:cloning vector pemvlaci pn:lac repressor gn:laci le:2685 re:3803 di:direct |
| CONTIG11 | 3328900_c3_9 | 15 | 5677 | 342 | 114 | 203 | 1.8(10)-16 | Haemophilus influenzae | HI0522 | [pn:sp] |
| CONTIG110 | 4084392_f2_1 | 16 | 5678 | 1110 | 370 | 154 | 2.1(10)-8 | Escherichia coli | P07620 | plasmid partition par a protein. |
| CONTIG111 | 25803317_f2_3 | 17 | 5679 | 1056 | 352 | 1446 | 3.5(10)-148 | Escherichia coli | b2392 | [pn:hypothetical protein] |
| CONTIG113 | 34192257_f2_1 | 18 | 5680 | 1071 | 357 | 805 | 3.0(10)-80 | Escherichia coli | b3589 | [pn:hypothetical 40.2 kd protein in avta-selb intergenic region] [gn:yiay] |
| CONTIG115 | 26750793_f3_3 | 19 | 5681 | 537 | 179 | 799 | 1.3(10)-79 | Escherichia coli | b3279 | [pn:hypothetical;ita protein] [gn:yrda] |
| CONTIG115 | 16175299_c1_5 | 20 | 5682 | 199 | 66 | 275 | 4.5(10)-24 | Escherichia coli | b3281 | [pn:shikimate dehydrogenase] [gn:aroe] |
| CONTIG115 | 2293815_c3_7 | 21 | 5683 | 357 | 119 | 311 | 6.5(10)-28 | Escherichia coli | b3280 | [pn:hypothetical 10.0 kd protein in rmd-aroe intergenic region] |
| CONTIG116 | 19713405_c3_8 | 22 | 5684 | 198 | 66 | 180 | 5.0(10)-14 | Escherichia coli | b1972 | [pn:hypothetical protein] |
| CONTIG116 | 24033587_c3_9 | 23 | 5685 | 522 | 174 | 479 | 1.0(10)-45 | Haemophilus influenzae | HI0970 | [pn:3-dehydroquinate dehydratase] [gn:aroq] |
| CONTIG117 | 13852211_f1_1 | 24 | 5686 | 591 | 197 | 647 | 1.6(10)-63 | Escherichia coli | b1988 | [pn:nitrogen assimilation regulatory protein] [gn:nac] |
| CONTIG117 | 21690876_f2_2 | 25 | 5687 | 240 | 80 | 224 | 1.1(10)-18 | Escherichia coli | b1990 | [pn:31.6 kd protein in cobt 3"" region precusor] [gn:erfk] |
| CONTIG118 | 29942556_f2_4 | 26 | 5688 | 342 | 114 | 250 | 1.8(10)-21 | Escherichia coli | b1988 | [pn:nitrogen assimilation regulatory protein] [gn:nac] |
| CONTIG118 | 14225431_c1_13 | 27 | 5689 | 492 | 164 | 558 | 4.4(10)-54 | Erwinia carotovora subsp. carotovora | JC4729 | mob protein c - erwinia carotovora susbp. carotovora a cis-acting locus, orit and trans-acting locus, mob are involved in mobilization of pec3, a non-self-transmissible multiple-copy plasmid. the mob consists of five proteins |
| CONTIG118 | 5163340_c2_16 | 28 | 5690 | 696 | 232 | 938 | 2.3(10)-94 | Plasmid pSW200 | L42525 | or:plasmid psw200 gn:moba le.1657 re:3156 |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG119 | 306072216_c2_6 | 29 | 5691 | 1392 | 464 | 2041 | 3.1(10)-211 | Escherichia coli | b0930 | di:direct sr:plasmid psw200 dna [pn:asparaginyl-trna synthetase] [gn:asns] |
| CONTIG120 | 2394707_f1_1 | 30 | 5692 | 567 | 189 | 629 | 1.3(10)-61 | Escherichia coli | b3983 | [pn:50s ribosomal subunit protein 111] [gn:rplk] |
| CONTIG120 | 23572188_f1_2 | 31 | 5693 | 708 | 236 | 959 | 1.3(10)-96 | Escherichia coli | b3984 | [pn:50s ribosomal subunit protein 11] [gn:rpla] |
| CONTIG120 | 31651642_f2_4 | 32 | 5694 | 315 | 105 | 295 | 3.2(10)-26 | Escherichia coli | b3985 | [pn:50s ribosomal subunit protein 110] [gn:rplj] |
| CONTIG121 | 23552216_f2_1 | 33 | 5695 | 384 | 128 | 612 | 8.4(10)-60 | Escherichia coli | b3310 | [pn:50s ribosomal subunit protein 114] [gn:rpln] |
| CONTIG121 | 20117711_f2_3 | 34 | 5696 | 600 | 200 | 779 | 1.3(10)-77 | Escherichia coli | b3308 | [pn:50s ribosomal subunit protein 15] [gn:rple] |
| CONTIG121 | 2037562_f3_3 | 35 | 5697 | 357 | 119 | 512 | 3.2(10)-49 | Escherichia coli | b3309 | [pn:50s ribosomal subunit protein 124] [gn:rplx] |
| CONTIG122 | 16411425_f1_2 | 36 | 5698 | 1055 | 352 | 1187 | 9.8(10)-121 | Escherichia coli | b2965 | [pn:ornithine decarboxylase, constitutive] [gn:spec] |
| CONTIG122 | 24229836_c2_9 | 37 | 5699 | 531 | 177 | 571 | 1.8(10)-55 | Escherichia coli | b2966 | [pn:hypothetical protein] [gn:yuga] |
| CONTIG123 | 23448627_f2_2 | 38 | 5700 | 516 | 172 | 188 | 7.0(10)-15 | Escherichia coli | b3335 | [pn:type 4 prepilin-like protein specific leader peptidase] [gn:hofd] |
| CONTIG123 | 3203906_c2_6 | 39 | 5701 | 519 | 173 | 732 | 1.6(10)-72 | Escherichia coli | b3336 | [pn:bacterioferritin] [gn:bfr] |
| CONTIG125 | 24335430_c2_7 | 40 | 5702 | 1173 | 391 | 1749 | 2.7(10)-180 | Escherichia coli | b0094 | [pn:cell division protein ftsa] [gn:ftsa] |
| CONTIG125 | 10020833_c3_8 | 41 | 5703 | 255 | 85 | 309 | 1.1(10)-27 | Escherichia coli | b0093 | [pn:cell division protein ftsq] [gn:ftsq] |
| CONTIG126 | 26582552_f1_1 | 42 | 5704 | 657 | 219 | 1051 | 2.5(10)-106 | Escherichia coli | b3229 | [pn:stringent starvation protein] [gn:sspa] |
| CONTIG126 | 31338512_f3_4 | 43 | 5705 | 216 | 72 | 243 | 1.1(10)-20 | Escherichia coli | b3228 | [pn:stringent starvation protein b] [gn:sspb] |
| CONTIG127 | 4891510_f1_2 | 44 | 5706 | 333 | 111 | 387 | 5.7(10)-36 | Escherichia coli | b1060 | [pn:hypothetical protein] |
| CONTIG127 | 33255311_f2_4 | 45 | 5707 | 699 | 233 | 774 | 5.7(10)-77 | Escherichia coli | b1059 | [pn:hypothetical protein] [gn:sola] |
| CONTIG128 | 25781411_f2_1 | 46 | 5708 | 474 | 158 | 646 | 2.1(10)-63 | Escherichia coli | b3342 | [pn:30s ribosomal subunit protein s12] [gn:rpsl] |
| CONTIG128 | 23714561_f2_2 | 47 | 5709 | 411 | 137 | 637 | 1.8(10)-62 | Escherichia coli | b3341 | [pn:30s ribosomal subunit protein s7] [gn:rpsg] |
| CONTIG128 | 46907_c3_4 | 48 | 5710 | 339 | 113 | 158 | 1.1(10)-11 | Eikenella corrodens | P35648 | hemagglutinin 2. |
| CONTIG129 | 1617812_f1_2 | 49 | 5711 | 555 | 185 | 706 | 9.9(10)-70 | Escherichia coli | P08504 | transposase for transposon tn2501. |
| CONTIG129 | 22386375_c1_6 | 50 | 5712 | 636 | 212 | 691 | 3.6(10)-68 | Escherichia coli | b1374 | [pn:insertion element is5 hypothetical 39.3 kd protein] |
| CONTIG130 | 16016405_f2_1 | 51 | 5713 | 402 | 134 | 349 | 6.2(10)-32 | Escherichia coli | b0339 | [pn:cyanate permease] [gn:cynt] |
| CONTIG130 | 1150468_c2_7 | 52 | 5714 | 909 | 303 | 970 | 9.6(10)-98 | Escherichia coli | b1668 | [pn:hypothetical protein] |
| CONTIG131 | 395662_f1_2 | 53 | 5715 | 380 | 127 | 208 | 5.4(10)-17 | Haemophilus influenzae | H11053 | [pn:gb] |
| CONTIG131 | 35806526_f3_3 | 54 | 5716 | 357 | 119 | 91 | 0.00013 | Mycoplasma genitalium | MG427 | [pn:hypothetical protein mg427] |
| CONTIG131 | 23601436_f3_1 | 55 | 5717 | 624 | 208 | 134 | 2.7(10)-8 | Escherichia coli | b1649 | [pn:hypothetical protein] |
| CONTIG132 | 22667830_f1_1 | 56 | 5718 | 786 | 262 | 331 | 5.0(10)-30 | Bacillus subtilis | pdhD | [pn:dihydrolipoamide dehydrogenase e3 subunit of both pyruvate dehydrogenase and 2-oxoglutarate dehydrogenase |
| CONTIG134 | 34410768_f2_2 | 57 | 5719 | 249 | 83 | 301 | 7.5(10)-27 | Escherichia coli | b1994 | [pn:insertion element is5 hypothetical 39.3 kd protein] |
| CONTIG134 | 10651717_c1_6 | 58 | 5720 | 498 | 166 | 777 | 2.7(10)-77 | Plasmid pSW200 | L42525 | orplasmid psw200 gn:mobb le:2345 re:2830 di:direct sr:plasmid psw200 dna |
| CONTIG134 | 26681536_c1_7 | 59 | 5721 | 219 | 73 | 328 | 1.0(10)-29 | Erwinia carotovora subsp. carotovora | JC4730 | mob protein d - erwinia carotovora subsp. carotovora cis-acting locus, orit and trans-acting locus, mob are involved in mobilization of pec3, a non-self-transmissible mutliple-copy plasmid. the mob consists of five proteins. |
| CONTIG134 | 12897806_c3_9 | 60 | 5722 | 861 | 287 | 1188 | 7.7(10)-121 | Plasmid pSW200 | L42525 | orplasmid psw200 gn:moba le:1657 re:3156 di:direct sr:plasmid psw200 dna |
| CONTIG135 | 964590_f1_2 | 61 | 5723 | 627 | 209 | 824 | 2.8(10)-82 | Escherichia coli | b0434 | [pn:hypothetical lipoprotein in ampg 5'''' region] [gn:yajg] |
| CONTIG135 | 30722826_f1_3 | 62 | 5724 | 372 | 124 | 458 | 1.7(10)-43 | Escherichia coli | b0433 | [pn:ampg protein] [gn:ampg] |
| CONTIG135 | 34626891_c1_5 | 63 | 5725 | 237 | 79 | 316 | 1.8(10)-28 | Escherichia coli | b0435 | [pn:bola protein] [gn:bola] |
| CONTIG136 | 5954207_f1_1 | 64 | 5726 | 765 | 255 | 828 | 1.1(10)-82 | Escherichia coli | b2511 | [pn:hypothetical protein] |
| CONTIG136 | 32500050_f3_3 | 65 | 5727 | 606 | 202 | 891 | 2.2(10)-89 | Escherichia coli | b2512 | [pn:hypothetical protein] |
| CONTIG137 | 14506503_f1_1 | 66 | 5728 | 462 | 154 | 166 | 2.8(10)-12 | Escherichia coli | b4396 | [pn:right origin-binding protein] [gn:rob] |
| CONTIG137 | 30667937_f3_3 | 67 | 5729 | 192 | 64 | 121 | 2.8(10)-7 | Escherichia coli | b1790 | [pn:hypothetical protein] |
| CONTIG137 | 1189430_f3_4 | 68 | 5730 | 360 | 120 | 100 | 1.5(10)-5 | Escherichia coli | b1112 | [pn:hypothetical protein] |
| CONTIG137 | 14743832_c3_6 | 69 | 5731 | 216 | 72 | 228 | 4.0(10)-19 | Escherichia coli | b2106 | [pn:hypothetical protein] |
| CONTIG138 | 25392331_f1_1 | 70 | 5732 | 312 | 104 | 378 | 5.2(10)-35 | Escherichia coli | b1852 | [pn:glucose 6-phosphate 1 dehydrogenase] [gn:zwfl] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG138 | 16695877_f3_6 | 71 | 5733 | 885 | 295 | 1346 | 1.3(10)-137 | Escherichia coli | b1851 | [pn:phosphogluconate dehydratase] [gn:edd] |
| CONTIG139 | 32314061_f2_4 | 72 | 5734 | 387 | 129 | 130 | 1.0(10)-8 | Escherichia coli | b1569 | [pn:repressor protein of division inhibition gene dicb] [gn:dicc] |
| CONTIG139 | 14470637_c2_8 | 73 | 5735 | 423 | 141 | 401 | 1.8(10)-37 | Escherichia coli | b1570 | [pn:repressor protein of division inhibition gene dicb] [gn:dica] |
| CONTIG140 | 35949137_f3_4 | 74 | 5736 | 1260 | 420 | 211 | 1.5(10)-14 | Pseudomonas putida | S27611 | agglutination protein - pseudomonas putida |
| CONTIG142 | 35835092_f1_1 | 75 | 5737 | 1197 | 399 | 1652 | 5.2(10)-170 | Escherichia coli | b3544 | [pn:periplasmic dipeptide transport protein precursor] [gn:dppa] |
| CONTIG143 | 16054202_f1_4 | 76 | 5738 | 336 | 112 | 528 | 6.7(10)-51 | Escherichia coli | b1827 | [pn:hypothetical protein] |
| CONTIG144 | 10314637_c2_10 | 77 | 5739 | 987 | 329 | 1049 | 3.3(10)-106 | Escherichia coli | b1828 | [pn:hypothetical protein] |
| CONTIG145 | 33239137_f2_2 | 78 | 5740 | 711 | 237 | 1012 | 3.3(10)-102 | Escherichia coli | b0571 | [pn:hypothetical protein] [gn:ylca] |
| CONTIG145 | 11117780_f3_4 | 79 | 5741 | 342 | 114 | 242 | 6.0(10)-20 | Escherichia coli | b0570 | [pn:hypothetical protein] [gn:ybcz] |
| CONTIG146 | 35569027_c3_10 | 80 | 5742 | 603 | 201 | 287 | 4.5(10)-25 | Escherichia coli | b0572 | [pn:hypothetical protein] [gn:ylcb] |
| CONTIG147 | 3906875_f3_3 | 81 | 5743 | 1296 | 432 | 1799 | 1.3(10)-185 | Escherichia coli | b3702 | [pn:chromosomal replication initiator protein dnaa] [gn:dnaa] |
| CONTIG147 | 32610875_f3_3 | 82 | 5744 | 288 | 96 | 278 | 2.0(10)-24 | Escherichia coli | b1916 | [pn:regulatory protein] [gn:sdia] |
| CONTIG147 | 16413907_f3_5 | 83 | 5745 | 461 | 154 | 500 | 6.2(10)-48 | Escherichia coli | b1914 | [pn:23.9 kd protein in uvrc-sdia intergenic region] [gn:uvry] |
| CONTIG148 | 12614702_c1_7 | 84 | 5746 | 225 | 75 | 299 | 1.2(10)-26 | Escherichia coli | b1915 | [pn:yecf] |
| CONTIG148 | 22748011_f1_1 | 85 | 5747 | 366 | 122 | 199 | 4.9(10)-16 | Escherichia coli | b1166 | [pn:hypothetical protein] |
| CONTIG148 | 5250378_c2_7 | 86 | 5748 | 888 | 296 | 464 | 4.0(10)-44 | Klebsiella pneumoniae | L23111 | or:klebsiella pneumoniae pn:fimbrial adhesin gn:fimk ie:1139 re:2380 di:direct sr:klebsiella pneumoniae |
| CONTIG149 | 3954682_c2_4 | 87 | 5749 | 558 | 186 | 555 | 9.1(10)-54 | Bacteriophage lambda | A14086 | repressor protein ci - phase lambda repressor protein ci allows phage lambda to reside inactively in the chromosome of its host bacterium. this lysogenic state is maintained by binding of regulatory protein cl to the or and ol operators, preventing |
| CONTIG15 | 36406937_f1_1 | 88 | 5750 | 467 | 156 | 168 | 9.9(10)-12 | Escherichia coli | b3066 | [pn:dna primase] [gn:dnag] |
| CONTIG15 | 9784375_f2_2 | 89 | 5751 | 330 | 110 | 113 | 8.3(10)-6 | Haemophilus influenzae | HI0532 | [pn:dna primase] [gn:dnag] |
| CONTIG150 | 24485818_f1_1 | 90 | 5752 | 195 | 65 | 160 | 4.0(10)-11 | Escherichia coli | b1184 | [pn:umuc protein] [gn:umuc] |
| CONTIG150 | 24042892_c1_5 | 91 | 5753 | 258 | 86 | 104 | 0.00018 | Methanococcus jannaschii | MJ1643 | [pn:chromosome segregation protein] |
| CONTIG151 | 4485693_c1_4 | 92 | 5754 | 825 | 275 | 1160 | 7.0(10)-118 | Escherichia coli | b0197 | [pn:hypothetical 29.4 kd lipoprotein in resf-rrnh intergenic region] |
| CONTIG152 | 3228024_c1_7 | 93 | 5755 | 931 | 310 | 1152 | 5.0(10)-117 | Escherichia coli | A25937 | arsenical pump-driving atpase (ec 3.6.1.—) - escherichia coliplasmid r773 this anion-transporting atpase catalyzes the extrusion of the oxyanions arsenite, antimonite, and arsenate, thus lowering the extracellular concentration of these toxic oxyanions. |
| CONTIG153 | 14258412_f1_1 | 94 | 5756 | 183 | 61 | 101 | 1.2(10)-5 | Haemophilus influenzae | HI0598 | [pn:hypothetical protein] |
| CONTIG153 | 1461540_f1_2 | 95 | 5757 | 945 | 315 | 633 | 5.0(10)-62 | Escherichia coli | b0626 | [pn:hypothetical protein] [gn:ybem] |
| CONTIG153 | 14850461_c2_8 | 96 | 5758 | 396 | 132 | 588 | 2.8(10)-57 | Escherichia coli | b0624 | [pn:hypothetical 13.8 kd protein in cspe-lipa intergenic region] [gn:ybgr] |
| CONTIG154 | 24645175_c1_1 | 97 | 5759 | 456 | 152 | 183 | 2.3(10)-14 | Escherichia coli | S70162 | , |
| CONTIG155 | 23622260_c3_10 | 98 | 5760 | 839 | 279 | 1123 | 5.9(10)-114 | Escherichia coli | b0031 | [pn:dihydrodipicolinate reductase] [gn:dapb] |
| CONTIG156 | 1384665_f2_1 | 99 | 5761 | 390 | 130 | 567 | 4.9(10)-55 | Escherichia coli | b0032 | [pn:carbamoyl-phosphate synthase small chain] [gn:cara] |
| CONTIG157 | 16305956_f2_2 | 100 | 5762 | 1269 | 423 | 1956 | 3.2(10)-202 | Escherichia coli | b4260 | [pn:aminopeptidase a/l] [gn:pepa] |
| CONTIG158 | 10563465_f3_3 | 101 | 5763 | 2103 | 701 | 2013 | 2.8(10)-208 | Escherichia coli | b1102 | [pn:outer-membrane receptor for fe] [gn:fhue] |
| CONTIG159 | 12991252_f1_1 | 102 | 5764 | 492 | 164 | 102 | 9.3(10)-6 | Escherichia coli | b2861 | [pn:insertion element is2 hypothetical 13.4 kd protein] |
| CONTIG159 | 23938415_f3_4 | 103 | 5765 | 726 | 242 | 313 | 4.0(10)-28 | Escherichia coli | b0752 | [pn:hypothetical protein] [gn:ybgr] |
| CONTIG159 | 2466037_c3_8 | 104 | 5766 | 390 | 130 | 102 | 9.3(10)-6 | Bacillus subtilis | yozA | [pn:hypothetical protein] |
| CONTIG16 | 4019806_c2_5 | 105 | 5767 | 285 | 95 | 375 | 1.1(10)-34 | Escherichia coli | b1994 | [pn:insertion element is5 hypothetical 39.3 kd protein] |
| CONTIG16 | 23728327_f1_1 | 106 | 5768 | 435 | 145 | 108 | 2.1(10)-6 | Escherichia coli | b1219 | [pn:hypothetical 12.7 kd protein in chac-narl intergenic region] [gn:ychm] |
| CONTIG160 | 23728327_f1_1 | 107 | 5769 | 510 | 170 | 244 | 8.3(10)-21 | Escherichia coli | glcR | [pn:transcriptional regulator] [gn:ywpi] |
| CONTIG160 | 35253527_f2_3 | 108 | 5770 | 1143 | 381 | 824 | 2.8(10)-82 | Escherichia coli | b1624 | [pn:hypothetical protein] |
| CONTIG161 | 12694182_c1_9 | 109 | 5771 | 762 | 254 | 426 | 4.2(10)-40 | Escherichia coli | b0897 | [pn:hypothetical 23.1 kd protein in dmsc 3''' region] [gn:ycac] |
| CONTIG161 | 26166641_c3_11 | 110 | 5772 | 582 | 194 | 222 | 1.8(10)-18 | Homo sapiens | Y07867 | or:homo sapiens pn:pirin ie:205 di:direct sr:human |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG162 | 7282255_f1_1 | 111 | 5773 | 372 | 124 | 450 | 1.2(10)-42 | Escherichia coli | b0946 | [pn:hypothetical protein] |
| CONTIG162 | 21741657_c2_12 | 112 | 5774 | 972 | 324 | 1313 | 4.4(10)-134 | Escherichia coli | b0947 | [pn:hypothetical protein] |
| CONTIG163 | 22940371_c1_12 | 113 | 5775 | 792 | 264 | 1273 | 7.5(10)-130 | Escherichia coli | b2568 | [pn:signal peptidase i] [gn:lepB] |
| CONTIG163 | 31880432_c1_13 | 114 | 5776 | 531 | 177 | 776 | 3.5(10)-77 | Escherichia coli | b2566 | [pn:gtp-binding protein] [gn:era] |
| CONTIG163 | 12203387_c2_15 | 115 | 5777 | 801 | 267 | 1059 | 3.6(10)-107 | Escherichia coli | b2567 | [pn:ribonuclease iii] [gn:rnc] |
| CONTIG165 | 20508557_f1_1 | 116 | 5778 | 1307 | 436 | 1915 | 7.0(10)-198 | Escherichia coli | b4208 | [pn:d-serine/d-alanine/glycine transporter] [gn:cycA] |
| CONTIG165 | 23866588_f2_2 | 117 | 5779 | 636 | 212 | 821 | 6.0(10)-82 | Escherichia coli | b4207 | [pn:probable fkbp-type 22 kd peptidyl-prolyl cis-trans isomerase] |
| CONTIG167 | 31367263_f1_2 | 118 | 5780 | 1200 | 400 | 452 | 7.5(10)-43 | Escherichia coli | AF005044 | [PN:TraU] [GN:traU] [DE:Escherichia coli plasmid R100-1 TraV (traV), TraR (traR), OrfG1 (orfG1), OrfH (orfH), OrfI (orfI), TraC (traC), TrbI (trbI), TraW (traW), TraU (traU), TrbC (trbC), TraN (traN), TrbE (trbE) and TraF (traF) genes, c |
| CONTIG168 | 34615936_c1_7 | 119 | 5781 | 879 | 293 | 1005 | 1.8(10)-101 | Escherichia coli | b4174 | [pn:hflK protein] [gn:hflK] |
| CONTIG168 | 26601532_c2_8 | 120 | 5782 | 333 | 111 | 516 | 1.2(10)-49 | Escherichia coli | b4173 | [pn:gtp-binding protein hflX] [gn:hflX] |
| CONTIG169 | 21657693_f1_2 | 121 | 5783 | 597 | 199 | 707 | 7.2(10)-70 | Escherichia coli | b3639 | [pn:dfp protein] [gn:dfp] |
| CONTIG169 | 32246000_f2_5 | 122 | 5784 | 204 | 68 | 151 | 4.0(10)-10 | Escherichia coli | b3639 | [pn:dfp protein] [gn:dfp] |
| CONTIG169 | 5953150_c3_14 | 123 | 5785 | 852 | 284 | 801 | 7.7(10)-80 | Escherichia coli | b3638 | [pn:dna repair protein radc] [gn:radC] |
| CONTIG170 | 1204702_f1_1 | 124 | 5786 | 336 | 112 | 523 | 2.2(10)-50 | Escherichia coli | b0969 | [pn:hypothetical protein in held-sert intergenic region] [gn:radc] |
| CONTIG170 | 31462776_f2_4 | 125 | 5787 | 663 | 221 | 634 | 3.8(10)-62 | Escherichia coli | b0970 | [pn:hypothetical 23.4 kd protein in sert 5"" region] [gn:ycca] |
| CONTIG170 | 1210765_c2_13 | 126 | 5788 | 282 | 94 | 307 | 1.7(10)-27 | Escherichia coli | b0968 | [pn:hypothetical protein] |
| CONTIG170 | 32428439_c3_17 | 127 | 5789 | 1152 | 384 | 965 | 3.2(10)-97 | Escherichia coli | b1243 | [pn:periplasmic oligopeptide-binding protein precursor] [gn:oppA] |
| CONTIG171 | 11737962_f3_4 | 128 | 5790 | 948 | 316 | 104 | 0.01 | Streptococcus phage phi7201 | U89246 | [de:streptococcus phage phi7201 orfx and orfy unknown protein genes, partial cds] [pn:unknown] [nt:orfy] |
| CONTIG173 | 26742882_f2_2 | 129 | 5791 | 555 | 185 | 144 | 1.5(10)-9 | Pseudomonas sp. | P18896 | increased glyphosate resistance protein. |
| CONTIG173 | 4164015_c3_8 | 130 | 5792 | 1047 | 349 | 1016 | 1.3(10)-102 | Escherichia coli | b3001 | [pn:trigger factor] [gn:tig] |
| CONTIG174 | 5270268_f1_1 | 131 | 5793 | 1392 | 464 | 1809 | 1.2(10)-186 | Escherichia coli | b0436 | [pn:ironii dicitrate transport atp-binding protein fecE] [gn:fecE] |
| CONTIG175 | 22050143_f1_1 | 132 | 5794 | 1092 | 364 | 463 | 5.2(10)-44 | Bacillus subtilis | b4287 | [pn:hypothetical 23.4 kd protein in melb-fumb intergenic region] |
| CONTIG175 | 4579201_f2_2 | 133 | 5795 | 558 | 186 | 304 | 3.6(10)-27 | Escherichia coli | yvrB | [pn:hypothetical protein] |
| CONTIG176 | 35567462_c2_12 | 134 | 5796 | 402 | 134 | 324 | 8.5(10)-29 | Escherichia coli | b1243 | [pn:periplasmic oligopeptide-binding protein precursor] [gn:oppA] |
| CONTIG176 | 25938376_f2_2 | 135 | 5797 | 576 | 192 | 659 | 8.8(10)-65 | Escherichia coli | b0199 | [gn:abc] [gn:abc] |
| CONTIG176 | 23473562_f2_3 | 136 | 5798 | 483 | 161 | 767 | 3.1(10)-76 | Escherichia coli | b0199 | [gn:abc] [gn:abc] |
| CONTIG176 | 7270092_f3_8 | 137 | 5799 | 614 | 205 | 777 | 2.7(10)-77 | Escherichia coli | b0198 | [pn:hypothetical abc transporter permease protein yaee] [gn:yaee] |
| CONTIG176 | 29453308_c2_12 | 138 | 5800 | 630 | 210 | 892 | 1.8(10)-89 | Escherichia coli | b0200 | [pn:hypothetical 21.3 kd protein in abc-rrsh intergenic region] [gn:yaed] |
| CONTIG177 | 24884941_f2_2 | 139 | 5801 | 525 | 175 | 573 | 3.8(10)-55 | Escherichia coli | b2216 | [pn:probable sensor protein yojn] [gn:yojn] |
| CONTIG178 | 24253325_f1_1 | 140 | 5802 | 429 | 143 | 141 | 6.7(10)-10 | Escherichia coli | b3097 | [pn:hypothetical 14.5 kd protein in exur-tdcc intergenic region] [gn:tig] |
| CONTIG180 | 13066567_f1_1 | 141 | 5803 | 654 | 218 | 509 | 6.9(10)-49 | Escherichia coli | b4121 | [pn:hypothetical 23.4 kd protein in melb-fumb intergenic region] [gn:yjdF] |
| CONTIG180 | 30672151_f3_4 | 142 | 5804 | 189 | 63 | 270 | 1.5(10)-23 | Escherichia coli | b4121 | [pn:hypothetical 23.4 kd protein in melb-fumb intergenic region] [gn:yjdF] |
| CONTIG182 | 11814452_f1_1 | 143 | 5805 | 369 | 123 | 397 | 5.0(10)-37 | Escherichia coli | b4372 | [pn:hold] [gn:hold] |
| CONTIG182 | 21991462_f2_3 | 144 | 5806 | 492 | 164 | 521 | 3.7(10)-50 | Escherichia coli | b4373 | [pn:dna polymerase iii psi subunit] [gn:yjdF] |
| CONTIG182 | 5086063_f2_4 | 145 | 5807 | 351 | 117 | 461 | 8.4(10)-44 | Escherichia coli | b4375 | [pn:ribosomal-protein-alanine acetyltransferase] [gn:rimI] |
| CONTIG182 | 34491258_f3_6 | 146 | 5808 | 786 | 262 | 999 | 8.1(10)-101 | Escherichia coli | b4374 | [pn:peptide-chain-release factor 3] [gn:prfc] |
| CONTIG184 | 25969562_c1_6 | 147 | 5809 | 696 | 232 | 1038 | 6.0(10)-105 | Escherichia coli | b3346 | [pn:hypothetical 22.2 kd protein in rimi-prfc intergenic region] [gn:yheo] |
| CONTIG184 | 4897691_c2_7 | 148 | 5810 | 684 | 228 | 837 | 1.2(10)-83 | Escherichia coli | b3347 | [pn:fkbp-type peptidyl-prolyl cis-trans isomerase] [gn:yheo] |
| CONTIG185 | 30556284_c1_4 | 149 | 5811 | 1331 | 443 | 690 | 4.5(10)-68 | Escherichia coli | b0544 | [pn:hypothetical protein] [gn:ybck] |
| CONTIG186 | 4416343_f1_3 | 150 | 5812 | 669 | 223 | 1018 | 7.9(10)-103 | Escherichia coli | b1180 | [pn:hypothetical protein] |
| CONTIG186 | 2625761_f2_6 | 151 | 5813 | 402 | 134 | 443 | 6.7(10)-42 | Escherichia coli | b1179 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG186 | 9805436_c1_12 | 152 | 5814 | 726 | 242 | 1038 | 6.0(10)-105 | Escherichia coli | b1175 | [pn:cell division inhibitor mind] [gn:mind] |
| CONTIG186 | 15681716_c3_17 | 153 | 5815 | 807 | 269 | 908 | 3.6(10)-91 | Escherichia coli | b1176 | [pn:cell division inhibitor minc] [gn:minc] |
| CONTIG187 | 962900_f3_2 | 154 | 5816 | 1848 | 616 | 1429 | 2.2(10)-146 | Escherichia coli | b2395 | [pn:ytea] |
| CONTIG188 | 676041_f2_3 | 155 | 5817 | 1506 | 502 | 1903 | 1.3(10)-196 | Escherichia coli | b1603 | [pn:pyridine nucleotide transhydrogenase subunit- alpha] [gn:pnta] |
| CONTIG189 | 24508336_f3_4 | 156 | 5818 | 579 | 193 | 573 | 1.1(10)-55 | Escherichia coli | b1622 | [pn:maly protein] [gn:maly] |
| CONTIG189 | 34569806_f3_5 | 157 | 5819 | 1011 | 337 | 1346 | 1.3(10)-137 | Escherichia coli | b1623 | [pn:adenosine deaminase] [gn:add] |
| CONTIG19 | 32204791_f1_1 | 158 | 5820 | 399 | 133 | 622 | 7.2(10)-61 | Enterobacteriaceae | S07447 | [pn:hypothetical protein, 13.1 k] |
| CONTIG19 | 25522168_f2_3 | 159 | 5821 | 297 | 99 | 165 | 2.0(10)-12 | Shigella flexneri | P04337 | hypothetical mercuric resistance protein merc. mercuric transport protein. |
| CONTIG19 | 12995781_f3_5 | 160 | 5822 | 339 | 113 | 114 | 5.0(10)-7 | Shigella flexneri | P04336 | mercuric resistance operon regulatory protein. |
| CONTIG19 | 9901712_c1_6 | 161 | 5823 | 663 | 221 | 722 | 1.8(10)-71 | Shigella flexneri | P07044 | [pn:lactaldehyde dehydrogenase a] [gn:alda] |
| CONTIG19 | 15651516_f1_2 | 162 | 5824 | 960 | 320 | 1514 | 2.6(10)-155 | Escherichia coli | b1415 | [gn:cybb] |
| CONTIG19 | 12242930_f1_2 | 163 | 5825 | 444 | 148 | 521 | 3.7(10)-50 | Escherichia coli | b1418 | [gn:cybb] |
| CONTIG190 | 35662765_f2_5 | 164 | 5826 | 204 | 68 | 138 | 1.3(10)-9 | Escherichia coli | b1418 | [gn:cybb] |
| CONTIG190 | 35348277_c1_11 | 165 | 5827 | 345 | 115 | 111 | 1.3(10)-6 | Azospirillum brasilense | X70360 | or:azospirillum brasilense gn:carr le:<1 re:588 di:direct |
| CONTIG190 | 16095807_c2_13 | 166 | 5828 | 390 | 130 | 135 | 2.8(10)-9 | Azospirillum brasilense | X70360 | or:azospirillum brasilense gn:carr le:59 re:580 di:direct nt:orf2] |
| CONTIG191 | 25508265_c2_11 | 167 | 5829 | 735 | 245 | 920 | 1.8(10)-92 | Escherichia coli | b1913 | [pn:excinuclease abc subunit c] [gn:uvrc] |
| CONTIG191 | 6760811_c2_13 | 168 | 5830 | 240 | 80 | 316 | 1.8(10)-28 | Escherichia coli | b1913 | [pn:excinuclease abc subunit c] [gn:uvrc] |
| CONTIG191 | 30128300_c3_15 | 169 | 5831 | 1203 | 401 | 1726 | 7.5(10)-178 | Escherichia coli | b1912 | [pn:phosphotidylglycerophosphate synthetase] [gn:pgsa] |
| CONTIG192 | 29711561_c2_11 | 170 | 5832 | 522 | 174 | 322 | 4.5(10)-29 | Escherichia coli | b1043 | [pn:hypothetical protein] [gn:csgg] |
| CONTIG192 | 35548807_c3_12 | 171 | 5833 | 561 | 187 | 589 | 2.2(10)-57 | Escherichia coli | b1041 | [pn:nucleation component of curlin monomers] [gn:csgb] |
| CONTIG192 | 30331555_c3_13 | 172 | 5834 | 477 | 159 | 507 | 1.1(10)-48 | Escherichia coli | b1042 | [pn:major curlin subunit precursor] [gn:csga] |
| CONTIG193 | 3939087_f1_1 | 173 | 5835 | 891 | 297 | 1376 | 9.1(10)-141 | Escherichia coli | b1829 | [pn:heat shock protein htpx] [gn:htpx] |
| CONTIG193 | 33848575_f2_2 | 174 | 5836 | 1608 | 536 | 2343 | 3.1(10)-243 | Escherichia coli | b1830 | [pn:tail-specific protease precursor] [gn:prc] |
| CONTIG194 | 16019651_f2_3 | 175 | 5837 | 926 | 309 | 1434 | 6.5(10)-147 | Escherichia coli | b1370 | [pn:insertion element is5 hypothetical protein] [gn:yi52_5] transposase,,is5b, |
| CONTIG194 | 30157255_f3_6 | 176 | 5838 | 279 | 93 | 94 | 0.00042 | Escherichia coli | U95365 | or:escherichia coli gn:is5 le:13994 re:14362 di:direct _lib:kohara lambda minise nt:orf_id:o263#20; similar to [swissprot accession |
| CONTIG194 | 21775383_c1_8 | 177 | 5839 | 300 | 100 | 447 | 2.6(10)-42 | Escherichia coli | D90774 | [pn:hypothetical protein] |
| CONTIG194 | 22458580_c1_9 | 178 | 5840 | 348 | 116 | 484 | 3.1(10)-46 | Escherichia coli | b1371 | [pn:hypothetical protein] |
| CONTIG195 | 16500153_c1_7 | 179 | 5841 | 1560 | 520 | 1825 | 2.3(10)-188 | Escherichia coli | b2216 | [pn:probable sensor protein yojn] [gn:yojn] |
| CONTIG196 | 34647280_f2_4 | 180 | 5842 | 414 | 138 | 558 | 4.4(10)-54 | Escherichia coli | b4200 | [pn:30s ribosomal subunit protein s6] [gn:rpsf] |
| CONTIG196 | 14884500_f2_5 | 181 | 5843 | 216 | 72 | 345 | 1.6(10)-31 | Escherichia coli | b4201 | [pn:primosomal replication protein n] [gn:prib] |
| CONTIG196 | 10632182_c1_8 | 182 | 5844 | 399 | 133 | 307 | 1.7(10)-27 | Escherichia coli | b4199 | [pn:hypothetical 10.1 kd protein in aidb-rpsf intergenic region] [gn:ybel] |
| CONTIG197 | 1308262_f2_2 | 183 | 5845 | 564 | 188 | 655 | 2.2(10)-64 | Escherichia coli | b3856 | [pn:hypothetical transcriptional regulator in lipa-lipb intergenic region] [gn:ybef] |
| CONTIG198 | 23687750_c1_6 | 184 | 5846 | 729 | 243 | 757 | 3.6(10)-75 | Escherichia coli | b0629 | [pn:hypothetical protein] |
| CONTIG198 | 3242252_c1_7 | 185 | 5847 | 1011 | 337 | 1650 | 8.5(10)-170 | Escherichia coli | b0628 | [pn:lipoic acid synthetase] [gn:lipa] |
| CONTIG199 | 29723842_c1_10 | 186 | 5848 | 561 | 187 | 102 | 0.0028 | Haemophilus influenzae | III0015 | [pn:signal peptidase i] [gn:lepb] |
| CONTIG199 | 54140_c2_11 | 187 | 5849 | 813 | 271 | 93 | 0.027 | Escherichia coli | AF005044 | [PN:TrbC] [GN:trbC] [DE:Escherichia coli plasmid R100-1 TraV (traV), TraR (traR), OrfG1 (orfG1), OrfH (orfH), OrfI (orfI), TraC (traC), TrbI (trbI), TraW (traW), TraU (traU), TrbC (trbC), TraN (traN), TrbE (trbE) and TraF (traF) genes, c |
| CONTIG199 | 32032827_c3_12 | 188 | 5850 | 714 | 247 | 93 | 0.20999 | Vibrio cholerae | Y00557 | [PN:protease] [GN:prtV] [DE:Vibrio cholerae DNA for hlyA, hlyB, lipA and prtV genes.] [LE:7537] [RE:10296] [DI:complement] |
| CONTIG2 | 16218928_c2_6 | 189 | 5851 | 417 | 139 | 129 | 1.3(10)-8 | Escherichia coli | b1228 | [pn:hypothetical protein] |
| CONTIG2 | 829150_c3_7 | 190 | 5852 | 336 | 112 | 115 | 3.8(10)-7 | Escherichia coli | b1228 | [pn:hypothetical protein] |
| CONTIG20 | 16620400_c2_3 | 191 | 5853 | 519 | 173 | 153 | 1.2(10)-10 | Escherichia coli | b3816 | [pn:magnesium and cobalt transport protein cora] [gn:cora] |
| CONTIG200 | 31875006_f1_1 | 192 | 5854 | 810 | 270 | 966 | 2.6(10)-97 | Escherichia coli | b0761 | [pn:molybdenum transport protein mode] [gn:mode] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG200 | 10634661_f2_2 | 193 | 5855 | 1164 | 388 | 1413 | 1.1(10)-144 | Escherichia coli | b0760 | [pn:putative molybdenum transport atp-binding protein modf] [gn:modf] |
| CONTIG201 | 5198443_c3_13 | 194 | 5856 | 792 | 264 | 490 | 7.0(10)-47 | Bacillus subtilis | ymaE | [pn:hypothetical protein] |
| CONTIG202 | 4394533_c3_5 | 195 | 5857 | 831 | 277 | 993 | 3.5(10)-100 | Escherichia coli | b0732 | [pn:ybgb] [gn:ybgb] |
| CONTIG203 | 2375193_c1_4 | 196 | 5858 | 204 | 68 | 102 | 8.9(10)-5 | Methanobacterium thermoautotrophicum | MTH104 | [pn:multidrg transporter homolog] |
| CONTIG203 | 5164657_c1_5 | 197 | 5859 | 741 | 247 | 921 | 1.5(10)-92 | Methanobacterium thermoautotrophicum | MTH104 | [pn:multidrg transporter homolog] |
| CONTIG204 | 1962750_c1_5 | 198 | 5860 | 750 | 250 | 962 | 6.7(10)-97 | Escherichia coli | b2055 | [pn:hypothetical protein] [gn:wcae] |
| CONTIG204 | 4739000_f1_9 | 199 | 5861 | 351 | 117 | 558 | 4.4(10)-54 | Escherichia coli | b2054 | [pn:hypothetical protein] [gn:wcaf] |
| CONTIG204 | 159627_c3_10 | 200 | 5862 | 228 | 76 | 355 | 1.3(10)-32 | Escherichia coli | b2056 | [pn:hypothetical protein] [gn:wcad] |
| CONTIG205 | 26694807_c1_5 | 201 | 5863 | 372 | 124 | 594 | 6.7(10)-58 | Yersinia pestis | AF053945 | [de:yersinia pestis plasmid ppcp1, complete plasmid sequence.] [pn:transposase] |
| CONTIG206 | 21683457_f1_1 | 202 | 5864 | 2127 | 709 | 3388 | 0 | Escherichia coli | b3340 | [pn:fusa] 8 gn:fusa] |
| CONTIG206 | 1069483_f1_2 | 203 | 5865 | 378 | 126 | 406 | 5.7(10)-38 | Escherichia coli | b3339 | [pn:elongation factor tu] [gn:tufa] |
| CONTIG206 | 510290_c1_4 | 204 | 5866 | 705 | 235 | 390 | 4.0(10)-36 | Eikenella corrodens | P35649 | hypothetical 66.3 kd protein in hag2 5' region. |
| CONTIG206 | 394215_c1_5 | 205 | 5867 | 1113 | 371 | 575 | 7.0(10)-56 | Eikenella corrodens | P35649 | hypothetical 66.3 kd protein in hag2 5' region. |
| CONTIG206 | 22352280_c2_10 | 206 | 5868 | 189 | 63 | 105 | 5.7(10)-5 | Eikenella corrodens | P35649 | hypothetical 66.3 kd protein in hag2 5' region. |
| CONTIG207 | 2376381_f1_4 | 207 | 5869 | 825 | 275 | 274 | 1.8(10)-33 | Escherichia coli | b2106 | [pn:hypothetical protein] |
| CONTIG207 | 4867075_f2_5 | 208 | 5870 | 447 | 149 | 168 | 9.4(10)-13 | Escherichia coli | D90774 | or:escherichia coli gn:is5 le:13994 re:14362 di:direct sr:escherichia coli (strain:k12) dna, clone_lib:kohara lambda minise nt:orf_id:o263#20; similar to [swissprot accession |
| CONTIG207 | 34410768_c2_13 | 209 | 5871 | 987 | 329 | 1308 | 1.5(10)-133 | Escherichia coli | b1994 | [pn:insertion element is5 hypothetical 39.3 kd protein] |
| CONTIG208 | 16506441_f1_1 | 210 | 5872 | 1032 | 344 | 1346 | 1.3(10)-137 | Escherichia coli | b4175 | [pn:hflc protein] [gn:hflc] |
| CONTIG209 | 25839843_f2_2 | 211 | 5873 | 504 | 168 | 450 | 1.2(10)-42 | Escherichia coli | b4174 | [pn:hflk protein] [gn:hflk] |
| CONTIG21 | 32445803_f2_1 | 212 | 5874 | 909 | 303 | 1213 | 1.7(10)-123 | Escherichia coli | P03008 | transposase for transposon tn3. |
| CONTIG210 | 34188287_f2_4 | 213 | 5875 | 2229 | 743 | 1836 | 1.7(10)-189 | Pseudomonas aeruginosa | X99514 | or:pseudomonas aeruginosa gn:mexf le:1439 re:4627 di:direct |
| CONTIG210 | 4867075_f2_5 | 214 | 5876 | 279 | 93 | 92 | 0.00011 | Saccharomyces cerevisiae | YNL259C | [pn:antioxidant protein and metal homeostasis factor] [gn:atx1] |
| CONTIG211 | 5944581_c2_13 | 215 | 5877 | 1152 | 384 | 545 | 1.1(10)-52 | Escherichia coli | AF044506 | [de:escherichia coli strain ec50 hep gene, partial cds; rhsg accessorygenetic element vgrg gene, partial cds; and core proteingene, partial cds.] [pn:vgrg protein] |
| CONTIG211 | 36147260_c2_14 | 216 | 5878 | 1092 | 364 | 100 | 0.12 | Mycobacterium tuberculosis | AL021246 | [de:mycobacterium tuberculosis sequence v008.] [pn:pgrs-family] [gn mtv008 46c] [nt mtv008.46c, member of the m. tuberculosis] |
| CONTIG212 | 13880212_f2_2 | 217 | 5879 | 390 | 130 | 462 | 6.5(10)-44 | Escherichia coli | b3501 | [pn:arsenical resistance operon arsefg repressor] [gn:arsr] |
| CONTIG212 | 16600136_f2_3 | 218 | 5880 | 393 | 131 | 463 | 5.2(10)-44 | Escherichia coli | A25937 | escherichia coliplasmid r773 this anion-transporting atpase catalyzes the extrusion of the oxyanions arsenite, antimonite, and arsenate, thus lowering the intracellular concentration of these toxic oxyanions. |
| CONTIG212 | 31284383_c2_8 | 219 | 5881 | 333 | 111 | 494 | 2.7(10)-47 | Enterobacter aerogenes | U67194 | or:enterobacter aerogenes pn:tnpa gn:tnpa le:10303 re:11307 di:complement |
| CONTIG213 | 4494000_f1_1 | 220 | 5882 | 954 | 318 | 90 | 0.23 | Drosophila melanogaster | M19537 | or:drosophila melanogaster gn:rpii215 le:join(<1 re:133,379 di:direct sr:d. melanogaster dna, clone p4.1 nt:description: rna polymerase ii 215kd subunit; rna |
| CONTIG213 | 24477907_f1_2 | 221 | 5883 | 1770 | 590 | 150 | 2.5(10)-15 | Escherichia coli | AF005044 | [PN:TraC] [GN:traC] [DE:Escherichia coli plasmid R100-1 TraV (traV), TraR (traR), OrfG1 (orfG1), OrfH (orfH), OrfI (orfI), TraC (traC), TrbI (trbI), TraW (traW), traU (traU), TrbC (trbC), TraN (traN), TrbE (trbE) and TraF (traF) genes, c |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG214 | 22770005_f3_5 | 222 | 5884 | 1548 | 516 | 2262 | 1.2(10)-234 | Escherichia coli | b2149 | [pn:galactoside transport atp-binding protein mglа] [gn:mgla] |
| CONTIG214 | 3417013_f3_6 | 223 | 5885 | 1026 | 342 | 1311 | 7.0(10)-134 | Escherichia coli | b2148 | [pn:galactoside transport system permease protein mglc] [gn:mglc] |
| CONTIG215 | 5078300_f3_6 | 224 | 5886 | 876 | 292 | 1456 | 3.1(10)-149 | Escherichia coli | b4192 | [pn:hypothetical 40.3 kd protein in aidb-rpsf intergenic region] [gn:yjfi] |
| CONTIG215 | 22367036_c1_8 | 225 | 5887 | 804 | 268 | 1175 | 1.8(10)-119 | Escherichia coli | b4193 | [pn:hypothetical 52.9 kd protein in aidb-rpsf intergenic region] [gn:yjfs] |
| CONTIG216 | 10411407_f1_3 | 226 | 5888 | 388 | 130 | 195 | 1.3(10)-15 | Rhizobium sp. | S34667 | hypothetical protein 140 - rhizobium sp. |
| CONTIG216 | 10563465_f2_6 | 227 | 5889 | 420 | 140 | 102 | 9.3(10)-6 | Escherichia coli | b2861 | [pn:insertion element is2 hypothetical 13.4 kd protein] |
| CONTIG216 | 6383505_c3_17 | 228 | 5890 | 633 | 211 | 232 | 1.6(10)-19 | Bacillus subtilis | soj | [pn:hypothetical protein] |
| CONTIG217 | 4301907_f1_1 | 229 | 5891 | 1212 | 404 | 1634 | 4.2(10)-168 | Escherichia coli | b2393 | [pn:nucleoside permease nupc] [gn:nupc] |
| CONTIG217 | 4900012_c1_1 | 230 | 5892 | 651 | 217 | 505 | 4.5(10)-48 | Escherichia coli | b2395 | [pn:yfea] |
| CONTIG218 | 21697135_f2_2 | 231 | 5893 | 873 | 291 | 1293 | 5.7(10)-132 | Escherichia coli | b4396 | [pn:right origin-binding protein] [gn:rob] |
| CONTIG22 | 34587776_c1_4 | 232 | 5894 | 201 | 67 | 315 | 2.5(10)-28 | Escherichia coli | b3232 | [pn:hypothetical 43.1 kd protein in rplm-rhoa intergenic region] [gn:yhem] |
| CONTIG220 | 13775768_f2_1 | 233 | 5895 | 432 | 144 | 675 | 1.8(10)-66 | Enterobacter aerogenes | U67194 | or:enterobacter aerogenes pn:tnpa gn:tnpa le:1303 re:11307 di:complement |
| CONTIG220 | 1977312_c1_7 | 234 | 5896 | 882 | 294 | 91 | 0.031 | Bacillus subtilis | ydeM | [pn:hypothetical protein] |
| CONTIG221 | 23609515_f1_1 | 235 | 5897 | 294 | 98 | 419 | 2.3(10)-39 | Enterobacter agglomerans | A38965 | hypothetical protein a (insertion sequence is1222) - enterobacter agglomerans |
| CONTIG221 | 9896067_f3_4 | 236 | 5898 | 185 | 62 | 185 | 1.5(10)-14 | Enterobacter agglomerans | B38965 | hypothetical protein b (insertion sequence is1222) - enterobacter agglomerans |
| CONTIG221 | 190787_c1_6 | 237 | 5899 | 513 | 171 | 143 | 4.2(10)-10 | Rhizobium sp. | P55623 | hypothetical 18.8 kd protein y4qb, |
| CONTIG222 | 29744052_f3_7 | 238 | 5900 | 1122 | 374 | 165 | 6.0(10)-10 | Methanococcus jannaschii | MJ1187 | [pn:dinitrogenase reductase activating glycohydrolase] [gn:drag] |
| CONTIG223 | 34448000_f1_1 | 239 | 5901 | 249 | 83 | 341 | 4.4(10)-31 | Escherichia coli | b2833 | [pn:hypothetical protein] |
| CONTIG223 | 12699062_f1_2 | 240 | 5902 | 459 | 153 | 704 | 1.5(10)-69 | Escherichia coli | b2834 | [pn:hypothetical protein] |
| CONTIG223 | 1898537_f1_3 | 241 | 5903 | 324 | 108 | 320 | 7.2(10)-29 | Escherichia coli | b2834 | [pn:hypothetical protein] |
| CONTIG223 | 10425262_f2_5 | 242 | 5904 | 729 | 243 | 954 | 4.7(10)-96 | Escherichia coli | b2831 | [pn:muth] [gn:muth] |
| CONTIG223 | 4720916_f2_8 | 243 | 5905 | 375 | 125 | 504 | 2.2(10)-48 | Escherichia coli | b2834 | [pn:hypothetical protein] |
| CONTIG223 | 32550407_c3_17 | 244 | 5906 | 354 | 118 | 393 | 1.3(10)-36 | Escherichia coli | b2835 | [pn:hypothetical protein in muth-aas intergenic region] [gn:ygeд] |
| CONTIG224 | 35447642_c1_15 | 245 | 5907 | 915 | 305 | 1424 | 7.5(10)-146 | Escherichia coli | S70160 | , |
| CONTIG224 | 4110291_c1_16 | 246 | 5908 | 420 | 140 | 639 | 1.2(10)-62 | Escherichia coli | S70161 | , |
| CONTIG224 | 3907697_c2_17 | 247 | 5909 | 1473 | 491 | 2437 | 3.3(10)-253 | Escherichia coli | S70159 | , |
| CONTIG224 | 3939017_c2_20 | 248 | 5910 | 273 | 91 | 434 | 6.0(10)-41 | Escherichia coli | S70163 | , |
| CONTIG225 | 24301557_f1_2 | 249 | 5911 | 1362 | 454 | 1668 | 1.0(10)-171 | Escherichia coli | b3502 | [pn:arsenical pump membrane protein] [gn:arsb] |
| CONTIG225 | 4110263_f1_3 | 250 | 5912 | 279 | 93 | 416 | 4.9(10)-39 | Escherichia coli | b3503 | [pn:arsenate reductase] [gn:arsc] |
| CONTIG225 | 6135812_f3_6 | 251 | 5913 | 336 | 112 | 431 | 1.3(10)-40 | Escherichia coli | A25937 | arsenical pump-driving atpase (ec 3.6.1.—)-escherichia coli plasmid r773 this anion-transporting atpase catalyzes the extrusion of the oxyanions arsenite, antimonite, and arsenate, thus lowering the intracellular concentration of these toxic oxyanions |
| CONTIG226 | 15661513_c1_10 | 252 | 5914 | 639 | 213 | 359 | 1.1(10)-32 | Rhizobium sp. | P50360 | hypothetical 29.3 kd protein in region 2 of sym plasmid (no1265). |
| CONTIG226 | 22760817_f1_1 | 253 | 5915 | 426 | 142 | 472 | 5.7(10)-45 | Escherichia coli | b4206 | [pn:hypothetical protein] [gn:ytfb] |
| CONTIG226 | 7220463_c1_13 | 254 | 5916 | 462 | 154 | 536 | 9.5(10)-52 | Escherichia coli | b4203 | [pn:50s ribosomal subunit protein 19] [gn:rpli] |
| CONTIG226 | 15056377_c2_16 | 255 | 5917 | 246 | 82 | 385 | 9.5(10)-36 | Escherichia coli | b4202 | [pn:30s ribosomal subunit protein s18] [gn:rpsr] |
| CONTIG226 | 38537_c3_22 | 256 | 5918 | 957 | 319 | 151 | 9.0(10)-9 | Escherichia coli | b1533 | [pn:hypothetical 28.7 kd protein in marb-dcp intergenic region] [gn:yded] |
| CONTIG227 | 3382959_c2_10 | 257 | 5919 | 287 | 95 | 231 | 2.0(10)-19 | Escherichia coli | b1099 | [pn:dna polymerase iii, delta'' subunit] [gn:holb] |
| CONTIG227 | 19800956_c3_11 | 258 | 5920 | 873 | 291 | 1259 | 2.2(10)-128 | Escherichia coli | b1100 | [pn:hypothetical protein in holb-ptsg intergenic region] [gn:ych] |
| CONTIG227 | 24010937_c3_12 | 259 | 5921 | 1467 | 489 | 2174 | 2.5(10)-225 | Escherichia coli | b1101 | [pn:pts system, glucose-specific iibc component] [gn:ptsg] |
| CONTIG228 | 15814663_c2_11 | 260 | 5922 | 531 | 177 | 144 | 9.0(10)-10 | Methanobacterium thermoautotrophicum | MTH806 | [pr:protease iv] |

US 7,041,814 B1

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG228 | 26598393_c3_13 | 261 | 5923 | 738 | 246 | 95 | 0.024 | Methanobacterium thermoautotrophicum | MTH466 | [pn:unknown] |
| CONTIG229 | 12927341_f2_3 | 262 | 5924 | 825 | 275 | 1127 | 2.2(10)-114 | Escherichia coli | b2741 | [pn:rna polymerase sigma subunit rpos] [gn:rpos] |
| CONTIG229 | 15673942_f3_4 | 263 | 5925 | 1095 | 365 | 1130 | 1.1(10)-114 | Escherichia coli | b2742 | [pn:lipoprotein nlpd precursor] [gn:nlpd] |
| CONTIG23 | 2464555_c1_3 | 264 | 5926 | 390 | 130 | 100 | 1.5(10)-5 | Escherichia coli | b4283 | [pn:insertion element is 911 hypothetical 11.6 kd protein] [gn:yi91] |
| CONTIG230 | 9860003_f2_4 | 265 | 5927 | 1815 | 605 | 277 | 3.3(10)-21 | Bacteriophage T7 | P03692 | dna primase, chains a and b (ec 2.7.7.—). |
| CONTIG230 | 32505283_f3_6 | 266 | 5928 | 1029 | 343 | 272 | 2.2(10)-23 | Escherichia coli | b1149 | [pn:hypothetical protein] |
| CONTIG231 | 11963255_f2_3 | 267 | 5929 | 546 | 182 | 382 | 2.0(10)-35 | Escherichia coli | b0633 | [pn:rare lipoprotein a precursor] [gn:rlpa] |
| CONTIG231 | 12363162_f2_5 | 268 | 5930 | 318 | 106 | 371 | 2.8(10)-34 | Escherichia coli | b0631 | [pn:hypothetical 9.8 kd protein in lipb-daca intergenic region] |
| CONTIG231 | 15723956_f3_6 | 269 | 5931 | 270 | 90 | 204 | 3.7(10)-16 | Escherichia coli | b0633 | [pn:rare lipoprotein a precursor] [gn:rlpa] |
| CONTIG231 | 25563161_f3_7 | 270 | 5932 | 1305 | 435 | 1920 | 2.1(10)-198 | Escherichia coli | b0632 | [pn:d-alanine carboxypeptidase] [gn:daca] |
| CONTIG231 | 32516510_f3_9 | 271 | 5933 | 687 | 229 | 858 | 7.2(10)-86 | Escherichia coli | b0630 | [pn:lipoate-protein ligase b] [gn:lipb] |
| CONTIG232 | 25839831_f1_1 | 272 | 5934 | 1161 | 387 | 1782 | 8.6(10)-184 | Escherichia coli | b0677 | [pn:n-acetylglucosamine-6-phosphate deacetylase] [gn:naga] |
| CONTIG232 | 3009677_f3_5 | 273 | 5935 | 804 | 268 | 1338 | 9.8(10)-137 | Escherichia coli | b0678 | [pn:glucosamine-6-phosphate isomerase] [gn:nagb] |
| CONTIG232 | 34174053_f3_7 | 274 | 5936 | 1197 | 399 | 1782 | 8.6(10)-184 | Escherichia coli | b0676 | [pn:n-acetylglucosamine repressor] [gn:nagc] |
| CONTIG233 | 26445952_c1_13 | 275 | 5937 | 345 | 115 | 285 | 3.7(10)-25 | Escherichia coli | b0551 | [pn:hypothetical protein] [gn:ybcq] |
| CONTIG233 | 3636038_c3_18 | 276 | 5938 | 636 | 212 | 159 | 8.4(10)-12 | Escherichia coli | b0798 | [pn:hypothetical 18.7 kd protein in rhle-ding/rarb intergenic region] [gn:ybia] |
| CONTIG236 | 4166305_c1_17 | 277 | 5939 | 651 | 217 | 174 | 2.2(10)-13 | Escherichia coli | b2846 | [pn:hypothetical protein] |
| CONTIG236 | 5353400_c3_22 | 278 | 5940 | 2436 | 812 | 3750 | 0 | Escherichia coli | b0221 | [pn:hypothetical protein] |
| CONTIG236 | 4191068_c3_23 | 279 | 5941 | 789 | 263 | 1171 | 4.9(10)-119 | Escherichia coli | b0219 | [pn:hypothetical protein] [gn:yafv] |
| CONTIG237 | 21517313_f1_1 | 280 | 5942 | 498 | 166 | 483 | 3.8(10)-46 | Escherichia coli | b4365 | [pn:hypothetical 27.0 kd protein in dnat-hold intergenic region] |
| CONTIG237 | 24705188_f2_10 | 281 | 5943 | 1149 | 383 | 478 | 1.3(10)-45 | Bacillus subtilis | licC | [pn:phosphotransferase system] [gn:celb]; [pn:pts system, cellobiose-specific iic component] [gn:bbb04] [nt:similar to gb] |
| CONTIG237 | 30557000_f2_11 | 282 | 5944 | 213 | 71 | 93 | 0.00079 | Borrelia burgdorferi | AE000792 | [dc:borrelia burgdorferi plasmid cp26, complete plasmid sequence.] |
| CONTIG237 | 24431568_f3_14 | 283 | 5945 | 690 | 230 | 494 | 2.7(10)-47 | Escherichia coli | b4366 | [pn:hypothetical 25.6 kd protein in dnat-hold intergenic region] [gn:yjir] |
| CONTIG237 | 14237692_c1_17 | 284 | 5946 | 801 | 267 | 964 | 4.2(10)-97 | Escherichia coli | b4367 | [pn:hypothetical 30.1 kd protein in dnat-hold intergenic region] [gn:yjjs] |
| CONTIG237 | 22765961_c1_20 | 285 | 5947 | 492 | 164 | 335 | 1.8(10)-30 | Bacillus subtilis | ywhH | [pn:hypothetical protein] |
| CONTIG238 | 2382277_f3_9 | 286 | 5948 | 1005 | 335 | 1289 | 1.5(10)-131 | Escherichia coli | b3862 | [pn:hypothetical 36.3 kd protein in pola 5"" region] [gn:yihg] |
| CONTIG238 | 21488165_f3_12 | 287 | 5949 | 555 | 185 | 552 | 1.8(10)-53 | Escherichia coli | b3857 | [pn:molybdopterin-guanine dinucleotide biosynthesis protein a] [gn:moba] |
| CONTIG238 | 2034766_c1_13 | 288 | 5950 | 300 | 100 | 442 | 8.6(10)-42 | Escherichia coli | b3858 | [pn:hypothetical 10.3 kd protein in moba 3"" region] [gn:yihd] |
| CONTIG238 | 25603875_c1_14 | 289 | 5951 | 1002 | 334 | 1428 | 2.7(10)-146 | Escherichia coli | b3859 | [pn:hypothetical 38.1 kd protein in dsba 5"" region] [gn:yihe] |
| CONTIG238 | 12614200_c1_15 | 290 | 5952 | 651 | 217 | 867 | 8.0(10)-87 | Escherichia coli | b3860 | [pn:dsba] [gn:dsba] |
| CONTIG239 | 1306513_f1_3 | 291 | 5953 | 264 | 88 | 339 | 7.0(10)-31 | Escherichia coli | b1203 | [pn:hypothetical grp-binding protein in pth 3"" region] [gn:ychf] |
| CONTIG239 | 4948290_f1_6 | 292 | 5954 | 249 | 83 | 154 | 1.3(10)-10 | Escherichia coli | b1203 | [pn:hypothetical grp-binding protein in pth 3"" region] [gn:ychf] |
| CONTIG239 | 4948291_c1_17 | 293 | 5955 | 306 | 102 | 186 | 1.8(10)-14 | Escherichia coli | b1203 | [pn:hypothetical grp-binding protein in pth 3"" region] [gn:ychf] |
| CONTIG239 | 3395628_c1_19 | 294 | 5956 | 1332 | 444 | 253 | 2.2(10)-28 | Escherichia coli | b0703 | hypothetical 17.5 kd protein in tk-vs intergenic region. |
| CONTIG239 | 5273307_c2_22 | 295 | 5957 | 804 | 268 | 126 | 6.4(10)-8 | coliphage T4 | P13309 | [pn:csra] [gn:csra] |
| CONTIG240 | 26753130_c1_15 | 296 | 5958 | 204 | 68 | 298 | 1.6(10)-26 | Escherichia coli | b2696 | [pn:alanyl-trna synthetase] [gn:alas] |
| CONTIG240 | 35554527_c1_16 | 297 | 5959 | 267 | 89 | 218 | 8.1(10)-17 | Escherichia coli | b2697 | [pn:alanyl-trna synthetase] [gn:alas] |
| CONTIG240 | 36611683_c3_17 | 298 | 5960 | 2121 | 707 | 2566 | 7.2(10)-267 | Escherichia coli | b2697 | [pn:alanyl-trna synthetase] [gn:alas] |
| CONTIG241 | 3224078_f2_1 | 299 | 5961 | 897 | 299 | 135 | 8.0(10)-9 | Escherichia coli | b2358 | [pn:hypothetical protein] [gn:yfdo] |
| CONTIG241 | 636327_f1_3 | 300 | 5962 | 657 | 219 | 157 | 1.3(10)-11 | Escherichia coli | b1361 | [pn:hypothetical protein] |
| CONTIG241 | 4900300_f2_4 | 301 | 5963 | 417 | 139 | 350 | 4.9(10)-32 | Escherichia coli | b1358 | [pn:hypothetical protein] |
| CONTIG241 | 3620762_f2_6 | 302 | 5964 | 378 | 126 | 127 | 2.1(10)-8 | Synechocystis sp. | S74697 | [PN:hypothetical protein sl11193] [OR:Synechocystis sp.] [SR:PCC 6803., PCC 6803.] |
| CONTIG242 | 35745317_c1_14 | 303 | 5965 | 615 | 205 | 117 | 0.00012 | Helicobacter pylori | HP0966 | [pn:conserved hypothetical protein] |
| CONTIG242 | 4491678_f2_5 | 304 | 5966 | 726 | 242 | 1200 | 4.0(10)-122 | Escherichia coli | b4401 | [pn:aerobic respiration control protein arca] [gn:arca] |
| CONTIG242 | 10954577_c2_15 | 305 | 5967 | 687 | 229 | 834 | 2.5(10)-83 | Escherichia coli | b4403 | [pn:hypothetical 25.3 kd protein in arca-thrl intergenic |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG242 | 4098393_c3_16 | 306 | 5968 | 480 | 160 | 698 | 6.4(10)-69 | Escherichia coli | b4397 | region] 8 gn:last] [pn:crea protein] [gn:crea] |
| CONTIG243 | 245337_c1_13 | 307 | 5969 | 864 | 288 | 249 | 2.3(10)-21 | Bacteriophage 186 | U32222 | or:bacteriophage 186 le:181 re:711 di:direct nt:orf38, similar to bacteriophage p2 i protein, |
| CONTIG243 | 23714843_c3_20 | 308 | 5970 | 840 | 280 | 163 | 1.7(10)-9 | Bacteriophage P2 | P26700 | probable tail fibre protein (gph). |
| CONTIG244 | 16658141_f1_2 | 309 | 5971 | 357 | 119 | 502 | 3.7(10)-48 | Escherichia coli | b4195 | [pn:hypothetical phosphotransferase enzyme ii] [gn:ptxa] |
| CONTIG244 | 24617338_f1_3 | 310 | 5972 | 663 | 221 | 1063 | 1.3(10)-107 | Escherichia coli | b4196 | [pn:hypothetical 23.6 kd protein in aidb-rpsf intergenic region] [gn:yjfv] |
| CONTIG244 | 4197943_f1_4 | 311 | 5973 | 870 | 290 | 1382 | 2.1(10)-141 | Escherichia coli | b4197 | [pn:hypothetical 32.0 kd protein in aidb-rpsf intergenic region] [gn:yjfs] |
| CONTIG244 | 22120707_f2_5 | 312 | 5974 | 654 | 218 | 897 | 5.2(10)-90 | Escherichia coli | b4193 | [pn:hypothetical 52.9 kd protein in aidb-rpsf intergenic region] [gn:yjft] |
| CONTIG244 | 5156693_f2_6 | 313 | 5975 | 318 | 106 | 421 | 1.5(10)-39 | Escherichia coli | b4194 | [pn:hypothetical 10.9 kd protein in aidb-rpsf intergenic region] [gn:ptxa] |
| CONTIG244 | 4473818_f2_7 | 314 | 5976 | 186 | 62 | 188 | 7.0(10)-15 | Escherichia coli | b4195 | [pn:hypothetical phosphotransferase enzyme ii] [gn:ptxa] |
| CONTIG244 | 24870965_f2_11 | 315 | 5977 | 570 | 190 | 706 | 9.1(10)-70 | Escherichia coli | b4198 | [pn:hypothetical protein] [gn:sgae] |
| CONTIG244 | 31377187_f2_6 | 316 | 5978 | 708 | 236 | 107 | 0.00058 | Escherichia coli | b4366 | [pn:hypothetical 25.6 kd protein in dnat-hold intergenic region] [gn:yjir] |
| CONTIG245 | 198377_f3_9 | 317 | 5979 | 762 | 254 | 107 | 0.0023 | Escherichia coli | b0457 | [pn:hypothetical protein] [gn:ylab] |
| CONTIG245 | 25583543_c2_16 | 318 | 5980 | 186 | 62 | 220 | 2.8(10)-18 | Escherichia coli | b3661 | [pn:lipoprotein-28 precursor] [gn:nlpa] |
| CONTIG245 | 1270761_c2_17 | 319 | 5981 | 555 | 185 | 750 | 2.0(10)-74 | Escherichia coli | b3661 | [pn:lipoprotein-28 precursor] [gn:nlpa] |
| CONTIG246 | 35722707_f1_4 | 320 | 5982 | 240 | 80 | 168 | 9.4(10)-13 | Zea mays | S58640 | hypothetical protein 137 - maize chloroplast |
| CONTIG246 | 31910000_c1_15 | 321 | 5983 | 237 | 79 | 351 | 3.7(10)-32 | Escherichia coli | b3319 | [pn:50s ribosomal subunit protein 14] [gn:rpld] |
| CONTIG246 | 22847717_c1_17 | 322 | 5984 | 819 | 273 | 1094 | 7.0(10)-111 | Escherichia coli | b3314 | [pn:30s ribosomal subunit protein s3] [gn:rpsc] |
| CONTIG246 | 3213568_c1_18 | 323 | 5985 | 423 | 141 | 675 | 1.8(10)-66 | Escherichia coli | b3313 | [pn:50s ribosomal subunit protein 116] [gn:rplp] |
| CONTIG246 | 34627178_c2_19 | 324 | 5986 | 843 | 281 | 1349 | 6.7(10)-138 | Escherichia coli | b3317 | [pn:50s ribosomal subunit protein 122] [gn:rplb] |
| CONTIG246 | 5289213_c2_20 | 325 | 5987 | 342 | 114 | 469 | 1.2(10)-44 | Escherichia coli | b3315 | [pn:50s ribosomal subunit protein s17] [gn:rplv] |
| CONTIG246 | 2500038_c2_22 | 326 | 5988 | 270 | 90 | 325 | 2.2(10)-29 | Escherichia coli | b3311 | [pn:30s ribosomal subunit protein s19] [gn:rpsq] |
| CONTIG246 | 35282943_c3_23 | 327 | 5989 | 315 | 105 | 209 | 4.2(10)-17 | Escherichia coli | b3318 | [pn:50s ribosomal subunit protein 123] [gn:rplw] |
| CONTIG246 | 32134658_c3_26 | 328 | 5990 | 282 | 94 | 441 | 1.1(10)-41 | Escherichia coli | b3316 | [pn:30s ribosomal subunit protein s19] [gn:rpss] |
| CONTIG246 | 6004788_c3_27 | 329 | 5991 | 204 | 68 | 210 | 3.2(10)-17 | Escherichia coli | b3312 | [pn:50s ribosomal subunit protein 129] [gn:rpmc] |
| CONTIG247 | 3125207_f1_1 | 330 | 5992 | 1308 | 436 | 1735 | 8.3(10)-179 | Escherichia coli | b1309 | [pn:hypothetical protein] |
| CONTIG247 | 20593891_f1_2 | 331 | 5993 | 375 | 125 | 292 | 3.5(10)-25 | Escherichia coli | b1309 | [pn:hypothetical protein] |
| CONTIG247 | 24227265_f2_9 | 332 | 5994 | 1326 | 442 | 1595 | 5.7(10)-164 | Escherichia coli | b1310 | [pn:hypothetical protein] |
| CONTIG247 | 1630213_f2_10 | 333 | 5995 | 903 | 301 | 1055 | 9.5(10)-107 | Escherichia coli | b1311 | [pn:hypothetical protein] |
| CONTIG247 | 16835032_f3_15 | 334 | 5996 | 645 | 215 | 917 | 4.0(10)-92 | Escherichia coli | b1312 | [pn:hypothetical protein] |
| CONTIG248 | 17003167_f1_1 | 335 | 5997 | 459 | 153 | 607 | 2.7(10)-59 | Escherichia coli | b2210 | [pn:hypothetical 60.2 kd protein in eco-alkb intergenic region] [pn:hypothetical protein] |
| CONTIG248 | 125915_f1_2 | 336 | 5998 | 372 | 124 | 221 | 2.2(10)-18 | Escherichia coli | b1332 | [pn:hypothetical protein] |
| CONTIG248 | 35650802_f1_7 | 337 | 5999 | 410 | 137 | 516 | 1.2(10)-49 | Escherichia coli | b2186 | [pn:hypothetical 37.8 kd protein in rply-prol intergenic region] [gn:ycjk] |
| CONTIG248 | 16506555_c1_17 | 338 | 6000 | 1875 | 625 | 2506 | 1.7(10)-260 | Escherichia coli | b2188 | [pn:hypothetical 67.3 kd protein in rply-prol intergenic region] |
| CONTIG248 | 4976561_c2_22 | 339 | 6001 | 519 | 173 | 632 | 6.4(10)-62 | Escherichia coli | b2209 | [pn:tin precursor] [gn:eco] |
| CONTIG248 | 22369000_c3_24 | 340 | 6002 | 231 | 77 | 319 | 9.4(10)-29 | Escherichia coli | b2187 | [pn:hypothetical 8.3 kd protein in rply-prol intergenic region] |
| CONTIG249 | 25507783_f1_2 | 341 | 6003 | 1458 | 486 | 2340 | 6.5(10)-243 | Escherichia coli | S70165 | [pn:hypothetical protein] [gn:yojh] |
| CONTIG249 | 35807766_f2_4 | 342 | 6004 | 732 | 244 | 963 | 5.2(10)-97 | Escherichia coli | S70163 | [pn:hypothetical protein] [gn:ylca] |
| CONTIG249 | 546888_f2_5 | 343 | 6005 | 711 | 237 | 620 | 1.2(10)-60 | Escherichia coli | b0571 | [pn:hypothetical 13.4 kd protein in argw 3''''] |
| CONTIG249 | 10563465_f3_9 | 344 | 6006 | 413 | 138 | 102 | 9.3(10)-6 | Escherichia coli | b2861 | [pn:insertion element is2 hypothetical 13.4 kd protein in argw 3''''] |
| CONTIG250 | 12277217_c1_14 | 345 | 6007 | 1230 | 410 | 937 | 3.0(10)-94 | Escherichia coli | b2349 | [pn:putative phophage sf6-like integrase in argw 3'''' region] |
| CONTIG250 | 35552032_c2_15 | 346 | 6008 | 1227 | 409 | 1710 | 3.7(10)-176 | Escherichia coli | b0243 | [pn:gamma-glutamyl phosphate reductase] [gn:proa] |
| CONTIG251 | 34417067_c1_12 | 347 | 6009 | 399 | 133 | 631 | 8.0(10)-62 | Escherichia coli | b3306 | [pn:30s ribosomal subunit protein s8] [gn:rpsh] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG251 | 34198580_c1_13 | 348 | 6010 | 546 | 182 | 850 | 5.0(10)-85 | *Escherichia coli* | b3305 | [pn:50s ribosomal subunit protein 16] [gn:rplf] |
| CONTIG251 | 4020268_c1_14 | 349 | 6011 | 363 | 121 | 434 | 6.0(10)-41 | *Escherichia coli* | b3304 | [pn:50s ribosomal subunit protein 118] [gn:rplr] |
| CONTIG251 | 23572211_c1_18 | 350 | 6012 | 927 | 309 | 1047 | 6.7(10)-106 | *Escherichia coli* | b3300 | [pn:preprotein translocase secy subunit] [gn:secy] |
| CONTIG251 | 5267592_c3_22 | 351 | 6013 | 510 | 170 | 829 | 8.5(10)-83 | *Escherichia coli* | b3303 | [pn:30s ribosomal subunit protein s5] [gn:rpse] |
| CONTIG251 | 16832370_c3_23 | 352 | 6014 | 186 | 62 | 283 | 6.0(10)-25 | *Escherichia coli* | b3302 | [pn:50s ribosomal subunit protein 130] [gn:rpmd] |
| CONTIG251 | 259713_c3_24 | 353 | 6015 | 438 | 146 | 398 | 4.0(10)-37 | *Escherichia coli* | b3301 | [pn:50s ribosomal subunit protein 115] [gn:rplo] |
| CONTIG252 | 4698250_c1_32 | 354 | 6016 | 273 | 91 | 215 | 9.8(10)-18 | *Escherichia coli* | b1346 | [pn:hypothetical protein] |
| CONTIG252 | 11744091_c3_43 | 355 | 6017 | 1389 | 463 | 306 | 1.1(10)-24 | *Escherichia coli* | b1350 | [pn:exodeoxyribonuclease viii] [gn:rece] |
| CONTIG252 | 2845092_c3_45 | 356 | 6018 | 1392 | 464 | 1150 | 8.1(10)-117 | *Escherichia coli* | b1345 | [pn:hypothetical protein] |
| CONTIG253 | 29503136_f1_1 | 357 | 6019 | 522 | 174 | 338 | 9.0(10)-31 | *Escherichia coli* | b3981 | [pn:preprotein translocase sece subunit] [gn:sece] |
| CONTIG253 | 1035760_f3_2 | 358 | 6020 | 1221 | 407 | 1578 | 3.6(10)-162 | *Escherichia coli* | b3339 | [pn:elongation factor tu] [gn:tufa] |
| CONTIG253 | 5281893_f3_7 | 359 | 6021 | 555 | 185 | 927 | 3.5(10)-93 | *Escherichia coli* | b3982 | [pn:transcription antitermination protein nusg] [gn:nusg] |
| CONTIG254 | 3416407_f1_8 | 360 | 6022 | 309 | 103 | 365 | 1.2(10)-33 | *Escherichia coli* | b2609 | [pn:30s ribosomal subunit protein s16] [gn:rpsp] |
| CONTIG254 | 7144130_f1_9 | 361 | 6023 | 555 | 185 | 812 | 5.4(10)-81 | *Escherichia coli* | b2608 | [pn:hypothetical 21.0 kd protein in trmd-rpsp intergenic region] |
| CONTIG254 | 22789178_f2_10 | 362 | 6024 | 441 | 147 | 622 | 7.2(10)-61 | *Escherichia coli* | b2614 | [pn:heat shock protein] [gn:grpe] |
| CONTIG254 | 12268766_f2_12 | 363 | 6025 | 1389 | 463 | 1971 | 8.1(10)-204 | *Escherichia coli* | b2610 | [pn:signal recognition particle protein] [gn:ffh] |
| CONTIG254 | 26366082_f2_14 | 364 | 6026 | 786 | 262 | 1233 | 1.3(10)-125 | *Escherichia coli* | b2607 | [pn:guanine-7methyltransferase] [gn:trmd] |
| CONTIG254 | 16304761_c1_27 | 365 | 6027 | 888 | 296 | 1070 | 2.5(10)-108 | *Escherichia coli* | b2611 | [pn:hypothetical protein] |
| CONTIG254 | 1385936_c2_37 | 366 | 6028 | 1302 | 434 | 934 | 6.2(10)-94 | *Escherichia coli* | b2613 | [pn:hypothetical protein in grpe 3'''' region] [gn:yfid] |
| CONTIG255 | 3028941_f2_6 | 367 | 6029 | 1095 | 365 | 1318 | 1.2(10)-113 | *Escherichia coli* | b1620 | [pn:repressor protein] [gn:malj] |
| CONTIG255 | 19922527_c1_11 | 368 | 6030 | 693 | 231 | 794 | 4.2(10)-79 | *Escherichia coli* | b1621 | [pn:pts system, maltose and glucose-specific ii abc component] [gn:malx] |
| CONTIG255 | 1364218_c1_12 | 369 | 6031 | 603 | 201 | 785 | 3.8(10)-78 | *Escherichia coli* | b1622 | [pn:maly protein] [gn:maly] |
| CONTIG255 | 1036625_c2_15 | 370 | 6032 | 993 | 331 | 1307 | 1.8(10)-133 | *Escherichia coli* | b1621 | [pn:pts system, maltose and glucose-specific ii abc component] [gn:malx] |
| CONTIG256 | 33725701_f3_1 | 371 | 6033 | 1035 | 345 | 1335 | 2.0(10)-136 | *Escherichia coli* | b1235 | [pn:hnr protein] [gn:hnr] |
| CONTIG256 | 1299183_f2_4 | 372 | 6034 | 954 | 318 | 1218 | 5.0(10)-124 | *Escherichia coli* | b1234 | [pn:hypothetical 34.4 kd protein in hnr-puru intergenic region] |
| CONTIG256 | 32126890_f2_6 | 373 | 6035 | 840 | 280 | 950 | 1.3(10)-95 | *Escherichia coli* | b1236 | [pn:glucose-1-phosphate uridylyltransferase] [gn:ga] |
| CONTIG256 | 14572040_c1_15 | 374 | 6036 | 891 | 297 | 1318 | 1.3(10)-134 | *Escherichia coli* | b1232 | [pn:formyltetrahydrofolate deformylase] [gn:puru] |
| CONTIG256 | 31416_c2_18 | 375 | 6037 | 495 | 165 | 542 | 2.2(10)-52 | *Escherichia coli* | b1233 | [pn:hypothetical 17.0 kd protein in hnr-puru intergenic region] [gn:ychj] |
| CONTIG257 | 32145043_f2_3 | 376 | 6038 | 222 | 742 | 235 | 7.5(10)-20 | synthetic construct | M15619 | or:artificial sequence le:29 re:>232 di:direct src. *coli* (strain se5000) synthetic dna, clone pkb1 nt:orf16-lacz fusion protein |
| CONTIG258 | 12781963_c3_15 | 377 | 6039 | 189 | 63 | 101 | 1.2(10)-5 | *Homo sapiens* | A44803 | pg1 protein - human (fragment) |
| CONTIG258 | 22438128_f2_4 | 378 | 6040 | 645 | 215 | 846 | 1.3(10)-84 | *Escherichia coli* | b3740 | [pn:glucose inhibited division protein] [gn:gidb] |
| CONTIG258 | 24277186_f2_5 | 379 | 6041 | 411 | 137 | 600 | 1.6(10)-58 | *Escherichia coli* | b3738 | [pn:atp synthase f0 subunit a] [gn:atpb] |
| CONTIG258 | 13147637_f3_6 | 380 | 6042 | 1947 | 649 | 2757 | 4.2(10)-287 | *Escherichia coli* | b3741 | [pn:glucose inhibited division protein] [gn:gida] |
| CONTIG258 | 2071915_f3_7 | 381 | 6043 | 456 | 152 | 436 | 3.7(10)-41 | *Escherichia coli* | b3739 | [pn:atp synthase subunit] [gn:atpi] |
| CONTIG258 | 881516_f2_5 | 382 | 6044 | 768 | 256 | 441 | 1.1(10)-41 | *Escherichia coli* | b2110 | [pn:hypothetical 26.6 kd fimbrial chaperone in mrp 5'''' region] [gn:yehc] |
| CONTIG259 | 3007955_f2_6 | 383 | 6045 | 2508 | 836 | 1320 | 7.9(10)-135 | *Escherichia coli* | b2109 | [pn:hypothetical outer membrane usher protein in mrp 5'''' region] [gn:yehb] |
| CONTIG259 | 3948925_f2_7 | 384 | 6046 | 1080 | 360 | 147 | 9.5(10)-8 | *Escherichia coli* | b2108 | [pn:hypothetical 36.9 kd protein in mrp 5'''' region precursor] [gn:yeha] |
| CONTIG260 | 87513_c3_25 | 385 | 6047 | 498 | 166 | 176 | 1.5(10)-13 | *Escherichia coli* | b2217 | [pn:regulator of capsule synthesis b component] [gn:rcsb] |
| CONTIG260 | 16848787_f1_10 | 386 | 6048 | 1545 | 515 | 2236 | 6.7(10)-232 | *Escherichia coli* | b2411 | [pn:dna ase] [gn:lig] |
| CONTIG260 | 4114465_f3_11 | 387 | 6049 | 603 | 201 | 865 | 1.3(10)-86 | *Escherichia coli* | b2411 | [pn:dna ase] [gn:lig] |
| CONTIG260 | 5257752_f3_14 | 388 | 6050 | 951 | 317 | 1146 | 2.2(10)-116 | *Escherichia coli* | b2409 | [pn:hypothetical protein] |
| CONTIG260 | 1188966_c1_19 | 389 | 6051 | 1020 | 340 | 1320 | 7.9(10)-135 | *Escherichia coli* | b2410 | [pn:hypothetical 36.4 kd protein in xapb-lig intergenic region] [gn:rtn] |
| CONTIG261 | 35816301_f1_1 | 390 | 6052 | 1587 | 529 | 1699 | 5.4(10)-175 | *Escherichia coli* | b2176 | [pn:hypothetical protein in ber 5''' region] [gn:yfeh] |
| CONTIG261 | 21676375_f1_2 | 391 | 6053 | 1881 | 627 | 2470 | 1.1(10)-256 | *Escherichia coli* | b2177 | [pn:hypothetical protein in ber 5''' region] [gn:yeja] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG261 | 5197318_f1_3 | 392 | 6054 | 834 | 278 | 1164 | 2.7(10)-118 | Escherichia coli | b2178 | [pn:hypothetical 40.4 kd protein in ber 5'''' region] [gn:yejb] |
| CONTIG261 | 35781511_f3_6 | 393 | 6055 | 294 | 98 | 394 | 1.1(10)-36 | Escherichia coli | b2175 | [pn:hypothetical protein] [gn:sspr] |
| CONTIG262 | 13930381_c2_20 | 394 | 6056 | 1512 | 504 | 735 | 7.7(10)-73 | Escherichia coli | b0139 | [pn:outermembrane usher protein htre precursor] [gn:htre] |
| CONTIG262 | 32287800_c2_22 | 395 | 6057 | 600 | 200 | 97 | 0.00459 | Escherichia coli | b2369 | [pn:putative positive transcription regulator evga] [gn:evga] |
| CONTIG262 | 22460963_c3_24 | 396 | 6058 | 1209 | 403 | 454 | 3.1(10)-42 | Escherichia coli | b3144 | [pn:hypothetical outer membrane usher protein in agal-mtr intergenic region] [gn:yraj] |
| CONTIG262 | 5286713_c3_25 | 397 | 6059 | 1161 | 387 | 107 | 0.016 | Saccharomyces cerevisiae | YOL155C | [pn:similarity to glucan 1,4-alpha-glucosidase mal5p] |
| CONTIG263 | 5119186_f1_3 | 398 | 6060 | 1214 | 405 | 98 | 0.23 | Saccharomyces cerevisiae | YCR089W | [pn:required for efficient mating] [gn:fig2] |
| CONTIG263 | 21641312_f2_4 | 399 | 6061 | 903 | 301 | 1471 | 7.9(10)-151 | Serratia marcescens | U62007 | rep protein,, rep hi2b, putative rep protein; similar to inchi plasmid r27 trae protein. |
| CONTIG263 | 3164077_f2_5 | 400 | 6062 | 789 | 263 | 121 | 5.7(10)-6 | Salmonella typhimurium | P12057 | |
| CONTIG264 | 34386086_f1_2 | 401 | 6063 | 642 | 214 | 873 | 1.8(10)-87 | Escherichia coli | b2302 | [pn:hypothetical protein] [gn:yfcg] |
| CONTIG264 | 12239405_f1_3 | 402 | 6064 | 444 | 148 | 560 | 2.7(10)-54 | Escherichia coli | b2303 | [pn:hypothetical protein] [gn:folx] |
| CONTIG264 | 14450385_f1_4 | 403 | 6065 | 513 | 171 | 178 | 8.1(10)-14 | Bacillus subtilis | yijcK | [pn:hypothetical protein] |
| CONTIG264 | 16286633_f2_10 | 404 | 6066 | 927 | 309 | 1223 | 1.5(10)-124 | Escherichia coli | b2304 | [pn:hypothetical protein] |
| CONTIG264 | 12001891_c1_24 | 405 | 6067 | 504 | 168 | 548 | 5.0(10)-53 | Escherichia coli | b2301 | [pn:hypothetical protein] [gn:yfcf] |
| CONTIG264 | 24634813_c2_25 | 406 | 6068 | 720 | 240 | 1065 | 8.3(10)-108 | Escherichia coli | b2306 | [pn:histidine transport atp-binding protein hisp] [gn:hisp] |
| CONTIG265 | 3145261_f1_1 | 407 | 6069 | 1050 | 350 | 1257 | 3.7(10)-128 | Escherichia coli | b2810 | [pn:hypothetical protein] [gn:ygdk] |
| CONTIG265 | 16258266_f2_2 | 408 | 6070 | 501 | 167 | 574 | 8.9(10)-56 | Escherichia coli | b2811 | [pn:hypothetical protein] |
| CONTIG265 | 32708250_f2_6 | 409 | 6071 | 210 | 70 | 301 | 7.5(10)-27 | Escherichia coli | b2810 | [pn:hypothetical protein] |
| CONTIG265 | 1536718_c2_20 | 410 | 6072 | 1134 | 378 | 1789 | 1.6(10)-184 | Escherichia coli | b2813 | [pn:membrane-bound lytic murein transglycosylase a precursor] [gn:mlta] |
| CONTIG265 | 10968768_c2_21 | 411 | 6073 | 813 | 271 | 1292 | 7.2(10)-132 | Escherichia coli | b2812 | [pn:hypothetical protein] [gn:ygdl] |
| CONTIG265 | 26756450_c3_29 | 412 | 6074 | 207 | 69 | 237 | 4.5(10)-20 | Escherichia coli | b2809 | [pn:hypothetical protein] |
| CONTIG266 | 30078286_f1_6 | 413 | 6075 | 462 | 154 | 452 | 7.5(10)-43 | Escherichia coli | b2171 | [pn:hypothetical 30.9 kd protein in frub 5'''' region] [gn:yeip] |
| CONTIG266 | 16453125_f3_24 | 414 | 6076 | 1272 | 424 | 1593 | 9.3(10)-164 | Escherichia coli | b2170 | [pn:hypothetical 42.7 kd protein in frub 5'''' region] [gn:yeio] |
| CONTIG266 | 2552157_c2_35 | 415 | 6077 | 996 | 332 | 1477 | 1.8(10)-151 | Escherichia coli | b2168 | [pn:1-phosphofructokinase] [gn:fruk] |
| CONTIG266 | 5195383_c3_42 | 416 | 6078 | 1167 | 389 | 1476 | 2.2(10)-151 | Escherichia coli | b2169 | [pn:pts system, fructose-specific iia/fpr component] |
| CONTIG266 | 14453287_c3_43 | 417 | 6079 | 1755 | 585 | 2135 | 3.3(10)-221 | Escherichia coli | b2167 | [pn:pts system, fructose-specific iibc component] [gn:fnua] |
| CONTIG267 | 36570837_f1_2 | 418 | 6080 | 2496 | 832 | 3364 | 0 | Escherichia coli | b3863 | [pn:dna polymerase i] [gn:pola] |
| CONTIG267 | 2464037_f1_4 | 419 | 6081 | 258 | 86 | 116 | 3.0(10)-7 | Archaeoglobus fulgidus | H69378 | [pn:hypothetical 19.1 kd protein in pola-hemn intergenic region] |
| CONTIG267 | 11890640_f3_12 | 420 | 6082 | 471 | 157 | 650 | 1.1(10)-63 | Escherichia coli | b3866 | [pn:dna polymerase i] 8 gn:pola] |
| CONTIG267 | 5260155_c1_16 | 421 | 6083 | 663 | 221 | 878 | 5.4(10)-88 | Escherichia coli | b3865 | [pn:hypothetical protein] [gn:yiha] |
| CONTIG268 | 5324008_c1_15 | 422 | 6084 | 650 | 216 | 795 | 3.3(10)-79 | Escherichia coli | b2572 | [pn:sigma-e factor negative regulatory protein] [gn:rsea] |
| CONTIG268 | 20109425_c1_18 | 423 | 6085 | 1632 | 544 | 2419 | 2.5(10)-251 | Escherichia coli | b2569 | [pn:gtp-binding protein lepa] [gn:lepa] |
| CONTIG268 | 29979502_c2_22 | 424 | 6086 | 492 | 164 | 513 | 2.6(10)-49 | Escherichia coli | b2570 | [pn:sigma-e factor regulatory protein rsec] [gn:rsec] |
| CONTIG268 | 24317933_c3_23 | 425 | 6087 | 1023 | 341 | 1294 | 4.5(10)-132 | Escherichia coli | b2571 | [pn:sigma-e factor regulatory protein seb precursor] [gn:rseb] |
| CONTIG269 | 2428216_f2_5 | 426 | 6088 | 243 | 81 | 94 | 0.0015 | Archaeoglobus fulgidus | H69378 | [pn:purine ntpase homolog] |
| CONTIG269 | 10269038_c2_22 | 427 | 6089 | 816 | 272 | 915 | 6.5(10)-92 | Escherichia coli | b0570 | [pn:hypothetical protein] [gn:ybcz] |
| CONTIG269 | 30111081_c2_23 | 428 | 6090 | 444 | 148 | 123 | 5.5(10)-8 | Synechocystis sp. | S77018 | [PN:hypothetical protein] 8 OR:Synechocystis sp.] [SR:PCC 6803,, PCC 6803] [SR:PCC 6803] , |
| CONTIG269 | 12620775_c3_27 | 429 | 6091 | 702 | 234 | 342 | 3.3(10)-31 | Escherichia coli | S70162 | [pn:urease alpha subunit] [gn:urea] |
| CONTIG27 | 6511700_f2_2 | 430 | 6092 | 396 | 132 | 192 | 2.5(10)-14 | Haemophilus influenzae | HI0539 | mercuric resistance operon regulatory protein |
| CONTIG270 | 14313817_f1_4 | 431 | 6093 | 768 | 256 | 727 | 5.5(10)-72 | Shigella flexneri | P07044 | or:enterobacter aerogenes pn:tnpa gn:tnpa le:10303 re:11307 di:complement |
| CONTIG270 | 31284383_f1_5 | 432 | 6094 | 351 | 117 | 553 | 1.5(10)-53 | Enterobacter aerogenes | U67194 | transposase for transposon tn3. |
| CONTIG270 | 31523431_f2_8 | 433 | 6095 | 3222 | 1074 | 4832 | 0 | Escherichia coli | P03008 | [pn:hypothetical protein, 13.1k] |
| CONTIG270 | 32204791_c1_14 | 434 | 6096 | 399 | 133 | 628 | 1.7(10)-61 | Enterobacteria ceae | S07447 | |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG270 | 1057266_c1_18 | 435 | 6097 | 438 | 146 | 122 | 4.7(10)-7 | Streptomyces fradiae | P20188 | hypothetical 44.4 kd protein in transposon tn4556. |
| CONTIG270 | 22550252_c1_19 | 436 | 6098 | 639 | 213 | 684 | 2.0(10)-67 | Escherichia coli | P03011 | transposon tn3 resolvase. |
| CONTIG270 | 25522168_c2_20 | 437 | 6099 | 297 | 99 | 165 | 2.0(10)-12 | Shigella flexneri | P04337 | hypothetical mercuric resistance protein merc. |
| CONTIG271 | 16820950_f1_1 | 438 | 6100 | 702 | 234 | 1040 | 3.7(10)-105 | Escherichia coli | b0437 | [pn:atp-dependent clp protease proteolytic subunit] [gn:clpp] |
| CONTIG271 | 183188_f2_3 | 439 | 6101 | 1332 | 444 | 1904 | 1.0(10)-196 | Escherichia coli | b0438 | [pn:atp-dependent clp protease atp-binding subunit clpx] [gn:clpx] |
| CONTIG271 | 2500431_f3_7 | 440 | 6102 | 1695 | 565 | 2578 | 3.8(10)-268 | Escherichia coli | b0439 | [pn:lon protease] [gn:lon] |
| CONTIG271 | 35736527_c1_10 | 441 | 6103 | 225 | 75 | 99 | 4.0(10)-5 | Bacillus subtilis | Z75208 | or:bacillus subtilis pn:hypothetical protein gn:ysoc le:80592 re:81206 di:complement nt:unknown function; putative |
| CONTIG271 | 11067152_c1_11 | 442 | 6104 | 192 | 64 | 112 | 1.3(10)-6 | Bacillus subtilis | Z75208 | or:bacillus subtilis pn:hypothetical protein gn:ysoc le:80592 re:81206 di:complement nt:unknown function; putative |
| CONTIG272 | 36595388_f1_4 | 443 | 6105 | 483 | 161 | 113 | 6.2(10)-7 | Escherichia coli | b1031 | [pn:hypothetical protein] 8 [gn:ycdv] |
| CONTIG272 | 16526588_f2_7 | 444 | 6106 | 1119 | 373 | 1440 | 1.5(10)-147 | Escherichia coli | b1020 | [pn:ploh protein] [gn:ploh] |
| CONTIG272 | 36220786_f2_8 | 445 | 6107 | 186 | 62 | 117 | 2.3(10)-7 | Escherichia coli | b1031 | [pn:hypothetical protein] 8 [gn:ycdv] |
| CONTIG272 | 16853317_f3_9 | 446 | 6108 | 270 | 90 | 310 | 8.4(10)-28 | Escherichia coli | b1017 | [pn:hypothetical protein] |
| CONTIG272 | 13851425_f3_10 | 447 | 6109 | 1155 | 385 | 1589 | 2.5(10)-163 | Escherichia coli | b1018 | [pn:hypothetical protein] |
| CONTIG272 | 25978458_f3_11 | 448 | 6110 | 1287 | 429 | 1830 | 7.0(10)-189 | Escherichia coli | b1019 | [pn:hypothetical protein in phoh 5'''' region] [gn:ycdv] |
| CONTIG272 | 3251026_f3_13 | 449 | 6111 | 312 | 104 | 106 | 3.5(10)-6 | Escherichia coli | b1031 | [pn:hypothetical protein] 8 [gn:ycdv] |
| CONTIG273 | 5370841_f1_1 | 450 | 6112 | 1809 | 603 | 2802 | 7.0(10)-292 | Escherichia coli | b0680 | [pn:glutaminyl-trna synthetase] [gn:glns] |
| CONTIG273 | 13931505_f1_2 | 451 | 6113 | 615 | 205 | 948 | 2.1(10)-95 | Escherichia coli | b0681 | [pn:hypothetical protein] |
| CONTIG273 | 267062_f3_12 | 452 | 6114 | 2001 | 667 | 2384 | 1.3(10)-247 | Escherichia coli | b0679 | [pn:pts system, n-acetylglucosamine-specific iiabc component] [gn:nage] |
| CONTIG273 | 26659787_c3_23 | 453 | 6115 | 861 | 287 | 90 | 0.024 | Homo sapiens | I53641 | mucin - human (fragment) |
| CONTIG274 | 35752258_f2_2 | 454 | 6116 | 1101 | 367 | 1209 | 4.5(10)-123 | Escherichia coli | b0356 | [pn:alcohol -- acetaldehyde dehydrogenase] [gn:adhc] |
| CONTIG274 | 20490962_f3_5 | 455 | 6117 | 312 | 104 | 243 | 1.1(10)-20 | Escherichia coli | b0357 | [pn:hypothetical protein] |
| CONTIG274 | 32594790_f3_8 | 456 | 6118 | 312 | 104 | 331 | 5.0(10)-30 | Haemophilus influenzae | HI0185 | [pn:putative alcohol dehydrogenase class iii] [gn:adhc] |
| CONTIG274 | 24234380_f3_9 | 457 | 6119 | 1551 | 517 | 1357 | 9.5(10)-139 | Escherichia coli | b1421 | [pn:methyl-accepting chemotaxis protein iii] [gn:trg] |
| CONTIG274 | 4837_c2_18 | 458 | 6120 | 501 | 167 | 419 | 2.3(10)-39 | Escherichia coli | b1931 | [pn:yedk] [gn:yedk] |
| CONTIG274 | 31532686_c2_19 | 459 | 6121 | 333 | 111 | 486 | 1.8(10)-46 | Escherichia coli | b1931 | [pn:yedk] [gn:yedk] |
| CONTIG275 | 9892787_f1_1 | 460 | 6122 | 429 | 143 | 582 | 1.3(10)-56 | Escherichia coli | b0240 | [pn:curlin genes transcriptional activator] [gn:crl] |
| CONTIG275 | 31355201_f2_4 | 461 | 6123 | 507 | 169 | 731 | 2.1(10)-72 | Escherichia coli | b0239 | [pn:hypothetical protein in gpt-crl intergenic region] [gn:yafa] |
| CONTIG275 | 866576_f3_10 | 462 | 6124 | 1143 | 381 | 1784 | 5.4(10)-184 | Escherichia coli | b0242 | [pn:glutamate 5-kinase] [gn:prob] |
| CONTIG275 | 3906666_c1_13 | 463 | 6125 | 1080 | 360 | 1533 | 2.1(10)-157 | Escherichia coli | b0241 | [pn:outer membrane pore protein e precursor] [gn:phoe] |
| CONTIG276 | 20604691_f1_2 | 464 | 6126 | 732 | 244 | 856 | 1.2(10)-85 | Escherichia coli | b0192 | [pn:copper homeostasis protein precursor] [gn:cutf] |
| CONTIG276 | 9961630_f2_8 | 465 | 6127 | 453 | 151 | 492 | 4.4(10)-47 | Escherichia coli | b0191 | [pn:hypothetical protein in acca-cutf intergenic region] [gn:yaej] |
| CONTIG276 | 34648825_f3_14 | 466 | 6128 | 564 | 188 | 842 | 3.5(10)-84 | Escherichia coli | b0190 | [pn:hypothetical protein in acca-cutf intergenic region] [gn:yaeq] |
| CONTIG276 | 24725817_c1_20 | 467 | 6129 | 183 | 61 | 290 | 1.1(10)-25 | Escherichia coli | b0196 | [pn:resf protein] [gn:resf] |
| CONTIG276 | 16100083_c1_21 | 468 | 6130 | 294 | 98 | 93 | 8.5(10)-5 | Escherichia coli | C47040 | orf3 3' to resf - escherichia coli |
| CONTIG276 | 907_c1_22 | 469 | 6131 | 1785 | 595 | 2738 | 4.2(10)-285 | Escherichia coli | b0194 | [pn:prolyl-trna synthetase] [gn:pros] |
| CONTIG276 | 326528_c2_30 | 470 | 6132 | 225 | 75 | 202 | 2.2(10)-16 | Escherichia coli | P52099 | [pn:hypothetical protein in gpt-crl mesj-cutf intergenic region. |
| CONTIG276 | 26066886_c3_31 | 471 | 6133 | 720 | 240 | 1037 | 7.7(10)-105 | Escherichia coli | b0195 | hypothetical 26.4 kd protein in pros-rcsf intergenic region] |
| CONTIG276 | 29886588_c1_14 | 472 | 6134 | 441 | 147 | 730 | 2.6(10)-72 | Serratia marcescens | U59129 | or:serratia marcescens pn:htdf gn:htdf le:29 re:454 di:direct |
| CONTIG276 | 26255000_c2_16 | 473 | 6135 | 3678 | 1226 | 92 | 0.68 | Anas platyrhynchos | U27213 | or:anas platyrhynchos pn:igm heavy chain, constant region domains one, gn:imu le:<1 re:1350 di:direct sr: domestic duck nt:presumed antibody; immunoglobulin heavy chain |
| CONTIG277 | 3937825_c3_17 | 474 | 6136 | 480 | 160 | 755 | 5.9(10)-75 | Plasmid R478 | A55209 | h transfer determinant a-plasmid r478 |
| CONTIG277 | 32687777_c3_18 | 475 | 6137 | 597 | 199 | 904 | 9.5(10)-91 | Serratia marcescens | U59129 | or:serratia marcescens pn:htdk gn:htdk le:463 re:996 di:direct |
| CONTIG278 | 1362586_f1_4 | 476 | 6138 | 519 | 173 | 249 | 2.3(10)-21 | Vibrio cholerae | S81006 | or:vibrio cholerae pn:hcp gn:hcp le:690 re:1208 di:direct sr:vibrion cholerae o17 nt:28 kds secreted hydrophilic protein, this sequence |
| CONTIG278 | 3333152_c2_17 | 477 | 6139 | 1284 | 428 | 1901 | 2.1(10)-196 | Escherichia coli | b1184 | [pn:umc protein] [gn:umuc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG278 | 21759555_c3_18 | 478 | 6140 | 474 | 158 | 568 | 3.7(10)-55 | Escherichia coli | b1183 | [pn:uumc protein] [gn:uumc] |
| CONTIG279 | 995266_c1_16 | 479 | 6141 | 948 | 316 | 122 | 2.7(10)-6 | Methanococcus jannaschii | MJ1494 | [pn:aaa superfamily atpase, similar to fish] |
| CONTIG279 | 2145887_c2_23 | 480 | 6142 | 522 | 174 | 604 | 5.9(10)-59 | Escherichia coli | AJ224995 | [de:escherichia coli ecorii restriction endonuclease gene.] [pn:restriction endonuclease] [gn:ecorii] |
| CONTIG28 | 476581_f1_1 | 481 | 6143 | 243 | 81 | 173 | 2.6(10)-12 | Escherichia coli | b4065 | [pn:hypothetical 60.5 kd protein in soxr-acs intergenic region] [gn:yjcc] |
| CONTIG28 | 2972882_f2_2 | 482 | 6144 | 315 | 105 | 133 | 5.2(10)-8 | Escherichia coli | b4065 | [pn:hypothetical 60.5 kd protein in soxr-acs intergenic region] [gn:yjcc] |
| CONTIG280 | 2360915_f3_13 | 483 | 6145 | 294 | 98 | 419 | 2.3(10)-39 | Enterobacter agglomerans | A38965 | hypothetical protein a (insertion sequence is1222)-enterobacter agglomerans |
| CONTIG280 | 36211006_c1_14 | 484 | 6146 | 2109 | 703 | 107 | 0.028 | Legionella pneumophila | AF026534 | [de:legionella pneumphila dot region ii, cita, doto, dotm, dote, dotf, dotg, doth, doti, dotj, dotk, dotl, and dotm genes, complete cds.] [pn:dotg] [gn:dotl] [nt:similar to trbc from the inci plasmid r64.] |
| CONTIG280 | 14538317_c2_15 | 485 | 6147 | 2613 | 871 | 104 | 0.03799 | Listeria monocytogenes | M80351 | or:listeria monocytogenes pn:p60-related protein le:1 re:1437 di:direct sr:listeria monocytogenes (serovar 1/2a mackancss) dna |
| CONTIG281 | 21567780_f2_8 | 486 | 6148 | 768 | 256 | 755 | 5.9(10)-75 | Escherichia coli | b4190 | [pn:hypothetical 27.6 kd protein in aidb-rpsf intergenic region] [gn:yjfo] |
| CONTIG281 | 2668152,6_c1_13 | 487 | 6149 | 759 | 253 | 1187 | 9.8(10)-121 | Escherichia coli | b4191 | [pn:hypothetical transcriptional regulator in aidb-rpsf intergenic region] [gn:yjfq] |
| CONTIG281 | 4392281_c1_15 | 488 | 6150 | 231 | 77 | 95 | 0.00025 | Nannocystis exedens | U66220 | or:nannocystis exedens pn:unknown le:<1 re:872 dr complement nt orf1 |
| CONTIG282 | 23609702_c2_16 | 489 | 6151 | 447 | 149 | 408 | 3.5(10)-38 | Escherichia coli | b4189 | [pn:hypothetical 16.0 kd protein in aidb-rpsf intergenic region] [gn:yhcf] |
| CONTIG282 | 32501253_c3_23 | 490 | 6152 | 333 | 111 | 309 | 1.1(10)-27 | Escherichia coli | b4188 | [pn:hypothetical 11.0 kd protein in aidb-rpsf intergenic region] [gn:yjfn] |
| CONTIG282 | 17080463_f2_12 | 491 | 6153 | 1182 | 394 | 1562 | 1.8(10)-160 | Escherichia coli | b4322 | [pn:mannonate hydratase] [gn:uxua] |
| CONTIG282 | 20752305_c1_18 | 492 | 6154 | 1482 | 494 | 2008 | 9.8(10)-208 | Escherichia coli | b2172 | [pn:hypothetical 54.0 kd protein in fruk 5'''' region] [gn:yeiq] |
| CONTIG282 | 13719178_c1_19 | 493 | 6155 | 1026 | 342 | 1336 | 1.6(10)-136 | Escherichia coli | b2173 | [pn:hypothetical 36.1 kd protein in frub-rtn intergenic region] [gn:yeir] |
| CONTIG282 | 895125_c1_20 | 494 | 6156 | 735 | 245 | 744 | 8.5(10)-74 | Escherichia coli | b2174 | [pn:hypothetical protein] |
| CONTIG283 | 32551313_f1_1 | 495 | 6157 | 369 | 123 | 362 | 2.6(10)-33 | Escherichia coli | b3228 | [pn:stringent starvation protein b] [gn:sspb] |
| CONTIG283 | 2385927_f1_3 | 496 | 6158 | 2436 | 812 | 1534 | 1.7(10)-157 | Escherichia coli | b3216 | [pn:hypothetical outer membrane usher protein in gltf-nant intergenic region] [gn:yhcd] |
| CONTIG283 | 4875010_f2_6 | 497 | 6159 | 816 | 272 | 565 | 8.0(10)-55 | Escherichia coli | b3215 | [pn:hypothetical 25.3 kd fimbrial chaperone protein in gltf-nant intergenic region] [gn:yhca] |
| CONTIG283 | 24415941_f3_8 | 498 | 6160 | 681 | 227 | 242 | 1.3(10)-20 | Escherichia coli | b3219 | [pn:hypothetical protein] [gn:yhcf] |
| CONTIG283 | 24415936_f3_10 | 499 | 6161 | 282 | 94 | 160 | 6.5(10)-12 | Escherichia coli | b3219 | [pn:hypothetical protein] [gn:yhcf] |
| CONTIG283 | 14081275_f1_1 | 500 | 6162 | 228 | 76 | 115 | 2.2(10)-6 | Escherichia coli | b1514 | [pn:hypothetical protein] |
| CONTIG284 | 23464702_f1_2 | 501 | 6163 | 978 | 326 | 771 | 1.2(10)-76 | Escherichia coli | b1515 | [pn:hypothetical protein] |
| CONTIG284 | 2294541.8_f1_6 | 502 | 6164 | 978 | 326 | 1134 | 4.0(10)-115 | Escherichia coli | b1517 | [pn:hypothetical protein] |
| CONTIG284 | 16130028_f2_8 | 503 | 6165 | 1056 | 352 | 1315 | 2.2(10)-134 | Escherichia coli | b1516 | [pn:hypothetical protein] |
| CONTIG284 | 31845937_f3_13 | 504 | 6166 | 543 | 181 | 353 | 2.2(10)-32 | Escherichia coli | b1518 | [pn:hypothetical protein] |
| CONTIG285 | 23922002_f2_1 | 505 | 6167 | 1338 | 446 | 1837 | 1.3(10)-189 | Escherichia coli | b1423 | [pn:hypothetical protein] |
| CONTIG285 | 31752501_c3_22 | 506 | 6168 | 960 | 320 | 1315 | 2.7(10)-134 | Escherichia coli | b1422 | [pn:hypothetical protein] |
| CONTIG286 | 7207808_f2_9 | 507 | 6169 | 1038 | 346 | 1460 | 1.2(10)-149 | Escherichia coli | b1097 | [pn:hypothetical 38.2 kd protein in pabc-holb intergenic region] [gn:yceg] |
| CONTIG286 | 26303760_f2_11 | 508 | 6170 | 759 | 253 | 822 | 4.7(10)-82 | Escherichia coli | b1099 | [pn:dna polymerase iii, delta'''' subunit] [gn:holb] |
| CONTIG286 | 84378_f3_12 | 509 | 6171 | 1299 | 433 | 1922 | 1.3(10)-198 | Escherichia coli | b1095 | [pn:3-oxoacyl-acyl-carrier-protein synthase ii] [gn:fabf] |
| CONTIG286 | 40198.18_f3_13 | 510 | 6172 | 819 | 273 | 864 | 1.7(10)-86 | Escherichia coli | b1096 | [pn:4-amino-4-deoxychorismate lyase] [gn:pabc] |
| CONTIG286 | 33988967_f3_15 | 511 | 6173 | 660 | 220 | 904 | 9.5(10)-91 | Escherichia coli | b1098 | [pn:hypothetical protein in pabc-holb intergenic region] [gn:tmk] |
| CONTIG287 | 20525451_f1_1 | 512 | 6174 | 1008 | 336 | 1549 | 4.2(10)-159 | Escherichia coli | b1779 | [pn:glyceraldehyde 3-phosphate dehydrogenase a] [gn:gapa] |
| CONTIG287 | 29951057_f3_8 | 513 | 6175 | 900 | 300 | 1148 | 1.3(10)-116 | Escherichia coli | b1780 | [pn:hypothetical protein] |
| CONTIG287 | 36135312_f3_11 | 514 | 6176 | 1574 | 525 | 2554 | 1.3(10)-265 | Escherichia coli | b1783 | [pn:hypothetical protein] |
| CONTIG287 | 20125050_c2_19 | 515 | 6177 | 774 | 258 | 934 | 6.2(10)-94 | Escherichia coli | b1782 | [pn:cell division protein ftsj] [gn:ftsj] |
| CONTIG288 | 206649_c1_21 | 516 | 6178 | 184 | 61 | 183 | 2.3(10)-14 | Escherichia coli | b3179 | [pn:hypothetical protein] |
| CONTIG288 | 2187917_c1_23 | 517 | 6179 | 933 | 311 | 1346 | 1.3(10)-137 | Escherichia coli | b3177 | [pn:dihydropteroate synthase] [gn:folp] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG288 | 34038453_c2_25 | 518 | 6180 | 288 | 96 | 374 | 1.3(10)-34 | Escherichia coli | b3179 | [pn:cell division protein ftsj] [gn:ftsj] |
| CONTIG288 | 23495385_c2_26 | 519 | 6181 | 1959 | 653 | 2979 | 0 | Escherichia coli | b3178 | [pn:cell division protein ftsh] [gn:ftsh] |
| CONTIG288 | 6491462_c2_28 | 520 | 6182 | 1125 | 375 | 1407 | 4.7(10)-144 | Escherichia coli | b3176 | [pn:mrsa protein] [gn:mrsa] |
| CONTIG288 | 14338511_f3_21 | 521 | 6183 | 2178 | 726 | 522 | 3.1(10)-49 | Achlya klebsiana | P41755 | nad-specific glutamate dehydrogenase (ec 1.4.1.2) (nad-gdh). |
| CONTIG289 | 2018505_c1_25 | 522 | 6184 | 687 | 229 | 433 | 7.7(10)-41 | Escherichia coli | b0019 | [pn:na] [gn:nhaA] |
| CONTIG289 | 4877327_c2_27 | 523 | 6185 | 1914 | 638 | 2830 | 7.7(10)-295 | Escherichia coli | b0014 | [pn:dnaK protein] [gn:dnaK] |
| CONTIG289 | 13672255_f2_28 | 524 | 6186 | 1011 | 337 | 922 | 1.2(10)-92 | Escherichia coli | b0019 | [pn:na] [gn:nhaA] |
| CONTIG289 | 26658142_c2_30 | 525 | 6187 | 987 | 329 | 1437 | 3.2(10)-147 | Escherichia coli | b0020 | [pn:transcriptional activator protein nhar] [gn:nhar] |
| CONTIG289 | 24471958_c3_35 | 526 | 6188 | 1116 | 372 | 1243 | 3.0(10)-146 | Escherichia coli | b0015 | [pn:dnaJ protein] [gn:dnaJ] |
| CONTIG290 | 9896067_f1_4 | 527 | 6189 | 318 | 106 | 273 | 7.0(10)-24 | Enterobacter agglomerans | B38965 | hypothetical protein b (insertion sequence is1222)- enterobacter agglomerans |
| CONTIG290 | 23609515_f2_8 | 528 | 6190 | 294 | 98 | 419 | 2.3(10)-39 | Enterobacter agglomerans | A38965 | hypothetical protein b (insertion sequence is1222)- enterobacter agglomerans |
| CONTIG290 | 22905462_f3_15 | 529 | 6191 | 561 | 187 | 866 | 1.0(10)-86 | Enterobacter agglomerans | B38965 | hypothetical protein b (insertion sequence is1222)- enterobacter agglomerans |
| CONTIG290 | 24500893_c2_21 | 530 | 6192 | 2418 | 806 | 110 | 0.012 | Escherichia coli | AF005044 | [PN:TraN] [GN:traN] [DE:Escherichia coli plasmid R100-1 TraV (traV), TraR (traR), OrfG1 (orfG1), OrfH (orfH), OrfI (orfI) TraC (traC), TrbI (trbI), TraW (traW), TraU (traU), TrbC (trbC), TraN (traN), TrbE (trbE) and TraF (traF) genes, c |
| CONTIG291 | 32225050_c2_24 | 531 | 6193 | 1680 | 560 | 286 | 5.5(10)-22 | Bacillus subtilis | yjcD | [pn:hypothetical protein] |
| CONTIG291 | 20370300_f2_10 | 532 | 6194 | 321 | 107 | 113 | 2.8(10)-6 | Rhizobium sp. | P55426 | hypothetical 34.2 kd protein [gn:ykqm] |
| CONTIG291 | 1050702_f3_13 | 533 | 6195 | 900 | 300 | 95 | 0.04 | Bacillus subtilis | ripX | [pn:integrase/recombinase] [gn:ykqm] |
| CONTIG291 | 33879001_f3_17 | 534 | 6196 | 729 | 243 | 324 | 8.4(10)-28 | Enterobacter aerogenes | P27190 | dna primase trac (ec 2.7.7.—) (replication primase). |
| CONTIG291 | 16020063_c3_33 | 535 | 6197 | 192 | 64 | 259 | 2.1(10)-22 | Enterobacter aerogenes | U67194 | or:enterobacter aerogenes pn:tnpa gn:tnpa le:13384 re:14388 di:direct |
| CONTIG292 | 4114091_f2_10 | 536 | 6198 | 480 | 160 | 439 | 1.8(10)-41 | Escherichia coli | M16489 | or:escherichia coli le:627 re:1199 di:complement sr:escherichia coli dna nt:orf4; putative |
| CONTIG292 | 24611566_c1_26 | 537 | 6199 | 450 | 150 | 644 | 3.3(10)-63 | Escherichia coli | b0736 | [pn:hypothetical 15.6 kd protein in cydb-tolq intergenic region] [gn:ybgc] |
| CONTIG292 | 802151_c1_28 | 538 | 6200 | 1128 | 376 | 211 | 2.8(10)-21 | Escherichia coli | b0739 | [pn:tolA] [pn:protein] [gn:tolA] |
| CONTIG292 | 1190692_c2_29 | 539 | 6201 | 1515 | 505 | 2417 | 4.5(10)-251 | Escherichia coli | b0733 | [pn:cytochrome d ubiquinol oxidase subunit i] [gn:cydA] |
| CONTIG292 | 21761538_c2_30 | 540 | 6202 | 1155 | 385 | 1632 | 6.7(10)-168 | Escherichia coli | b0734 | [pn:cytochrome d ubiquinol oxidase subunit ii] [gn:cydB] |
| CONTIG292 | 2867192_c3_38 | 541 | 6203 | 303 | 101 | 343 | 7.7(10)-31 | Escherichia coli | b0735 | [pn:10.9 kd protein in cydb-tolq intergenic region] [gn:ybgE] |
| CONTIG292 | 25509808_c3_39 | 542 | 6204 | 696 | 232 | 1068 | 4.0(10)-108 | Escherichia coli | b0737 | [pn:tolQ protein] [gn:tolQ] |
| CONTIG292 | 33728407_c3_40 | 543 | 6205 | 432 | 144 | 529 | 5.2(10)-51 | Escherichia coli | b0738 | [pn:tolR protein] [gn:tolR] |
| CONTIG293 | 20875925_f2_6 | 544 | 6206 | 903 | 301 | 1407 | 4.7(10)-144 | Escherichia coli | b3073 | [pn:probable ornithine aminotransferase] [gn:ygjG] |
| CONTIG293 | 24728780_f3_14 | 545 | 6207 | 576 | 192 | 844 | 2.2(10)-84 | Escherichia coli | b3073 | [pn:probable ornithine aminotransferase] [gn:ygjG] |
| CONTIG293 | 25509681_c1_20 | 546 | 6208 | 606 | 202 | 126 | 1.7(10)-7 | Escherichia coli | b1434 | [pn:hypothetical protein] |
| CONTIG294 | 10335302_f1_2 | 547 | 6209 | 414 | 138 | 421 | 1.5(10)-39 | Escherichia coli | b0530 | [pn:hypothetical protein] [gn:sfmA] |
| CONTIG294 | 13947040_f1_3 | 548 | 6210 | 612 | 204 | 558 | 4.4(10)-54 | Salmonella typhi | Q08456 | fibrin-like protein fimi. |
| CONTIG294 | 5963891_f1_5 | 549 | 6211 | 2586 | 862 | 2988 | 0 | Escherichia coli | b0532 | [pn:hypothetical protein] [gn:sfmD] |
| CONTIG294 | 25487750_f2_10 | 550 | 6212 | 738 | 246 | 660 | 6.9(10)-65 | Escherichia coli | b0531 | [pn:hypothetical protein] [gn:sfmC] |
| CONTIG294 | 26845900_f2_14 | 551 | 6213 | 1104 | 368 | 1037 | 7.7(10)-105 | Escherichia coli | b0533 | [pn:hypothetical protein] [gn:sfmH] |
| CONTIG294 | 391957_f3_17 | 552 | 6214 | 240 | 80 | 104 | 8.5(10)-6 | Escherichia coli | b0530 | [pn:hypothetical protein] [gn:sfmA] |
| CONTIG294 | 30338206_f3_23 | 553 | 6215 | 498 | 166 | 333 | 3.1(10)-30 | Escherichia coli | b0534 | [pn:hypothetical fimbrial-like protein in fimz 5'" region] [gn:sfmF] |
| CONTIG294 | 3242619_c1_25 | 554 | 6216 | 503 | 167 | 156 | 1.8(10)-11 | Salmonella typhimurium | P26318 | fimbriae y protein. |
| CONTIG294 | 10471711_c1_37 | 555 | 6217 | 276 | 92 | 249 | 2.3(10)-21 | Escherichia coli | b0529 | [pn:methylenetetrahydrofolate dehydrogenase] [gn:folD] |
| CONTIG294 | 12697187_c3_44 | 556 | 6218 | 636 | 212 | 687 | 9.4(10)-68 | Escherichia coli | b0535 | [pn:fimbriae z protein] [gn:fimZ] |
| CONTIG295 | 24647536_f1_6 | 557 | 6219 | 753 | 251 | 428 | 2.6(10)-40 | Bacteriophage P21 | P36693 | terminase large subunit (gp2) (fragments). |
| CONTIG295 | 3960443_f1_7 | 558 | 6220 | 333 | 111 | 139 | 1.1(10)-9 | Bacteriophage lambda | P03712 | head decoration protein (gpd) (major capsid protein d) |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG295 | 11207801_f2_16 | 559 | 6221 | 540 | 180 | 114 | 6.7(10)-7 | Bacteriophage lambda | J02459 | or:bacteriophage lambda le 5132 re:5737 di:direct sr lambda wild-type and lambda strain ci857s7 nu:mu3 (capsid assembly, 201) |
| CONTIG295 | 9970952_f2_17 | 560 | 6222 | 1035 | 345 | 972 | 5.9(10)-98 | Bacteriophage lambda | P03713 | major head protein (gpe) (major coat protein). |
| CONTIG295 | 36135213_f2_18 | 561 | 6223 | 444 | 148 | 100 | 1.5(10)-5 | Bacteriophage lambda | P03709 | dna packaging protein fi. |
| CONTIG296 | 6281375_f2_2 | 562 | 6224 | 990 | 330 | 701 | 3.1(10)-69 | Haemophilus influenzae | HI1144 | [pn:udp-3-0-acyl n-acetylglucosamine deacetylase] [gn:lpxc] |
| CONTIG296 | 4942010_f2_3 | 563 | 6225 | 453 | 151 | 266 | 3.8(10)-23 | Haemophilus influenzae | HI0293 | [pn:mercury resistance homolog] |
| CONTIG296 | 978425_f2_4 | 564 | 6226 | 933 | 311 | 711 | 6.9(10)-70 | Escherichia coli | b0462 | [pn:acriflavin resistance protein b] [gn:acrb] |
| CONTIG296 | 4145218_f3_5 | 565 | 6227 | 3639 | 1213 | 282 | 1.6(10)-34 | Bacillus subtilis | yoaE | [pn:hypothetical protein] |
| CONTIG296 | 13797188_f3_6 | 566 | 6228 | 1299 | 433 | 505 | 1.8(10)-48 | Escherichia coli | b0463 | [pn:acriflavin resistance protein a precursor] [gn:acra] |
| CONTIG297 | 30347307_f2_10 | 567 | 6229 | 546 | 182 | 180 | 5.9(10)-14 | Escherichia coli | b3558 | [pn:insertion element is150 hypothetical 33.3 kd protein] [gn:yi5b] |
| CONTIG297 | 12948526_f3_13 | 568 | 6230 | 291 | 97 | 391 | 2.2(10)-36 | Escherichia coli | I41306 | hypothetical protein (argf-lacz region)-escherichia coli |
| CONTIG297 | 1448266_c2_17 | 569 | 6231 | 2382 | 794 | 91 | 0.34 | Candida albicans | P43060 | phosphoribosylaminoimidazole-succinocarboxamide synthase (ec 6.3.2.6) (saicar synthetase). |
| CONTIG298 | 5971942_f1_1 | 570 | 6232 | 279 | 93 | 269 | 1.8(10)-23 | Escherichia coli | b1648 | [pn:hypothetical protein] |
| CONTIG298 | 2348136_f1_2 | 571 | 6233 | 921 | 307 | 1273 | 7.5(10)-130 | Escherichia coli | b1647 | [pn:hypothetical protein] |
| CONTIG298 | 2603262_f3_3 | 572 | 6234 | 573 | 191 | 789 | 1.5(10)-78 | Escherichia coli | b1646 | [pn:copper-zinc superoxide dismutase] [gn:sodc] |
| CONTIG298 | 884512_c1_23 | 573 | 6235 | 282 | 94 | 295 | 3.2(10)-26 | Escherichia coli | b1643 | [pn:hypothetical protein] |
| CONTIG298 | 25907180_c2_31 | 574 | 6236 | 2100 | 700 | 2323 | 4.0(10)-241 | Escherichia coli | b1645 | [pn:hypothetical protein] |
| CONTIG298 | 12634512_c3_35 | 575 | 6237 | 945 | 315 | 1096 | 4.2(10)-111 | Escherichia coli | b1644 | [pn:hypothetical protein] |
| CONTIG299 | 415412_f1_1 | 576 | 6238 | 1200 | 400 | 152 | 2.8(10)-8 | Bacteriophage P1 | P06956 | recombinase cre. |
| CONTIG299 | 10006261_c3_21 | 577 | 6239 | 1032 | 344 | 98 | 0.056 | Saccharomyces cerevisiae | YGR155W | [pn:cystathionine beta-synthase] [gn:cys4] |
| CONTIG3 | 463125_c3_6 | 578 | 6240 | 606 | 202 | 473 | 4.5(10)-45 | Escherichia coli | b0698 | [pn:potassium-transporting atpase, a chain] [gn:kdpa] |
| CONTIG30 | 2928277_f1_1 | 579 | 6241 | 303 | 101 | 229 | 9.4(10)-19 | Escherichia coli | b1053 | [pn:hypothetical 43.9 kd protein in msyb-htrb intergenic region] [gn:ycee] |
| CONTIG300 | 5163340_f1_2 | 580 | 6242 | 438 | 146 | 493 | 3.3(10)-47 | Erwinia carotovora subsp. carotovora | JC4727 | mob protein a - erwinia carotovora subsp. carotovora a cis-acting locus, orit and transacting locus, mob are involved in mobilization of pec3, a non-self-transmissible mutliple-copy plasmid. the mob consists of five proteins |
| CONTIG300 | 14866452_f3_5 | 581 | 6243 | 432 | 144 | 546 | 8.3(10)-53 | Erwinia carotovora subsp. carotovora | JC4729 | mob protein a - erwinia carotovora subsp. carotovora a cis-acting locus, orit and transacting locus, mob are involved in mobilization of pec3, a non-self-transmissible mutliple-copy plasmid. the mob consists of five proteins |
| CONTIG301 | 31755158_f1_1 | 582 | 6244 | 993 | 331 | 1496 | 1.8(10)-153 | Escherichia coli | b3974 | [pn:pantothenate kinase] [gn:coaa] |
| CONTIG301 | 33475302_c1_29 | 583 | 6245 | 1185 | 395 | 1621 | 1.0(10)-166 | Escherichia coli | b3543 | [pn:dipeptide transport system permease protein dppb] [gn:dppb] |
| CONTIG301 | 4332343_c1_30 | 584 | 6246 | 912 | 304 | 1144 | 3.5(10)-116 | Escherichia coli | b3542 | [pn:dipeptide transport system permease protein dppc] [gn:dppc] |
| CONTIG301 | 17011415_1_32 | 585 | 6247 | 1032 | 344 | 1665 | 2.2(10)-171 | Escherichia coli | b3540 | [pn:dipeptide transport ap-binding protein dppf] [gn:dppf] |
| CONTIG301 | 20167543_c2_35 | 586 | 6248 | 228 | 76 | 392 | 1.7(10)-36 | Escherichia coli | b3544 | [pn:periplasmic dipeptide transport protein precursor] [gn:dppa] |
| CONTIG301 | 34564667_c2_37 | 587 | 6249 | 1002 | 334 | 1402 | 1.6(10)-143 | Escherichia coli | b3541 | [pn:dipeptide transport ap-binding protein dppd] [gn:dppd] |
| CONTIG302 | 13753811_f1_3 | 588 | 6250 | 1221 | 407 | 1664 | 2.7(10)-171 | Escherichia coli | b2844 | [pn:hypothetical protein] |
| CONTIG302 | 6445812_f1_4 | 589 | 6251 | 717 | 239 | 136 | 1.5(10)-7 | Escherichia coli | b4311 | [pn:hypothetical 28.3 kd protein in feci-fimb intergenic region] |
| CONTIG302 | 4461517_f2_6 | 590 | 6252 | 327 | 109 | 137 | 6.4(10)-9 | Escherichia coli | b0208 | [pn:hypothetical transcriptional regulator in rrnh-dnir intergenic region] [gn:yafc] |
| CONTIG303 | 3176081_f2_7 | 591 | 6253 | 555 | 185 | 91 | 0.041 | Haemophilus influenzae | HI0681 | [pn:transcriptional activator protein] [gn:ilvy] |
| CONTIG303 | 28535_c3_37 | 592 | 6254 | 276 | 92 | 338 | 9.0(10)-31 | Escherichia coli | b2845 | [pn:hypothetical protein] |
| CONTIG303 | 894181_f1_1 | 593 | 6255 | 1428 | 476 | 834 | 2.5(10)-83 | Escherichia coli | b1525 | [pn:hypothetical protein] |
| CONTIG303 | 32689752_c1_13 | 594 | 6256 | 1863 | 621 | 2460 | 1.2(10)-255 | Salmonella enterica | X99719 | or:salmonella enterica le:<142 re:1998 di:direct nt:similarity with helicase, orfi |
| CONTIG303 | 25986000_c3_29 | 595 | 6257 | 567 | 189 | 356 | 1.1(10)-32 | Escherichia coli | b2250 | [pn:hypothetical protein] |
| CONTIG304 | 22656568_f3_8 | 596 | 6258 | 222 | 74 | 359 | 5.4(10)-33 | Escherichia coli | b1823 | [pn:cold shock-like protein cspc] [gn:cspc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG304 | 1308402_f3_9 | 597 | 6259 | 1779 | 593 | 1863 | 2.2(10)-192 | Escherichia coli | b0084 | [pn:penicillin-binding protein 3 precursor] [gn:ftsi] |
| CONTIG304 | 9879466_f3_10 | 598 | 6260 | 855 | 285 | 1136 | 2.5(10)-115 | Escherichia coli | b1822 | [pn:hypothetical 30.4 kd protein in manz-cspc intergenic region] [gn:yebh] |
| CONTIG304 | 12531889_c1_13 | 599 | 6261 | 425 | 141 | 561 | 2.1(10)-54 | Escherichia coli | b1819 | [pn:pts system, mannose-specific iid component] [gn:manz] |
| CONTIG304 | 14110327_c1_14 | 600 | 6262 | 459 | 153 | 602 | 9.5(10)-59 | Escherichia coli | b1820 | [pn:hypothetical protein] |
| CONTIG304 | 31770643_c3_26 | 601 | 6263 | 774 | 258 | 832 | 4.0(10)-83 | Escherichia coli | b1821 | [pn:hypothetical protein] |
| CONTIG305 | 1424025_f1_1 | 602 | 6264 | 204 | 68 | 101 | 0.00029 | Porphyromonas gingivalis | P46071 | protease prth (ec 3.4.22.—). |
| CONTIG305 | 34085002_f3_7 | 603 | 6265 | 3627 | 1209 | 560 | 5.2(10)-51 | Acinetobacter calcoaceticus | AF011339 | [PN:unknown] [DE:Acinetobacter calcoaceticus unknown protein gene, partial cds.] [LE:<1] [RE:2753] [DI:direct] |
| CONTIG305 | 6101512_c2_16 | 604 | 6266 | 570 | 190 | 172 | 3.5(10)-13 | Escherichia coli | b2846 | [pn:hypothetical protein] |
| CONTIG305 | 24254687_c2_17 | 605 | 6267 | 1806 | 602 | 310 | 8.5(10)-25 | Escherichia coli | X86087 | or:escherichia coli gn:ehec-hylb 1e:3628 re:5748 di:direct |
| CONTIG306 | 15750937_f1_1 | 606 | 6268 | 990 | 330 | 1061 | 2.2(10)-107 | Escherichia coli | b2100 | [pn:hypothetical protein] |
| CONTIG306 | 26351577_f2_7 | 607 | 6269 | 1005 | 335 | 1345 | 1.8(10)-137 | Escherichia coli | b2099 | [pn:hypothetical protein] |
| CONTIG306 | 29718840_f3_15 | 608 | 6270 | 1236 | 412 | 1733 | 1.3(10)-178 | Escherichia coli | b2098 | [pn:hypothetical protein] |
| CONTIG306 | 11885284_c1_20 | 609 | 6271 | 896 | 298 | 1152 | 5.0(10)-117 | Escherichia coli | b2103 | [pn:hypothetical protein] [gn:thid] |
| CONTIG306 | 29850408_c1_21 | 610 | 6272 | 789 | 263 | 1085 | 6.2(10)-110 | Escherichia coli | b2101 | [pn:hypothetical protein] |
| CONTIG307 | 4332807_f1_2 | 611 | 6273 | 1629 | 543 | 2360 | 4.9(10)-245 | Escherichia coli | b2574 | [pn:l-aspartate oxidase] [gn:nadb] |
| CONTIG307 | 5978412_f3_12 | 612 | 6274 | 1332 | 444 | 1704 | 1.6(10)-175 | Escherichia coli | b2576 | [pn:atp-dependent rna helicase srmb] [gn:srmb] |
| CONTIG307 | 22449093_c1_14 | 613 | 6275 | 396 | 132 | 599 | 2.0(10)-58 | Escherichia coli | b2579 | [pn:hypothetical 14.3 kd protein in srmb-ung intergenic region] |
| CONTIG307 | 32531250_c2_28 | 614 | 6276 | 1089 | 363 | 969 | 1.2(10)-97 | Escherichia coli | b2575 | [pn:hypothetical protein in nadb-srmb intergenic region] [gn:yfic] |
| CONTIG307 | 9817892_c3_36 | 615 | 6277 | 414 | 138 | 602 | 9.5(10)-59 | Escherichia coli | b2573 | [pn:rna polymerase sigma-e factor] [gn:rpoe] |
| CONTIG308 | 4306635_f2_9 | 616 | 6278 | 915 | 305 | 1404 | 9.9(10)-144 | Escherichia coli | b2843 | [pn:5-keto-4-deoxyuronate isomerase] [gn:kdui] |
| CONTIG308 | 4491568_f2_10 | 617 | 6279 | 771 | 257 | 1202 | 2.5(10)-122 | Escherichia coli | b2842 | [pn:2-deoxy-d-gluconate 3-dehydrogenase] [gn:kdud] |
| CONTIG308 | 20341441_f2_11 | 618 | 6280 | 1557 | 519 | 1989 | 1.0(10)-205 | Escherichia coli | b2841 | [pn:l-arabinose isomerase] [gn:arae] |
| CONTIG309 | 20038125_c3_30 | 619 | 6281 | 741 | 247 | 958 | 1.8(10)-96 | Erwinia chrysanthemi | P21258 | oligogalacturonate lyase (ec 4.2.2.6). |
| CONTIG309 | 25802285_f2_15 | 620 | 6282 | 861 | 287 | 696 | 1.1(10)-68 | Mycobacterium tuberculosis | Z95121 | unknown., mtcy20l11.07c, mtcy20l11.07c. len |
| CONTIG309 | 15834716_f2_24 | 621 | 6283 | 930 | 310 | 978 | 1.3(10)-98 | Escherichia coli | b1473 | [pn:yddg] |
| CONTIG309 | 23443818_f2_25 | 622 | 6284 | 531 | 177 | 606 | 3.6(10)-59 | Escherichia coli | b0553 | [pn:outer membrane porin protein nmpc precursor] [gn:nmpc] |
| CONTIG309 | 4817250_c1_37 | 623 | 6285 | 282 | 94 | 284 | 9.0(10)-24 | Escherichia coli | b1474 | [pn:alpha subunit of formate dehydrogenase n] [gn:nmpc] |
| CONTIG309 | 17083292_c1_38 | 624 | 6286 | 333 | 111 | 465 | 3.6(10)-43 | Escherichia coli | b1474 | [pn:alpha subunit of formate dehydrogenase n] [gn:nmpc] |
| CONTIG309 | 14555411_c2_39 | 625 | 6287 | 2460 | 820 | 3784 | 0 | Escherichia coli | b1476 | [pn:gamma subunit of formate dehydrogenase n] |
| CONTIG309 | 13784625_c1_42 | 626 | 6288 | 717 | 239 | 803 | 4.7(10)-80 | Escherichia coli | b0396 | [pn:araj protein precursor] [gn:araj] |
| CONTIG309 | 7054750_c2_52 | 627 | 6289 | 270 | 90 | 253 | 1.3(10)-21 | Escherichia coli | b1475 | [pn:beta subunit of formate dehydrogenase n] [gn:fdnh] |
| CONTIG309 | 26604202_c3_57 | 628 | 6290 | 885 | 295 | 1459 | 1.5(10)-149 | unidentified | X06035 | or:unidentified le.107 re:>319 di:direct nt:laci gene product (71 aa) |
| CONTIG31 | 29877090_c1_7 | 629 | 6291 | 297 | 99 | 122 | 7.0(10)-8 | Haemophilus influenzae | HI0522 | [pn:sp] |
| CONTIG311 | 32605456_c2_8 | 630 | 6292 | 453 | 151 | 226 | 6.7(10)-19 | Haemophilus influenzae | HI1623 | [pn:mercury resistance regulatory protein] |
| CONTIG311 | 21776426_f3_19 | 631 | 6293 | 483 | 161 | 233 | 1.2(10)-19 | Escherichia coli | b0487 | [pn:hypothetical protein] [gn:ybbi] |
| CONTIG311 | 4499003_c1_26 | 632 | 6294 | 468 | 156 | 276 | 3.3(10)-24 | Escherichia coli | b1531 | [pn:multiple antibiotic resistance protein] [gn:mara] |
| CONTIG311 | 3959387_c1_27 | 633 | 6295 | 243 | 81 | 151 | 5.9(10)-11 | Escherichia coli | yygX | [pn:hypothetical protein] |
| CONTIG311 | 3986268_c2_28 | 634 | 6296 | 1641 | 547 | 778 | 2.1(10)-77 | Bacillus subtilis | b3469 | [pn:hypothetical protein] [gn:yhho] |
| CONTIG311 | 26096675_c2_30 | 635 | 6297 | 2556 | 852 | 1087 | 3.8(10)-110 | Escherichia coli | yygX | [pn:hypothetical protein] |
| CONTIG311 | 32714701_c3_31 | 636 | 6298 | 948 | 316 | 608 | 2.2(10)-59 | Bacillus subtilis | b1851 | [pn:phosphogluconate dehydratase] [gn:edd] |
| CONTIG312 | 34551934_c2_38 | 637 | 6299 | 866 | 288 | 1314 | 3.3(10)-134 | Escherichia coli | b1850 | [pn:2-keto-3-deoxygluconate 6-p aldolase] |
| CONTIG312 | 5082913_c2_39 | 638 | 6300 | 681 | 227 | 1022 | 3.0(10)-103 | Escherichia coli | AF044503 | [de:escherichia coli strain ec11 unknown (498), hcp gene, complete cds; and rhsg accessory genetic element vgrg protein, core component anddsorf-g1 genes, complete cds.] [pn:vgrg protein] |
| CONTIG312 | 10975301_c2_40 | 639 | 6301 | 2520 | 840 | 261 | 6.5(10)-19 | Escherichia coli | b1650 | [pn:hypothetical protein] [gn:nema] |
| CONTIG313 | 2082812_f1_1 | 640 | 6302 | 1311 | 437 | 1695 | 1.3(10)-174 | Escherichia coli | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG313 | 2828405_f1_2 | 641 | 6303 | 435 | 145 | 661 | 5.4(10)-65 | Escherichia coli | b1651 | [pn:hypothetical protein] [gn:gloa] |
| CONTIG313 | 5097838_f1_3 | 642 | 6304 | 669 | 223 | 887 | 6.0(10)-89 | Escherichia coli | b1652 | [pn:ribonuclease t] [gn:rnt] |
| CONTIG313 | 5093876_f1_5 | 643 | 6305 | 849 | 283 | 749 | 2.5(10)-74 | Escherichia coli | b1655 | [pn:hypothetical protein] [gn:ydhoi] |
| CONTIG313 | 4589017_f2_10 | 644 | 6306 | 609 | 203 | 840 | 5.7(10)-84 | Escherichia coli | b1649 | [pn:hypothetical protein] |
| CONTIG313 | 1387968_f3_19 | 645 | 6307 | 1767 | 589 | 1323 | 3.7(10)-135 | Escherichia coli | b4114 | [pn:hypothetical 61.7 kd protein in bass-adiy intergenic region] |
| CONTIG313 | 6735627_f3_21 | 646 | 6308 | 822 | 274 | 862 | 2.7(10)-86 | Escherichia coli | b1656 | [pn:superoxide dismutase] [gn:sodb] |
| CONTIG313 | 20114567_c1_22 | 647 | 6309 | 414 | 138 | 374 | 1.3(10)-34 | Escherichia coli | b1657 | [pn:hypothetical protein] |
| CONTIG313 | 26354717_c3_44 | 648 | 6310 | 360 | 120 | 593 | 8.5(10)-58 | Escherichia coli | b1654 | [pn:hypothetical protein in 1hr 5''" region] [gn:ydhd] |
| CONTIG313 | 35411430_c3_46 | 649 | 6311 | 633 | 211 | 90 | 0.066 | Rhodobacter sphaeroides | A57140 | motB protein homolog - rhodobacter sphaeroides |
| CONTIG314 | 4332768_c2_19 | 650 | 6312 | 231 | 77 | 224 | 1.1(10)-18 | Escherichia coli | b3267 | [pn:hypothetical 7.5 kd protein in acrf-rmd intergenic region] |
| CONTIG314 | 12269541_c3_20 | 651 | 6313 | 2973 | 991 | 3597 | 0 | Escherichia coli | b3266 | [pn:acrf] [gn:acrf] |
| CONTIG315 | 9786501_f1_11 | 652 | 6314 | 495 | 165 | 451 | 9.5(10)-43 | Escherichia coli | b1668 | [pn:hypothetical protein] |
| CONTIG315 | 26304632_c2_43 | 653 | 6315 | 318 | 106 | 185 | 1.5(10)-14 | Escherichia coli | b3049 | [pn:glycogen synthesis protein glgs] [gn:glgs] |
| CONTIG315 | 1959386_c3_45 | 654 | 6316 | 522 | 174 | 250 | 1.8(10)-21 | Escherichia coli | AF044503 | [de:escherichia coli strain ec11 unknown (498), hcp gene, complete cds; and rhsg accessory genetic element vgrg protein, core component anddsorf-g1 genes, complete cds.] [pn:unknown] [gn:498] |
| CONTIG315 | 2470468_c3_51 | 655 | 6317 | 438 | 146 | 174 | 2.2(10)-13 | Escherichia coli | b1419 | [pn:hypothetical protein] [gn:ydca] |
| CONTIG316 | 23729187_c3_52 | 656 | 6318 | 543 | 181 | 212 | 2.0(10)-17 | Escherichia coli | b3686 | [pn:hsls] [gn:ibpb] |
| CONTIG316 | 36572802_f1_1 | 657 | 6319 | 669 | 223 | 998 | 1.0(10)-100 | Escherichia coli | b1040 | [pn:putative regulatory protein] [gn:csgd] |
| CONTIG316 | 14568878_f1_2 | 658 | 6320 | 450 | 150 | 569 | 3.0(10)-55 | Escherichia coli | b1038 | [pn:assembly/transport component in curli production] [gn:csgf] |
| CONTIG316 | 4881326_f2_11 | 659 | 6321 | 450 | 150 | 555 | 9.1(10)-54 | Escherichia coli | b1039 | [pn:assembly/transport component in curli production] [gn:csge] |
| CONTIG316 | 24022000_f3_19 | 660 | 6322 | 867 | 289 | 1323 | 3.7(10)-135 | Escherichia coli | b1037 | [pn:assembly/transport component in curli production] [gn:csgg] |
| CONTIG316 | 24407841_c1_34 | 661 | 6323 | 567 | 189 | 808 | 1.3(10)-80 | Escherichia coli | b1035 | [pn:hypothetical protein] [gn:ycdy] |
| CONTIG316 | 22351626_c1_35 | 662 | 6324 | 579 | 193 | 720 | 3.0(10)-71 | Escherichia coli | b1036 | [pn:hypothetical protein] [gn:ycdz] |
| CONTIG316 | 22781591_c2_37 | 663 | 6325 | 801 | 267 | 277 | 2.6(10)-24 | Haemophilus influenzae | HI1364 | [pn:hypothetical protein] |
| CONTIG316 | 35984376_c2_38 | 664 | 6326 | 435 | 145 | 249 | 2.3(10)-21 | Escherichia coli | b1031 | [pn:hypothetical protein] [gn:ycdv] |
| CONTIG316 | 14882337_c3_47 | 665 | 6327 | 951 | 317 | 1285 | 4.0(10)-131 | Escherichia coli | b1033 | [pn:hypothetical protein] [gn:ycdw] |
| CONTIG316 | 475201_c3_48 | 666 | 6328 | 774 | 258 | 1079 | 2.7(10)-109 | Escherichia coli | b1034 | [pn:hypothetical protein] [gn:ycdx] |
| CONTIG317 | 23937778_f2_8 | 667 | 6329 | 1527 | 509 | 591 | 1.3(10)-57 | Escherichia coli | b2155 | [pn:colicin i receptor precursor] [gn:cira] |
| CONTIG317 | 781555_f2_15 | 668 | 6330 | 1104 | 368 | 1339 | 7.7(10)-135 | Escherichia coli | b2158 | [pn:hypothetical 36.9 kd protein in lysp-nfo intergenic region] [gn:yeih] |
| CONTIG317 | 7281308_f3_23 | 669 | 6331 | 873 | 291 | 1163 | 3.3(10)-118 | Escherichia coli | b2159 | [pn:endonuclease iv] [gn:nfo] |
| CONTIG317 | 2269158_c1_26 | 670 | 6332 | 873 | 291 | 1169 | 7.9(10)-119 | Escherichia coli | b2157 | [pn:hypothetical transcriptional regulator in lysp-nfo intergenic region] [gn:yeie] |
| CONTIG317 | 3922542_c3_41 | 671 | 6333 | 1557 | 519 | 2396 | 7.5(10)-249 | Escherichia coli | b2156 | [pn:lysine-specific permease] [gn:lysp] |
| CONTIG318 | 23722842_f1_4 | 672 | 6334 | 609 | 203 | 856 | 1.2(10)-85 | Serratia marcescens | U60283 | or:serratia marcescens pn:restriction methylase gn:trag1 1e:84 re:1775 di:direct nt:putative restriction methylase |
| CONTIG318 | 4351033_f2_9 | 673 | 6335 | 1173 | 391 | 1857 | 9.8(10)-192 | Serratia marcescens | U60283 | or:serratia marcescens pn:restriction methylase gn:trag1 1e:84 re:1775 di:direct nt:putative restriction methylase |
| CONTIG318 | 30275558_f3_14 | 674 | 6336 | 1188 | 396 | 101 | 0.012 | Pseudomonas putida | P31857 | hypothetical 32.4 kd protein in gidb-unci intergenic region |
| CONTIG319 | 10172502_c2_28 | 675 | 6337 | 858 | 286 | 424 | 7.0(10)-40 | Haemophilus influenzae | HI0209 | [pn:dna adenine methylase] [gn:dam] |
| CONTIG319 | 14448628_c1_28 | 676 | 6338 | 597 | 199 | 116 | 1.8(10)-5 | Escherichia coli | b0535 | [pn:fimbriae z protein] [gn:fimz] |
| CONTIG319 | 24648952_c1_29 | 677 | 6339 | 7962 | 2654 | 1058 | 3.7(10)-128 | Escherichia coli | b1509 | [pn:hypothetical protein] |
| CONTIG320 | 25492191_f1_3 | 678 | 6340 | 1248 | 416 | 1489 | 9.6(10)-153 | Escherichia coli | b2907 | [pn:ubih protein] [gn:ubih] |
| CONTIG320 | 14850443_f1_4 | 679 | 6341 | 1215 | 405 | 1730 | 2.7(10)-178 | Escherichia coli | b2906 | [pn:visc protein] [gn:visc] |
| CONTIG320 | 2596033_f1_6 | 680 | 6342 | 426 | 142 | 630 | 1.0(10)-61 | Escherichia coli | b2904 | [pn:glycine cleavage system h protein] [gn:gcvh] |
| CONTIG320 | 1291416_f2_7 | 681 | 6343 | 1206 | 402 | 1832 | 4.4(10)-189 | Escherichia coli | b2908 | [pn:proline aminopeptidase ii] [gn:pepp] |
| CONTIG320 | 1289712_f2_9 | 682 | 6344 | 1170 | 390 | 1730 | 2.7(10)-178 | Escherichia coli | b2905 | [pn:aminomehyltransferase] [gn:gcvt] |
| CONTIG321 | 24666092_f2_17 | 683 | 6345 | 1035 | 345 | 1509 | 7.4(10)-155 | Escherichia coli | b2151 | [pn:mgl repressor and galactose ultrainduction fator] [gn:gals] |
| CONTIG321 | 9770002_f3_20 | 684 | 6346 | 1179 | 393 | 262 | 6.7(10)-22 | Escherichia coli | b4332 | [pn:hypothetical 41.4 kd protein in iada-mcrd intergenic |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG321 | 19743927_f3_21 | 685 | 6347 | 759 | 253 | 883 | 1.6(10)-88 | Escherichia coli | b2153 | region] [gn:yjij] [pn:gtp cyclohydrolase i] [gn:fole] |
| CONTIG321 | 17067305_f3_22 | 686 | 6348 | 1176 | 392 | 1277 | 2.7(10)-130 | Escherichia coli | b2152 | [pn:hypothetical 43.4 kd protein in galls-fole intergenic region] [gn:yeib] |
| CONTIG321 | 15712632_f3_23 | 687 | 6349 | 966 | 322 | 1479 | 1.1(10)-151 | Escherichia coli | b2150 | [pn:d-galactose-binding periplasmic protein precursor] [gn:mglb] |
| CONTIG321 | 4143937_c1_29 | 688 | 6350 | 879 | 293 | 1253 | 9.9(10)-128 | Escherichia coli | b2154 | [pn:hypothetical 31.3 kd protein in fole-cira intergenic region] [gn:yeig] |
| CONTIG321 | 7078550_c2_37 | 689 | 6351 | 663 | 221 | 95 | 0.01099 | Synechococcus PCC7942 | U59236 | or synechococcus pcc7942 pn:unknown 1e:3661 re:4344 di:complement nt:orf227 |
| CONTIG321 | 5963902_c2_41 | 690 | 6352 | 666 | 222 | 230 | 2.7(10)-18 | Escherichia coli | b2155 | [pn:colicin i receptor precursor] [gn:cira] |
| CONTIG322 | 26855467_f2_9 | 691 | 6353 | 612 | 204 | 715 | 1.0(10)-70 | Escherichia coli | b1857 | [pn:31.1 kd protein in msbb-ruvb intergenic region] [gn:yebl] |
| CONTIG322 | 25664816_f2_10 | 692 | 6354 | 1335 | 445 | 1985 | 2.7(10)-205 | Escherichia coli | b1856 | [pn:hypothetical 46.7 kd protein in msbb-ruvb intergenic region] [gn:yeba] |
| CONTIG322 | 6535437_f2_11 | 693 | 6355 | 216 | 72 | 161 | 1.6(10)-11 | Escherichia coli | b1855 | [pn:msbb protein] [gn:msbb] |
| CONTIG322 | 13797676_f2_12 | 694 | 6356 | 858 | 286 | 1320 | 7.9(10)-135 | Escherichia coli | b1855 | [pn:msbb protein] [gn:msbb] |
| CONTIG322 | 26734465_f2_14 | 695 | 6357 | 771 | 257 | 892 | 1.8(10)-89 | Escherichia coli | b1852 | [pn:glucose 6-phosphate 1 dehydrogenase] [gn:zwf] |
| CONTIG322 | 80333_f3_27 | 696 | 6358 | 759 | 253 | 1123 | 5.9(10)-114 | Escherichia coli | b1852 | [pn:glucose 6-phosphate 1 dehydrogenase] [gn:zwf] |
| CONTIG322 | 24245760_c2_39 | 697 | 6359 | 942 | 314 | 1296 | 2.7(10)-132 | Escherichia coli | b1853 | [pn:hypothetical 32.0 kd protein in pyka-zwf intergenic region] [gn:yebk] |
| CONTIG322 | 13945816_c2_40 | 698 | 6360 | 1554 | 518 | 2232 | 1.8(10)-231 | Escherichia coli | b1854 | [pn:pyruvate kinase a] [gn:pyka] |
| CONTIG322 | 16823587_f3_8 | 699 | 6361 | 240 | 80 | 196 | 1.0(10)-15 | Escherichia coli | b2809 | [pn:hypothetical protein] |
| CONTIG322 | 10651717_c1_11 | 700 | 6362 | 498 | 166 | 760 | 1.7(10)-75 | Plasmid pSW200 | L42525 | or:plasmid psw200 gn:mobb 1e:2345 re:2830 di:direct sr:plasmid psw200 dna |
| CONTIG323 | 26681536_c1_12 | 701 | 6363 | 213 | 71 | 270 | 1.5(10)-23 | Plasmid pSW200 | L42525 | or:plasmid psw200 gn:mobd 1e:2834 re:3049 di:direct sr:plasmid psw200 dna |
| CONTIG323 | 5130252_c3_15 | 702 | 6364 | 336 | 112 | 455 | 3.6(10)-43 | Plasmid pSW200 | L42525 | or:plasmid psw200 gn:moba 1e:1657 re:3156 di:direct sr:plasmid psw200 dna |
| CONTIG323 | 24783153_c3_16 | 703 | 6365 | 708 | 236 | 967 | 2.0(10)-97 | Plasmid pSW200 | L42525 | or:plasmid psw200 gn:moba 1e:1657 re:3156 di:direct sr:plasmid psw200 dna |
| CONTIG324 | 24088337_f2_4 | 704 | 6366 | 3273 | 1091 | 276 | 1.5(10)-23 | Escherichia coli | b1350 | [pn:exodeoxyribonuclease viii] [gn:rece] |
| CONTIG324 | 3914843_f2_5 | 705 | 6367 | 1095 | 365 | 259 | 4.7(10)-44 | Escherichia coli | JN0845 | enterohemolysin 1 - escherichia coli |
| CONTIG324 | 22744032_f2_6 | 706 | 6368 | 216 | 72 | 244 | 8.3(10)-21 | Escherichia coli | b1346 | [pn:hypothetical protein] |
| CONTIG324 | 16143775_f3_8 | 707 | 6369 | 210 | 70 | 196 | 1.0(10)-15 | Salmonella typhimurium | AF001386 | [de:salmonella typhimurium prophage-like element gifsy-1, partialsequence.] [nt:orf-3, similar to orfF sequence of e. coli "rac""] |
| CONTIG324 | 23697218_f3_19 | 708 | 6370 | 1251 | 417 | 1525 | 1.5(10)-156 | Escherichia coli | b1345 | [pn:hypothetical protein] |
| CONTIG325 | 16298292_f1_4 | 709 | 6371 | 252 | 84 | 223 | 1.3(10)-18 | Escherichia coli | b3184 | [pn:hypothetical 35.0 kd protein in dacb-rpma intergenic region] [gn:yhbc] |
| CONTIG325 | 34588378_f1_5 | 710 | 6372 | 1191 | 397 | 1569 | 3.2(10)-161 | Escherichia coli | b3183 | [pn:hypothetical 43.3 kd gtp-binding protein in dacb-rpma intergenic region] [gn:yhbz] |
| CONTIG325 | 16437552_f2_13 | 711 | 6373 | 366 | 122 | 522 | 2.8(10)-50 | Escherichia coli | b3186 | [pn:50s ribosomal subunit protein 121] [gn:rplu] |
| CONTIG325 | 9777178_f2_14 | 712 | 6374 | 843 | 281 | 1077 | 4.4(10)-109 | Escherichia coli | b3184 | [pn:hypothetical 35.0 kd protein in dacb-rpma intergenic region] [gn:yhbc] |
| CONTIG325 | 16587811_f2_22 | 713 | 6375 | 480 | 160 | 670 | 6.0(10)-66 | Escherichia coli | b3181 | [pn:grea] |
| CONTIG325 | 23616702_f3_23 | 714 | 6376 | 258 | 86 | 418 | 3.0(10)-39 | Escherichia coli | b3185 | [pn:50s ribosomal subunit protein 127] [gn:rpma] |
| CONTIG325 | 21666317_c1_35 | 715 | 6377 | 1095 | 365 | 736 | 6.0(10)-73 | Escherichia coli | b4112 | [pn:sensor protein bass/pmrb] [gn:bass] |
| CONTIG325 | 31437785_c2_39 | 716 | 6378 | 375 | 125 | 461 | 8.4(10)-44 | Escherichia coli | b3180 | [pn:hypothetical 10.8 kd protein in ftsj-grea intergenic region] [gn:yhby] |
| CONTIG326 | 24651051_c2_42 | 717 | 6379 | 669 | 223 | 530 | 4.0(10)-51 | Escherichia coli | b4113 | [pn:transcriptional regulatory protein basr/pmra] [gn:basr] |
| CONTIG326 | 3948541_c3_51 | 718 | 6380 | 1443 | 481 | 2243 | 1.2(10)-232 | Escherichia coli | b3182 | [pn:d-alanyl-d-alanine caroxypeptidase, fraction b] [gn:"] |
| CONTIG326 | 10994040_c1_37 | 719 | 6381 | 696 | 232 | 128 | 2.7(10)-17 | Mycoplasma sp. | P43641 | modification methylase muni (ec 2.1.1.72) |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG326 | 32664142_c1_38 | 720 | 6382 | 768 | 256 | 503 | 3.0(10)-48 | Escherichia coli | b1560 | adenine-specific methyltransferase mun1) (m. mun1), [pn:hypothetical protein] |
| CONTIG326 | 23708141_c2_45 | 721 | 6383 | 531 | 177 | 130 | 1.0(10)-8 | Escherichia coli | b1147 | [pn:hypothetical protein] |
| CONTIG326 | 2151943_c2_47 | 722 | 6384 | 570 | 190 | 184 | 1.8(10)-14 | Escherichia coli | b2357 | [pn:hypothetical protein] [gn:yfdn] |
| CONTIG326 | 24422952_c2_49 | 723 | 6385 | 417 | 139 | 210 | 3.2(10)-17 | Escherichia coli | b0550 | [pn:hypothetical protein] [gn:rus] |
| CONTIG326 | 32070417_c2_50 | 724 | 6386 | 456 | 152 | 279 | 1.6(10)-24 | Escherichia coli | b0551 | [pn:hypothetical protein] [gn:ybcq] |
| CONTIG326 | 4416592_c3_57 | 725 | 6387 | 936 | 312 | 136 | 5.2(10)-7 | Bacteriophage SPP1 | S43811 | gene 38 protein - phage spp1 |
| CONTIG326 | 35657508_c3_58 | 726 | 6388 | 375 | 125 | 178 | 8.1(10)-14 | Escherichia coli | b4043 | [pn:lexa] [gn:lexa] |
| CONTIG326 | 12298415_c3_60 | 727 | 6389 | 216 | 72 | 329 | 8.1(10)-30 | Escherichia coli | b1560 | [pn:hypothetical protein] |
| CONTIG326 | 22369627_f1_1 | 728 | 6390 | 1446 | 482 | 765 | 5.0(10)-76 | Ralstonia solanacearum | A36929 | virulence regulatory protein vsrb-pseudomonas solanaccarum |
| CONTIG327 | 30746031_f1_3 | 729 | 6391 | 1386 | 462 | 1149 | 1.0(10)-116 | Escherichia coli | b4052 | [pn:replicative dna helicase] [gn:dnab] |
| CONTIG327 | 24077317_f3_15 | 730 | 6392 | 888 | 296 | 136 | 5.2(10)-7 | Bacillus subtilis | soj | [pn:hypothetical protein] |
| CONTIG327 | 12511376_f3_16 | 731 | 6393 | 1725 | 575 | 95 | 0.11 | Agrobacterium rhizogenes | P05683 | possible replication protein b. |
| CONTIG327 | 33798336_f3_19 | 732 | 6394 | 804 | 268 | 91 | 0.02999 | Hyphomicrobium sp. | Y08074 | [de]hyphomicrobium sp. mxaf gene, partial strain b 69.' [pn:methanol dehydrogenase] [gn:mxaf] [nt:alpha-subunit] |
| CONTIG328 | 32505382_f1_5 | 733 | 6395 | 855 | 285 | 884 | 1.3(10)-88 | Escherichia coli | b1226 | [pn:respiratory nitrate reductase 1 delta chain] [gn:narj] |
| CONTIG328 | 36049181_f2_9 | 734 | 6396 | 1557 | 519 | 2592 | 1.3(10)-269 | Escherichia coli | b1225 | [pn:respiratory nitrate reductase 1 beta chain] [gn:narh] |
| CONTIG328 | 4771955_f3_12 | 735 | 6397 | 3840 | 1280 | 6414 | 0 | Escherichia coli | b1224 | [pn:respiratory nitrate reductase 1 alpha chain] [gn:narg] |
| CONTIG328 | 16527216_f3_17 | 736 | 6398 | 273 | 91 | 360 | 4.2(10)-33 | Escherichia coli | b1227 | [pn:respiratory nitrate reductase 1 gamma chain] [gn:nari] |
| CONTIG328 | 2863535_f1_3 | 737 | 6399 | 897 | 299 | 252 | 1.2(10)-21 | Haemophilus influenzae | HI0359 | [pn:gb] |
| CONTIG329 | 2214012_f1_4 | 738 | 6400 | 633 | 211 | 753 | 9.5(10)-75 | Escherichia coli | b2700 | [pn:hypothetical 17.6 kd protein in mltb-rcca intergenic region] [gn:ygad] |
| CONTIG329 | 33595376_f1_7 | 739 | 6401 | 588 | 196 | 931 | 1.3(10)-93 | Escherichia coli | b2697 | [pn:alanyl-trna synthetase] [gn:alas] |
| CONTIG329 | 604638_f2_9 | 740 | 6402 | 759 | 253 | 327 | 1.3(10)-29 | Bacillus subtilis | ytgB | [pn:hypothetical protein] |
| CONTIG329 | 1442277_f2_11 | 741 | 6403 | 516 | 172 | 746 | 5.2(10)-74 | Escherichia coli | b2698 | [pn:regulatory protein recx] [gn:oraa] |
| CONTIG329 | 16307256_f3_15 | 742 | 6404 | 912 | 304 | 409 | 2.7(10)-38 | Haemophilus influenzae | HI0362 | [pn:adhesin b precursor] [gn:fima] |
| CONTIG329 | 15679167_f3_16 | 743 | 6405 | 1095 | 365 | 1601 | 1.3(10)-164 | Escherichia coli | b2699 | [pn:reca protein] [gn:reca] |
| CONTIG329 | 36343781_f1_2 | 744 | 6406 | 240 | 80 | 213 | 2.3(10)-17 | Escherichia coli | b1486 | [pn:hypothetical protein] |
| CONTIG330 | 23439000_c2_40 | 745 | 6407 | 330 | 110 | 119 | 1.5(10)-7 | Haemophilus influenzae | HI1250 | [pn:hypothetical protein] |
| CONTIG330 | 5105068_c2_43 | 746 | 6408 | 1260 | 420 | 325 | 2.2(10)-29 | Proteus vulgaris | S04739 | site-specific dna-methyltransferase (cytosine-specific) (ec2.1.1.73) pvuii - proteus vulgaris |
| CONTIG331 | 4027290_c1_32 | 747 | 6409 | 816 | 272 | 102 | 0.0085 | Treponema denticola | U84257 | or:treponema denticola pn:methyl-accepting chemotaxis protein b gn;dmcb le:1 re:>1107 di:direct |
| CONTIG331 | 14652281_c2_34 | 748 | 6410 | 585 | 195 | 152 | 4.7(10)-11 | Haemophilus influenzae | HI1418 | [pn:hypothetical protein] |
| CONTIG331 | 392502_c2_38 | 749 | 6411 | 1881 | 627 | 1007 | 1.2(10)-101 | Bacteriophage P4 | P10277 | putative p4-specific dna primase (ec 2.7.7.—). |
| CONTIG331 | 20491562_c3_40 | 750 | 6412 | 393 | 131 | 104 | 5.7(10)-6 | Escherichia coli | b2624 | [pn:prophage cp4-57 regulatory protein alpa] [gn:alpa] |
| CONTIG332 | 23993956_f1_1 | 751 | 6413 | 975 | 325 | 1387 | 6.2(10)-142 | Escherichia coli | b0025 | [pn:hypothetical 34.6 kd protein in rpst-iles intergenic region] [gn:yaac] |
| CONTIG332 | 23464537_f1_2 | 752 | 6414 | 2862 | 954 | 4572 | 0 | Escherichia coli | b0026 | [pn:isolcucyl-trna synthetase] [gn:iles] |
| CONTIG332 | 5209791_f2_10 | 753 | 6415 | 549 | 183 | 638 | 1.5(10)-62 | Escherichia coli | b0028 | [pn:probably fkbb-type 16 kd peptidyl-prolyl cis-trans isomerase] [gn:lspa] |
| CONTIG332 | 5098753_f3_15 | 754 | 6416 | 510 | 170 | 739 | 2.8(10)-73 | Escherichia coli | b0027 | [pn:lipoprotein signal peptidase] [gn:lspa] |
| CONTIG332 | 34614462_f3_16 | 755 | 6417 | 987 | 329 | 1496 | 1.8(10)-153 | Escherichia coli | b0029 | [pn:lytb protein] [gn:lytb] |
| CONTIG333 | 23556562_f1_4 | 756 | 6418 | 384 | 128 | 397 | 5.0(10)-37 | Escherichia coli | b4168 | [pn:hypothetical 16.9 kd protein in psd-amib intergenic region] [gn:yjee] |
| CONTIG333 | 32625456_f1_5 | 757 | 6419 | 1368 | 456 | 1651 | 6.5(10)-170 | Escherichia coli | b4169 | [pn:n-acetylmuramoyl-1-alanine amidase precursor] [gn:amib] |
| CONTIG333 | 4307943_f1_6 | 758 | 6420 | 1818 | 606 | 2103 | 8.4(10)-218 | Escherichia coli | b4170 | [pn:dna mismatch repair protein mutl] [gn:mutl] |
| CONTIG333 | 33414068_f1_8 | 759 | 6421 | 324 | 108 | 340 | 5.5(10)-31 | Escherichia coli | b4172 | [pn:host factor-1] [gn:hfq] |
| CONTIG333 | 21907291_f3_23 | 760 | 6422 | 1692 | 564 | 2008 | 9.8(10)-208 | Escherichia coli | b4167 | [pn:hypothetical 54.7 kd protein in psd-amib intergenic region] [gn:yjef] |
| CONTIG333 | 11022125_f3_24 | 761 | 6423 | 225 | 75 | 295 | 3.2(10)-26 | Escherichia coli | b4168 | [pn:hypothetical 16.9 kd protein in psd-amib intergenic region] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG333 | 25509662_f3_26 | 762 | 6424 | 954 | 318 | 1439 | 1.8(10)-147 | Escherichia coli | b4171 | [gn:yje] [pn:trna delta-2-isopentenylpyrophosphate] [gn:miaa] |
| CONTIG333 | 32033567_f3_27 | 763 | 6425 | 372 | 124 | 586 | 4.7(10)-57 | Escherichia coli | b4173 | [pn:gtp-binding protein hflx] [gn:hflx] |
| CONTIG334 | 12928592_c3_67 | 764 | 6426 | 1251 | 417 | 1857 | 9.8(10)-192 | Escherichia coli | b4166 | [pn:hypothetical 43.1 kd protein in psd-amib intergenic region] [gn:yjes] |
| CONTIG334 | 35362692_f2_8 | 765 | 6427 | 273 | 91 | 449 | 1.6(10)-42 | Escherichia coli | b0954 | [pn:d-3-hydroxydecanoyl-acyl carrier-protein] [gn:faba] |
| CONTIG334 | 6283552_f2_16 | 766 | 6428 | 450 | 150 | 117 | 6.4(10)-7 | Pseudomonas aeruginosa | JQ0133 | hypothetical 26.4 k protein - pseudomonas aeruginosa |
| CONTIG334 | 660278_f3_29 | 767 | 6429 | 315 | 105 | 113 | 1.6(10)-6 | Haemophilus influenzae | III1343 | [pn:nitrogen fixation protein] [gn:nifs] |
| CONTIG334 | 25634630_c1_39 | 768 | 6430 | 1257 | 419 | 1795 | 3.7(10)-185 | Escherichia coli | b0950 | [pn:pqia] [gn:pqia] |
| CONTIG334 | 2463131_c2_43 | 769 | 6431 | 231 | 77 | 111 | 1.2(10)-5 | Escherichia coli | b0951 | [pn:pqib] [gn:pqib] |
| CONTIG334 | 14661713_c2_44 | 770 | 6432 | 579 | 193 | 688 | 7.4(10)-68 | Escherichia coli | b0952 | [pn:hypothetical protein] [gn:ycby] |
| CONTIG334 | 21541091_c2_45 | 771 | 6433 | 2025 | 675 | 3149 | 0 | Escherichia coli | b0948 | [pn:hypothetical protein] [gn:ycbh] |
| CONTIG334 | 4688202_c3_46 | 772 | 6434 | 1908 | 636 | 2661 | 6.2(10)-277 | Escherichia coli | b0949 | [pn:pqib] [gn:pqib] |
| CONTIG334 | 34039693_c3_50 | 773 | 6435 | 1656 | 552 | 2259 | 2.5(10)-234 | Escherichia coli | b0951 | [pn:hypothetical protein] |
| CONTIG334 | 156328_c1_33 | 774 | 6436 | 399 | 133 | 91 | 0.0008 | Escherichia coli | b2354 | [pn:hypothetical protein] |
| CONTIG335 | 4100463_c2_37 | 775 | 6437 | 1074 | 358 | 160 | 3.3(10)-9 | unclassified | JC4865 | contractile tail sheath protein-pseudomonas aeruginosaphage ps17 |
| CONTIG335 | 31427007_c2_38 | 776 | 6438 | 582 | 194 | 199 | 1.7(10)-15 | unclassified | JC4865 | contractile tail sheath protein-pseudomonas aeruginosaphage ps17 |
| CONTIG335 | 23471062_c2_39 | 777 | 6439 | 525 | 175 | 146 | 2.0(10)-10 | no gb taxonomy match | JC5192 | |
| CONTIG335 | 6020968_c2_41 | 778 | 6440 | 1539 | 513 | 98 | 0.22 | Archaeoglobus fulgidus | E69444 | [pn:chromosome segregation protein (smc1) homolog] tail protein x (gpx). |
| CONTIG335 | 4040875_c2_49 | 779 | 6441 | 219 | 73 | 137 | 1.8(10)-9 | Bacteriophage P2 | P51772 | [pn:hypothetical protein] |
| CONTIG335 | 31427007_c2_38 | 780 | 6442 | 309 | 103 | 147 | 4.4(10)-9 | Escherichia coli | b1372 | [pn:hypothetical protein] |
| CONTIG336 | 3959462_f1_2 | 781 | 6443 | 906 | 302 | 1083 | 1.0(10)-109 | Escherichia coli | b4211 | [pn:hypothetical 29.7 kd protein in rpli-cpdb intergenic region] [gn:ytfg] |
| CONTIG336 | 34647781_f1_3 | 782 | 6444 | 843 | 281 | 272 | 9.0(10)-24 | Bacillus subtilis | ybfI | [pn:hypothetical protein] |
| CONTIG336 | 2604652_f1_4 | 783 | 6445 | 984 | 328 | 1215 | 1.1(10)-123 | Escherichia coli | b4210 | [pn:hypothetical 35.5 kd protein in rpli-cpdb intergenic region] [gn:ytff] |
| CONTIG336 | 19616637_f2_14 | 784 | 6446 | 699 | 233 | 1036 | 9.8(10)-105 | Escherichia coli | b4209 | [pn:hypothetical protein] [gn:ytfc] |
| CONTIG336 | 34037501_c1_33 | 785 | 6447 | 417 | 139 | 550 | 3.1(10)-53 | Escherichia coli | b4212 | [pn:hypothetical protein] [gn:ytfh] |
| CONTIG336 | 32214687_c2_35 | 786 | 6448 | 1662 | 554 | 1202 | 2.5(10)-122 | Escherichia coli | b4355 | [pn:methyl-accepting chemotaxis protein i] [gn:tsr] |
| CONTIG337 | 22864163_f1_1 | 787 | 6449 | 720 | 240 | 1125 | 3.6(10)-114 | Escherichia coli | b2565 | [pn:dna repair protein reco] [gn:reco] |
| CONTIG337 | 12539057_f1_2 | 788 | 6450 | 753 | 251 | 1131 | 8.4(10)-115 | Escherichia coli | b2564 | [pn:pyridoxal phosphate biosynthetic protein pdxj] [gn:pdxj] |
| CONTIG337 | 24627067_f2_11 | 789 | 6451 | 435 | 145 | 699 | 5.0(10)-69 | Escherichia coli | b2566 | [pn:gtp-binding protein] [gn:era] |
| CONTIG337 | 19687915_f2_17 | 790 | 6452 | 936 | 312 | 815 | 2.6(10)-81 | Escherichia coli | b2428 | [pn:hypothetical protein] [gn:yfycu] |
| CONTIG337 | 3916713_f2_18 | 791 | 6453 | 1374 | 458 | 702 | 2.3(10)-69 | Bacillus subtilis | ybbF | [pn:hypothetical protein] |
| CONTIG337 | 33728143_f2_19 | 792 | 6454 | 639 | 213 | 774 | 5.7(10)-77 | Escherichia coli | b2560 | [pn:hypothetical 21.9 kd protein in purl-dpj intergenic region] [gn:yfhb] |
| CONTIG337 | 20720005_f2_20 | 793 | 6455 | 564 | 188 | 687 | 9.4(10)-68 | Escherichia coli | b2559 | [pn:hypothetical 20.0 kd protein in purl-dpj intergenic region] [gn:yfhc] |
| CONTIG337 | 32120791_f3_25 | 794 | 6456 | 543 | 181 | 611 | 1.0(10)-59 | Escherichia coli | b2563 | [pn:dpj protein] [gn:acps] |
| CONTIG337 | 7133415_c1_36 | 795 | 6457 | 288 | 96 | 95 | 0.00058 | Mycobacterium leprae | Z70722 | [de:mycobacterium leprae cosmid b1770.] [nt:mlb1770.13c, ppp; putative phosphoprotein phosphatase] [pn:probable phosphoprotein phosphoprotein] |
| CONTIG337 | 15631650_c1_39 | 796 | 6458 | 891 | 297 | 1094 | 7.0(10)-111 | Escherichia coli | b2561 | [pn:hypothetical protein in purl-dpj intergenic region] [gn:yfhh] |
| CONTIG337 | 34425883_c2_44 | 797 | 6459 | 819 | 273 | 977 | 1.8(10)-98 | Escherichia coli | b2558 | [pn:hypothetical 53.2 kd protein in purl-dpj intergenic region] [gn:yfhd] |
| CONTIG337 | 15813833_c3_61 | 798 | 6460 | 306 | 102 | 468 | 1.5(10)-44 | Escherichia coli | b2562 | [pn:hypothetical protein] [gn:yfhl] |
| CONTIG337 | 26301586_f2_11 | 799 | 6461 | 1548 | 516 | 2212 | 2.3(10)-229 | Escherichia coli | b2011 | [pn:exodeoxyribonuclease i] [gn:sbcb] |
| CONTIG337 | 30663417_c1_29 | 800 | 6462 | 1167 | 389 | 1330 | 6.9(10)-136 | Escherichia coli | b2008 | [pn:hypothetical 40.0 kd protein in cobu-sbcb intergenic region] [gn:yeea] |
| CONTIG338 | 627287_c1_30 | 801 | 6463 | 384 | 128 | 589 | 2.2(10)-57 | Escherichia coli | b2007 | [pn:hypothetical protein] [gn:yeec] |
| CONTIG338 | 3145787_c2_31 | 802 | 6464 | 930 | 310 | 1209 | 4.5(10)-123 | Escherichia coli | b2015 | [pn:hypothetical protein] |
| CONTIG338 | 4120381_c2_34 | 803 | 6465 | 1182 | 394 | 1718 | 5.2(10)-177 | Escherichia coli | b2010 | [pn:hypothetical protein] |
| CONTIG338 | 14449842_c3_39 | 804 | 6466 | 1371 | 457 | 2127 | 2.3(10)-220 | Escherichia coli | b2014 | [pn:hypothetical 49.8 kd transport protein in sbcb 3'''' region] [gn:yecf] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG338 | 29695755_c3_45 | 805 | 6467 | 525 | 175 | 569 | 3.0(10)-55 | Escherichia coli | b2009 | [pn:hypothetical 18.1 kd protein in plsc 5'" region] [gn:sbmc] |
| CONTIG339 | 22073430_f2_23 | 806 | 6468 | 195 | 65 | 218 | 4.7(10)-18 | Escherichia coli | D90862 | or:escherichia coli gn:cvpa le:13907 re:14203 di:direct sr:escherichia coli (strain:k12) dna, clone_lib:kohara lambda minise nt:similar to [Pir accession number a04446] [pn:colicin v production protein] [gn:cvpa] |
| CONTIG339 | 1445258_c1_28 | 807 | 6469 | 819 | 273 | 778 | 2.1(10)-77 | Escherichia coli | b2313 | [pn:amidophosphoribosyltransferase] [gn:purf] |
| CONTIG339 | 30353282_c1_29 | 808 | 6470 | 1551 | 517 | 2388 | 5.2(10)-248 | Escherichia coli | b2312 | [pn:histidine transport system permease protein hisq] [gn:hisq] |
| CONTIG339 | 1224476_c1_32 | 809 | 6471 | 759 | 253 | 951 | 1.0(10)-95 | Escherichia coli | b2308 | [pn:histidine transport system permease protein hisq] [gn:hisq] |
| CONTIG339 | 36042669_c2_33 | 810 | 6472 | 464 | 154 | 404 | 9.1(10)-38 | Escherichia coli | b2314 | [pn:dedd protein] [gn:dedd] |
| CONTIG339 | 9766650_c2_41 | 811 | 6473 | 987 | 329 | 1107 | 2.8(10)-112 | Escherichia coli | b2310 | [pn:lysine-arginine-ornithine-binding periplasmic protein precursor] [gn:argt] |
| CONTIG339 | 24705382_c3_47 | 812 | 6474 | 216 | 72 | 141 | 6.7(10)-10 | Escherichia coli | D90862 | or:escherichia coli gn:cvpa le:13892 re:14173 di:complement sr:escherichia coli (strain:k12) dna, clone_lib:kohara lambda minise nt:similar to [swissprot accession number p03820]; |
| CONTIG339 | 22391387_c3_49 | 813 | 6475 | 612 | 204 | 864 | 1.7(10)-86 | Escherichia coli | b2309 | [pn:3-octaprenyl-4-hydroxybenzoate carboxy-lyase] [gn:ubix] |
| CONTIG339 | 1174038_c3_51 | 814 | 6476 | 804 | 268 | 1160 | 7.0(10)-118 | Escherichia coli | b2309 | [pn:histidine-binding periplasmic protein hisj] [gn:hisj] |
| CONTIG339 | 25431631_c3_52 | 815 | 6477 | 717 | 239 | 1070 | 2.5(10)-108 | Escherichia coli | b2307 | [pn:histidine transport system permease protein hism] [gn:hism] |
| CONTIG340 | 34004425_f2_9 | 816 | 6478 | 927 | 309 | 1467 | 2.1(10)-150 | Escherichia coli | b1344 | [pn:hypothetical protein] [gn:ydao] |
| CONTIG340 | 24320165_c1_32 | 817 | 6479 | 1164 | 388 | 572 | 1.5(10)-55 | Escherichia coli | b1885 | [pn:methyl-accepting chemotaxis protein iv] [gn:tap] |
| CONTIG340 | 36221037_c1_33 | 818 | 6480 | 999 | 333 | 1494 | 2.8(10)-153 | Escherichia coli | b1342 | [pn:hypothetical protein] |
| CONTIG340 | 867076_c2_38 | 819 | 6481 | 1401 | 467 | 2143 | 4.9(10)-222 | Escherichia coli | b1343 | [pn:atp-dependent rna helicase dbpa] [gn:dbpa] |
| CONTIG340 | 1959386_c3_40 | 820 | 6482 | 522 | 174 | 250 | 1.8(10)-21 | Escherichia coli | AF044503 | [de:escherichia coli strain ec11 unknown (498), hcp gene, complete cds; and rhsg accessory genetic element vgrg protein, core component anddsorf-g1 genes, complete cds] [pn:unknown] [gn:498] |
| CONTIG341 | 5992932_f2_3 | 821 | 6483 | 657 | 219 | 967 | 2.0(10)-97 | Escherichia coli | b1662 | [pn:riboflavin synthase alpha chain] [gn:ribe] |
| CONTIG341 | 33854677_f1_7 | 822 | 6484 | 1332 | 444 | 1429 | 2.2(10)-146 | Escherichia coli | b1659 | [pn:hypothetical transcriptional regulator in cfa-purr intergenic region] [gn:ydlb] |
| CONTIG341 | 35673775_f2_17 | 823 | 6485 | 837 | 279 | 1176 | 1.3(10)-119 | Escherichia coli | b1657 | [pn:hypothetical protein] |
| CONTIG341 | 3363193_c1_33 | 824 | 6486 | 327 | 109 | 93 | 0.00031 | Corynebacterium glutamicum | U85507 | or:corynebacterium glutamicum pn:unknown gn:orf6 le:3532 re:4290 di:complement |
| CONTIG341 | 23992051_c1_45 | 825 | 6487 | 1395 | 465 | 1790 | 1.2(10)-184 | Escherichia coli | b1663 | [pn:hypothetical protein in ribc 5'" region] [gn:ydhc] |
| CONTIG341 | 16834386_c2_48 | 826 | 6488 | 1032 | 344 | 1704 | 1.6(10)-175 | Escherichia coli | b1658 | [pn:purine nucleotide synthesis repressor] [gn:purr] |
| CONTIG341 | 12988952_c2_51 | 827 | 6489 | 1290 | 430 | 1494 | 2.8(10)-153 | Escherichia coli | b1660 | [pn:hypothetical 43.4 kd protein in purr-cfa intergenic region] [gn:ydhc] |
| CONTIG342 | 36120180_c3_63 | 828 | 6490 | 1173 | 391 | 1810 | 9.4(10)-187 | Escherichia coli | b1661 | [pn:cyclopropane-fatty-acyl-phospholipid synthase] [gn:cfa] |
| CONTIG342 | 17036458_f1_6 | 829 | 6491 | 1091 | 364 | 343 | 1.8(10)-30 | Escherichia coli | P22520 | colicin v secretion atp-binding protein cvab. |
| CONTIG342 | 2926577_f2_7 | 830 | 6492 | 624 | 208 | 241 | 1.7(10)-20 | Escherichia coli | b0293 | [pn:hypothetical 20.1 kd protein in intf-eaeh intergenic region precursor] [gn:yagz] |
| CONTIG342 | 4564068_f2_8 | 831 | 6493 | 687 | 229 | 439 | 1.8(10)-41 | Escherichia coli | b0292 | [pn:hypothetical 24.5 kd protein in intf-eaeh intergenic region precursor] [gn:yagy] |
| CONTIG342 | 7067568_f2_9 | 832 | 6494 | 2601 | 867 | 1162 | 4.4(10)-118 | Escherichia coli | b0291 | [pn:hypothetical 91.2 kd protein in intf-eaeh intergenic region precursor] [gn:yagx] |
| CONTIG342 | 35806508_f3_11 | 833 | 6495 | 828 | 276 | 127 | 3.7(10)-6 | Escherichia coli | b1608 | [pn:rsta] [gn:rsta] |
| CONTIG342 | 3213053_f3_15 | 834 | 6496 | 1740 | 580 | 138 | 5.0(10)-6 | Escherichia coli | b0290 | [pn:hypothetical 60.0 kd protein in intf-eaeh intergenic region] [gn:yagw] |
| CONTIG342 | 14879055_f3_16 | 835 | 6497 | 660 | 220 | 319 | 9.4(10)-29 | Escherichia coli | b0289 | [pn:hypothetical 28.2 kd protein in intf-eaeh intergenic region] |
| CONTIG343 | 5182963_f1_3 | 836 | 6498 | 1071 | 357 | 1273 | 7.5(10)-130 | Escherichia coli | b2213 | [pn:ada regulatory protein] [gn:ada] |
| CONTIG343 | 10940625_f1_5 | 837 | 6499 | 1668 | 556 | 2187 | 1.1(10)-226 | Escherichia coli | b2211 | [pn:hypothetical abc transporter in cco-alkb intergenic region] [gn:yoji] |
| CONTIG343 | 7130050_f2_10 | 838 | 6500 | 1035 | 345 | 1454 | 5.0(10)-149 | Escherichia coli | b2215 | [pn:outer membrane protein e precursor] [gn:ompc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG343 | 4119056_f2_11 | 839 | 6501 | 393 | 131 | 288 | 1.8(10)-25 | Escherichia coli | b2214 | [pn:hypothetical 38.5 kd protein in ada-ompc intergenic region] |
| CONTIG343 | 36572037_f2_12 | 840 | 6502 | 618 | 206 | 897 | 5.2(10)-90 | Escherichia coli | b2214 | [pn:hypothetical 38.5 kd protein in ada-ompc intergenic region] |
| CONTIG343 | 12679793_f3_24 | 841 | 6503 | 672 | 224 | 843 | 2.7(10)-84 | Escherichia coli | b2212 | [pn:alkb protein] [gn:alkb] |
| CONTIG343 | 7119075_f3_28 | 842 | 6504 | 1440 | 480 | 322 | 4.5(10)-29 | Bacillus subtilis | ykoK | [pn:hypothetical protein] |
| CONTIG343 | 16491667_f3_29 | 843 | 6505 | 204 | 68 | 93 | 0.0018 | Caenorhabditis elegans | Z81518 | [de:caenorhabditis elegans cosmid f28d9, complete sequence] [pn:f28d9 a] [nt:protein predicted using genefinder; preliminary] |
| CONTIG344 | 10400826_f3_30 | 844 | 6506 | 977 | 326 | 1363 | 2.2(10)-139 | Escherichia coli | b2210 | [pn:hypothetical 60.2 kd protein in eco-alkb intergenic region] [gn:yojh] |
| CONTIG344 | 23446927_c1_31 | 845 | 6507 | 1401 | 467 | 705 | 1.2(10)-69 | Bacillus subtilis | ybaR | [pn:hypothetical protein] |
| CONTIG344 | 4197127_f1_12 | 846 | 6508 | 606 | 202 | 578 | 3.3(10)-56 | Escherichia coli | b1304 | [pn:hypothetical protein a] [gn:pspa] |
| CONTIG344 | 451958_f1_13 | 847 | 6509 | 255 | 85 | 342 | 3.3(10)-31 | Escherichia coli | b1305 | [pn:hypothetical protein b] [gn:pspb] |
| CONTIG344 | 23463300_f3_26 | 848 | 6510 | 615 | 205 | 137 | 1.8(10)-9 | Escherichia coli | b0464 | [pn:potential acrab operon repressor] [gn:acrr] |
| CONTIG344 | 21601437_f3_37 | 849 | 6511 | 294 | 98 | 344 | 2.1(10)-31 | Escherichia coli | b1304 | [pn:hypothetical protein a] [gn:pspa] |
| CONTIG344 | 14713512_f3_38 | 850 | 6512 | 429 | 143 | 401 | 1.8(10)-37 | Escherichia coli | b1306 | [pn:hypothetical protein c] [gn:pspc] |
| CONTIG344 | 19649088_f3_39 | 851 | 6513 | 237 | 79 | 287 | 2.2(10)-25 | Escherichia coli | b1307 | [pn:hypothetical protein d] [gn:pspd] |
| CONTIG344 | 23494193_c2_53 | 852 | 6514 | 996 | 332 | 1387 | 6.2(10)-142 | Escherichia coli | b1293 | [pn:hypothetical protein in pspa 5'''' region] [gn:pspf] |
| CONTIG344 | 34102188_c2_55 | 853 | 6515 | 990 | 330 | 1302 | 6.4(10)-133 | Escherichia coli | b1293 | [pn:peptide transport system permease protein sapb] [gn:sapb] |
| CONTIG344 | 32704131_c2_58 | 854 | 6516 | 1041 | 347 | 1550 | 3.2(10)-159 | Escherichia coli | b1291 | [pn:peptide transport system atp-binding protein sapd] [gn:sapd] |
| CONTIG344 | 1039293_c3_68 | 855 | 6517 | 1761 | 587 | 2401 | 2.2(10)-249 | Escherichia coli | b1294 | [pn:peptide transport system periplasmic protein sapa precursor] [gn:sapa] |
| CONTIG344 | 24881542_c3_69 | 856 | 6518 | 906 | 302 | 1169 | 7.9(10)-119 | Escherichia coli | b1292 | [pn:peptide transport system permease protein sapc] [gn:sapc] |
| CONTIG344 | 26448807_c3_70 | 857 | 6519 | 825 | 275 | 1289 | 1.5(10)-131 | Escherichia coli | b1290 | [pn:peptide transport system atp-binding protein sapf] [gn:sapf] |
| CONTIG345 | 3361780_f2_11 | 858 | 6520 | 435 | 145 | 329 | 8.1(10)-30 | Escherichia coli | b1856 | [pn:hypothetical 46.7 kd protein in msbb-ruvb intergenic region] [gn:yeba] |
| CONTIG345 | 16303831_c2_48 | 859 | 6521 | 1341 | 447 | 1384 | 1.3(10)-141 | Escherichia coli | b0574 | [pn:hypothetical protein] [gn:ylcd] |
| CONTIG345 | 24629011_c2_53 | 860 | 6522 | 2496 | 832 | 1315 | 2.7(10)-134 | Bacillus subtilis | yvgX | [pn:hypothetical protein] [gn:ylcb] |
| CONTIG345 | 1219468_c3_55 | 861 | 6523 | 573 | 191 | 584 | 7.7(10)-57 | Escherichia coli | b0572 | [pn:hypothetical protein] [gn:ylcb] |
| CONTIG345 | 4688752_c3_58 | 862 | 6524 | 381 | 127 | 253 | 9.1(10)-22 | Escherichia coli | b0573 | [pn:hypothetical protein] [gn:ylcc] |
| CONTIG346 | 21520677_c3_58 | 863 | 6525 | 3177 | 1059 | 4318 | 0 | Escherichia coli | b0575 | [pn:hypothetical protein in phep 5'''' region] [gn:ybde] |
| CONTIG346 | 878876_f1_1 | 864 | 6526 | 402 | 134 | 518 | 7.7(10)-50 | Escherichia coli | b2582 | [pn:hypothetical protein in the ung 3'''' region] [gn:yfiq] |
| CONTIG346 | 32617793_f1_3 | 865 | 6527 | 2715 | 905 | 3772 | 0 | Escherichia coli | b2584 | [pn:hypothetical protein] [gn:yfip] |
| CONTIG346 | 29782832_f2_8 | 866 | 6528 | 783 | 261 | 999 | 8.1(10)-101 | Escherichia coli | b2583 | [pn:cdp-diacylglycerol-serine o-phosphatidyltransferase] [gn:pssa] |
| CONTIG346 | 24807932_f2_14 | 867 | 6529 | 1377 | 459 | 1923 | 1.0(10)-198 | Escherichia coli | b2585 | [pn:hypothetical 9.9 kd protein in pss-kgtp intergenic region] [gn:yfim] |
| CONTIG346 | 19972900_f3_26 | 868 | 6530 | 423 | 141 | 417 | 3.8(10)-39 | Escherichia coli | b2586 | [pn:alpha-ketoglutarate permease] [gn:kgtp] |
| CONTIG346 | 50066_c3_52 | 869 | 6531 | 1377 | 459 | 1610 | 1.5(10)-165 | Escherichia coli | b2587 | [de:escherichia coli ecorii restriction endonuclease gene.] [pn:restriction endonuclease] [gn:ecorii] |
| CONTIG347 | 6658593_f1_1 | 870 | 6532 | 441 | 147 | 479 | 1.0(10)-45 | Escherichia coli | AJ224995 | [pn:hypothetical protein] |
| CONTIG347 | 10605292_f1_5 | 871 | 6533 | 1557 | 519 | 124 | 3.2(10)-8 | Bacillus subtilis | yerF | [pn:hypothetical protein] |
| CONTIG347 | 20722933_f1_6 | 872 | 6534 | 1644 | 548 | 93 | 1.0(10)-0 | Caenorhabditis elegans | U33058 | [or:caenorhabditis elegans pn:unc-89 gn:unc-89 le:join(4920 re:4969, 5656 di:direct nt:giant ig superfamily member located in the middle |
| CONTIG347 | 2133550_f3_21 | 873 | 6535 | 1404 | 468 | 1121 | 9.6(10)-114 | Pseudomonas alcaligenes | U77945 | [de:pseudomonas alcaligenes maturase-related protein gene, complete cds.] [pn:maturase-related protein] |
| CONTIG347 | 24729507_c2_50 | 874 | 6536 | 204 | 68 | 116 | 1.5(10)-6 | Anabaena PCC7120 | AF047044 | [de:anabaena pcc7120 insertion sequence is1594 putative transposasegene, complete cds.] [pn:putative transposase] [nt:tnp1594] |
| CONTIG347 | 12319757_c2_51 | 875 | 6537 | 1596 | 532 | 1528 | 7.2(10)-157 | Escherichia coli | b1961 | [pn:dna-cytosine methyltransferase] [gn:dcm] |
| CONTIG347 | 35597962_c3_58 | 876 | 6538 | 306 | 102 | 176 | 3.2(10)-13 | Pseudoalteromonas atlantica | A32816 | [pn:hypothetical protein, 33k, (insertion sequence is492)- pseudomonas atlantica |
| CONTIG348 | 25442808_f1_1 | 877 | 6539 | 1383 | 461 | 2037 | 8.3(10)-211 | Escherichia coli | b0211 | [pn:regulatory protein dnir and hypothetical yafg] [gn:mltd] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG348 | 3393955_f1_6 | 878 | 6540 | 306 | 102 | 108 | 6.7(10)-6 | Corynebacterium glutamicum | U85507 | or:corynebacterium glutamicum pn:unknown gn.orf6 le:3332 re:4290 dr:complement |
| CONTIG348 | 26687512_f1_7 | 879 | 6541 | 927 | 309 | 1370 | 4.0(10)-140 | Escherichia coli | b0208 | [pn:hypothetical transcriptional regulator in rmh-dnir intergenic region] [gn:yafc] |
| CONTIG348 | 16047027_f2_12 | 880 | 6542 | 192 | 64 | 212 | 2.0(10)-17 | Escherichia coli | b0212 | [pn:hypothetical protein] [gn:glob] |
| CONTIG348 | 24884441_c1_24 | 881 | 6543 | 819 | 273 | 1204 | 1.5(10)-122 | Escherichia coli | b0207 | [pn:hypothetical 29.4 kd protein in aspu-dnir intergenic region] [gn:yafd] |
| CONTIG348 | 12148381_f1_29 | 882 | 6544 | 873 | 291 | 1288 | 1.8(10)-131 | Escherichia coli | b0209 | [pn:hypothetical protein in aspu-dnir intergenic region] [gn:yafd] |
| CONTIG348 | 6926692_c2_34 | 883 | 6545 | 1191 | 397 | 1054 | 1.2(10)-106 | Bacillus subtilis | ytbD | [pn:hypothetical protein] |
| CONTIG348 | 24098587_c3_41 | 884 | 6546 | 786 | 262 | 771 | 1.2(10)-76 | Escherichia coli | b0210 | [pn:hypothetical 23.0 kd protein in aspu-dnir intergenic region] |
| CONTIG349 | 31489806_f1_10 | 885 | 6547 | 1011 | 337 | 782 | 8.0(10)-78 | Escherichia coli | b1899 | [pn:hypothetical protein] |
| CONTIG349 | 2907259_f1_11 | 886 | 6548 | 914 | 305 | 702 | 2.3(10)-69 | Escherichia coli | b1897 | [pn:trehalose phosphatase] [gn:otsb] |
| CONTIG349 | 35397937_f2_12 | 887 | 6549 | 420 | 140 | 307 | 1.7(10)-27 | Escherichia coli | P52092 | hypothetical 9.1 kd protein in araf-ftn intergenic region. |
| CONTIG349 | 4886041_f2_15 | 888 | 6550 | 609 | 203 | 194 | 1.6(10)-15 | Escherichia coli | b0424 | [pn:thij protein] [gn:thij] |
| CONTIG349 | 32301093_f2_17 | 889 | 6551 | 1554 | 518 | 2320 | 8.5(10)-241 | Escherichia coli | b1900 | [pn:1-arabinose transport atp-binding protein arag] [gn:arag] |
| CONTIG349 | 22125378_f3_22 | 890 | 6552 | 1041 | 347 | 1573 | 1.2(10)-161 | Escherichia coli | b1901 | [pn:1-arabinose-binding periplasmic protein precursor] [gn:araf] |
| CONTIG349 | 34069716_c1_39 | 891 | 6553 | 540 | 180 | 539 | 4.5(10)-52 | Escherichia coli | b1902 | [pn:ferritin-like protein] [gn:yec] |
| CONTIG349 | 4574191_c1_40 | 892 | 6554 | 1356 | 452 | 1123 | 5.9(10)-114 | Escherichia coli | b4123 | [pn:anaerobic c4-dicarboxylate transporter dcub] [gn:dcub] |
| CONTIG349 | 24884458_c2_56 | 893 | 6555 | 1266 | 422 | 713 | 1.7(10)-70 | Escherichia coli | b3754 | [pn:hypothetical 51.5 kd protein in rbsr-rrsc intergenic region] [gn:yieo] |
| CONTIG349 | 32441526_c3_70 | 894 | 6556 | 240 | 80 | 171 | 4.5(10)-13 | Escherichia coli | b1903 | [pn:hypothetical protein] |
| CONTIG349 | 31913255_f2_14 | 895 | 6557 | 636 | 212 | 946 | 3.3(10)-95 | Escherichia coli | b2186 | [pn:hypothetical 37.8 kd protein in rply-prol intergenic region] [gn:yejk] |
| CONTIG350 | 4298562_f2_20 | 896 | 6558 | 717 | 239 | 1101 | 1.3(10)-111 | Escherichia coli | b2183 | [pn:hypothetical 25.9 kd protein in ber-rply intergenic region] [gn:yejd] |
| CONTIG350 | 24832252_f2_21 | 897 | 6559 | 1215 | 405 | 1519 | 6.5(10)-156 | Escherichia coli | b2182 | [pn:bicyclomycin resistance protein] [gn:ber] |
| CONTIG350 | 15632767_c1_45 | 898 | 6560 | 372 | 124 | 460 | 1.1(10)-43 | Escherichia coli | b2181 | [pn:hypothetical 12.5 kd protein in ber 5'''' region] [gn:yejg] |
| CONTIG350 | 2602187_c1_45 | 899 | 6561 | 399 | 133 | 94 | 0.00339 | Listeria innocua | Q01836 | protein p60 precursor (invasion-associated protein). |
| CONTIG350 | 2643907_c1_47 | 900 | 6562 | 1776 | 592 | 2642 | 6.4(10)-275 | Escherichia coli | b2184 | [pn:hypothetical 66.4 kd protein in rsua-rply intergenic region] [gn:yejh] |
| CONTIG350 | 5103967_c2_51 | 901 | 6563 | 1035 | 345 | 1250 | 2.1(10)-127 | Escherichia coli | b2179 | [pn:hypothetical 38.1 kd protein in ber 5'''' region] [gn:yejb] |
| CONTIG350 | 682093_c3_56 | 902 | 6564 | 906 | 302 | 1310 | 9.0(10)-134 | Escherichia coli | b2178 | [pn:hypothetical 40.4 kd protein in ber 5'''' region] [gn:yejb] |
| CONTIG350 | 16803125_c3_58 | 903 | 6565 | 1644 | 548 | 1921 | 1.6(10)-198 | Escherichia coli | b2180 | [pn:hypothetical abc transporter in ber 5'''' region] [gn:yejf] |
| CONTIG350 | 25885842_c3_64 | 904 | 6566 | 480 | 160 | 117 | 2.3(10)-7 | Escherichia coli | S24805 | hypothetical protein fwd1566-escherichia coli |
| CONTIG350 | 14504807_c3_65 | 905 | 6567 | 363 | 121 | 172 | 3.5(10)-13 | Escherichia coli | P28247 | very hypothetical 19.2 kd protein in ber 3' region. |
| CONTIG350 | 20500018_c3_68 | 906 | 6568 | 309 | 103 | 343 | 2.7(10)-31 | Escherichia coli | b2185 | [pn:50s ribosomal protein 125] [gn:rply] |
| CONTIG351 | 4015938_f1_1 | 907 | 6569 | 1488 | 496 | 1348 | 8.5(10)-138 | Bacillus subtilis | ybaR | [pn:hypothetical protein] |
| CONTIG351 | 3621971_f1_2 | 908 | 6570 | 846 | 282 | 1339 | 7.7(10)-137 | Yersinia enterocolitica | Y13308 | [PN:hypothetical protein] [DE:Yersinia enterocolitica plasmid DNA fragment, strain 15673,] [NT:ORF2] [LE:3722] [RE:4588] [DI:complement] |
| CONTIG351 | 30275251_f2_16 | 909 | 6571 | 726 | 242 | 1028 | 6.9(10)-104 | Yersinia enterocolitica | U58366 | or:yersinia enterocolitica pn:arsh gn:arsh le:3823 re:4521 di:direct nt:required for arsenic resistance |
| CONTIG351 | 9947125_f3_29 | 910 | 6572 | 1536 | 512 | 536 | 9.5(10)-52 | Escherichia coli | b3558 | [pn:insertion element is150 hypothetical 33.3 kd protein] [gn:yi5b] |
| CONTIG351 | 10979628_c1_32 | 911 | 6573 | 1443 | 481 | 942 | 9.0(10)-95 | Rhizobium sp. | P55373 | putative transposase y4bf, |
| CONTIG351 | 1282876_c2_43 | 912 | 6574 | 465 | 155 | 105 | 4.5(10)-6 | Escherichia coli | P19770 | insertion element is150 hypothetical 14 kd protein (orfc). |
| CONTIG351 | 22350087_c2_48 | 913 | 6575 | 375 | 125 | 385 | 9.5(10)-36 | Escherichia coli | b3501 | [pn:arsenical resistance operon arsefg repressor] [gn:arsr] |
| CONTIG351 | 1964202_c2_49 | 914 | 6576 | 1302 | 434 | 1649 | 1.1(10)-169 | Escherichia coli | b3502 | [pn:arsenical pump membrane protein] [gn:arsb] |
| CONTIG351 | 4110263_c2_50 | 915 | 6577 | 435 | 145 | 659 | 8.8(10)-65 | Escherichia coli | b3503 | [pn:arsenate reductase] [gn:arsc] |
| CONTIG352 | 3047583_f1_4 | 916 | 6578 | 624 | 208 | 90 | 0.51 | Rattus norvegicus | S54307 | myosin heavy chain - rat |
| CONTIG352 | 5156338_f1_6 | 917 | 6579 | 486 | 162 | 101 | 9.4(10)-5 | Mycobacterium tuberculosis | Z95586 | unknown,, mtcy336.26, mtcy336.26, len |
| CONTIG352 | 35329530_f2_11 | 918 | 6580 | 1326 | 442 | 532 | 2.5(10)-51 | Bacteriophage HK97 | P49859 | portal protein (gp3). |
| CONTIG352 | 33694458_f3_14 | 919 | 6581 | 408 | 136 | 153 | 3.6(10)-11 | Bacteriophage phi-105 | L35561 | or:bacteriophage phi-105 pn:holin le:796 re:1170 di:direct |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG352 | 31922905_f3_15 | 920 | 6582 | 1770 | 590 | 611 | 1.1(10)-59 | Escherichia coli | b1149 | sr:bacteriophage phi-105 dna nt:orf2; potential dual start motif; putative [pn:hypothetical protein] |
| CONTIG352 | 3230287_f3_17 | 921 | 6583 | 876 | 292 | 108 | 0.00035 | Haemophilus influenzae | HI0714 | [pn:atp-dependent clp protease proteolytic component] [gn:clpp] |
| CONTIG353 | 5352308_f1_3 | 922 | 6584 | 1251 | 417 | 1489 | 9.6(10)-153 | Haemophilus influenzae | HI0166 | [pn:nitrogen fixation protein] [gn:rnfe] |
| CONTIG353 | 4900311_f1_5 | 923 | 6585 | 1227 | 409 | 1512 | 3.6(10)-155 | Haemophilus influenzae | HI0171 | [pn:phenolhydroxylase component] |
| CONTIG353 | 31257276_f2_12 | 924 | 6586 | 489 | 163 | 608 | 2.2(10)-59 | Haemophilus influenzae | HI0674 | [pn:xanthine guanine phosphoribosyl transferase gpt] [gn:hi0692] |
| CONTIG353 | 886265_f2_14 | 925 | 6587 | 1449 | 483 | 1348 | 8.5(10)-138 | Haemophilus influenzae | HI0164 | [pn:nadh] |
| CONTIG353 | 4015843_f2_19 | 926 | 6588 | 879 | 293 | 617 | 2.5(10)-60 | Haemophilus influenzae | HI0167 | [pn:hypothetical protein] |
| CONTIG353 | 2525302_f3_25 | 927 | 6589 | 1068 | 356 | 1529 | 5.5(10)-157 | Escherichia coli | b0231 | [pn:hypothetical protein dinp] [gn:dinp] |
| CONTIG353 | 16835331_f3_26 | 928 | 6590 | 642 | 214 | 586 | 4.7(10)-57 | Haemophilus influenzae | HI0168 | [pn:nadh] |
| CONTIG353 | 3402000_f3_27 | 929 | 6591 | 603 | 201 | 672 | 3.7(10)-66 | Haemophilus influenzae | HIN_166 | [pn:nadh] [gn:hi0170] |
| CONTIG354 | 897881_c2_41 | 930 | 6592 | 216 | 72 | 102 | 9.3(10)-6 | Escherichia coli | HI0173 | [pn:hypothetical protein] |
| CONTIG354 | 5283561_c2_42 | 931 | 6593 | 558 | 186 | 857 | 9.0(10)-86 | Escherichia coli | b0237 | [pn:aminoacyl-histidine dipeptidase precursor] [gn:pepd] |
| CONTIG354 | 32426885_f1_1 | 932 | 6594 | 942 | 314 | 1379 | 4.4(10)-141 | Escherichia coli | b0237 | [pn:aminoacyl-histidine dipeptidase precursor] [gn:pepd] |
| CONTIG354 | 5113562_f1_5 | 933 | 6595 | 1701 | 567 | 2515 | 1.8(10)-261 | Escherichia coli | b0779 | [pn:excision nuclease abc subunit b] [gn:uvrb] |
| CONTIG354 | 26442752_f1_11 | 934 | 6596 | 252 | 84 | 310 | 8.4(10)-28 | Escherichia coli | b0784 | [pn:molybdopterin converting factor, subunit 1] [gn:moad] |
| CONTIG354 | 29941531_f2_18 | 935 | 6597 | 444 | 148 | 374 | 1.3(10)-34 | Escherichia coli | b0791 | [pn:hypothetical protein] |
| CONTIG354 | 5192562_f3_31 | 936 | 6598 | 513 | 171 | 694 | 1.7(10)-68 | Escherichia coli | b0785 | [pn:molybdopterin converting factor, subunit 2] [gn:moae] |
| CONTIG354 | 33208555_f3_32 | 937 | 6599 | 1212 | 404 | 1473 | 4.7(10)-151 | Escherichia coli | b0781 | [pn:molybdenum cofactor biosynthesis protein a] [gn:moaa] |
| CONTIG354 | 22353383_f3_33 | 938 | 6600 | 537 | 179 | 816 | 2.0(10)-81 | Escherichia coli | b0782 | [pn:molybdenum cofactor biosynthesis protein b] [gn:moab] |
| CONTIG354 | 31853402_f3_35 | 939 | 6601 | 489 | 163 | 768 | 2.5(10)-76 | Escherichia coli | b0783 | [pn:molybdenum cofactor biosynthesis protein c] [gn:moac] |
| CONTIG354 | 3682349_c1_45 | 940 | 6602 | 711 | 237 | 998 | 1.0(10)-100 | Escherichia coli | b0786 | [pn:hypothetical protein] |
| CONTIG354 | 15907653_c1_48 | 941 | 6603 | 1297 | 432 | 1608 | 2.3(10)-165 | Escherichia coli | b0788 | [pn:hypothetical protein] |
| CONTIG354 | 4194068_c1_54 | 942 | 6604 | 1155 | 385 | 1314 | 3.3(10)-134 | Escherichia coli | b0780 | [pn:hypothetical protein] |
| CONTIG354 | 24878930_c2_61 | 943 | 6605 | 918 | 306 | 974 | 3.7(10)-98 | Escherichia coli | b0790 | [pn:hypothetical protein] |
| CONTIG354 | 32048331_c2_62 | 944 | 6606 | 306 | 102 | 454 | 4.5(10)-43 | Escherichia coli | b0789 | [pn:hypothetical protein] |
| CONTIG354 | 34018807_c3_74 | 945 | 6607 | 1344 | 448 | 1686 | 1.3(10)-173 | Escherichia coli | b0790 | [pn:hypothetical protein] |
| CONTIG354 | 6350712_f1_4 | 946 | 6608 | 717 | 239 | 721 | 2.3(10)-71 | Escherichia coli | b3651 | [pn:spou protein] [gn:spou] |
| CONTIG355 | 36134652_f1_5 | 947 | 6609 | 717 | 239 | 1055 | 9.5(10)-107 | Escherichia coli | b3652 | [pn:dna recombinase] [gn:recg] |
| CONTIG355 | 644762_f1_8 | 948 | 6610 | 2085 | 695 | 3169 | 0 | Escherichia coli | b3654 | [pn:hypothetical 48.9 kd protein in glts 3""" region] [gn:yice] |
| CONTIG355 | 21488907_f2_14 | 949 | 6611 | 1425 | 475 | 1955 | 4.0(10)-202 | Escherichia coli | b3649 | [pn:dna-directed rna polymerase omega chain] [gn:rpoz] |
| CONTIG355 | 6016411_f2_24 | 950 | 6612 | 330 | 110 | 347 | 1.0(10)-31 | Escherichia coli | b3655 | [pn:hypothetical 62.3 kd protein in glts-sclc intergenic region] [gn:yich] |
| CONTIG355 | 11223782_f3_26 | 951 | 6613 | 1728 | 576 | 2085 | 6.7(10)-216 | Escherichia coli | b3650 | [pn:diphosphate 3""-pyrophospholhydrolase] [gn:spot] |
| CONTIG355 | 104886_c1_42 | 952 | 6614 | 2130 | 710 | 3369 | 0 | Escherichia coli | b3653 | hypothetical 77k protein (spot 3' region) in glts-sclc intergenic region)-escherichia coli |
| CONTIG355 | 24035758_c2_62 | 953 | 6615 | 1215 | 405 | 1441 | 1.2(10)-147 | Escherichia coli | A30374 | hypothetical 77k protein (spot 3' region)-escherichia coli |
| CONTIG356 | 2396282_fl_8 | 954 | 6616 | 585 | 195 | 632 | 6.4(10)-62 | Escherichia coli | b3610 | [pn:glutaredoxin 3] [gn:grxc] |
| CONTIG356 | 21532290_f1_9 | 955 | 6617 | 255 | 85 | 398 | 4.0(10)-37 | Escherichia coli | b3608 | [pn:1-glycerol 3-phosphate dehydrogenase] [gn:gpsa] |
| CONTIG356 | 13066677_f1_10 | 956 | 6618 | 1086 | 362 | 1613 | 7.0(10)-166 | Escherichia coli | b3607 | [pn:serine acetyltransferase] [gn:cyse] |
| CONTIG356 | 3151805_f2_15 | 957 | 6619 | 876 | 292 | 1374 | 1.5(10)-140 | Escherichia coli | b3611 | [pn:hypothetical 15.6 kd protein in secb-tdh intergenic region] [gn:yibn] |
| CONTIG356 | 602133_f2_16 | 958 | 6620 | 459 | 153 | 626 | 2.7(10)-61 | Escherichia coli | b3609 | [pn:protein-export protein secb] [gn:secb] |
| CONTIG356 | 31773430_c1_32 | 959 | 6621 | 504 | 168 | 736 | 6.0(10)-73 | Escherichia coli | P20343 | very hypothetical cysx protein. |
| CONTIG356 | 24348137_c2_46 | 960 | 6622 | 519 | 173 | 345 | 1.6(10)-31 | Escherichia coli | b3612 | [pu:putative 2,3-bisphosphoglycerate-independent phosphoglycerate] [gn:yibo] |
| CONTIG356 | 4393955_c2_47 | 961 | 6623 | 1587 | 529 | 2409 | 3.2(10)-250 | Escherichia coli | b3613 | [pn:hypothetical 47.5 kd protein in secb-tdh intergenic region] [gn:yibp] |
| CONTIG356 | 21509378_c2_48 | 962 | 6624 | 1293 | 431 | 1601 | 1.3(10)-164 | Escherichia coli | b3614 | [pn:hypothetical 30.7 kd protein in secb-tdh intergenic region] [gn:yibq] |
| | | 963 | 6625 | 966 | 322 | 1034 | 1.6(10)-104 | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG356 | 25562927_c3_51 | 964 | 6626 | 417 | 139 | 523 | 2.2(10)-50 | Escherichia coli | P15041 | very hypothetical 17.7 kd protein in secb region. |
| CONTIG357 | 33777166_f1_3 | 965 | 6627 | 606 | 202 | 717 | 6.2(10)-71 | Escherichia coli | b2136 | [pn:hypothetical 21.4 kd protein in pbpg-cdd intergenic region] [gn:yohd] |
| CONTIG357 | 25595075_f1_10 | 966 | 6628 | 432 | 144 | 404 | 9.1(10)-38 | Escherichia coli | b2141 | [pn:hypothetical 14.6 kd protein in pbpg-cdd intergenic region or:escherichia coli pn:yohk le:43789 re:44535 di:direct sr:escherichia coli k12 bhb2600 |
| CONTIG357 | 2204902_f2_25 | 967 | 6629 | 360 | 120 | 126 | 6.0(10)-8 | Escherichia coli | U00007 | |
| CONTIG357 | 4348418_f2_26 | 968 | 6630 | 894 | 298 | 1234 | 1.0(10)-125 | Escherichia coli | b2143 | [pn:cytidine deaminase] [gn:cdd] |
| CONTIG357 | 36580143_f3_41 | 969 | 6631 | 720 | 240 | 784 | 5.0(10)-78 | Escherichia coli | b2142 | [pn:hypothetical 24.5 kd protein in pbpg-cdd intergenic region] [gn:yohk] |
| CONTIG357 | 20989806_f3_42 | 970 | 6632 | 765 | 255 | 1098 | 2.6(10)-111 | Escherichia coli | b2144 | [pn:sana protein] [gn:sana] |
| CONTIG357 | 13804192_c1_50 | 971 | 6633 | 978 | 326 | 1378 | 5.5(10)-141 | Escherichia coli | b2140 | [pn:hypothetical 35.2 kd protein in pbpg-cdd intergenic region] [gn:ycek] |
| CONTIG357 | 33625277_c1_56 | 972 | 6634 | 537 | 179 | 399 | 3.1(10)-37 | Escherichia coli | b2134 | [pn:penicillin-binding protein 7 precursor] [gn:pbpg] |
| CONTIG357 | 9960917_c2_65 | 973 | 6635 | 930 | 310 | 1038 | 6.0(10)-105 | Escherichia coli | b2137 | [pn:hypothetical oxidoreductase in pbpg-cdd intergenic region] |
| CONTIG357 | 29822555_c2_67 | 974 | 6636 | 645 | 215 | 899 | 3.2(10)-90 | Escherichia coli | b2135 | [pn:hypothetical 22.4 kd protein in pbpg-cdd intergenic region] [gn:yohc] |
| CONTIG357 | 34547640_c2_68 | 975 | 6637 | 267 | 89 | 349 | 1.7(10)-36 | Escherichia coli | b2134 | [pn:penicillin-binding protein 7 precursor] [gn:pbpg] |
| CONTIG357 | 6532628_c3_76 | 976 | 6638 | 1431 | 477 | 1491 | 6.0(10)-153 | Escherichia coli | b2138 | [pn:hypothetical 43.3 kd protein in pbpg-cdd intergenic region] [gn:yohg] |
| CONTIG358 | 35257828_f1_2 | 977 | 6639 | 2559 | 853 | 3835 | 0 | Escherichia coli | b1049 | [pn:periplasmic glucans biosynthesis protein mdoh] [gn:mdoh] |
| CONTIG358 | 4506967_f1_3 | 978 | 6640 | 237 | 79 | 333 | 3.1(10)-30 | Escherichia coli | b1050 | [pn:hypothetical protein in mdoh-msyb intergenic region] [gn:ycej] |
| CONTIG358 | 30476516_f2_17 | 979 | 6641 | 1137 | 379 | 1610 | 1.5(10)-165 | Escherichia coli | b1055 | [pn:hypothetical 40.0 kd protein in htrb 5'" region] [gn:ycea] |
| CONTIG358 | 23472503_f3_22 | 980 | 6642 | 1614 | 538 | 2500 | 7.2(10)-260 | Escherichia coli | b1048 | [pn:periplasmic glucans biosynthesis protein mdog precursor] [gn:mdog] |
| CONTIG358 | 632292_c1_35 | 981 | 6643 | 621 | 207 | 788 | 1.8(10)-78 | Escherichia coli | b1056 | [pn:hypothetical 18.7 kd protein in htrb 5'" region] [gn:ycej] |
| CONTIG358 | 15112506_c2_56 | 982 | 6644 | 957 | 319 | 1353 | 2.5(10)-138 | Escherichia coli | b1054 | [pn:membrane protein affecting cell division, growth and high temperature survival] [gn:htrb] |
| CONTIG358 | 19688586_c2_57 | 983 | 6645 | 1290 | 430 | 1516 | 1.3(10)-155 | Escherichia coli | b1053 | [pn:hypothetical 43.9 kd protein in msyb-htrb intergenic region] [gn:ycee] |
| CONTIG358 | 11133918_c2_65 | 984 | 6646 | 471 | 157 | 714 | 1.3(10)-70 | Escherichia coli | b1047 | [pn:hypothetical protein] |
| CONTIG358 | 32632692_c3_66 | 985 | 6647 | 309 | 103 | 392 | 1.7(10)-36 | Escherichia coli | b1059 | [pn:hypothetical protein] [gn:sola] |
| CONTIG358 | 788387_c3_67 | 986 | 6648 | 651 | 217 | 655 | 2.2(10)-64 | Escherichia coli | b1057 | [pn:hypothetical protein] |
| CONTIG358 | 1985430_c3_73 | 987 | 6649 | 423 | 141 | 608 | 2.2(10)-59 | Escherichia coli | b1051 | [pn:acidic protein msyb, multicopy suppressor of sccy] [gn:msyb] |
| CONTIG358 | 11892042_c3_74 | 988 | 6650 | 273 | 91 | 90 | 0.00063 | Mycobacterium tuberculosis | Q10700 | hypothetical 26.0 kd protein cy49.31c. |
| CONTIG359 | 23704667_f1_3 | 989 | 6651 | 1299 | 433 | 1955 | 4.0(10)-202 | Escherichia coli | b3780 | [pn:rhlb] [gn:rhlb] |
| CONTIG359 | 3157813_f1_4 | 990 | 6652 | 1491 | 497 | 1952 | 8.4(10)-202 | Escherichia coli | b3779 | [pn:guanosine pentaphosphatase] [gn:gppa] |
| CONTIG359 | 36110330_f1_8 | 991 | 6653 | 277 | 93 | 344 | 2.1(10)-31 | Escherichia coli | b3775 | [pn:peptidyl-prolyl cis-trans isomerase c] [gn:ppic] |
| CONTIG359 | 15812950_c1_32 | 992 | 6654 | 405 | 135 | 595 | 5.2(10)-58 | Escherichia coli | b3781 | [pn:thioredoxin] [gn:trxa] |
| CONTIG359 | 32453180_c2_37 | 993 | 6655 | 2031 | 677 | 3208 | 0 | Escherichia coli | b3778 | [pn:atp-dependent dna helicase reg] [gn:rep] |
| CONTIG359 | 4382713_c2_41 | 994 | 6656 | 498 | 166 | 643 | 4.2(10)-63 | Escherichia coli | b3784 | [pn:putative undecaprenyl-phosphate alpha-n-acetylglucosaminyltransferase] [gn:rfe] |
| CONTIG359 | 26599182_c3_44 | 995 | 6657 | 1338 | 446 | 2038 | 6.5(10)-211 | Escherichia coli | b3783 | [pn:transcription termination factor] [gn:rho] |
| CONTIG36 | 7089053_c3_5 | 996 | 6658 | 525 | 175 | 891 | 2.2(10)-89 | Escherichia coli | b2580 | [pn:uracil-dna glycosylase] [gn:ung] |
| CONTIG360 | 6522187_f1_2 | 997 | 6659 | 885 | 295 | 949 | 1.6(10)-95 | Klebsiella pneumoniae | AF040380 | [de:klebsiella pneumoniae ribosomal protein 111 methyltransferase (prma) gene, partial cds; carbonic anhydrase (cah) and yhdg homologenes, complete cds; and small dna binding protein f"] [pn:carbonic anhydrase] [gn:cah] |
| CONTIG360 | 4741568_f1_9 | 998 | 6660 | 1149 | 383 | 1396 | 7.0(10)-143 | Escherichia coli | b3265 | [pn:acre] [gn:acre] |
| CONTIG360 | 6292163_f2_10 | 999 | 6661 | 1275 | 428 | 2007 | 1.3(10)-207 | Escherichia coli | b3256 | [pn:biotin carboxylase] [gn:accc] |
| CONTIG360 | 30163283_f2_11 | 1000 | 6662 | 291 | 97 | 200 | 3.7(10)-16 | Escherichia coli | b3257 | [pn:hypothetical 9.1 kd protein in accc-panf intergenic region] [gn:yhdt] |
| CONTIG360 | 34569061_f2_14 | 1001 | 6663 | 900 | 300 | 1313 | 4.4(10)-134 | Escherichia coli | b3259 | [pn:ribosomal protein 111 methyltransferase] [gn:prma] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG360 | 33797942_f2_17 | 1002 | 6664 | 312 | 104 | 401 | 1.8(10)-37 | Haemophilus influenzae | HI0980 | [pn:factor-for-inversion stimulation protein] [gn:fis] |
| CONTIG360 | 2908507_f2_19 | 1003 | 6665 | 2253 | 751 | 809 | 1.3(10)-94 | Bacillus subtilis | ykoW | [pn:hypothetical protein] |
| CONTIG360 | 3991262_f3_22 | 1004 | 6666 | 1488 | 496 | 1914 | 9.0(10)-198 | Escherichia coli | b3258 | [pn:sodium/pantothenate symporter] [gn:panf] |
| CONTIG360 | 4556526_f3_25 | 1005 | 6667 | 969 | 323 | 1585 | 6.5(10)-163 | Escherichia coli | b3260 | [pn:hypothetical 35.9 kd protein in pmra-fis intergenic region] [gn:yhdg] |
| CONTIG360 | 2603640_f3_31 | 1006 | 6668 | 233 | 78 | 145 | 6.5(10)-9 | Escherichia coli | b3266 | [pn:acrf] [gn:acrf] |
| CONTIG360 | 16834836_c3_58 | 1007 | 6669 | 654 | 218 | 555 | 9.1(10)-54 | Escherichia coli | b3264 | [pn:potential acref/envcd operon repressor] [gn:envr] |
| CONTIG361 | 16853457_f1_1 | 1008 | 6670 | 918 | 306 | 1425 | 5.9(10)-146 | Escherichia coli | b0750 | [pn:quinolinate synthetase a protein] [gn:nada] |
| CONTIG361 | 14457650_f2_13 | 1009 | 6671 | 789 | 263 | 881 | 2.6(10)-88 | Escherichia coli | b0751 | [pn:pnuc protein] [gn:pnuc] |
| CONTIG361 | 3387637_f2_17 | 1010 | 6672 | 1077 | 359 | 1703 | 2.1(10)-175 | Escherichia coli | b0754 | [pn:phospho-2-dehydro-3-deoxyheptonate aldolase] |
| CONTIG361 | 34241057_c1_38 | 1011 | 6673 | 1113 | 371 | 1434 | 6.5(10)-147 | Escherichia coli | b0756 | [pn:aldose 1-epimerase] [gn:galm] |
| CONTIG361 | 11995990_c1_42 | 1012 | 6674 | 447 | 149 | 149 | 6.0(10)-11 | Escherichia coli | b0753 | [pn:hypothetical protein] [gn:ybgs] |
| CONTIG361 | 25980277_c1_43 | 1013 | 6675 | 954 | 318 | 930 | 1.7(10)-93 | Escherichia coli | b0752 | [pn:hypothetical protein] [gn:ybgr] |
| CONTIG361 | 877066_c2_47 | 1014 | 6676 | 1182 | 394 | 1686 | 1.3(10)-173 | Escherichia coli | b0757 | [pn:galactokinase] [gn:galk] |
| CONTIG361 | 23572188_c2_50 | 1015 | 6677 | 756 | 252 | 1120 | 1.2(10)-113 | Escherichia coli | b0755 | [pn:hpsphoglycerate mutase 1] [gn:gpma] |
| CONTIG361 | 36541291_c3_57 | 1016 | 6678 | 1218 | 406 | 1734 | 1.1(10)-178 | Escherichia coli | b0758 | [pn:udp-glucose 4-epimerase] [gn:gale] |
| CONTIG361 | 4343818_c3_58 | 1017 | 6679 | 1056 | 352 | 1772 | 1.0(10)-182 | Escherichia coli | b0759 | [pn:galactose-1-phosphate uridylyltransferase] [gn:galt] |
| CONTIG362 | 20177211_f1_1 | 1018 | 6680 | 696 | 232 | 798 | 1.6(10)-79 | Escherichia coli | b0489 | [pn:hypothetical protein] [gn:ybbk] |
| CONTIG362 | 1054782_f1_5 | 1019 | 6681 | 858 | 286 | 924 | 2.8(10)-82 | Escherichia coli | b0482 | [pn:hypothetical protein] [gn:ybap] |
| CONTIG362 | 12913181_f1_6 | 1020 | 6682 | 579 | 193 | 666 | 1.6(10)-65 | Escherichia coli | b0481 | [pn:hypothetical protein] [gn:ybar] |
| CONTIG362 | 2283_f2_13 | 1021 | 6683 | 2640 | 880 | 3509 | 0 | Escherichia coli | b0484 | [pn:hypothetical protein] [gn:ybbi] |
| CONTIG362 | 25431562_f3_20 | 1022 | 6684 | 456 | 152 | 449 | 1.6(10)-42 | Escherichia coli | b0488 | [pn:hypothetical protein] [gn:ybbl] |
| CONTIG362 | 6456561_f3_27 | 1023 | 6685 | 1026 | 342 | 1248 | 3.3(10)-127 | Escherichia coli | b0479 | [pn:fosmidomycin resistance protein] [gn:fsr] |
| CONTIG362 | 4735278_c1_29 | 1024 | 6686 | 1698 | 566 | 2631 | 9.4(10)-274 | Escherichia coli | b0480 | [pn:udp-sugar hydrolase precursor] [gn:usha] |
| CONTIG362 | 21659407_c3_62 | 1025 | 6687 | 444 | 148 | 603 | 7.5(10)-59 | Escherichia coli | b0487 | [pn:hypothetical protein] [gn:ybbi] |
| CONTIG362 | 672192_c3_66 | 1026 | 6688 | 207 | 69 | 113 | 6.7(10)-6 | Escherichia coli | b0544 | [pn:hypothetical protein] [gn:ybck] |
| CONTIG362 | 21666540_f1_5 | 1027 | 6689 | 735 | 245 | 1128 | 1.8(10)-114 | Transposon Tn1525 | M12900 | or:transposon tn1525 gn:p12 le:996 re:>1721 di:direct sr:transposon tn1525 dna nt:putative |
| CONTIG363 | 4085387_f3_19 | 1028 | 6690 | 228 | 76 | 96 | 0.00018 | Thiobacillus ferrooxidans | AF032884 | [de:thiobacillus ferrooxidans n-acetylglucosamine-1-phosphateuridyltransferase (glmu) gene, partial cds; glucosamine synthase (glms)"] [pn:transposition complex] [gn:tnsa] |
| CONTIG363 | 2928432_f3_25 | 1029 | 6691 | 861 | 287 | 1457 | 2.3(10)-149 | Cloning vector pKF296 | D63840 | or:cloning vector pkf296 pn:aminoglucoside phosphotransferase in supe host gn:apg3 le:322 re:1137 di:complement sr:cloning vector pkf296 dna nt:cag for gln at the |
| CONTIG363 | 21666540_f3_26 | 1030 | 6692 | 786 | 262 | 1128 | 1.8(10)-114 | Transposon Tn1525 | M12900 | or:transposon tn1525 gn:p12 le:996 re:>1721 di:direct sr:transposon tn1525 dna nt:putative |
| CONTIG363 | 6439528_f3_31 | 1031 | 6693 | 255 | 85 | 345 | 1.6(10)-31 | Escherichia coli | I77547 | hypothetical protein 2 (insertion sequence is903)-escherichia coli |
| CONTIG363 | 4772550_c1_32 | 1032 | 6694 | 1665 | 555 | 1066 | 6.5(10)-108 | Escherichia coli | b4114 | [pn:hypothetical 61.7 kd protein in bass-adiy intergenic region] |
| CONTIG363 | 11891882_c1_35 | 1033 | 6695 | 738 | 246 | 1268 | 2.6(10)-129 | Salmonella ordonez | S34451 | hypothetical protein (insertion sequence is261)-salmonellaordonez plasmid pip173 |
| CONTIG363 | 25558159_c2_40 | 1034 | 6696 | 821 | 273 | 1387 | 6.2(10)-142 | Escherichia coli | X02527 | or:pi escherichia coli 1e:199 re:1122 di:direct nt:orf1 (aa1-307) |
| CONTIG363 | 11891882_c2_45 | 1035 | 6697 | 738 | 246 | 1268 | 2.6(10)-129 | Salmonella ordonez | S34451 | hypothetical protein (insertion sequence is261)-salmonellaordonez plasmid pip173 |
| CONTIG363 | 2397500_c2_47 | 1036 | 6698 | 999 | 333 | 1492 | 4.7(10)-153 | Yersinia pestis | AF053946 | [de:yersinia pestis plasmid pcd1, complete plasmid sequence] [pn:transposase (tn1000) homolog] [gn:tnpa] |
| CONTIG364 | 12553761_c3_49 | 1037 | 6699 | 2148 | 716 | 2685 | 1.8(10)-279 | Escherichia coli | I56963 | transposase (transposon)-escherichia coli |
| CONTIG364 | 4979758_f1_7 | 1038 | 6700 | 591 | 197 | 571 | 1.8(10)-55 | Escherichia coli | b0622 | [pn:hypothetical portein in cspe 5"" region] [gn:ybeg] |
| CONTIG364 | 25882937_f1_12 | 1039 | 6701 | 2715 | 905 | 1008 | 9.0(10)-102 | Methanobacterium thermoautotrophicum | MTH1516 | [pn:cation-transporting p-atpase pacl] |
| CONTIG364 | 2350761_f2_26 | 1040 | 6702 | 540 | 180 | 370 | 3.7(10)-34 | Escherichia coli | b0607 | [pn:hypothetical protein] [gn:ybdq] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG364 | 14266803_f3_46 | 1041 | 6703 | 713 | 238 | 928 | 2.7(10)-93 | Escherichia coli | b1990 | [pn:31.6 kd protein in cobt 3'" region precursor] [gn:erfk] |
| CONTIG364 | 19689037_c1_55 | 1042 | 6704 | 1110 | 370 | 186 | 7.7(10)-12 | Escherichia coli | b2074 | [pn:hypothetical protein] |
| CONTIG364 | 16103578_c2_70 | 1043 | 6705 | 477 | 159 | 169 | 7.4(10)-13 | Saccharomyces cerevisiae | X85757 | or:saccharomyces cerevisiae pn:unknown gn:internal orf g1669 le:e6964 re:7365 di:direct sr:baker's yeast |
| CONTIG364 | 33632800_c2_77 | 1044 | 6706 | 1344 | 448 | 1931 | 1.3(10)-199 | Escherichia coli | b1981 | [pn:hypothetical protein] [gn:shia] |
| CONTIG364 | 4027332_c3_85 | 1045 | 6707 | 3075 | 1025 | 633 | 2.5(10)-59 | Haemophilus influenzae | HI0895 | [pn:acriflavine resistance protein] [gn:acrb] |
| CONTIG364 | 32523467_c3_88 | 1046 | 6708 | 1551 | 517 | 2201 | 3.5(10)-228 | Escherichia coli | b1982 | [pn:amp nucleosidase] [gn:amn] |
| CONTIG364 | 24237891_f1_12 | 1047 | 6709 | 538 | 180 | 509 | 6.9(10)-49 | Escherichia coli | b3939 | [pn:cystathionine gamma-synthase] [gn:mctb] |
| CONTIG365 | 7110281_f2_15 | 1048 | 6710 | 312 | 104 | 106 | 3.5(10)-6 | Helicobacter pylori | AC000108 | or:helicobacter pylori pn:orf2 le:155 re:595 di:complement nt:orf2-probable transmembrane regions @ aa 18-36; |
| CONTIG365 | 4391268_f2_24 | 1049 | 6711 | 222 | 74 | 345 | 1.6(10)-31 | Escherichia coli | b3936 | [pn:50s ribosomal protein 131] [gn:rpmc] |
| CONTIG365 | 15738762_f2_25 | 1050 | 6712 | 765 | 255 | 345 | 1.6(10)-31 | Salmonella typhimurium | P43022 | hypothetical 15.6 kd protein in rhat 5' region. |
| CONTIG365 | 24266301_c1_46 | 1051 | 6713 | 1080 | 360 | 1477 | 1.8(10)-151 | Escherichia coli | b3934 | [pn:transcriptional repressor cytr] [gn:cytr] |
| CONTIG365 | 31885957_c1_48 | 1052 | 6714 | 459 | 153 | 124 | 1.6(10)-7 | Escherichia coli | L06547 | or:escherichia coli pn:suppressor protein gn:msga le:92 re:961 di:direct sr:escherichia coli (strain |
| CONTIG365 | 2246056_c1_49 | 1053 | 6715 | 546 | 182 | 757 | 3.6(10)-75 | Escherichia coli | b3932 | [pn:heat shock protein hslv] [gn:hslv] |
| CONTIG365 | 4400693_f2_50 | 1054 | 6716 | 1074 | 358 | 1692 | 3.0(10)-174 | Escherichia coli | b3931 | [pn:heat shock protein hslu] [gn:hslu] |
| CONTIG365 | 32656378_c2_53 | 1055 | 6717 | 2325 | 775 | 3256 | 0 | Escherichia coli | b3935 | [pn:primosomal protein replication factor] [gn:pria] |
| CONTIG365 | 4313842_c1_57 | 1056 | 6718 | 327 | 109 | 518 | 7.7(10)-50 | Escherichia coli | b3938 | [pn:metf aporepressor] [gn:metj] |
| CONTIG365 | 23635316_c3_63 | 1057 | 6719 | 996 | 332 | 421 | 2.0(10)-81 | Escherichia coli | b3933 | [pn:cell division protein ftsn] [gn:ftsn] |
| CONTIG365 | 25676576_f1_4 | 1058 | 6720 | 2142 | 714 | 2255 | 6.5(10)-234 | Escherichia coli | b0661 | [pn:hypothetical protein] [gn:ylea] |
| CONTIG366 | 34414182_f1_5 | 1059 | 6721 | 474 | 158 | 593 | 8.5(10)-58 | Escherichia coli | b0659 | [pn:hypothetical protein] [gn:ybey] |
| CONTIG366 | 25503555_f1_6 | 1060 | 6722 | 963 | 321 | 1269 | 2.0(10)-129 | Escherichia coli | b0658 | [pn:hypothetical protein] |
| CONTIG366 | 33703178_f2_14 | 1061 | 6723 | 1227 | 409 | 1648 | 1.3(10)-169 | Escherichia coli | b0660 | [pn:hypothetical protein] |
| CONTIG366 | 4532311_f2_17 | 1062 | 6724 | 768 | 256 | 1032 | 2.6(10)-104 | Escherichia coli | b0655 | [pn:hypothetical protein in gltj 5'" region] [gn:ybej] |
| CONTIG366 | 15623227_f3_25 | 1063 | 6725 | 1539 | 513 | 2176 | 1.5(10)-225 | Escherichia coli | b0657 | [pn:apolipoprotein n-acyltransferase] [gn:lnt] |
| CONTIG366 | 14897193_c1_35 | 1064 | 6726 | 1188 | 396 | 1499 | 8.5(10)-154 | Escherichia coli | b0662 | [pn:hypothetical protein] |
| CONTIG366 | 4586018_c1_36 | 1065 | 6727 | 297 | 99 | 232 | 1.6(10)-19 | Escherichia coli | b0663 | [pn:hypothetical protein] |
| CONTIG366 | 22678556_c1_37 | 1066 | 6728 | 246 | 82 | 139 | 1.1(10)-9 | Escherichia coli | b0667 | [pn:hypothetical protein] |
| CONTIG366 | 20510955_c2_48 | 1067 | 6729 | 246 | 82 | 169 | 7.4(10)-13 | Escherichia coli | b0669 | [pn:hypothetical protein] |
| CONTIG366 | 10400328_c3_58 | 1068 | 6730 | 378 | 126 | 149 | 9.6(10)-11 | Escherichia coli | b0669 | [pn:dna-invertase pin] [gn:pin] |
| CONTIG367 | 33828125_f1_9 | 1069 | 6731 | 588 | 196 | 736 | 6.0(10)-73 | Escherichia coli | b1158 | [pn:umud protein] [gn:umud] |
| CONTIG367 | 13800432_f2_20 | 1070 | 6732 | 501 | 167 | 567 | 4.9(10)-55 | Escherichia coli | b1183 | [pn:umuc protein] [gn:umuc] |
| CONTIG367 | 21878768_f3_24 | 1071 | 6733 | 531 | 177 | 829 | 8.5(10)-83 | Enterobacter agglomerans | B38965 | hypothetical protein b (insertion sequence is 1222)-enterobacter agglomerans |
| CONTIG367 | 17000680_f3_25 | 1072 | 6734 | 645 | 215 | 264 | 6.2(10)-23 | Haemophilus influenzae | HI1415 | [pn:hypothetical protein] |
| CONTIG367 | 11468_f3_26 | 1073 | 6735 | 1023 | 341 | 115 | 0.00016 | Bacillus subtilis | xtmA | [pn:pbsx defective prophage terminase] [gn:yksf] |
| CONTIG367 | 859550_f3_30 | 1074 | 6736 | 1299 | 433 | 1893 | 1.5(10)-195 | Escherichia coli | b1184 | [pn:umuc protein] [gn:umuc] |
| CONTIG367 | 16813157_c2_45 | 1075 | 6737 | 360 | 120 | 277 | 2.6(10)-24 | Escherichia coli | b1931 | [pn:yedg] [gn:yedg] |
| CONTIG367 | 284787_c2_50 | 1076 | 6738 | 636 | 212 | 98 | 1.8(10)-5 | coliphage T2 | P07067 | tail fiber protein gp37. |
| CONTIG367 | 9823576_c3_61 | 1077 | 6739 | 318 | 106 | 496 | 1.6(10)-47 | Escherichia coli | b1931 | [pn:yedg] [gn:yedg] |
| CONTIG368 | 4964080_c1_40 | 1078 | 6740 | 1146 | 382 | 1728 | 4.5(10)-178 | Escherichia coli | b3786 | [gn:rffe] |
| CONTIG368 | 12969003_c1_44 | 1079 | 6741 | 1266 | 422 | 1583 | 1.1(10)-162 | Escherichia coli | b3792 | [pn:hypothetical 45.0 kd protein in rffe-rfft intergenic region] [gn:yifj] |
| CONTIG368 | 1223875_c2_53 | 1080 | 6742 | 981 | 327 | 1423 | 9.5(10)-146 | Escherichia coli | b3785 | [pn:hypothetical protein] [gn:yifc] |
| CONTIG368 | 32695160_c2_56 | 1081 | 6743 | 696 | 232 | 620 | 1.2(10)-60 | Escherichia coli | b3790 | [pn:hypothetical 19.6 kd protein in rffe-rfft intergenic region] [gn:yifh] |
| CONTIG368 | 23886_c2_59 | 1082 | 6744 | 1425 | 475 | 1579 | 2.7(10)-162 | Escherichia coli | b3793 | [pn:4-alpha-1-fucosyltransferase] [gn:rfft] |
| CONTIG368 | 3949178_c2_60 | 1083 | 6745 | 753 | 251 | 1103 | 7.7(10)-112 | Escherichia coli | b3794 | [pn:probable udp-n-acetyl-d-mannosaminuronic acid transferase] [gn:rfffm] |
| CONTIG368 | 31285313_c2_61 | 1084 | 6746 | 984 | 328 | 1153 | 3.8(10)-117 | Escherichia coli | b3795 | [pn:probably transport protein yifk] [gn:yifk] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG368 | 36413932_c3_64 | 1085 | 6747 | 1281 | 427 | 1871 | 3.2(10)-193 | Escherichia coli | b3787 | [pn:udp-mannac dehydrogenase] [gn:rffd] |
| CONTIG368 | 16927331_c3_66 | 1086 | 6748 | 1305 | 435 | 1799 | 1.3(10)-185 | Escherichia coli | b3791 | [pn:hypothetical 41.9 kd protein in rffe-rfft intergenic region] [gn:yifi] |
| CONTIG368 | 14880207_c3_70 | 1087 | 6749 | 1086 | 362 | 863 | 2.1(10)-86 | Escherichia coli | b4405 | [pn:hypothetical protein] |
| CONTIG369 | 12144586_f1_4 | 1088 | 6750 | 873 | 291 | 116 | 0.00024 | Chlorella virus SC-1A | U65736 | or:chlorella virus sc-1a pn.dna adenine methyltransferase gn:m.cvisi le:51 re:1169 di:direct |
| CONTIG369 | 14875251_c3_55 | 1089 | 6751 | 1095 | 365 | 1548 | 5.5(10)-159 | Serratia marcescens | U62006 | rep protein, rep hi24, putative rep protein; similar to f plasmid rep |
| CONTIG370 | 6413317_c1_37 | 1090 | 6752 | 819 | 273 | 166 | 1.0(10)-10 | Methanococcus jannaschii | MJ1187 | [pn:dinitrogenase reductase activating glycohydrolase] [gn:drag] |
| CONTIG370 | 2605643_c1_42 | 1091 | 6753 | 4371 | 1457 | 354 | 4.4(10)-64 | Escherichia coli | b3593 | [pn:rhsa protein precursor] [gn:rhsa] |
| CONTIG370 | 6369787_c2_45 | 1092 | 6754 | 2283 | 761 | 656 | 1.8(10)-64 | Escherichia coli | AF044503 | [de:escherichia coli strain ec11 unknown (498), hcp gene, complete cds; and rhsg accessory genetic element vgrg protein, core component anddsorf-g1 genes, complete cds] [pn:vgrg protein] |
| CONTIG371 | 4538312_f1_10 | 1093 | 6755 | 1071 | 357 | 606 | 3.6(10)-59 | Escherichia coli | b0846 | [pn:hypothetical protein] |
| CONTIG371 | 32531952_f3_34 | 1094 | 6756 | 738 | 246 | 1154 | 3.1(10)-117 | Escherichia coli | b0839 | [pn:penicillin-binding protein 6 precursor] [gn:dacc] |
| CONTIG371 | 4532942_f3_36 | 1095 | 6757 | 1242 | 414 | 1804 | 4.0(10)-186 | Escherichia coli | b0842 | [pn:hypothetical protein] [gn:cmr] |
| CONTIG371 | 4454693_c1_46 | 1096 | 6758 | 489 | 163 | 170 | 5.7(10)-13 | Vibrio cholerae | S81006 | or:vibrio cholerae pn:hcp gn:hcp le:690 re:1208 di:direct sr:vibrio cholerae o17 nt:28 kda secreted hydrophilic protein; this sequence |
| CONTIG371 | 1962837_c1_48 | 1097 | 6759 | 1293 | 431 | 1611 | 1.2(10)-165 | Escherichia coli | b3502 | [pn:arsenical pump membrane protein] [gn:arsb] |
| CONTIG371 | 4119678_c1_49 | 1098 | 6760 | 441 | 147 | 605 | 4.5(10)-59 | Escherichia coli | b3503 | [pn:arsenate reductase] [gn:arsc] |
| CONTIG371 | 10400802_c2_66 | 1099 | 6761 | 1377 | 459 | 1517 | 1.1(10)-155 | Escherichia coli | b0845 | [pn:hypothetical protein] |
| CONTIG371 | 36407965_c2_71 | 1100 | 6762 | 741 | 247 | 700 | 4.0(10)-69 | Escherichia coli | b0841 | [pn:hypothetical protein] |
| CONTIG371 | 21894191_c3_75 | 1101 | 6763 | 429 | 143 | 364 | 1.6(10)-33 | Escherichia coli | b3501 | [pn:arsenical resistance operon aresfg repressor] [gn:arsr] |
| CONTIG371 | 12896930_c3_78 | 1102 | 6764 | 885 | 295 | 987 | 7.5(10)-99 | Escherichia coli | b0844 | [pn:hypothetical protein] |
| CONTIG371 | 2472658_c3_82 | 1103 | 6765 | 801 | 267 | 1094 | 7.0(10)-111 | Escherichia coli | b0840 | [pn:deoxyribose operon repressor] [gn:deor] |
| CONTIG372 | 25500018_f1_2 | 1104 | 6766 | 408 | 136 | 636 | 2.3(10)-62 | Escherichia coli | b3294 | [pn:50s ribosomal subunit protein l17] [gn:rplq] |
| CONTIG372 | 15808568_f1_11 | 1105 | 6767 | 486 | 162 | 756 | 4.5(10)-75 | Escherichia coli | b3284 | [pn:smg protein] [gn:smg] |
| CONTIG372 | 1562637_f1_13 | 1106 | 6768 | 627 | 209 | 817 | 1.6(10)-81 | Escherichia coli | b3282 | [pn:hypothetical protein in aroe-smg intergenic region] [gn:yrdc] |
| CONTIG372 | 6676963_f2_14 | 1107 | 6769 | 366 | 122 | 570 | 2.3(10)-55 | Escherichia coli | b3298 | [pn:30s ribosomal subunit protein s13] [gn:rpsm] |
| CONTIG372 | 34119062_f2_15 | 1108 | 6770 | 624 | 208 | 1008 | 9.0(10)-102 | Escherichia coli | b3296 | [pn:30s ribosomal subunit protein s4] [gn:rpsd] |
| CONTIG372 | 13859837_f2_16 | 1109 | 6771 | 459 | 153 | 632 | 6.4(10)-62 | Escherichia coli | b3292 | [pn:hypothetical transcriptional regulator in mscl-rplq intergenic region] [gn:yhdm] |
| CONTIG372 | 36020676_f2_17 | 1110 | 6772 | 234 | 78 | 319 | 9.4(10)-29 | Escherichia coli | P36675 | hypothetical 8.1 kd protein in mscl-rplq intergenic region |
| CONTIG372 | 647956_f2_24 | 1111 | 6773 | 306 | 102 | 354 | 1.8(10)-32 | Escherichia coli | b3281 | [pn:shikimate dehydrogenase] [gn:aroe] |
| CONTIG372 | 24353427_f3_25 | 1112 | 6774 | 393 | 131 | 522 | 2.8(10)-50 | Escherichia coli | b3297 | [pn:30s ribosomal subunit protein s11] [gn:rpsk] |
| CONTIG372 | 26445160_f3_27 | 1113 | 6775 | 1008 | 336 | 1641 | 7.5(10)-169 | Escherichia coli | b3295 | [pn:rpoa] [gn:rpoa] |
| CONTIG372 | 26440705_f3_28 | 1114 | 6776 | 510 | 170 | 508 | 8.8(10)-49 | Escherichia coli | b3293 | [pn:hypothetical 13.9 kd protein in mscl-rplq intergenic region] [gn:yhdn] |
| CONTIG372 | 31735932_f3_38 | 1115 | 6777 | 1200 | 400 | 683 | 8.5(10)-67 | Escherichia coli | b3286 | [pn:hypothetical protein] |
| CONTIG372 | 15751342_f3_39 | 1116 | 6778 | 597 | 199 | 744 | 8.5(10)-74 | Escherichia coli | b3283 | [pn:hypothetical 18.6 kd protein in aroc-smg intergenic region] |
| CONTIG372 | 1228918_c1_45 | 1117 | 6779 | 1323 | 441 | 1963 | 5.7(10)-203 | Escherichia coli | b3289 | [pn:fmu] [gn:sun] |
| CONTIG372 | 25667180_c2_56 | 1118 | 6780 | 1410 | 470 | 2235 | 8.5(10)-232 | Escherichia coli | b3290 | [pn:trka protein of the constitutive k+ transport system trk] [gn:trka] |
| CONTIG372 | 29711432_c3_69 | 1119 | 6781 | 528 | 176 | 795 | 3.3(10)-79 | Escherichia coli | b3287 | [pn:n-formylmethionylaminoacyl-trna ormylase] [gn:def] |
| CONTIG372 | 26660166_c3_70 | 1120 | 6782 | 972 | 324 | 1435 | 5.0(10)-147 | Escherichia coli | b3288 | [pn:methionyl-trna formyltransferase] [gn:fmt] |
| CONTIG372 | 23484430_c3_74 | 1121 | 6783 | 459 | 153 | 329 | 8.1(10)-30 | Escherichia coli | b3291 | [pn:large conductance mechanosensitive channel] [gn:mscl] |
| CONTIG373 | 3961086_f1_10 | 1122 | 6784 | 408 | 136 | 515 | 1.6(10)-49 | Escherichia coli | b3148 | [pn:hypothetical 14.8 kd protein in agai-mtr intergenic region] [gn:yran] |
| CONTIG373 | 6361092_f1_11 | 1123 | 6785 | 600 | 200 | 974 | 3.7(10)-98 | Escherichia coli | b3149 | [pn:hypothetical 21.1 kd protein in agai-mtr intergenic region] [gn:yrao] |
| CONTIG373 | 4312943_f1_12 | 1124 | 6786 | 585 | 195 | 693 | 2.2(10)-68 | Escherichia coli | b3150 | [pn:hypothetical 20.0 kd protein in agai-mtr intergenic region] [gn:yrap] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG373 | 5371093_f2_15 | 1125 | 6787 | 1173 | 391 | 949 | 1.6(10)-95 | Escherichia coli | b1621 | [pn:pts system, maltose and glucose-specific ii abc component] [gn:malx] |
| CONTIG373 | 6464836_f1_16 | 1126 | 6788 | 1185 | 395 | 658 | 1.1(10)-64 | Bacillus subtilis | patB | [pn:aminotransferase] |
| CONTIG373 | 2369633_f2_20 | 1127 | 6789 | 2169 | 723 | 1318 | 1.1(10)-251 | Escherichia coli | b3147 | [pn:hypothetical 72.8 kd protein in agai-mtr intergenic region] [gn:yral] |
| CONTIG373 | 13864777_c1_39 | 1128 | 6790 | 885 | 295 | 1225 | 9.1(10)-125 | Escherichia coli | b3146 | [pn:hypothetical 31.3 kd protein in agai-mtr intergenic region] [gn:yraq] |
| CONTIG373 | 2376312_c2_42 | 1129 | 6791 | 339 | 113 | 395 | 8.3(10)-37 | Escherichia coli | b3151 | [pn:hypothetical 37.3 kd protein in agai-mtr intergenic region] [gn:yraj] |
| CONTIG373 | 5995468_f1_1 | 1130 | 6792 | 291 | 97 | 426 | 4.2(10)-40 | Escherichia coli | b2606 | [pn:50s ribosomal subunit protein 119] [gn:rpls] |
| CONTIG374 | 22854707_f1_16 | 1131 | 6793 | 996 | 332 | 1524 | 1.8(10)-156 | Escherichia coli | b2594 | [pn:ftsh suppressor protein sfhb] [gn:sfhb] |
| CONTIG374 | 6095760_f2_24 | 1132 | 6794 | 1134 | 378 | 1646 | 2.2(10)-169 | Escherichia coli | b2601 | [pn:phospho-2-dehydro-3-deoxyheptonate aldolase, tyr-sensitive] [gn:arof] |
| CONTIG374 | 16125281_f2_33 | 1133 | 6795 | 387 | 129 | 103 | 4.5(10)-5 | Escherichia coli | D90887 | or:escherichia coli gn:yfii le:13236 re:14294 di:complement sr:escherichia coli (strain:k12) dna, clone_lib:kohara lambda miniset nt:similar to [swissprot accession number p33643]; |
| CONTIG374 | 33464032_f2_35 | 1134 | 6796 | 1554 | 518 | 2377 | 7.7(10)-247 | Escherichia coli | b2592 | [pn:clpb protein] [gn:clpb] |
| CONTIG374 | 3384667_f3_36 | 1135 | 6797 | 1599 | 533 | 214 | 1.3(10)-30 | Pseudomonas aeruginosa | D28119 | or:pseudomonas aeruginosa le:3035 re:4450 di:direct sr:pseudomonas aeruginosa, (strain pao1), dna, (clone ptn100) nt:putative |
| CONTIG374 | 29957332_f3_45 | 1136 | 6798 | 1161 | 387 | 1630 | 1.1(10)-167 | Escherichia coli | b2600 | [pn:chorismate mutase/prephenate dehydrogenase] [gn:tyra] |
| CONTIG374 | 6064015_f3_46 | 1137 | 6799 | 933 | 311 | 354 | 1.8(10)-32 | Bacillus subtilis | yvrE | [pn:hypothetical protein] |
| CONTIG374 | 35413193_f3_50 | 1138 | 6800 | 750 | 250 | 1091 | 1.5(10)-110 | Escherichia coli | b2593 | [pn:hypothetical 26.3 kd protein in clpb 5"" region] [gn:ycbi] |
| CONTIG374 | 3635756_f3_51 | 1139 | 6801 | 1077 | 359 | 1542 | 2.3(10)-158 | Escherichia coli | b2592 | [pn:clpb protein] [gn:clpb] |
| CONTIG374 | 29323783_c1_64 | 1140 | 6802 | 699 | 233 | 1092 | 1.1(10)-110 | Escherichia coli | b2595 | [pn:hypothetical protein] |
| CONTIG374 | 35605011_c1_65 | 1141 | 6803 | 396 | 132 | 542 | 2.2(10)-52 | Escherichia coli | b2597 | [pn:12.7 protein in sfhb-phel intergenic region] [gn:yfia] |
| CONTIG374 | 32145012_c2_93 | 1142 | 6804 | 429 | 143 | 328 | 1.0(10)-29 | Escherichia coli | b2606 | [pn:hypothetical protein in arof-rpls intergenic region] [gn:yfil] |
| CONTIG374 | 837807_c2_94 | 1143 | 6805 | 600 | 200 | 484 | 3.1(10)-46 | Escherichia coli | b2603 | [pn:hypothetical protein] |
| CONTIG374 | 2629262_c3_104 | 1144 | 6806 | 1179 | 393 | 1642 | 6.0(10)-169 | Escherichia coli | b2599 | [pn:chorismate mutase-p/prephenate dehydratase] [gn:phea] |
| CONTIG374 | 35728790_c3_112 | 1145 | 6807 | 1242 | 414 | 1260 | 1.8(10)-128 | Escherichia coli | b2604 | [pn:hypothetical protein in rpls 5"" region] [gn:yfin] |
| CONTIG374 | 2599337_c3_113 | 1146 | 6808 | 498 | 166 | 651 | 6.2(10)-64 | Escherichia coli | b2605 | [pn:hypothetical 17.2 kd protein in rpls 5"" region] [gn:yfib] |
| CONTIG375 | 3251076_f1_6 | 1147 | 6809 | 816 | 272 | 1019 | 6.2(10)-103 | Escherichia coli | b0933 | [pn:hypothetical abc transporter atp-binding protein in pepn-pyrd intergenic region] [gn:ycbe] |
| CONTIG375 | 13839807_f1_8 | 1148 | 6810 | 249 | 83 | 283 | 6.0(10)-25 | Escherichia coli | b0931 | [pn:nicotinate phosphoribosyltransferase] [gn:pncb] |
| CONTIG375 | 4413568_f2_12 | 1149 | 6811 | 585 | 195 | 812 | 5.4(10)-81 | Escherichia coli | b0937 | [pn:hypothetical protein] [gn:ycbp] |
| CONTIG375 | 16273437_f2_13 | 1150 | 6812 | 1158 | 386 | 1803 | 5.2(10)-186 | Escherichia coli | b0935 | [pn:hypothetical protein] [gn:ycbi] |
| CONTIG375 | 4882842_f2_14 | 1151 | 6813 | 801 | 267 | 1066 | 6.5(10)-108 | Escherichia coli | b0934 | [pn:hypothetical protein] [gn:ycbm] |
| CONTIG375 | 410443_f2_15 | 1152 | 6814 | 1014 | 338 | 1333 | 3.2(10)-136 | Escherichia coli | b0936 | [pn:hypothetical protein] |
| CONTIG375 | 5362907_f3_27 | 1153 | 6815 | 306 | 102 | 410 | 2.1(10)-38 | Escherichia coli | b0946 | [pn:hypothetical protein] |
| CONTIG375 | 1292785_c1_50 | 1154 | 6816 | 2718 | 906 | 3941 | 0 | Escherichia coli | b0932 | [pn:aminopeptidase n] [gn:pepn] |
| CONTIG375 | 17070301_c3_60 | 1155 | 6817 | 1050 | 350 | 1608 | 2.3(10)-165 | Escherichia coli | b0945 | [pn:dihydroorotate dehydrogenase] [gn:pyrd] |
| CONTIG375 | 35641405_c3_69 | 1156 | 6818 | 1404 | 468 | 1811 | 7.4(10)-187 | Escherichia coli | b2509 | [pn:exodeoxyribonuclease large subunit] [gn:xsea] |
| CONTIG376 | 204126_f1_5 | 1157 | 6819 | 1107 | 369 | 1263 | 8.6(10)-129 | Erwinia carotovora | Q99132 | extracellular metalloprotease precursor (ec 3.4.24.—). |
| CONTIG376 | 31765664_c1_29 | 1158 | 6820 | 437 | 145 | 644 | 3.3(10)-63 | Escherichia coli | b2511 | [pn:hypothetical protein] |
| CONTIG376 | 6534456_c1_30 | 1159 | 6821 | 1599 | 533 | 429 | 4.2(10)-71 | Bacillus subtilis | yclF | [pn:hypothetical protein] |
| CONTIG376 | 11207056_c1_36 | 1160 | 6822 | 1491 | 497 | 1945 | 4.7(10)-201 | Escherichia coli | b2508 | [pn:inosine-5"" monophosphate dehydrogenase] [gn:guab] |
| CONTIG376 | 863205_c2_40 | 1161 | 6823 | 348 | 116 | 276 | 3.3(10)-24 | Escherichia coli | b2510 | [pn:hypothetical protein] |
| CONTIG376 | 2431944_c2_46 | 1162 | 6824 | 1686 | 562 | 2669 | 8.8(10)-278 | Escherichia coli | b2507 | [pn:gmp synthase] [gn:guaa] |
| CONTIG377 | 15704432_f1_8 | 1163 | 6825 | 510 | 170 | 685 | 1.5(10)-67 | Escherichia coli | b0965 | [pn:hypothetical protein] |
| CONTIG377 | 160378_f2_11 | 1164 | 6826 | 702 | 234 | 541 | 2.7(10)-52 | Escherichia coli | b0959 | [pn:hypothetical protein] |
| CONTIG377 | 10830131_f3_31 | 1165 | 6827 | 2076 | 692 | 2895 | 1.0(10)-301 | Escherichia coli | b0962 | [pn:helicase iv] [gn:held] |
| CONTIG377 | 35558843_c1_40 | 1166 | 6828 | 759 | 253 | 786 | 3.1(10)-78 | Escherichia coli | b0964 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG377 | 32616015_c1_42 | 1167 | 6829 | 255 | 85 | 99 | 5.2(10)-5 | Paramecium bursaria Chlorella virus 1 | U42580 | or:paramecium bursaria chlorella virus 1 gn:a316r le:158299 re:158976 di:direct nt:papk (17x) similar to pbcv-1 orf a41r, encoded |
| CONTIG377 | 34406561_c2_51 | 1168 | 6830 | 1197 | 399 | 1740 | 2.5(10)-179 | Escherichia coli | b0967 | [pn:hypothetical protein] |
| CONTIG377 | 23678515_c2_52 | 1169 | 6831 | 348 | 116 | 506 | 1.3(10)-48 | Escherichia coli | b0966 | [pn:hypothetical protein] |
| CONTIG377 | 32453218_c2_61 | 1170 | 6832 | 453 | 151 | 627 | 2.2(10)-61 | Escherichia coli | b0961 | [pn:hypothetical protein in held 5'''' region] [gn:yccf] |
| CONTIG377 | 16150193_c2_62 | 1171 | 6833 | 2178 | 726 | 2662 | 4.9(10)-277 | Escherichia coli | b0960 | [pn:hypothetical protein] |
| CONTIG377 | 2533566_c3_67 | 1172 | 6834 | 483 | 161 | 714 | 6.0(10)-70 | Escherichia coli | b0963 | [pn:hypothetical 17.3 kd protein in held-sert intergenic region] [gn:yccg] |
| CONTIG377 | 5267193_f1_8 | 1173 | 6835 | 672 | 224 | 779 | 1.7(10)-77 | Escherichia coli | b3552 | [pn:hypothetical 22.2 kd lipoprotein in bisc-cspa intergenic regi] |
| CONTIG378 | 32212756_f2_19 | 1174 | 6836 | 585 | 195 | 716 | 8.0(10)-71 | Escherichia coli | b3549 | [pn:3-methyladenine dna glycosylase i, constitutive] [gn:tag] |
| CONTIG378 | 35742087_f2_25 | 1175 | 6837 | 1170 | 390 | 573 | 1.1(10)-55 | Bacillus subtilis | kdgR | [pn:transcriptional regulator] |
| CONTIG378 | 24009657_f2_27 | 1176 | 6838 | 942 | 314 | 762 | 1.1(10)-75 | Bacillus subtilis | kdgK | [pn:2-keto-3-deoxygluconate kinase] |
| CONTIG378 | 20754033_f2_28 | 1177 | 6839 | 1338 | 446 | 336 | 1.5(10)-30 | Escherichia coli | b3691 | [pn:hypothetical 48.8 kd protein in ibpa-gyrb intergenic region] |
| CONTIG378 | 24218902_f2_29 | 1178 | 6840 | 1002 | 334 | 1353 | 2.5(10)-138 | Escherichia coli | b3553 | [pn:putative 2-hydroxyacid dehydrogenase in bisc-cspa intergenic region] [gn:yiae] |
| CONTIG378 | 2128201_f3_30 | 1179 | 6841 | 507 | 169 | 92 | 0.028 | Escherichia coli | b2321 | [pn:div protein] [gn:div] |
| CONTIG378 | 16926562_f3_37 | 1180 | 6842 | 552 | 184 | 460 | 1.1(10)-43 | Escherichia coli | b3550 | [pn:hypothetical 17.1 kd protein in tag-bisc intergenic region] [gn:bisc] |
| CONTIG378 | 10838453_c1_64 | 1181 | 6843 | 231 | 77 | 249 | 2.8(10)-20 | Escherichia coli | b3551 | [pn:biotin sulfoxide reductase] [gn:bisc] |
| CONTIG378 | 12975261_c1_66 | 1182 | 6844 | 375 | 125 | 211 | 2.6(10)-17 | Escherichia coli | b3548 | [pn:hypothetical 26.0 kd protein in prok-tag intergenic region] [gn:yhjy] |
| CONTIG378 | 2110138_c1_69 | 1183 | 6845 | 324 | 108 | 283 | 6.0(10)-25 | Escherichia coli | b3554 | [pn:hypothetical 30.2 kd protein in bisc-cspa intergenic region] [gn:yiaf] |
| CONTIG378 | 21503126_c2_70 | 1184 | 6846 | 294 | 98 | 354 | 1.8(10)-32 | Escherichia coli | b3556 | [pn:cold shock protein cspa] [gn:cspa] |
| CONTIG378 | 6726562_c2_80 | 1185 | 6847 | 534 | 178 | 265 | 3.7(10)-27 | Escherichia coli | b3548 | [pn:hypothetical 26.0 kd protein in prok-tag intergenic region] [gn:yhjy] |
| CONTIG378 | 3646138_c2_83 | 1186 | 6848 | 1287 | 426 | 1411 | 1.8(10)-144 | Escherichia coli | b3546 | [pn:64.9 kd protein in prok-tag intergenic region] [gn:yhjw] |
| CONTIG378 | 4769752_c3_96 | 1187 | 6849 | 2232 | 744 | 2986 | 0 | Escherichia coli | b3551 | [pn:biotin sulfoxide reductase] [gn:bisc] |
| CONTIG378 | 22659625_c3_102 | 1188 | 6850 | 1224 | 408 | 1401 | 2.1(10)-143 | Escherichia coli | b3547 | [pn:hypothetical 43.0 kd protein in prok-tag intergenic region] [gn:yhjx] |
| CONTIG379 | 14580087_f1_8 | 1189 | 6851 | 1194 | 398 | 956 | 3.0(10)-96 | Escherichia coli | b1163 | [pn:hypothetical protein] |
| CONTIG379 | 6855218_c1_40 | 1190 | 6852 | 858 | 286 | 266 | 3.8(10)-23 | Escherichia coli | b1559 | [pn:hypothetical protein] |
| CONTIG379 | 35283591_c2_44 | 1191 | 6853 | 699 | 233 | 710 | 3.5(10)-70 | Bacteriophage phi-80 | P14814 | replication protein 14. |
| CONTIG379 | 2562816_c2_45 | 1192 | 6854 | 312 | 104 | 129 | 1.3(10)-8 | Bacillus subtilis | ydfG | [pn:hypothetical protein] [gn:gloa] |
| CONTIG379 | 9974138_c2_48 | 1193 | 6855 | 486 | 162 | 101 | 1.2(10)-5 | Escherichia coli | b1651 | [pn:hypothetical protein] [gn:rus] |
| CONTIG379 | 23542083_c2_51 | 1194 | 6856 | 474 | 158 | 510 | 5.4(10)-49 | Escherichia coli | b0550 | [pn:hypothetical protein] |
| CONTIG379 | 9896067_c2_53 | 1195 | 6857 | 894 | 298 | 1229 | 3.5(10)-125 | Enterobacter agglomerans | B38965 | hypothetical protein b (insertion sequence is1222)-enterobacter agglomerans |
| CONTIG379 | 35320333_c3_56 | 1196 | 6858 | 459 | 153 | 252 | 1.2(10)-21 | Bacteriophage phi-80 | P14820 | regulatory protein cii. |
| CONTIG379 | 13086467_c3_57 | 1197 | 6859 | 990 | 330 | 1068 | 4.0(10)-108 | Bacteriophage phi-80 | P14815 | replication protein 15. |
| CONTIG379 | 4145052_c3_64 | 1198 | 6860 | 267 | 89 | 157 | 1.3(10)-11 | Escherichia coli | b1061 | [pn:dna-damage-inducible protein i] [gn:dini] |
| CONTIG379 | 23609515_c3_68 | 1199 | 6861 | 294 | 98 | 419 | 2.3(10)-39 | Enterobacter agglomerans | A38965 | hypothetical protein a (insertion sequence is1222)-enterobacter agglomerans |
| CONTIG38 | 24714410_c3_7 | 1200 | 6862 | 783 | 261 | 1109 | 1.8(10)-112 | Escherichia coli | b4371 | [pn:hypothetical 37.6 kd protein in dnat-hold intergenic region] [gn:yjit] |
| CONTIG380 | 12695760_f1_15 | 1201 | 6863 | 938 | 313 | 1475 | 3.0(10)-151 | Escherichia coli | b2114 | [pn:methionyl-trna synthetase] [gn:metg] |
| CONTIG380 | 3992202_f2_17 | 1202 | 6864 | 1101 | 367 | 136 | 4.7(10)-6 | Haemophilus influenzae | U38617 | or:haemophilus influenzae pn:hia gn:hia le:251 re:3547 di:direct sr:haemophilus influenzae strain=nontypeable strain 11 |
| CONTIG380 | 35833441_f2_18 | 1203 | 6865 | 1401 | 467 | 1336 | 1.6(10)-136 | Haemophilus influenzae | HI0949 | [pn:gamma-aminobutyric acid transaminase] |
| CONTIG380 | 792331_f2_19 | 1204 | 6866 | 1485 | 495 | 1247 | 4.2(10)-127 | Haemophilus influenzae | HIN_937 | [pn:1-2,4-diaminobutyrate decarboxylase] [gn:hi0946] |
| CONTIG380 | 22112882_f2_28 | 1205 | 6867 | 399 | 133 | 318 | 1.2(10)-28 | Escherichia coli | b2107 | [pn:hypothetical protein] |
| CONTIG380 | 12923325_f3_42 | 1206 | 6868 | 492 | 164 | 154 | 2.8(10)-11 | Escherichia coli | b3550 | [pn:hypothetical 17.1 kd protein in tag-bisc intergenic region] |
| CONTIG380 | 36042042_c1_54 | 1207 | 6869 | 2250 | 750 | 1965 | 3.5(10)-203 | Escherichia coli | b0981 | [pn:hypothetical protein in appa 3'''' region] [gn:yccc] |
| CONTIG380 | 33463915_c1_61 | 1208 | 6870 | 504 | 168 | 475 | 2.7(10)-45 | Escherichia coli | b2104 | [pn:hypothetical protein] [gn:yiac] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG380 | 24473131_c2_68 | 1209 | 6871 | 492 | 164 | 487 | 1.5(10)-46 | Escherichia coli | b0982 | [pn:hypothetical protein [gn:yccy] |
| CONTIG380 | 21515768_c3_78 | 1210 | 6872 | 1140 | 380 | 1734 | 1.1(10)-178 | Escherichia coli | b2113 | [pn:mrp] [gn:mrp] |
| CONTIG380 | 24805387_c3_80 | 1211 | 6873 | 1203 | 401 | 1445 | 4.5(10)-148 | Escherichia coli | b0983 | [pn:hypothetical protein] [gn:yccz] |
| CONTIG381 | 25503383_f1_1 | 1212 | 6874 | 840 | 280 | 265 | 4.9(10)-23 | Escherichia coli | b0300 | [pn:hypothetical transcriptional regulator in eaeh-beta intergenic region] [gn:ykga] |
| CONTIG381 | 4032952_f1_10 | 1213 | 6875 | 762 | 254 | 1010 | 5.5(10)-102 | Escherichia coli | b1284 | [pn:hypothetical protein] |
| CONTIG381 | 130671l_f2_14 | 1214 | 6876 | 243 | 81 | 300 | 9.6(10)-27 | Escherichia coli | b4248 | [pn:hypothetical 14.6 kd protein in pyrI-argI intergenic region] [gn:yjgH] |
| CONTIG381 | 14742013_f2_16 | 1215 | 6877 | 1002 | 334 | 596 | 7.9(10)-68 | Escherichia coli | b1287 | [pn:hypothetical protein] |
| CONTIG381 | 4103433_f3_20 | 1216 | 6878 | 813 | 271 | 1271 | 1.2(10)-129 | Escherichia coli | b1288 | [pn:enoyl-acyl-carrier-protein reductase nadh] [gn:fabi] |
| CONTIG381 | 1203412_f3_23 | 1217 | 6879 | 1941 | 647 | 3006 | 0 | Escherichia coli | b1286 | [pn:exoribonuclease ii] [gn:rnb] |
| CONTIG381 | 20181625_f3_24 | 1218 | 6880 | 2025 | 675 | 2702 | 2.7(10)-281 | Escherichia coli | b1285 | [pn:hypothetical protein] [gn:ycir] |
| CONTIG381 | 9954777_f3_27 | 1219 | 6881 | 243 | 81 | 156 | 1.8(10)-11 | Escherichia coli | b1283 | [pn:osmotically inducible lipoprotein b precursor] [gn:osmb] |
| CONTIG381 | 25503415_cl_29 | 1220 | 6882 | 351 | 117 | 405 | 7.2(10)-38 | Escherichia coli | b1282 | [pn:hypothetical 11.4 kd protein in pyrf-osmb intergenic region] [gn:yciH] |
| CONTIG381 | 34667968_c2_41 | 1221 | 6883 | 870 | 290 | 958 | 1.8(10)-96 | Escherichia coli | b1281 | [pn:orotidine-5""-p decarboxylase] [gn:pyrf] |
| CONTIG381 | 34505012_c2_54 | 1222 | 6884 | 1407 | 469 | 768 | 2.5(10)-76 | Escherichia coli | b1025 | [pn:hypothetical protein] [gn:ycdt] |
| CONTIG381 | 15742130_c3_58 | 1223 | 6885 | 915 | 305 | 390 | 2.7(10)-36 | Xanthomonas campestris | Y09701 | ,,rpff |
| CONTIG381 | 2361512_f1_8 | 1224 | 6886 | 1323 | 441 | 2095 | 5.9(10)-217 | Escherichia coli | b0154 | [pn:glutamate-1-semialdehyde 2,1-aminomutase] [gn:hemI] |
| CONTIG381 | 21650204_c1_36 | 1225 | 6887 | 587 | 195 | 810 | 8.6(10)-81 | Escherichia coli | b0149 | [pn:peptidoglycan synthetase] [gn:mrcb] |
| CONTIG381 | 9956407_c1_37 | 1226 | 6888 | 2334 | 778 | 1322 | 1.8(10)-253 | Escherichia coli | b0150 | [pn:ferrichrome-iron receptor precursor] [gn:fhua] |
| CONTIG382 | 15836458_c1_38 | 1227 | 6889 | 2142 | 714 | 2080 | 2.2(10)-215 | Escherichia coli | b0153 | [pn:ferrichrome transport protein fhub precursor] [gn:fhub] |
| CONTIG382 | 35785137_c1_41 | 1228 | 6890 | 825 | 275 | 675 | 1.8(10)-66 | Escherichia coli | b0155 | [pn:hypothetical protein in hemI-pfs intergenic region] [gn:yadq] |
| CONTIG382 | 35285941_c2_46 | 1229 | 6891 | 975 | 325 | 1086 | 4.9(10)-110 | Escherichia coli | b0152 | [pn:ferrichrome-binding periplasmic protein precursor] [gn:fhud] |
| CONTIG382 | 21892677_c3_56 | 1230 | 6892 | 933 | 311 | 1265 | 5.2(10)-129 | Escherichia coli | b0151 | [pn:ferrichrome transport atp-binding protein fhuc] [gn:fhuc] |
| CONTIG383 | 35281502_f1_2 | 1231 | 6893 | 2499 | 833 | 3387 | 0 | Escherichia coli | b4179 | [pn:vacb protein] [gn:vacb] |
| CONTIG383 | 14082000_f1_3 | 1232 | 6894 | 795 | 265 | 1184 | 2.0(10)-120 | Escherichia coli | b4180 | [pn:hypothetical 26.6 kd protein in vacb-aidb intergenic region] |
| CONTIG383 | 16804581_f2_12 | 1233 | 6895 | 1392 | 464 | 2087 | 4.2(10)-216 | Escherichia coli | b4177 | [pn:adenylosuccinate synthetase] [gn:pura] |
| CONTIG383 | 29969426_f2_13 | 1234 | 6896 | 501 | 167 | 669 | 7.5(10)-66 | Escherichia coli | b4178 | [pn:hypothetical 15.6 kd protein in pura-vacb intergenic region] [gn:yjeb] |
| CONTIG383 | 21957031_f2_19 | 1235 | 6897 | 1695 | 565 | 2361 | 3.7(10)-245 | Escherichia coli | b4187 | [pn:aidb protein] [gn:aidb] |
| CONTIG383 | 4547906_f2_22 | 1236 | 6898 | 186 | 62 | 222 | 1.8(10)-18 | Escherichia coli | b4176 | [pn:hypothetical protein] [gn:yjct] |
| CONTIG383 | 4067692_c1_36 | 1237 | 6899 | 1383 | 461 | 545 | 1.1(10)-52 | Escherichia coli | b1886 | [pn:methyl-accepting chemotaxis protein ii] [gn:tar] |
| CONTIG383 | 23948293_c1_43 | 1238 | 6900 | 1347 | 449 | 154 | 1.0(10)-7 | Shigella flexneri | P30851 | vacb protein. |
| CONTIG383 | 31875013_c2_52 | 1239 | 6901 | 411 | 137 | 101 | 0.00011 | Gluconobacter suboxydans | O05543 | [sp:o05543] [de:hypothetical protein in adhs 5"" region (orf3) (fragment)] |
| CONTIG383 | 9922177_c3_70 | 1240 | 6902 | 1311 | 437 | 570 | 2.3(10)-55 | Escherichia coli | b4111 | [pn:proline/betaine transporter] [gn:prop] |
| CONTIG384 | 33413132_f2_31 | 1241 | 6903 | 732 | 244 | 757 | 3.6(10)-75 | Escherichia coli | b1908 | [pn:hypothetical 25.0 kd protein in tyrp-leuz intergenic region] |
| CONTIG384 | 19532255_f2_33 | 1242 | 6904 | 264 | 88 | 314 | 3.2(10)-28 | Escherichia coli | b1906 | [pn:hypothetical 7.3 kd protein in tyrp-rsga intergenic region] |
| CONTIG384 | 171887_f3_37 | 1243 | 6905 | 933 | 311 | 239 | 2.7(10)-20 | Escherichia coli | b2808 | [pn:regulatory protein for glycine cleavage pathway] [gn:gcva] |
| CONTIG384 | 32228407_c1_54 | 1244 | 6906 | 342 | 114 | 239 | 2.7(10)-20 | Escherichia coli | b1904 | [pn:hypothetical protein] |
| CONTIG384 | 24881642_c1_64 | 1245 | 6907 | 1293 | 431 | 702 | 2.3(10)-69 | Escherichia coli | b3456 | [pn:high-affinity branched-chain amino acid transport permease protein livm] [gn:livm] |
| CONTIG384 | 15051625_c2_69 | 1246 | 6908 | 1287 | 429 | 1480 | 8.8(10)-152 | Escherichia coli | b1907 | [pn:tyrosine-specific transport protein] [gn:tyrp] |
| CONTIG384 | 4424067_c2_74 | 1247 | 6909 | 996 | 332 | 808 | 1.3(10)-80 | Escherichia coli | b3457 | [pn:high-affinity branched-chain amino acid transport permease protein livh] [gn:livh] |
| CONTIG384 | 29455312_c2_76 | 1248 | 6910 | 765 | 255 | 662 | 4.2(10)-65 | Escherichia coli | b3454 | [pn:high-affinity branched-chain amino acid transport permease protein livf] [gn:livf] |
| CONTIG384 | 19725927_c3_85 | 1249 | 6911 | 555 | 185 | 787 | 2.3(10)-78 | Escherichia coli | b1905 | [pn:ferritin-like protein] [gn:ftn] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG384 | 32547515_c3_89 | 1250 | 6912 | 1281 | 427 | 765 | 5.0(10)-76 | Escherichia coli | b3460 | [pn:leu/ile/val-binding protein precursor [gn:livj] |
| CONTIG384 | 16299092_c3_93 | 1251 | 6913 | 888 | 296 | 541 | 2.2(10)-72 | Escherichia coli | b3455 | [pn:high-affinity branched-chain amino acid transport permease protein livg] [gn:livg] |
| CONTIG385 | 12150208_f1_1 | 1252 | 6914 | 885 | 295 | 1078 | 3.5(10)-109 | Escherichia coli | b3424 | [pn:glpg protein] [gn:glpg] |
| CONTIG385 | 5203167_f2_13 | 1253 | 6915 | 243 | 81 | 367 | 7.7(10)-34 | Escherichia coli | b3425 | [pn:protein] [gn:glpe] |
| CONTIG385 | 786635_f2_14 | 1254 | 6916 | 903 | 301 | 1076 | 5.7(10)-109 | Escherichia coli | b3423 | [pn:glycerol-3-phosphate regulon repressor] [gn:glpr] |
| CONTIG385 | 30507666_f3_29 | 1255 | 6917 | 2433 | 811 | 3553 | 0 | Escherichia coli | b3417 | [pn:maltodextrin phosphorylase] [gn:malp] |
| CONTIG385 | 5208443_f3_30 | 1256 | 6918 | 2091 | 697 | 3271 | 0 | Escherichia coli | b3416 | [pn:4-alpha-glucanotransferase] [gn:malq] |
| CONTIG385 | 22128751_c1_38 | 1257 | 6919 | 267 | 89 | 90 | 0.00044 | Rattus norvegicus | P04474 | acidic proline-rich protein precursor (clone prp33). |
| CONTIG385 | 16289550_c1_39 | 1258 | 6920 | 2760 | 920 | 3776 | 0 | Escherichia coli | b3418 | [pn:malt] [gn:malt] |
| CONTIG385 | 34629027_c1_53 | 1259 | 6921 | 189 | 63 | 193 | 1.1(10)-14 | Escherichia coli | b3415 | [pn:high-affinity gluconate transporter] [gn:gntt] |
| CONTIG386 | 22479712_f2_19 | 1260 | 6922 | 1053 | 351 | 931 | 1.3(10)-93 | Escherichia coli | b0419 | [pn:hypothetical protein] [gn:yajo] |
| CONTIG386 | 3017328_f2_26 | 1261 | 6923 | 1023 | 341 | 515 | 1.6(10)-49 | Escherichia coli | b0900 | [pn:hypothetical protein] [gn:ycan] |
| CONTIG386 | 13166067_f2_29 | 1262 | 6924 | 537 | 179 | 135 | 8.8(10)-9 | Escherichia coli | b1967 | [pn:hypothetical protein] [gn:yedu] |
| CONTIG386 | 4384828_f3_30 | 1263 | 6925 | 186 | 62 | 164 | 2.5(10)-12 | Escherichia coli | I41306 | hypothetical protein (argf-lacz region)-escherichia coli |
| CONTIG386 | 32667087_f3_37 | 1264 | 6926 | 528 | 176 | 169 | 2.2(10)-12 | Escherichia coli | H10821 | [pn:gals] [gn:galr] |
| CONTIG386 | 18611432_c2_67 | 1265 | 6927 | 1068 | 356 | 901 | 2.0(10)-90 | Haemophilus influenzae | yrpG | [pn:hypothetical protein] |
| CONTIG386 | 34589712_c2_80 | 1266 | 6928 | 453 | 151 | 97 | 0.01799 | Bacillus subtilis | MJ1643 | [pn:chromosome segretation protein] |
| CONTIG386 | 3942063_c2_82 | 1267 | 6929 | 909 | 303 | 301 | 7.5(10)-27 | Methanococcus jannaschii | b0900 | [pn:hypothetical protein] [gn:ycan] |
| CONTIG386 | 14925383_c3_86 | 1268 | 6930 | 1290 | 430 | 700 | 4.0(10)-69 | Helicobacter pylori | HP1193 | [pn:aldo-keto reductase, putative] |
| CONTIG386 | 11807803_c3_87 | 1269 | 6931 | 975 | 325 | 163 | 9.8(10)-10 | Zymomonas mobilis | Q01578 | gluconolactonase precursor (ec 3.1.1.17) (d-glucono-delta-lactone lactonohydrolase) |
| CONTIG387 | 36415791_f1_1 | 1270 | 6932 | 561 | 187 | 748 | 3.2(10)-74 | Escherichia coli | b1181 | [pn:hypothetical protein] |
| CONTIG387 | 10667163_f3_38 | 1271 | 6933 | 894 | 298 | 1177 | 1.1(10)-119 | Escherichia coli | b1187 | [pn:fatty acid--fatty acyl responsive dna-binding protein] 8 gn:fadr] |
| CONTIG387 | 29501675_f3_42 | 1272 | 6934 | 1335 | 445 | 2065 | 8.9(10)-214 | Escherichia coli | b1189 | [pn:d-amino acid dehydrogenase] [gn:dada] |
| CONTIG387 | 4816068_f3_43 | 1273 | 6935 | 1080 | 360 | 1507 | 1.2(10)-154 | Escherichia coli | b1190 | [pn:alanine racemase, catabolic precursor] [gn:dadx] |
| CONTIG387 | 34016706_f3_48 | 1274 | 6936 | 633 | 211 | 892 | 1.8(10)-89 | Escherichia coli | b1193 | [pn:hypothetical protein] |
| CONTIG387 | 33805281_c1_49 | 1275 | 6937 | 771 | 257 | 845 | 1.7(10)-84 | Escherichia coli | b1194 | [pn:hypothetical protein] |
| CONTIG387 | 21518877_c1_50 | 1276 | 6938 | 939 | 313 | 1176 | 1.3(10)-119 | Escherichia coli | b1192 | [pn:hypothetical protein] |
| CONTIG387 | 33673808_c1_64 | 1277 | 6939 | 552 | 184 | 716 | 8.0(10)-71 | Escherichia coli | b1185 | [pn:disulfide bond formation protein b] [gn:dsbb] |
| CONTIG387 | 23714768_c2_72 | 1278 | 6940 | 1752 | 584 | 2241 | 2.0(10)-232 | Escherichia coli | b1191 | [pn:hypothetical protein] |
| CONTIG387 | 2089212_c2_78 | 1279 | 6941 | 1581 | 527 | 2647 | 1.8(10)-275 | Escherichia coli | b1188 | [pn:hypothetical protein in fadr-dada intergenic region] [gn:ycgb] |
| CONTIG387 | 437640_c2_81 | 1280 | 6942 | 1620 | 540 | 1544 | 1.3(10)-158 | Escherichia coli | b1186 | [pn:regulator of intracellular ph] [gn:nhab] |
| CONTIG387 | 3986291_c3_95 | 1281 | 6943 | 375 | 125 | 226 | 4.0(10)-18 | Escherichia coli | b1186 | [pn:regulator of intracellular ph] [gn:nhab] |
| CONTIG387 | 13681887_c3_96 | 1282 | 6944 | 186 | 62 | 161 | 5.2(10)-12 | Escherichia coli | M83655 | or:escherichia coli !e:1764 re:1952 di:direct sr:escherichia coli (sub_strain w1333, strain k-12) dna nt:putative orf |
| CONTIG388 | 25900302_f1_4 | 1283 | 6945 | 585 | 195 | 844 | 2.2(10)-84 | Escherichia coli | b1627 | [pn:hypothetical protein] |
| CONTIG388 | 3177037_f1_7 | 1284 | 6946 | 2106 | 702 | 2255 | 6.5(10)-234 | Escherichia coli | b1629 | [pn:hypothetical protein] |
| CONTIG388 | 33594202_f1_8 | 1285 | 6947 | 1053 | 351 | 1560 | 2.8(10)-160 | Escherichia coli | b1630 | [pn:hypothetical protein] [gn:ydgo] |
| CONTIG388 | 4416068_f1_9 | 1286 | 6948 | 696 | 232 | 874 | 1.3(10)-87 | Escherichia coli | b1632 | [pn:hypothetical protein] [gn:ydgq] |
| CONTIG388 | 1269557_f1_12 | 1287 | 6949 | 1548 | 516 | 2011 | 4.7(10)-208 | Escherichia coli | b1634 | [pn:hypothetical protein] |
| CONTIG388 | 24449011_f1_13 | 1288 | 6950 | 639 | 213 | 850 | 5.0(10)-85 | Escherichia coli | b1635 | [pn:glutathione s-transferase] [gn:gst] |
| CONTIG388 | 24346900_f2_23 | 1289 | 6951 | 345 | 115 | 252 | 1.2(10)-21 | Escherichia coli | b1625 | [pn:hypothetical protein] |
| CONTIG388 | 32556875_f2_27 | 1290 | 6952 | 780 | 260 | 832 | 4.0(10)-83 | Escherichia coli | b1631 | [pn:hypothetical protein] |
| CONTIG388 | 22784386_f3_41 | 1291 | 6953 | 468 | 156 | 386 | 7.4(10)-36 | Escherichia coli | b1626 | [pn:hypothetical protein] |
| CONTIG388 | 25672590_f3_42 | 1292 | 6954 | 597 | 199 | 757 | 3.6(10)-75 | Escherichia coli | b1628 | [pn:hypothetical protein] |
| CONTIG388 | 13932707_f3_48 | 1293 | 6955 | 672 | 224 | 955 | 3.7(10)-96 | Escherichia coli | b1633 | [pn:endonuclease iii] [gn:nth] |
| CONTIG388 | 32522791_c1_57 | 1294 | 6956 | 1371 | 457 | 1780 | 1.3(10)-183 | Escherichia coli | b1637 | [pn:tyrosyl-trna synthetase] [gn:tyrs] |
| CONTIG388 | 30132800_c1_58 | 1295 | 6957 | 927 | 309 | 1353 | 2.5(10)-138 | Escherichia coli | b1636 | [pn:hypothetical protein] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG388 | 4557818_c2_70 | 1296 | 6958 | 1134 | 378 | 1559 | 3.7(10)-160 | Escherichia coli | b1640 | [pn:hypothetical protein] |
| CONTIG388 | 26737658_c2_71 | 1297 | 6959 | 360 | 120 | 399 | 3.1(10)-37 | Escherichia coli | b1639 | [pn:hypothetical protein in pdxh 5'''' region] [gn:ydha] |
| CONTIG388 | 4785791_c2_72 | 1298 | 6960 | 687 | 229 | 1069 | 3.1(10)-108 | Escherichia coli | b1638 | [pn:pyridoxamine 5''''-phosphate oxidase] [gn:pdxh] |
| CONTIG388 | 14511040_c3_109 | 1299 | 6961 | 1158 | 386 | 1601 | 1.3(10)-164 | Escherichia coli | b1624 | [pn:hypothetical protein] |
| CONTIG388 | 4557750_f1_3 | 1300 | 6962 | 774 | 258 | 1117 | 2.6(10)-113 | Escherichia coli | b0652 | [pn:glutamate/aspartate transport system atp-binding protein gltl] [gn:gltl] |
| CONTIG388 | 2379182_f1_4 | 1301 | 6963 | 534 | 178 | 783 | 6.2(10)-78 | Escherichia coli | b0651 | [pn:hypothetical 33.8 kd protein in leus-gltl intergenic region] [gn:ybck] or:vibrio cholerae pn:hcp gn:hcp le:690 re:1208 di:direct |
| CONTIG388 | 13671885_f1_6 | 1302 | 6964 | 507 | 169 | 171 | 4.5(10)-13 | Vibrio cholerae | S81006 | sr:vibrio cholerae o17 nt:28 kda secreted hydrophilic protein; this sequence |
| CONTIG389 | 33664701_f1_14 | 1303 | 6965 | 1035 | 345 | 1390 | 3.0(10)-142 | Escherichia coli | b0640 | [pn:dna polymerase iii, delta subunit] [gn:hola] |
| CONTIG389 | 3204625_f1_16 | 1304 | 6966 | 1914 | 638 | 3029 | 0 | Escherichia coli | b0635 | [pn:mrda] [gn:mrda] |
| CONTIG389 | 291465_f1_17 | 1305 | 6967 | 528 | 176 | 572 | 1.5(10)-55 | Escherichia coli | b0633 | [pn:rare lipoprotein a precursor] [gn:rlpa] |
| CONTIG389 | 11769203_f2_18 | 1306 | 6968 | 828 | 276 | 1110 | 1.3(10)-112 | Escherichia coli | b0654 | [pn:glutamate/aspartate transport system permease protein gltj] [gn:gltj] |
| CONTIG389 | 207577_f2_19 | 1307 | 6969 | 675 | 225 | 971 | 7.5(10)-98 | Escherichia coli | b0653 | [pn:glutamate/aspartate transport system permease protein gltk] [gn:gltk] |
| CONTIG389 | 10751002_f2_24 | 1308 | 6970 | 609 | 203 | 650 | 7.9(10)-64 | Escherichia coli | b0641 | [pn:rare lipoprotein b precursor] [gn:rlpb] |
| CONTIG389 | 13714662_f2_27 | 1309 | 6971 | 753 | 251 | 887 | 6.0(10)-89 | Escherichia coli | b0639 | [pn:hypothetical protein] [gn:ybeb] |
| CONTIG389 | 2680153_f3_34 | 1310 | 6972 | 252 | 84 | 336 | 1.5(10)-30 | Escherichia coli | b0655 | [pn:hypothetical protein in gltj 5'''' region] [gn:ybej] |
| CONTIG389 | 9766277_f3_36 | 1311 | 6973 | 582 | 194 | 681 | 4.0(10)-67 | Escherichia coli | b0651 | [pn:hypothetical 33.8 kd protein in leus-gltl intergenic region] [gn:ybek] |
| CONTIG389 | 24344502_f3_40 | 1312 | 6974 | 2712 | 904 | 4217 | 0 | Escherichia coli | b0642 | [pn:leucyl-trna synthetase] [gn:leus] |
| CONTIG389 | 31728136_f3_44 | 1313 | 6975 | 405 | 135 | 240 | 2.2(10)-20 | Escherichia coli | b0637 | [pn:hypothetical 7.7 kd protein in mrda/pbpa 3'''' region] [gn:ybeb] |
| CONTIG389 | 1369165_f3_45 | 1314 | 6976 | 471 | 157 | 792 | 7.0(10)-79 | Escherichia coli | b0636 | [pn:hypothetical 17.3 kd protein in mrda-phpb intergenic region] [gn:ybca] |
| CONTIG389 | 33878937_f3_47 | 1315 | 6977 | 1149 | 383 | 1390 | 3.0(10)-142 | Escherichia coli | b0634 | [pn:rod shape-determining protein roda] [gn:mrdb] |
| CONTIG389 | 787643_c3_97 | 1316 | 6978 | 525 | 175 | 688 | 7.4(10)-68 | Escherichia coli | b0643 | [pn:hypothetical 18.8 kd protein in leus-gltl intergenic region] [gn:ybel] |
| CONTIG39 | 22785700_c2_2 | 1317 | 6979 | 444 | 148 | 575 | 7.0(10)-56 | Escherichia coli | b1830 | [pn:tail-specific protease precursor] [gn:prc] |
| CONTIG390 | 32706312_f1_12 | 1318 | 6980 | 354 | 118 | 95 | 0.0015 | Kaposi''s sarcoma-associated herpesvirus | U93872 | [OR:Kaposi's sarcoma-associated herpesvirus] [SR:Kaposi's sarcoma-associated herpesvirus - Human herpesvirus 8] [DE:Kaposi's sarcoma-associated herpesvirus glycoprotein M, DNA replication protein, glycoprotein, DNA replication protein. |
| CONTIG390 | 24256457_f2_29 | 1319 | 6981 | 843 | 281 | 635 | 3.1(10)-62 | Bacillus subtilis | yusA | [pn:hypothetical protein] |
| CONTIG390 | 6926543_f2_30 | 1320 | 6982 | 228 | 76 | 274 | 5.5(10)-24 | Escherichia coli | b1675 | [pn:hypothetical protein] |
| CONTIG390 | 4959691_f3_43 | 1321 | 6983 | 1032 | 344 | 816 | 2.0(10)-81 | Bacillus subtilis | yusC | [pn:hypothetical protein] |
| CONTIG390 | 9782192_f3_45 | 1322 | 6984 | 663 | 221 | 387 | 5.7(10)-36 | Bacillus subtilis | yusB | [pn:hypothetical protein] |
| CONTIG390 | 14642966_c1_54 | 1323 | 6985 | 864 | 288 | 339 | 7.0(10)-31 | Escherichia coli | glnH | [pn:glutamine abc transporter] |
| CONTIG390 | 31304138_c1_56 | 1324 | 6986 | 909 | 303 | 273 | 7.0(10)-24 | Escherichia coli | b0654 | [pn:glutamate/aspartate transport system permease protein gltj] [gn:gltj] |
| CONTIG390 | 23722712_c2_72 | 1325 | 6987 | 828 | 276 | 645 | 2.7(10)-63 | Escherichia coli | glnQ | [pn:glutamine abc transporter] |
| CONTIG390 | 30602294_c2_74 | 1326 | 6988 | 735 | 245 | 264 | 6.2(10)-23 | Bacillus subtilis | glnP | [pn:glutamine abc transporter] |
| CONTIG390 | 35833276_c2_81 | 1327 | 6989 | 876 | 292 | 1193 | 2.2(10)-121 | Escherichia coli | b1676 | [pn:pyruvate kinase] [gn:pykf] |
| CONTIG390 | 4422550_c3_92 | 1328 | 6990 | 1602 | 534 | 554 | 1.7(10)-57 | Saccharomyces cerevisiae | YGR155W | [pn:cystathionine beta-synthase] [gn:cys4] |
| CONTIG390 | 24401712_c3_93 | 1329 | 6991 | 1158 | 386 | 980 | 8.4(10)-99 | Helicobacter pylori | HP0106 | [pn:cystathionine gamma-synthase] [gn:metb] |
| CONTIG391 | 1620843_f1_1 | 1330 | 6992 | 855 | 285 | 211 | 3.2(10)-35 | Escherichia coli | b1559 | [pn:hypothetical protein] |
| CONTIG391 | 12928328_f1_4 | 1331 | 6993 | 363 | 121 | 158 | 1.1(10)-11 | Bacteriophage phi-105 | L35561 | or:bacteriophage phi-105 pn:holin le:796 re:1170 di:direct sr:bacteriophage phi-105 dna nt:orf2; potential dual start motif; putative |
| CONTIG391 | 31922906_f1_6 | 1332 | 6994 | 1770 | 590 | 611 | 1.1(10)-59 | Escherichia coli | b1149 | [pn:hypothetical protein] |
| CONTIG391 | 3230287_f1_9 | 1333 | 6995 | 876 | 292 | 106 | 0.00067 | Helicobacter pylori | HP0794 | [pn:atp-dependent clp protease proteolytic component] [gn:clpp] |
| CONTIG391 | 3913318_f1_10 | 1334 | 6996 | 1221 | 407 | 591 | 1.3(10)-57 | Bacteriophage HK97 | P49861 | major capsid protein precursor (gp5) (head protein). |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG391 | 26817202_f2_16 | 1335 | 6997 | 666 | 222 | 241 | 1.7(10)-20 | Haemophilus influenzae | HI1415 | [pn:hypothetical protein] |
| CONTIG391 | 21775277_f2_18 | 1336 | 6998 | 948 | 316 | 372 | 2.2(10)-34 | Bacteriophage phi-80 | S43823 | hypothetical protein - phage phi-80. |
| CONTIG391 | 5156338_f2_21 | 1337 | 6999 | 486 | 162 | 101 | 9.4(10)-5 | Mycobacterium tuberculosis | Z95586 | unknown,,mtcy336.26, mtcy336.26. len |
| CONTIG391 | 35329530_f3_35 | 1338 | 7000 | 1326 | 442 | 524 | 1.8(10)-50 | Bacteriophage HK97 | P49859 | portal protein (gp3). |
| CONTIG391 | 5162802_f1_5 | 1339 | 7001 | 471 | 157 | 214 | 1.3(10)-17 | Escherichia coli | b1160 | [pn:hypothetical protein] |
| CONTIG392 | 3447837_f1_6 | 1340 | 7002 | 1335 | 445 | 1719 | 4.0(10)-177 | Escherichia coli | b1609 | [pn:unknown sensor protein in terminator region] [gn:rstb] |
| CONTIG392 | 5315675_f2_15 | 1341 | 7003 | 1419 | 473 | 1891 | 2.5(10)-195 | Escherichia coli | b1605 | [pn:hypothetical protein] |
| CONTIG392 | 26757882_f2_16 | 1342 | 7004 | 735 | 245 | 994 | 2.7(10)-100 | Escherichia coli | b1606 | [pn:hypothetical protein] [gn:ydgb] |
| CONTIG392 | 7161263_f2_17 | 1343 | 7005 | 765 | 255 | 924 | 7.2(10)-93 | Escherichia coli | b1608 | [pn:rsta] [gn:rsta] |
| CONTIG392 | 22054561_f3_28 | 1344 | 7006 | 990 | 330 | 1008 | 9.0(10)-102 | Escherichia coli | b1604 | [pn:hypothetical protein] |
| CONTIG392 | 15761550_f3_30 | 1345 | 7007 | 942 | 314 | 1161 | 5.5(10)-118 | Escherichia coli | b1610 | [pn:dna replication terminus site-binding protein, dna sequence-specific contrahelicase] [gn:tus] |
| CONTIG393 | 1385410_f3_36 | 1346 | 7008 | 1215 | 405 | 1645 | 2.8(10)-169 | Escherichia coli | b1613 | [pn:mannose-6-phosphate isomerase] [gn:mana] |
| CONTIG393 | 282081_f3_37 | 1347 | 7009 | 1608 | 536 | 1656 | 2.0(10)-170 | Escherichia coli | b1614 | [pn:hypothetical protein] |
| CONTIG393 | 4960968_c1_51 | 1348 | 7010 | 345 | 115 | 425 | 5.5(10)-40 | Escherichia coli | b1607 | [pn:hypothetical protein] [gn:ydgc] |
| CONTIG393 | 4806553_c2_63 | 1349 | 7011 | 1398 | 466 | 1910 | 2.3(10)-197 | Escherichia coli | b1611 | [pn:fumarate hydratase class ii] [gn:fumc] |
| CONTIG393 | 23438526_c3_81 | 1350 | 7012 | 1716 | 572 | 2604 | 6.7(10)-271 | Escherichia coli | b1612 | [pn:fumarate hydratase class i] [gn:fuma] |
| CONTIG393 | 5267713_f1_2 | 1351 | 7013 | 939 | 313 | 1400 | 2.6(10)-143 | Escherichia coli | b0003 | [pn:homoserine kinase] [gn:thrb] |
| CONTIG393 | 2931566_f1_3 | 1352 | 7014 | 1290 | 430 | 2030 | 4.5(10)-210 | Escherichia coli | b0004 | [pn:threonine synthase] [gn:thrc] |
| CONTIG393 | 14258462_f1_8 | 1353 | 7015 | 969 | 323 | 1541 | 3.0(10)-158 | Escherichia coli | b0008 | [pn:transaldolase b] [gn:talb] |
| CONTIG393 | 25651656_f2_19 | 1354 | 7016 | 537 | 179 | 188 | 7.0(10)-15 | Escherichia coli | b0005 | [pn:hypothetical protein] |
| CONTIG393 | 22382155_f2_22 | 1355 | 7017 | 1350 | 450 | 323 | 3.5(10)-29 | Escherichia coli | b3523 | [pn:hypothetical metabolite transport protein in tref-kdgk intergenic region] [gn:yhje] |
| CONTIG394 | 6900287_f3_25 | 1356 | 7018 | 2466 | 822 | 3632 | 0 | Escherichia coli | b0002 | [pn:aspartokinase i/homoserine dehydrogenase i] [gn:thra] |
| CONTIG394 | 31411253_f3_34 | 1357 | 7019 | 750 | 250 | 900 | 2.5(10)-90 | Escherichia coli | b0009 | [pn:molybdopterin biosynthesis mog protein] [gn:mog] |
| CONTIG394 | 3021030_c2_62 | 1358 | 7020 | 1500 | 500 | 1004 | 2.3(10)-101 | Escherichia coli | b0007 | [pn:hypothetical 51.7 kd protein in thrc-talb intergenic region] [gn:yaaj] |
| CONTIG394 | 5162711_c2_63 | 1359 | 7021 | 840 | 280 | 1183 | 2.6(10)-120 | Escherichia coli | b0006 | [pn:hypothetical 29.6 kd protein in thrc-talb intergenic region] [gn:yaaa] |
| CONTIG394 | 29850786_c3_74 | 1360 | 7022 | 564 | 188 | 759 | 2.2(10)-75 | Escherichia coli | b0010 | [pn:hypothetical 20.1 kd protein in mog-htga intergenic region] [gn:yaah] |
| CONTIG394 | 25932_f2_20 | 1361 | 7023 | 906 | 302 | 1412 | 1.3(10)-144 | Escherichia coli | b0819 | [pn:hypothetical protein] |
| CONTIG394 | 6447130_f2_33 | 1362 | 7024 | 1008 | 336 | 1393 | 1.5(10)-142 | Escherichia coli | b0815 | [pn:hypothetical protein] [gn:ybip] |
| CONTIG394 | 12145327_c1_51 | 1363 | 7025 | 1110 | 370 | 1327 | 1.3(10)-135 | Escherichia coli | b0818 | [pn:hypothetical protein] [gn:ybir] |
| CONTIG394 | 26852088_c1_57 | 1364 | 7026 | 1551 | 517 | 364 | 1.6(10)-33 | Escherichia coli | b4080 | [pn:hypothetical 53.4 kd protein in fdhf-phnp intergenic region] |
| CONTIG394 | 5199068_c1_64 | 1365 | 7027 | 726 | 242 | 467 | 1.8(10)-44 | Bacillus subtilis | ydhQ | [pn:hypothetical protein] |
| CONTIG394 | 4802193_c2_68 | 1366 | 7028 | 483 | 161 | 707 | 7.2(10)-70 | Bacillus subtilis | b0817 | [pn:intracellular esterase b] [gn:estb] |
| CONTIG394 | 21773553_c2_73 | 1367 | 7029 | 1590 | 530 | 762 | 1.1(10)-75 | Haemophilus influenzae | HI0897 | [pn:multidrng resistance protein] [gn:cmrb] |
| CONTIG394 | 24253551_c2_77 | 1368 | 7030 | 1398 | 466 | 871 | 3.0(10)-87 | Bacillus subtilis | yckE | [pn:hypothetical protein] |
| CONTIG394 | 10336090_c2_78 | 1369 | 7031 | 1338 | 446 | 528 | 6.7(10)-51 | Bacillus subtilis | ywbA | [pn:hypothetical protein] [gn:ipa-16d] |
| CONTIG394 | 26306507_c3_85 | 1370 | 7032 | 1098 | 366 | 330 | 6.5(10)-35 | Haemophilus influenzae | HI0898 | [pn:multidrng resistance protein] [gn:emra] |
| CONTIG394 | 2976609_f1_9 | 1371 | 7033 | 1062 | 354 | 1078 | 3.5(10)-109 | Escherichia coli | b1428 | [pn:hypothetical protein] |
| CONTIG395 | 13865937_f2_24 | 1372 | 7034 | 1254 | 418 | 703 | 1.8(10)-69 | Escherichia coli | pepT | [pn:peptidase t] |
| CONTIG395 | 32509638_f3_45 | 1373 | 7035 | 846 | 282 | 328 | 1.0(10)-29 | Escherichia coli | b2808 | [pn:regulatory protein for glycine cleavage pathway] [gn:gcva] |
| CONTIG395 | 24804715_c1_50 | 1374 | 7036 | 1524 | 508 | 481 | 6.4(10)-46 | Bacillus subtilis | pnbA | [pn:intracellular esterase b] [gn:estb] |
| CONTIG395 | 21520675_c1_53 | 1375 | 7037 | 1200 | 400 | 932 | 1.0(10)-93 | Escherichia coli | b0600 | [pn:hypothetical protein] |
| CONTIG395 | 1171956_c1_54 | 1376 | 7038 | 1746 | 582 | 2562 | 1.8(10)-266 | Escherichia coli | b1424 | [pn:hypothetical protein] |
| CONTIG395 | 7271905_c1_55 | 1377 | 7039 | 645 | 215 | 627 | 2.2(10)-61 | Escherichia coli | b1427 | [pn:ribosomal-protein-serine acetyltransferase] [gn:riml] |
| CONTIG395 | 4726568_c1_62 | 1378 | 7040 | 603 | 201 | 861 | 3.3(10)-86 | Escherichia coli | b1430 | [pn:tellurite resistance protein tehb] [gn:tehb] |
| CONTIG395 | 2034780_c2_74 | 1379 | 7041 | 861 | 287 | 565 | 8.0(10)-55 | Escherichia coli | b2310 | [pn:lysine-arginine-ornithine-binding periplasmic protein precursor] [gn:argt] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG395 | 24412506_c2_80 | 1380 | 7042 | 1008 | 336 | 1338 | 9.8(10)-137 | Escherichia coli | b1429 | [pn:tellurite resistance protein teha] [gn:teha] |
| CONTIG395 | 34181577_c3_94 | 1381 | 7043 | 1599 | 533 | 1893 | 1.5(10)-195 | Escherichia coli | b3544 | [pn:periplasmic dipeptide transport protein precursor] [gn:dppa] |
| CONTIG396 | 976575_f2_25 | 1382 | 7044 | 825 | 275 | 778 | 2.1(10)-77 | Escherichia coli | b2558 | [pn:hypothetical 53.2 kd protein in purl-dpj intergenic region] [gn:yfhd] |
| CONTIG396 | 35807756_f3_26 | 1383 | 7045 | 777 | 259 | 1109 | 1.8(10)-112 | Escherichia coli | b2552 | [pn:flavohemoprotein] [gn:hmpa] |
| CONTIG396 | 36369777_f3_29 | 1384 | 7046 | 786 | 262 | 160 | 1.3(10)-10 | Aeromonas hydrophila | U56832 | [DE:Aeromonas hydrophila FK506 binding protein (fkpA) gene, complete cds in 3.9 kb fragment.] [NT:ORF5; no significant similarity with known] [LE:2969] [RE:3721] [DI:complement] |
| CONTIG396 | 10366717_c1_47 | 1385 | 7047 | 1485 | 495 | 1795 | 3.7(10)-185 | Escherichia coli | b2556 | [pn:hypothetical protein] [gn:yfhk] |
| CONTIG396 | 4410193_c1_51 | 1386 | 7048 | 348 | 116 | 553 | 1.5(10)-53 | Escherichia coli | b2553 | [pn:nitrogen regulatory protein p-ii] [gn:glnb] |
| CONTIG396 | 14660413_c2_56 | 1387 | 7049 | 1365 | 455 | 2071 | 2.1(10)-214 | Escherichia coli | b2554 | [pn:hypothetical protein in glnb 5"" region] [gn:yfha] |
| CONTIG396 | 32675833_c3_61 | 1388 | 7050 | 3918 | 1306 | 6216 | 0 | Escherichia coli | b2557 | [pn:phosphoribosylformylglycineamide synthetase] [gn:purl] |
| CONTIG396 | 4883533_c3_63 | 1389 | 7051 | 771 | 257 | 574 | 8.9(10)-56 | Escherichia coli | b1136 | [pn:hypothetical 27.3 kd protein in glnb 5"" region] [gn:yfhg] |
| CONTIG396 | 33663886_f1_11 | 1390 | 7052 | 1293 | 431 | 2031 | 3.6(10)-210 | Escherichia coli | b1295 | [pn:isocitrate dehydrogenase] [gn:icd] |
| CONTIG396 | 13105186_f1_12 | 1391 | 7053 | 300 | 100 | 340 | 5.5(10)-31 | Escherichia coli | b1127 | [pn:hypothetical protein] |
| CONTIG396 | 25423317_f2_15 | 1392 | 7054 | 1035 | 345 | 1559 | 3.7(10)-160 | Escherichia coli | b1795 | [pn:peptidase t] [gn:pept] |
| CONTIG396 | 24032750_f3_46 | 1393 | 7055 | 282 | 94 | 332 | 3.8(10)-30 | Escherichia coli | b1135 | [pn:hypothetical protein] |
| CONTIG396 | 32459633_c1_49 | 1394 | 7056 | 669 | 223 | 942 | 9.0(10)-95 | Escherichia coli | b1133 | [pn:hypothetical protein] [gn:ymfc] |
| CONTIG396 | 14630207_c1_51 | 1395 | 7057 | 1287 | 429 | 1694 | 1.8(10)-174 | Escherichia coli | b1132 | [pn:hypothetical protein in purb 5"" region] [gn:ycfc] |
| CONTIG396 | 14297282_c1_52 | 1396 | 7058 | 657 | 219 | 865 | 1.3(10)-86 | Escherichia coli | b1128 | [pn:hypothetical 22.9 kd protein in purb 5"" region] [gn:ycfb] |
| CONTIG396 | 26688338_c1_55 | 1397 | 7059 | 1143 | 381 | 1745 | 7.2(10)-180 | Escherichia coli | b1131 | [pn:hypothetical protein in pept-phoq intergenic region] [gn:ycfd] |
| CONTIG396 | 22925191_c2_67 | 1398 | 7060 | 1425 | 475 | 2217 | 7.0(10)-230 | Escherichia coli | b1794 | [pn:adenylosuccinate lyase] [gn:purb] |
| CONTIG397 | 1058467_c3_71 | 1399 | 7061 | 297 | 99 | 227 | 1.2(10)-18 | Escherichia coli | b4061 | [pn:hypothetical protein] |
| CONTIG397 | 34025381_c3_74 | 1400 | 7062 | 1548 | 516 | 300 | 3.7(10)-24 | Escherichia coli | b1134 | [pn:hypothetical 60.8 kd protein in ssb-soxs intergenic region] [gn:yjcc] |
| CONTIG397 | 5101693_c3_76 | 1401 | 7063 | 483 | 161 | 684 | 2.0(10)-67 | Escherichia coli | b1130 | [pn:hypothetical protein] |
| CONTIG397 | 6519052_c3_82 | 1402 | 7064 | 720 | 240 | 936 | 3.8(10)-94 | Escherichia coli | b1129 | [pn:transcriptional regulatory protein phop] [gn:phop] |
| CONTIG397 | 5367202_c3_83 | 1403 | 7065 | 1464 | 488 | 1829 | 9.0(10)-189 | Escherichia coli | b3657 | [pn:sensor protein phoq] [gn:phoq] |
| CONTIG397 | 22117656_f1_4 | 1404 | 7066 | 1431 | 477 | 1108 | 2.2(10)-112 | Erwinia herbicola | Q01336 | [pn:hypothetical 51.0 kd protein in glts-selc intergenic region] [gn:yicj] |
| CONTIG397 | 1301712_f1_5 | 1405 | 7067 | 2052 | 684 | 2519 | 7.0(10)-262 | Escherichia coli | b1792 | hypothetical protein in crte 3' region (orf2) (fragment). |
| CONTIG398 | 5324127_f1_9 | 1406 | 7068 | 411 | 137 | 429 | 2.1(10)-40 | Escherichia coli | b1141 | [pn:hypothetical protein] |
| CONTIG398 | 2821017_f2_13 | 1407 | 7069 | 279 | 93 | 110 | 1.3(10)-6 | Escherichia coli | b1789 | [pn:hypothetical protein] |
| CONTIG398 | 15728292_f2_19 | 1408 | 7070 | 513 | 171 | 400 | 2.3(10)-37 | Escherichia coli | b1794 | [pn:hypothetical protein] |
| CONTIG398 | 21581381_f2_26 | 1409 | 7071 | 711 | 237 | 754 | 7.5(10)-75 | Escherichia coli | b1140 | [pn:hypothetical protein] |
| CONTIG398 | 31382327_f3_31 | 1410 | 7072 | 1143 | 381 | 950 | 1.3(10)-95 | Escherichia coli | b1787 | [pn:hypothetical protein] |
| CONTIG398 | 20813561_f3_32 | 1411 | 7073 | 537 | 179 | 667 | 1.2(10)-65 | Escherichia coli | b1791 | [pn:hypothetical protein] |
| CONTIG398 | 4725963_f3_37 | 1412 | 7074 | 1197 | 399 | 1339 | 7.7(10)-137 | Bacillus subtilis | ctrA | [pn:ctp synthase] [gn:pyrg] |
| CONTIG398 | 30081918_c1_44 | 1413 | 7075 | 753 | 251 | 216 | 2.6(10)-17 | Escherichia coli | b1793 | [pn:hypothetical protein] |
| CONTIG398 | 5112842_c2_61 | 1414 | 7076 | 267 | 89 | 211 | 3.2(10)-17 | Escherichia coli | b1790 | [pn:hypothetical protein] |
| CONTIG398 | 270387_c2_66 | 1415 | 7077 | 825 | 275 | 833 | 3.2(10)-83 | Escherichia coli | b0860 | [pn:arginine-binding periplasmic protein 2 precursor] [gn:artj] |
| CONTIG398 | 13116057_f1_1 | 1416 | 7078 | 567 | 189 | 888 | 4.7(10)-89 | Haemophilus influenzae | HI1532 | [pn:grxa] [gn:grxa] |
| CONTIG399 | 3963966_f1_20 | 1417 | 7079 | 333 | 111 | 357 | 8.8(10)-33 | Saccharomyces cerevisiae | S57378 | hypothetical protein yol091w - yeast (saccharomyces cerevisiae) |
| CONTIG399 | 11758450_f1_23 | 1418 | 7080 | 882 | 294 | 99 | 0.03699 | Escherichia coli | b0847 | [pn:hypothetical protein] |
| CONTIG399 | 20990640_f2_44 | 1419 | 7081 | 1803 | 601 | 2483 | 4.5(10)-258 | Escherichia coli | P12009 | multi-copy supressor of livr. |
| CONTIG399 | 33638956_c1_65 | 1420 | 7082 | 480 | 160 | 124 | 4.2(10)-8 | Escherichia coli | b0848 | [pn:hypothetical protein] |
| CONTIG399 | 33260086_c1_66 | 1421 | 7083 | 528 | 176 | 373 | 1.8(10)-34 | Escherichia coli | b0852 | [pn:ribosomal protein s6 modification protein] [gn:rimk] |
| CONTIG399 | 16525416_c1_68 | 1422 | 7084 | 1086 | 362 | 1365 | 1.3(10)-139 | Escherichia coli | b0853 | [pn:hypothetical protein] |
| CONTIG399 | 32211630_c1_69 | 1423 | 7085 | 513 | 171 | 424 | 7.0(10)-40 | Escherichia coli | b1791 | [pn:hypothetical protein] |
| CONTIG399 | 2630807_c1_74 | 1424 | 7086 | 876 | 292 | 1150 | 8.1(10)-117 | Escherichia coli | b0857 | [pn:putrescine transport system permease protein poti] [gn:poti] |
| CONTIG399 | 20832265_c1_75 | 1425 | 7087 | 519 | 173 | 691 | 3.6(10)-68 | Escherichia coli | b0858 | [pn:hypothetical protein] [gn:ybjo] |
| CONTIG399 | 12932812_c1_80 | 1426 | 7088 | 1542 | 514 | 320 | 1.3(10)-26 | Bacillus subtilis | phoR | [pn:two-component sensor histidine kinase |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG399 | 16589783_c2_88 | 1427 | 7089 | 1218 | 406 | 1754 | 8.0(10)-181 | Escherichia coli | b0855 | [pn:putrescine transport atp-binding protein potg] [gn:potg] |
| CONTIG399 | 4354193_c2_89 | 1428 | 7090 | 963 | 321 | 1321 | 6.2(10)-135 | Escherichia coli | b0856 | [pn:putrescine transport system permease protein poth] [gn:poth] |
| CONTIG399 | 4078143_c2_91 | 1429 | 7091 | 1137 | 379 | 1608 | 2.3(10)-165 | Escherichia coli | b0859 | [pn:hypothetical protein] [gn:ybjf] |
| CONTIG399 | 16970910_c3_101 | 1430 | 7092 | 813 | 271 | 994 | 2.7(10)-100 | Escherichia coli | b0851 | [pn:modulator of drug activity a] [gn:mdaa] |
| CONTIG399 | 3359469l_c3_102 | 1431 | 7093 | 1137 | 379 | 1799 | 1.3(10)-185 | Escherichia coli | b0854 | [pn:putrescine-binding periplasmic protein precursor] [gn:potf] |
| CONTIG399 | 25431561_c3_110 | 1432 | 7094 | 729 | 243 | 517 | 9.8(10)-50 | Bacillus subtilis | ycII | [pn:hypothetical protein] |
| CONTIG399 | 2402532б_f1_5 | 1433 | 7095 | 2097 | 699 | 3000 | 0 | Escherichia coli | b0984 | [pn:hypothetical protein] [gn:ymca] |
| CONTIG400 | 5292787_f1_7 | 1434 | 7096 | 477 | 159 | 368 | 6.0(10)-34 | Escherichia coli | b0981 | [pn:hypothetical protein] [gn:yccy] |
| CONTIG400 | 3908300_f1_8 | 1435 | 7097 | 2187 | 729 | 2495 | 2.3(10)-259 | Escherichia coli | b0981 | [pn:hypothetical protein in appa 3'''' region] [gn:yccy] |
| CONTIG400 | 15626550_f2_17 | 1436 | 7098 | 1818 | 606 | 1732 | 1.7(10)-178 | Escherichia coli | b3647 | [pn:hypothetical 63.2 kd protein in gmk 5'''' region] [gn:yicf] |
| CONTIG400 | 31802025_f2_20 | 1437 | 7099 | 825 | 275 | 537 | 7.4(10)-52 | Escherichia coli | b0985 | [pn:hypothetical protein] [gn:yccz] |
| CONTIG400 | 6445327_f2_26 | 1438 | 7100 | 1134 | 378 | 1617 | 2.7(10)-166 | Escherichia coli | b0983 | [pn:hypothetical protein] [gn:ymcc] |
| CONTIG400 | 4765950_f3_42 | 1439 | 7101 | 678 | 226 | 707 | 7.2(10)-70 | Escherichia coli | b0986 | [pn:hypothetical protein] [gn:yccy] |
| CONTIG400 | 35413343_f3_45 | 1440 | 7102 | 249 | 83 | 130 | 1.0(10)-8 | Escherichia coli | b0982 | [pn:hypothetical protein] [gn:yccy] |
| CONTIG400 | 1268827_f3_50 | 1441 | 7103 | 840 | 280 | 954 | 4.7(10)-96 | Escherichia coli | b3643 | [pn:rnase ph] [gn:rph] |
| CONTIG400 | 4153_f3_51 | 1442 | 7104 | 690 | 230 | 1030 | 4.2(10)-104 | Escherichia coli | b3642 | [pn:orotate phosphoribosyltransferase] [gn:pyre] |
| CONTIG400 | 2660317_c1_57 | 1443 | 7105 | 219 | 73 | 250 | 5.2(10)-21 | Escherichia coli | b3639 | [pn:dfp protein] [gn:df] |
| CONTIG400 | 24017165_c1_59 | 1444 | 7106 | 684 | 228 | 922 | 1.2(10)-92 | Escherichia coli | b3641 | [pn:ttk protein] [gn:ttk] |
| CONTIG400 | 25488563_c1_60 | 1445 | 7107 | 918 | 306 | 1362 | 2.7(10)-139 | Escherichia coli | b3644 | [pn:33.2 kd protein in dind-rph intergenic region] [gn:gmk] |
| CONTIG400 | 24397161_c1_80 | 1446 | 7108 | 579 | 193 | 853 | 2.3(10)-85 | Escherichia coli | b3648 | [pn:5'''' guanylate kinase] [gn:gmk] |
| CONTIG400 | 2032005_c2_86 | 1447 | 7109 | 645 | 215 | 709 | 4.4(10)-70 | Escherichia coli | b3646 | [pn:hypothetical 22.0 kd protein in rph-gmk intergenic region] [gn:yicg] |
| CONTIG400 | 16977086_c3_99 | 1448 | 7110 | 570 | 190 | 737 | 4.7(10)-73 | Escherichia coli | b3640 | [pn:deoxyuridine 5''''-triphosphate nucleotidohydrolase] [gn:dut] |
| CONTIG400 | 36460400_f1_11 | 1449 | 7111 | 1578 | 526 | 2446 | 3.7(10)-254 | Escherichia coli | b3749 | [pn:high affinity ribose transport protein] [gn:rbsk] |
| CONTIG400 | 10256930_f1_13 | 1450 | 7112 | 270 | 90 | 163 | 8.4(10)-12 | Escherichia coli | b3752 | [pn:ribokinase] [gn:rbsk] |
| CONTIG400 | 14196916_f1_14 | 1451 | 7113 | 996 | 332 | 1421 | 1.6(10)-145 | Escherichia coli | b3753 | [pn:rbs repressor] [gn:rbsr] |
| CONTIG400 | 14337755_f2_24 | 1452 | 7114 | 1872 | 624 | 2382 | 2.2(10)-247 | Escherichia coli | b3747 | [pn:kup] |
| CONTIG401 | 23714652_f2_27 | 1453 | 7115 | 831 | 277 | 945 | 4.2(10)-95 | Escherichia coli | b3750 | [pn:hypothetical 49.6 kd protein in asna 3'''' region] [gn:yiep] |
| CONTIG401 | 14650302_f2_35 | 1454 | 7116 | 996 | 332 | 1573 | 1.2(10)-161 | Escherichia coli | b3744 | [pn:aspartate--ammonia ligase] [gn:asna] |
| CONTIG401 | 9817191_f3_41 | 1455 | 7117 | 450 | 150 | 640 | 9.0(10)-63 | Escherichia coli | b3748 | [pn:hypothetical 51.5 kd protein in rbsr-rnsc intergenic region] [gn:yicq] |
| CONTIG401 | 13917556_f3_42 | 1456 | 7118 | 546 | 182 | 90 | 0.02999 | Escherichia coli | b3750 | [pn:high affinity ribose transport protein rbsd] [gn:rbsd] |
| CONTIG401 | 2854076_f3_43 | 1457 | 7119 | 918 | 306 | 1354 | 2.0(10)-138 | Escherichia coli | b3751 | [pn:high affinity ribose transport protein] [gn:rbsc] |
| CONTIG401 | 24319718_f3_44 | 1458 | 7120 | 897 | 299 | 1009 | 7.0(10)-102 | Escherichia coli | b3752 | [pn:periplasmic ribose-binding protein precursor] [gn:rbsb] |
| CONTIG401 | 29800187_c1_49 | 1459 | 7121 | 441 | 147 | 451 | 9.5(10)-43 | Escherichia coli | b3755 | [pn:hypothetical 20.8 kd protein in rbsr-rrsc intergenic region] [gn:yiep] |
| CONTIG401 | 11067932_c2_80 | 1460 | 7122 | 1464 | 488 | 1648 | 1.3(10)-169 | Escherichia coli | b3745 | [pn:hypothetical 49.6 kd protein in asna 3'''' region] |
| CONTIG401 | 24819702_c3_83 | 1461 | 7123 | 1434 | 478 | 1844 | 2.2(10)-190 | Escherichia coli | b3754 | [pn:hypothetical 51.5 kd protein in rbsr-rnsc intergenic region] [gn:yicq] |
| CONTIG401 | 9880166_c3_97 | 1462 | 7124 | 1587 | 529 | 2038 | 6.5(10)-211 | Escherichia coli | b3746 | [pn:hypothetical 57.4 kd protein in asna-kup intergenic region] [gn:yien] |
| CONTIG402 | 4007813_c3_100 | 1463 | 7125 | 468 | 156 | 605 | 4.5(10)-59 | Escherichia coli | b3743 | [pn:regulatory protein] [gn:asnc] |
| CONTIG402 | 196080_c3_101 | 1464 | 7126 | 540 | 180 | 559 | 3.5(10)-54 | Escherichia coli | b3742 | [pn:involved in modulation of initiation at oric] [gn:mioc] |
| CONTIG402 | 7082715_f1_3 | 1465 | 7127 | 978 | 326 | 1390 | 3.0(10)-142 | Escherichia coli | b2378 | [pn:hypothetical protein] |
| CONTIG402 | 6837836_f1_8 | 1466 | 7128 | 735 | 245 | 1148 | 1.3(10)-116 | Escherichia coli | b2381 | [pn:hypothetical protein] |
| CONTIG402 | 20703533_f1_11 | 1467 | 7129 | 1260 | 420 | 1163 | 3.3(10)-118 | Escherichia coli | b2389 | [pn:hypothetical protein] |
| CONTIG402 | 19724077_f2_15 | 1468 | 7130 | 957 | 319 | 1145 | 2.7(10)-116 | Escherichia coli | b2347 | [pn:hypothetical 34.5 kd protein in argw 5'''' region] [gn:yfdc] |
| CONTIG402 | 24782786_f3_31 | 1469 | 7131 | 381 | 127 | 94 | 0.00072 | Pseudomonas sp. | L81125 | or:pseudomonas sp. pn:monooxygenase subunit le:502 re:2016 di:direct sr:pseudomonas sp. (strain imt37) dna |
| CONTIG402 | 6343752_f3_38 | 1470 | 7132 | 1725 | 575 | 2476 | 2.5(10)-257 | Escherichia coli | b2380 | [pn:hypothetical protein] |
| CONTIG402 | 24745641_c1_45 | 1471 | 7133 | 1311 | 437 | 1930 | 1.8(10)-199 | Enterobacter cloacae | P23234 | indole-3-pyruvate decarboxylase (ec 4.1.1.74) (indolepyruvate |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG402 | 25473516_c1_51 | 1472 | 7134 | 1254 | 418 | 2026 | 1.2(10)-209 | Escherichia coli | b2379 | decarboxylase). |
| CONTIG402 | 33474091_c2_61 | 1473 | 7135 | 981 | 327 | 1556 | 7.7(10)-160 | Escherichia coli | b2388 | [pn:hypothetical protein] [pn:glucokinase] [gn:glk] |
| CONTIG402 | 11770652_c2_72 | 1474 | 7136 | 1416 | 472 | 1587 | 4.0(10)-163 | Escherichia coli | b1490 | [pn:hypothetical protein] |
| CONTIG402 | 7292291_c2_74 | 1475 | 7137 | 888 | 296 | 1111 | 1.1(10)-112 | Escherichia coli | b2346 | [pn:vacJ lipoprotein precursor] [gn:vacj] |
| CONTIG402 | 25567885_f1_10 | 1476 | 7138 | 525 | 175 | 898 | 4.0(10)-90 | Escherichia coli | b0264 | [pn:insertion element is1 protein insB] [gn:insb_2] |
| CONTIG402 | 2911290_f1_15 | 1477 | 7139 | 234 | 78 | 254 | 7.2(10)-22 | Escherichia coli | S40546 | hypothetical protein - escherichia coli |
| CONTIG402 | 24489756_f2_28 | 1478 | 7140 | 942 | 314 | 101 | 0.05299 | Methanococcus jannaschii | MJ1322 | [pn:purine ntpase] |
| CONTIG403 | 6735393_f2_29 | 1479 | 7141 | 285 | 95 | 446 | 3.2(10)-42 | Escherichia coli | b4294 | [pn:insertion element is1f protein insA] [gn:insa_7] |
| CONTIG403 | 25567885_f2_36 | 1480 | 7142 | 525 | 175 | 829 | 8.5(10)-83 | Escherichia coli | b0264 | [pn:insertion element is1 protein insB] [gn:insa_2] |
| CONTIG403 | 2911290_f3_50 | 1481 | 7143 | 234 | 78 | 296 | 2.6(10)-26 | Escherichia coli | S40546 | hypothetical protein - escherichia coli |
| CONTIG403 | 6735393_f3_55 | 1482 | 7144 | 285 | 95 | 446 | 3.2(10)-42 | Escherichia coli | b4294 | [pn:insertion element is1f protein insA] [gn:insa_7] |
| CONTIG403 | 21666540_f3_56 | 1483 | 7145 | 729 | 243 | 1128 | 1.8(10)-114 | Transposon Tn1525 | M12900 | or:transposon tn1525 gn:p12 le:996 re:>1721 di:direct sr:transposon tn1525 dna nt:putative |
| CONTIG403 | 14885165_c1_59 | 1484 | 7146 | 297 | 99 | 377 | 6.7(10)-35 | Escherichia coli | D93826 | hypothetical 11k protein (insertion sequence is1)-escherichia coli this protein is coded by the insertion sequence is1. |
| CONTIG403 | 11909633_c1_60 | 1485 | 7147 | 681 | 227 | 420 | 1.8(10)-39 | Escherichia coli | b3025 | [pn:hypothetical protein] [gn:ygjx] |
| CONTIG403 | 35556507_c1_71 | 1486 | 7148 | 1413 | 471 | 1826 | 1.8(10)-188 | Pseudomonas aeruginosa | Y10528 | [PN:cyanide insensitive terminal oxidase] [GN:cioA] [DE:P. aeruginosa cioA and cioB genes.] [LE:276] [RE:1742] [DI:direct] |
| CONTIG403 | 11891882_c2_73 | 1487 | 7149 | 738 | 246 | 1268 | 2.6(10)-129 | Salmonella ordonez | S34451 | hypothetical protein (insertion sequence is261)-salmonella ordonez plasmid pip173 |
| CONTIG403 | 14885165_c2_77 | 1488 | 7150 | 297 | 99 | 390 | 2.7(10)-36 | Escherichia coli | D93826 | hypothetical 11k protein (insertion sequence is1)-escherichia coli this protein is coded by the insertion sequence is1. |
| CONTIG403 | 36501937_c3_89 | 1489 | 7151 | 1386 | 462 | 347 | 1.0(10)-31 | Escherichia coli | b3026 | [pn:hypothetical protein] [gn:ygjy] |
| CONTIG403 | 35410666_c3_96 | 1490 | 7152 | 348 | 116 | 104 | 5.7(10)-6 | Escherichia coli | Q52331 | transcriptional repressor protein kore. |
| CONTIG403 | 24109468_c3_99 | 1491 | 7153 | 1041 | 347 | 1016 | 1.3(10)-102 | Pseudomonas aeruginosa | Y10528 | [PN:cyanide insensitive terminal oxidase] [GN:cioB] [DE:P. aeruginosa cioA and cioB genes.] [LE:1746] [RE:2753] [DI:direct] |
| CONTIG404 | 4453427_f1_14 | 1492 | 7154 | 501 | 167 | 253 | 9.1(10)-22 | Escherichia coli | b1164 | [pn:hypothetical protein] |
| CONTIG404 | 34413938_f1_15 | 1493 | 7155 | 381 | 127 | 212 | 2.0(10)-17 | Escherichia coli | b1166 | [pn:hypothetical protein] |
| CONTIG404 | 21509432_f2_40 | 1494 | 7156 | 2184 | 728 | 2478 | 1.5(10)-257 | Escherichia coli | b4079 | [pn:formate dehydrogenase, formate-hydrogen-lyase-linked, selenocysteine-containing polypeptide] [gn:fdhf] |
| CONTIG404 | 4882768_c1_67 | 1495 | 7157 | 687 | 229 | 413 | 1.0(10)-38 | Escherichia coli | b4316 | [pn:chaperone protein involved in biogenesis of type 1 fimbriae] [gn:fimc] |
| CONTIG404 | 6506280_c1_68 | 1496 | 7158 | 2571 | 857 | 1485 | 2.6(10)-152 | Escherichia coli | b3144 | [pn:hypothetical outer membrane usher protein in agaI-mtr intergenic region] [gn:yraj] |
| CONTIG404 | 1613091_c1_71 | 1497 | 7159 | 681 | 227 | 176 | 1.3(10)-13 | Escherichia coli | b4319 | [pn:fimg protein precursor] [gn:fimg] |
| CONTIG404 | 14485390_c1_77 | 1498 | 7160 | 1284 | 428 | 1312 | 5.5(10)-134 | Escherichia coli | b1163 | [pn:hypothetical protein] |
| CONTIG404 | 35431691_c1_78 | 1499 | 7161 | 852 | 284 | 812 | 5.4(10)-81 | Escherichia coli | b1162 | [pn:hypothetical protein] |
| CONTIG404 | 4008518_c1_79 | 1500 | 7162 | 378 | 126 | 563 | 1.3(10)-54 | Escherichia coli | b1684 | [pn:hypothetical protein] |
| CONTIG404 | 14900762_c1_82 | 1501 | 7163 | 1317 | 439 | 1843 | 3.0(10)-190 | Escherichia coli | b1681 | [pn:hypothetical protein] [gn:ydic] |
| CONTIG404 | 35335205_c2_87 | 1502 | 7164 | 1065 | 355 | 145 | 1.1(10)-9 | Escherichia coli | b0530 | [pn:hypothetical protein] |
| CONTIG404 | 22160268_c2_99 | 1503 | 7165 | 534 | 178 | 515 | 1.6(10)-49 | Escherichia coli | b1679 | [pn:hypothetical protein] [gn:sfma] |
| CONTIG404 | 12382906_c3_117 | 1504 | 7166 | 846 | 282 | 1343 | 2.8(10)-137 | Escherichia coli | b1683 | [pn:hypothetical protein] |
| CONTIG404 | 12681461_c3_118 | 1505 | 7167 | 702 | 234 | 1158 | 1.2(10)-117 | Escherichia coli | b1682 | [pn:hypothetical protein] |
| CONTIG404 | 4479693_c3_119 | 1506 | 7168 | 756 | 252 | 1168 | 1.0(10)-118 | Escherichia coli | b1680 | [pn:hypothetical protein] |
| CONTIG404 | 15913557_c3_120 | 1507 | 7169 | 1269 | 423 | 1797 | 2.2(10)-185 | Escherichia coli | b1678 | [pn:hypothetical protein] |
| CONTIG404 | 2152177_c3_122 | 1508 | 7170 | 609 | 203 | 740 | 2.2(10)-73 | Escherichia coli | | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG405 | 33886088_f1_1 | 1509 | 7171 | 495 | 165 | 90 | 0.034 | Bacillus subtilis | ybfI | [pn:hypothetical protein] |
| CONTIG405 | 11050187_f1_2 | 1510 | 7172 | 990 | 330 | 146 | 7.4(10)-10 | Escherichia coli | b2578 | [pn:hypothetical 21.2 kd protein in srmb-ung intergenic region] |
| CONTIG405 | 2383393_f1_12 | 1511 | 7173 | 810 | 270 | 341 | 4.4(10)-31 | Escherichia coli | X02307 | or:escherichia coli le:115 re:522 di:complement nt:urf 4 |
| CONTIG405 | 36414562_f1_21 | 1512 | 7174 | 537 | 179 | 456 | 2.7(10)-43 | Escherichia coli | b4144 | [pn:hypothetical protein] [gn:yjeI] |
| CONTIG405 | 6522338_f1_23 | 1513 | 7175 | 843 | 281 | 966 | 2.6(10)-97 | Escherichia coli | b4147 | [pn:elongation factor p] [gn:efp] |
| CONTIG405 | 4346033_f2_33 | 1514 | 7176 | 1221 | 407 | 247 | 4.0(10)-21 | Escherichia coli | X02307 | or:escherichia coli le:2104 re:2802 di:complement nt:urf3 |
| CONTIG405 | 23571887_f2_37 | 1515 | 7177 | 555 | 185 | 376 | 8.5(10)-35 | Escherichia coli | b4140 | [pn:hypothetical protein] |
| CONTIG405 | 12141687_f2_41 | 1516 | 7178 | 390 | 130 | 449 | 1.6(10)-42 | Escherichia coli | b4142 | [pn:groes protein] [gn:mopb] |
| CONTIG405 | 21523957_f3_51 | 1517 | 7179 | 219 | 73 | 104 | 2.2(10)-5 | Bacillus subtilis | ybfI | [pn:hypothetical protein] |
| CONTIG405 | 24798443_f3_64 | 1518 | 7180 | 1659 | 553 | 2236 | 6.7(10)-232 | Escherichia coli | b4143 | [pn:60 kd chaperonin] [gn:mopa] |
| CONTIG405 | 1310462B_f3_71 | 1519 | 7181 | 333 | 111 | 338 | 9.0(10)-31 | Escherichia coli | b4148 | [pn:surges] [gn:suge] |
| CONTIG405 | 3017827_c1_81 | 1520 | 7182 | 1248 | 416 | 1588 | 3.1(10)-163 | Escherichia coli | b4141 | [pn:hypothetical 44.8 kd protein in aspa-mopb intergenic region] [gn:yjeh] |
| CONTIG405 | 4353830_c1_83 | 1521 | 7183 | 1518 | 506 | 2253 | 1.1(10)-233 | Escherichia coli | b4139 | [pn:aspartate ammonia-lyase] [gn:aspa] |
| CONTIG405 | 2037566_c1_87 | 1522 | 7184 | 1722 | 574 | 2053 | 1.7(10)-212 | Escherichia coli | b4136 | [pn:thiol] [gn:dsbd] |
| CONTIG405 | 24005301_c2_98 | 1523 | 7185 | 1041 | 347 | 1532 | 2.7(10)-157 | Escherichia coli | b4146 | [pn:hypothetical 38.7 kd protein in mopa-efp intergenic region] |
| CONTIG405 | 19688916_c2_101 | 1524 | 7186 | 627 | 209 | 601 | 1.2(10)-58 | Escherichia coli | b4329 | [pn:hypothetical 16.2 kd protein in iada-mcrd intergenic region] |
| CONTIG405 | 6511528_c2_102 | 1525 | 7187 | 1674 | 558 | 101 | 0.00259 | Mycobacterium tuberculosis | M15467 | or:mycobacterium tuberculosis pn:unknown protein le:1194 re:1670 di:complement sr:mycobacterium tuberculosis (strain erdman) dna nt.orfd158; putative |
| CONTIG405 | 2986693_c2_109 | 1526 | 7188 | 336 | 112 | 426 | 4.2(10)-40 | Escherichia coli | b4137 | [pn:c-type cyl] [gn:cutA] |
| CONTIG405 | 30B0456_c2_110 | 1527 | 7189 | 681 | 227 | 916 | 5.0(10)-92 | Escherichia coli | b4135 | [pn:yjdc] |
| CONTIG405 | 26777213_c3_113 | 1528 | 7190 | 966 | 322 | 703 | 1.8(10)-69 | Escherichia coli | b4149 | [pn:hypothetical 19.9 kd protein in suge-ampe intergenic region] |
| CONTIG405 | 1622D215_c3_115 | 1529 | 7191 | 639 | 213 | 118 | 1.3(10)-5 | Escherichia coli | b1951 | [pn:colanic acid capsullar biosynthesis activation protein a] [gn:rcsa] |
| CONTIG405 | 6291406_c2_101 | 1530 | 7192 | 711 | 237 | 762 | 1.1(10)-75 | Escherichia coli | b4330 | [pn:hypothetical 24.2 kd protein in iada-mcrd intergenic region] |
| CONTIG405 | 10317165_c3_119 | 1531 | 7193 | 1191 | 397 | 1216 | 8.3(10)-124 | Escherichia coli | b4328 | [pn:isoaspartyl dipeptidase] [gn:iadA] |
| CONTIG405 | 134683_c3_123 | 1532 | 7194 | 474 | 158 | 233 | 1.2(10)-19 | Mycobacterium tuberculosis | M15467 | or:mycobacterium tuberculosis pn:unknown protein le:769 di:complement sr:mycobacterium tuberculosis (strain erdman) dna nt.orf f175; putative |
| CONTIG406 | 7214683_c3_129 | 1533 | 7195 | 1317 | 439 | 1127 | 2.2(10)-114 | Escherichia coli | b4138 | [pn:anaerobic c4-dicarboxylate transporter dcuA] [gn:dcuA] |
| CONTIG406 | 15673342_f1_9 | 1534 | 7196 | 1734 | 578 | 2055 | 1.0(10)-212 | Escherichia coli | b1336 | [pn:hypothetical protein in ogt 5"" region] [gn:ydaH] |
| CONTIG406 | 5100443_f1_10 | 1535 | 7197 | 525 | 175 | 717 | 6.2(10)-71 | Escherichia coli | b1335 | [pn:o6-methylguanine-dna-alkyltransferase] [gn:ogt] |
| CONTIG406 | 24103168_f1_11 | 1536 | 7198 | 768 | 256 | 1255 | 6.0(10)-128 | Escherichia coli | b1334 | [pn:hypothetical 30.7 kd protein near the replication terminus] [gn:ydbc] |
| CONTIG406 | 26613250_f2_21 | 1537 | 7199 | 1470 | 490 | 1998 | 1.1(10)-206 | Escherichia coli | b1337 | [pn:fumarate and nitrate reduction regulatory protein] [gn:fnr] |
| CONTIG406 | 25942627_f3_28 | 1538 | 7200 | 1719 | 573 | 1220 | 3.1(10)-124 | Salmonella typhimurium | U94729 | [de:salmonella typhimurium oxd-6 operon, putative substrate-binding protein (oxd-6a), putative transmembrane protein (oxd-6), putative transmembrane protein (oxd-6c), putative atpase (oxd-6d), and putative atpase (oxd-6e)"] |
| CONTIG406 | 22345917_f3_29 | 1539 | 7201 | 1347 | 449 | 1668 | 1.0(10)-171 | Escherichia coli | b4355 | [pn:methyl-accepting chemotaxis protein j] [gn:tsr] |
| CONTIG406 | 16503_f3_36 | 1540 | 7202 | 999 | 333 | 1547 | 7.0(10)-159 | Escherichia coli | b1333 | [pn:35.6 kd protein in tpx-fnr intergenic region] [gn:ydaj] |
| CONTIG406 | 22073937_c2_63 | 1541 | 7203 | 1296 | 432 | 1811 | 7.4(10)-187 | Escherichia coli | b1602 | [pn:pyridine nucleotide transhydrogenase subunit-beta] [gn:pntb] |
| CONTIG406 | 439527_c2_82 | 1542 | 7204 | 897 | 299 | 1093 | 9.0(10)-111 | Escherichia coli | b1406 | [pn:hypothetical 30.7 kd protein near the replication terminus] [gn:ydbc] |
| CONTIG406 | 23677087_c3_83 | 1543 | 7205 | 1230 | 410 | 1253 | 9.9(10)-128 | Salmonella typhimurium | U94729 | [de:salmonella typhimurium oxd-6 operon, putative substrate-binding protein (oxd-6a), putative transmembrane protein (oxd-6), putative transmembrane protein (oxd-6c), putative atpase (oxd-6d), and putative atpase (oxd-6e)"] |
| CONTIG406 | 3963432_c3_92 | 1544 | 7206 | 927 | 309 | 1201 | 3.2(10)-122 | Escherichia coli | b1339 | [pn:hypothetical protein] |
| CONTIG406 | 29328408_c3_93 | 1545 | 7207 | 651 | 217 | 658 | 1.1(10)-64 | Escherichia coli | b1340 | [pn:hypothetical protein] |
| CONTIG407 | 119052_f1_4 | 1546 | 7208 | 1410 | 470 | 971 | 7.5(10)-98 | Bacillus subtilis | sacA | [pn:sucrase-6-phosphate hydrolase] [gn:ipa-50d] |
| CONTIG407 | 9978192_f1_6 | 1547 | 7209 | 1602 | 534 | 552 | 1.8(10)-53 | Klebsiella pneumoniae | b1421 | [pn:methyl-accepting chemotaxis protein iii] [gn:trg] |
| CONTIG407 | 9817713_f2_19 | 1548 | 7210 | 873 | 291 | 1222 | 1.8(10)-124 | | P27218 | sucrose porin precursor. |
| CONTIG407 | 3237531_f2_20 | 1549 | 7211 | 1437 | 479 | 918 | 3.1(10)-92 | Bacillus subtilis | sacP | [pn:phosphotransferase system] [gn:ipa-49d] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG407 | 34422278_f2_23 | 1550 | 7212 | 1023 | 341 | 1420 | 2.0(10)-145 | Klebsiella pneumoniae | P37076 | sucrose (ser) operon repressor |
| CONTIG407 | 33797292_f2_25 | 1551 | 7213 | 837 | 279 | 688 | 7.4(10)-68 | Escherichia coli | b0604 | [pn:hypothetical protein] |
| CONTIG407 | 34192591_f3_42 | 1552 | 7214 | 591 | 197 | 114 | 1.3(10)-5 | Bacillus subtilis | sigZ | [pn:rna polymerase of ecf-type sigma factor] |
| CONTIG407 | 4188967_f3_47 | 1553 | 7215 | 894 | 298 | 418 | 3.0(10)-39 | Bacillus subtilis | alsR | [pn:transcriptional regulator] |
| CONTIG407 | 962827_c1_56 | 1554 | 7216 | 1548 | 516 | 294 | 2.2(10)-24 | Methanobacterium thermoautotrophicum | MTH1394 | [pn:conserved protein] |
| CONTIG407 | 31808341_c2_72 | 1555 | 7217 | 1107 | 369 | 136 | 8.5(10)-7 | Bacillus subtilis | ytnP | [pn:hypothetical protein] |
| CONTIG407 | 22657666_c3_90 | 1556 | 7218 | 369 | 123 | 332 | 3.8(10)-30 | Bacillus subtilis | yhxD | [pn:hypothetical protein] |
| CONTIG407 | 14553381_c3_92 | 1557 | 7219 | 936 | 312 | 276 | 3.3(10)-24 | Escherichia coli | b0076 | [pn:leuO] |
| CONTIG407 | 16253767_c3_95 | 1558 | 7220 | 1434 | 478 | 1768 | 2.7(10)-182 | Escherichia coli | b1491 | [pn:hypothetical protein] |
| CONTIG407 | 1457626_c3_100 | 1559 | 7221 | 318 | 106 | 96 | 0.00067 | Enterobacter aerogenes | U67194 | or:enterobacter aerogenes pn:trae gn:trae le:44196 re:46259 di:complement |
| CONTIG408 | 34398586_f1_14 | 1560 | 7222 | 609 | 203 | 655 | 2.2(10)-64 | Escherichia coli | b1806 | [pn:hypothetical protein] |
| CONTIG408 | 6120461_f2_20 | 1561 | 7223 | 1572 | 524 | 2053 | 1.7(10)-212 | Escherichia coli | b1816 | [pn:hypothetical protein] [gn:yoae] |
| CONTIG408 | 665793_f2_34 | 1562 | 7224 | 1206 | 402 | 1650 | 8.5(10)-170 | Escherichia coli | b1804 | [pn:ribonuclease d] [gn:rnd] |
| CONTIG408 | 14464211_f3_46 | 1563 | 7225 | 195 | 65 | 261 | 1.3(10)-22 | Escherichia coli | b1811 | [pn:hypothetical protein] |
| CONTIG408 | 6364088_f3_48 | 1564 | 7226 | 1920 | 640 | 2813 | 4.9(10)-293 | Escherichia coli | b1808 | [pn:hypothetical protein] |
| CONTIG408 | 1560326_f3_49 | 1565 | 7227 | 723 | 241 | 931 | 1.3(10)-93 | Escherichia coli | b1807 | [pn:hypothetical protein] |
| CONTIG408 | 23485885_f3_51 | 1566 | 7228 | 1755 | 585 | 2749 | 2.8(10)-286 | Escherichia coli | b1805 | [pn:long-chain-fatty-acid--coa ligase] [gn:fadd] |
| CONTIG408 | 915878_c1_53 | 1567 | 7229 | 270 | 90 | 422 | 1.1(10)-39 | Escherichia coli | b1174 | [pn:cell division topological specificity factor] [gn:mine] |
| CONTIG408 | 4416061_c1_74 | 1568 | 7230 | 966 | 322 | 1392 | 1.8(10)-142 | Escherichia coli | b1817 | [pn:pts system, mannose-specific iiab component] [gn:manx] |
| CONTIG408 | 20789142_c2_89 | 1569 | 7231 | 615 | 205 | 836 | 1.5(10)-83 | Escherichia coli | b1813 | [pn:hypothetical 21.4 kd protein in pabb-sdaa intergenic region] [gn:yeab] |
| CONTIG408 | 26844406_c3_105 | 1570 | 7232 | 504 | 168 | 548 | 5.0(10)-53 | Escherichia coli | b1809 | [pn:hypothetical protein] |
| CONTIG408 | 16265877_c3_106 | 1571 | 7233 | 1380 | 460 | 1671 | 5.0(10)-172 | Escherichia coli | b1812 | [pn:para-aminobenzoate synthase component i] [gn:pabb] |
| CONTIG408 | 29845761_c3_108 | 1572 | 7234 | 1407 | 469 | 2040 | 4.0(10)-211 | Escherichia coli | b1814 | [pn:1-serine dehydratase 1] [gn:sdaa] |
| CONTIG408 | 9784408_c3_109 | 1573 | 7235 | 1728 | 576 | 1732 | 1.7(10)-178 | Escherichia coli | b1815 | [pn:hypothetical protein] |
| CONTIG408 | 23714651_f1_16 | 1574 | 7236 | 573 | 191 | 95 | 0.03799 | Thermus thermophilus | Y15464 | [de:thermus thermophilus phes, phet genes and 5 orf"'s,] |
| CONTIG408 | 2652002_f1_17 | 1575 | 7237 | 792 | 264 | 245 | 1.2(10)-20 | Escherichia coli | b3442 | [pn:ferredoxin oxidoreductase-like (gamma and alpha] [gn:orf2] |
| CONTIG408 | 406255_f2_27 | 1576 | 7238 | 495 | 165 | 293 | 5.2(10)-26 | Escherichia coli | b1183 | [pn:hypothetical 44.2 kd protein in gntr-ggt intergenic region] [gn:yhhz] |
| CONTIG408 | 14885165_f3_46 | 1577 | 7239 | 297 | 99 | 390 | 2.7(10)-36 | Escherichia coli | D93826 | hypothetical 11k protein (insertion sequence is1)-escherichia coli this protein is coded by the insertion sequence is1. |
| CONTIG409 | 16485627_f3_48 | 1578 | 7240 | 1272 | 424 | 959 | 1.3(10)-96 | Escherichia coli | b1184 | [pn:umc protein] [gn:umc] |
| CONTIG409 | 33460927_f3_53 | 1579 | 7241 | 570 | 190 | 194 | 1.6(10)-15 | Escherichia coli | Z68186 | or:escherichia coli pn:bfph gn:bfph le:9044 re:9490 di:direct |
| CONTIG409 | 14578162_f3_54 | 1580 | 7242 | 228 | 76 | 181 | 1.7(10)-13 | Escherichia coli | b3442 | [pn:hypothetical 44.2 kd protein in gntr-ggt intergenic region] [gn:yhhz] |
| CONTIG409 | 4322962_f3_55 | 1581 | 7243 | 516 | 172 | 135 | 2.8(10)-9 | Escherichia coli | b3443 | [pn:hypothetical protein] |
| CONTIG409 | 24410340_c1_63 | 1582 | 7244 | 1500 | 500 | 214 | 5.0(10)-15 | Plasmid F | M24492 | or:plasmid f pn:periplasmic protein gn:trah le:550 re:1629 di:direct sr:plasmid f dna |
| CONTIG409 | 6735393_c1_72 | 1583 | 7245 | 285 | 95 | 446 | 3.2(10)-42 | Escherichia coli | b4294 | [pn:insertion element is1f protein insa] [gn:insa_7] |
| CONTIG409 | 15897332_c1_75 | 1584 | 7246 | 1959 | 653 | 115 | 0.00309 | Lycopersicon esculentum | Y07861 | or:lycopersicon esculentum pn:mfp1 protein gn:mfp1 le:6 re:2099 di:direct sr:tomato |
| CONTIG409 | 2047880_c1_76 | 1585 | 7247 | 315 | 105 | 369 | 4.7(10)-34 | Yersinia pestis | AF053945 | [de:yersinia pestis plasmid ppcp1, complete plasmid sequence,] [pn:transposase] |
| CONTIG409 | 4901068_c2_80 | 1586 | 7248 | 759 | 253 | 347 | 1.0(10)-31 | Escherichia coli | b2893 | [pn:disulfide interchange protein, precursor] [gn:dsbc] |
| CONTIG409 | 34178880_c2_83 | 1587 | 7249 | 909 | 303 | 238 | 3.6(10)-20 | Coxiella burnetii | A49232 | outer membrane protein - coxiella burnetii |
| CONTIG409 | 2911290_c2_86 | 1588 | 7250 | 234 | 78 | 296 | 2.6(10)-26 | Escherichia coli | S40546 | hypothetical protein - escherichia coli |
| CONTIG409 | 25480326_c3_91 | 1589 | 7251 | 3963 | 1321 | 111 | 0.032 | Bombyx mori | S52714 | sericin1b - silkworm |
| CONTIG409 | 25567885_c3_96 | 1590 | 7252 | 525 | 175 | 898 | 4.0(10)-90 | Escherichia coli | b0264 | [pn:insertion element is1 protein insb] [gn:insb_2] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG41 | 1449812_f1_1 | 1591 | 7253 | 453 | 151 | 410 | 2.1(10)-38 | Escherichia coli | b0097 | [pn:hypothetical 16.0 kd protein in lpxc-seca intergenic region] [gn:yaca] |
| CONTIG41 | 26688902_f3_3 | 1592 | 7254 | 213 | 71 | 278 | 2.1(10)-24 | Escherichia coli | b0096 | [pn:udp-3-o-3-hydroxymyristoyl n-acetylglucosamine deacetylase] [gn:lpxc] |
| CONTIG410 | 26593890_f1_19 | 1593 | 7255 | 1506 | 502 | 523 | 8.0(10)-58 | Bacillus subtilis | yusP | [pn:hypothetical protein] |
| CONTIG410 | 20587883_f2_38 | 1594 | 7256 | 462 | 154 | 293 | 5.2(10)-26 | Erwinia amylovora | L25828 | or:erwinia amylovora le:10466 re:10885 di:direct nt:orf 12 |
| CONTIG410 | 26449211_f3_46 | 1595 | 7257 | 963 | 321 | 218 | 5.7(10)-18 | Escherichia coli | b2714 | [pn:asc operon repressor protein] [gn:ascg] |
| CONTIG410 | 34070927_c1_67 | 1596 | 7258 | 672 | 224 | 155 | 2.2(10)-11 | Escherichia coli | b1013 | [pn:hypothetical protein] [gn:ycdc] |
| CONTIG410 | 24423567_c1_72 | 1597 | 7259 | 3141 | 1047 | 2558 | 5.0(10)-266 | Escherichia coli | b0462 | [pn:acriflavin resistance protein b] [gn:acrb] |
| CONTIG410 | 16828927_c1_73 | 1598 | 7260 | 1164 | 388 | 433 | 7.7(10)-41 | Bacillus subtilis | ydgK | [pn:hypothetical protein] |
| CONTIG410 | 1094818_c1_76 | 1599 | 7261 | 327 | 109 | 182 | 3.1(10)-14 | Bacillus subtilis | ydhM | [pn:hypothetical protein] |
| CONTIG410 | 34416581_c2_80 | 1600 | 7262 | 576 | 192 | 146 | 2.0(10)-10 | Escherichia coli | b1618 | [pn:glucuronide repressor] [gn:uidr] |
| CONTIG410 | 3396086_c2_81 | 1601 | 7263 | 1155 | 385 | 831 | 5.2(10)-83 | Escherichia coli | b0463 | [pn:acriflavin resistance protein a precursor] [gn:acra] |
| CONTIG410 | 12692683_c3_105 | 1602 | 7264 | 1386 | 462 | 744 | 8.5(10)-74 | Escherichia coli | b0572 | [pn:hypothetical protein] [gn:ylcb] |
| CONTIG410 | 3016517_c3_113 | 1603 | 7265 | 1284 | 428 | 539 | 4.5(10)-52 | Bacillus subtilis | ywbA | [pn:hypothetical protein] [gn:ipa-16d] |
| CONTIG410 | 2465030_f1_1 | 1604 | 7266 | 1062 | 354 | 1374 | 1.5(10)-140 | Escherichia coli | b0929 | [pn:outer membrane protein f precursor] [gn:ompf] |
| CONTIG411 | 22520135_f1_15 | 1605 | 7267 | 666 | 222 | 648 | 1.3(10)-63 | Escherichia coli | b0920 | [pn:hypothetical protein in kdsb-kieb intergenic region] [gn:ycbc] |
| CONTIG411 | 24851430_f2_17 | 1606 | 7268 | 1209 | 403 | 1930 | 1.8(10)-199 | Escherichia coli | b0928 | [pn:aspartate aminotransferase] [gn:aspc] |
| CONTIG411 | 35814061_c1_59 | 1607 | 7269 | 816 | 272 | 1089 | 2.3(10)-110 | Escherichia coli | b0921 | [pn:hypothetical 29.8 kd protein in kdsb-kicb intergenic region] [gn:smta] |
| CONTIG411 | 25665880_c1_60 | 1608 | 7270 | 1326 | 442 | 2147 | 1.8(10)-222 | Escherichia coli | b0922 | [pn:mukf protein] [gn:mukf] |
| CONTIG411 | 34274216_c1_61 | 1609 | 7271 | 4464 | 1488 | 6395 | 0 | Escherichia coli | b0924 | [pn:mukb] |
| CONTIG411 | 15686_c1_65 | 1610 | 7272 | 582 | 194 | 820 | 7.5(10)-82 | Escherichia coli | b0926 | [pn:hypothetical protein] [gn:mukc] |
| CONTIG411 | 30730282_c2_75 | 1611 | 7273 | 801 | 267 | 1108 | 2.2(10)-112 | Escherichia coli | b0923 | [pn:muke protein] [gn:muke] |
| CONTIG411 | 13088555_c2_76 | 1612 | 7274 | 225 | 75 | 93 | 8.3(10)-5 | Homo sapiens | S40543 | or:homo sapiens pn:low density lipoprotein receptor le:1 re:177 di:direct sr:human nt:description: low density lipoprotein receptor, ldl |
| CONTIG411 | 33839465_c2_79 | 1613 | 7275 | 330 | 110 | 136 | 9.3(10)-8 | Escherichia coli | P22523 | cell division protein mukb. |
| CONTIG411 | 1654216_c3_89 | 1614 | 7276 | 1908 | 636 | 2340 | 6.5(10)-243 | Escherichia coli | b0925 | [pn:hypothetical protein in mukb 3''' region] [gn:ycbb] |
| CONTIG411 | 35683285_c3_90 | 1615 | 7277 | 693 | 231 | 981 | 6.5(10)-99 | Escherichia coli | b0927 | [pn:hypothetical protein] [gn:ycbl] |
| CONTIG411 | 1442568_c3_91 | 1616 | 7278 | 1218 | 406 | 393 | 1.3(10)-36 | Pseudomonas aeruginosa | U50396 | or:pseudomonas aeruginosa pn:wbpn gn:wbpn le:22302 re:23693 di:direct |
| CONTIG412 | 13087788_f1_13 | 1617 | 7279 | 1392 | 464 | 543 | 1.7(10)-52 | Bacillus subtilis | yenF | [pn:hypothetical protein] |
| CONTIG412 | 31344415_f1_14 | 1618 | 7280 | 1586 | 529 | 1902 | 1.7(10)-196 | Escherichia coli | b4340 | [pn:hypothetical 53.0 kd protein in iada-mcrd intergenic region] |
| CONTIG412 | 24431531_f2_15 | 1619 | 7281 | 1275 | 425 | 1574 | 9.5(10)-162 | Escherichia coli | b4336 | [pn:hypothetical 48.2 kd protein in iada-mcrd intergenic region] |
| CONTIG412 | 4957168_f3_36 | 1620 | 7282 | 528 | 176 | 183 | 2.3(10)-14 | Azospirillum brasilense | X70360 | or:azospirillum brasilense gn:carr le:59 re:580 di:direct nt:orf2 |
| CONTIG412 | 31431505_c1_38 | 1621 | 7283 | 906 | 302 | 510 | 5.4(10)-49 | Escherichia coli | b0900 | [pn:hypothetical protein] [gn:ycan] |
| CONTIG412 | 26432281_c1_50 | 1622 | 7284 | 1050 | 350 | 276 | 3.3(10)-24 | Bacillus subtilis | ydfG | [pn:hypothetical protein] |
| CONTIG412 | 13783340_c1_57 | 1623 | 7285 | 495 | 165 | 208 | 5.4(10)-17 | Escherichia coli | b1642 | [pn:hypothetical protein] [gn:slya] |
| CONTIG412 | 5119091_c2_74 | 1624 | 7286 | 744 | 248 | 3736 | 1.8(10)-34 | Bacillus subtilis | ydfF | [pn:hypothetical protein] |
| CONTIG412 | 22895156_c2_78 | 1625 | 7287 | 189 | 63 | 161 | 5.2(10)-12 | Escherichia coli | b4341 | [pn:hypothetical protein] [gn:yjis] |
| CONTIG412 | 3407211_c3_84 | 1626 | 7288 | 1449 | 483 | 687 | 9.4(10)-68 | Escherichia coli | b0312 | [pn:betaine aldehyde dehydrogenase] [gn:betb] |
| CONTIG412 | 2081292_c3_85 | 1627 | 7289 | 399 | 133 | 96 | 4.0(10)-5 | Bacillus subtilis | yqjZ | [pn:hypothetical protein] |
| CONTIG412 | 4883288_c3_87 | 1628 | 7290 | 1077 | 359 | 267 | 3.0(10)-23 | Escherichia coli | b4082 | [pn:hypothetical 36.9 kd protein in fdhf-pfmp intergenic region] |
| CONTIG412 | 22370937_f1_4 | 1629 | 7291 | 948 | 316 | 1266 | 4.2(10)-129 | Escherichia coli | b2131 | [pn:hypothetical 32.6 kd protein in molr-bglx intergenic region] [gn:yehz] |
| CONTIG413 | 1698609_f1_5 | 1630 | 7292 | 1170 | 390 | 662 | 4.2(10)-65 | Escherichia coli | b2130 | [pn:hypothetical abc transporter permease protein ychy] [gn:yehy] |
| CONTIG413 | 17058580_f2_17 | 1631 | 7293 | 1104 | 368 | 1257 | 3.7(10)-128 | Escherichia coli | b2129 | [pn:hypothetical abc trasnpoter in molr-bglx intergenic region] [gn:yehx] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG413 | 3227158_f2_24 | 1632 | 7294 | 771 | 257 | 1035 | 1.3(10)-104 | *Escherichia coli* | b2125 | [pn:hypothetical 27.9 kd protein in molr-bglx intergenic region] |
| CONTIG413 | 14255177_f3_28 | 1633 | 7295 | 285 | 95 | 441 | 1.1(10)-41 | *Escherichia coli* | b2134 | [pn:penicillin-binding protein 7 precursor] [gn:pbpg] |
| CONTIG413 | 7223781_f3_34 | 1634 | 7296 | 2391 | 797 | 3750 | 0 | *Escherichia coli* | b2132 | [pn:periplasmic beta-glucosidase precursor] [gn:bglx] |
| CONTIG413 | 30666041_f3_39 | 1635 | 7297 | 741 | 247 | 821 | 6.0(10)-82 | *Escherichia coli* | b2128 | [pn:hypothetical 25.5 kd protein in molr-bglx intergenic region] |
| CONTIG413 | 1431637_f3_40 | 1636 | 7298 | 1704 | 568 | 2269 | 2.2(10)-235 | *Escherichia coli* | b2126 | [pn:hypothetical 62.1 kd protein in molr-bglx intergenic region] [gn:yehu] |
| CONTIG413 | 14642543_f3_42 | 1637 | 7299 | 525 | 175 | 642 | 5.5(10)-63 | *Escherichia coli* | b2124 | [pn:hypothetical 18.0 kd protein in molr-bglx intergenic region] [gn:yehs] |
| CONTIG413 | 21565658_c1_45 | 1638 | 7300 | 1182 | 394 | 1740 | 2.5(10)-179 | *Escherichia coli* | b2114 | [pn:methionyl-trna synthetase] [gn:metg] |
| CONTIG413 | 24397250_c1_48 | 1639 | 7301 | 825 | 275 | 890 | 2.8(10)-89 | *Escherichia coli* | b2127 | [pn:hypothetical transcriptional regulator in molr-bglx intergenic region] [gn:yehv] |
| CONTIG414 | 16620831_c2_85 | 1640 | 7302 | 1923 | 641 | 2678 | 9.8(10)-279 | *Escherichia coli* | b2133 | [pn:d-lactate dehydrogenase] [gn:dld] |
| CONTIG414 | 23847008_c2_86 | 1641 | 7303 | 636 | 212 | 488 | 1.2(10)-46 | *Alcaligenes faecalis* | P31668 | phosphinothricin-resistance protein (ptc-resistance protein). |
| CONTIG414 | 25829787_f1_1 | 1642 | 7304 | 900 | 300 | 1364 | 1.7(10)-139 | *Escherichia coli* | b4161 | [pn:hypothetical 37.7 kg protein in psd-amib intergenic region] |
| CONTIG414 | 23567037_f1_9 | 1643 | 7305 | 417 | 139 | 472 | 5.7(10)-45 | *Escherichia coli* | b4152 | [pn:fumarate reductase, membrane anchor polypeptide] [gn:frdc] |
| CONTIG414 | 3162711_f1_12 | 1644 | 7306 | 1254 | 418 | 1245 | 7.0(10)-127 | *Escherichia coli* | b4150 | [pn:beta-lactamase precursor] [gn:ampc] |
| CONTIG414 | 2439512_f2_13 | 1645 | 7307 | 1044 | 348 | 1600 | 1.7(10)-164 | *Escherichia coli* | b4160 | [pn:phosphatidylserine decarboxylase proenzyme] [gn:psd] |
| CONTIG414 | 33206957_f2_21 | 1646 | 7308 | 1842 | 614 | 2810 | 1.0(10)-292 | *Escherichia coli* | b4154 | [pn:fumarate reductase flavoprotein subunit] [gn:frda] |
| CONTIG414 | 10948336_f2_22 | 1647 | 7309 | 417 | 139 | 535 | 1.2(10)-51 | *Escherichia coli* | b4151 | [pn:fumarate reductase, membrane anchor polypeptide] [gn:frdd] |
| CONTIG414 | 16879681_f3_26 | 1648 | 7310 | 3483 | 1161 | 4253 | 0 | *Escherichia coli* | b4159 | [pn:hypothetical 123.8 kd protein in genx-psd intergenic region] |
| CONTIG414 | 32131937_f3_35 | 1649 | 7311 | 810 | 270 | 1239 | 3.0(10)-126 | *Escherichia coli* | b4153 | [pn:fumarate reductase iron-sulfur protein] [gn:frdb] |
| CONTIG414 | 37576_c1_41 | 1650 | 7312 | 903 | 301 | 1516 | 1.3(10)-155 | *Enterobacter cloacae* | A25686 | ampr protein - *enterobacter cloacae* |
| CONTIG414 | 26056626_c1_48 | 1651 | 7313 | 981 | 327 | 1573 | 1.2(10)-161 | *Escherichia coli* | b4155 | [pn:lysyl-trna synthetase analog] [gn:yjea] |
| CONTIG414 | 163931_c2_66 | 1652 | 7314 | 1563 | 521 | 1981 | 7.0(10)-205 | *Escherichia coli* | b4156 | [pn:hypothetical 56.3 kd protein in genx-psd intergenic region] |
| CONTIG415 | 23572162_f1_1 | 1653 | 7315 | 642 | 214 | 883 | 1.6(10)-88 | *Serratia marcescens* | U59131 | or:*serratia marcescens* le:1362 re:1982 di:direct nt:orfb |
| CONTIG415 | 4876425_f1_10 | 1654 | 7316 | 306 | 102 | 418 | 3.0(10)-39 | *Escherichia coli* | b2105 | [pn:intracellular protein transport protein] [gn:usol] |
| CONTIG415 | 32230063_f1_19 | 1655 | 7317 | 1311 | 437 | 172 | 3.1(10)-9 | *Saccharomyces cerevisiae* | YDL058W | [pn:hypothetical protein] [gn:yohl] |
| CONTIG415 | 23928775_f2_26 | 1656 | 7318 | 765 | 255 | 1195 | 1.3(10)-121 | *Serratia marcescens* | U59131 | or:*serratia marcescens* pn:stba gn:stba le:313 re:1350 di:direct |
| CONTIG415 | 19572828_f2_27 | 1657 | 7319 | 1416 | 472 | 2236 | 6.7(10)-232 | *Escherichia coli* | S70165 | or:*serratia marcescens* pn:restriction methylase gn:trag1 le:84 re:1775 di:direct nt:putative restriction methylase |
| CONTIG415 | 6297128_f2_34 | 1658 | 7320 | 825 | 275 | 102 | 0.016 | *Serratia marcescens* | U60283 | very hypothetical 20.3 kd protein in dcm 3'' region (orf3). |
| CONTIG415 | 24744778_f2_39 | 1659 | 7321 | 447 | 149 | 237 | 4.5(10)-20 | *Escherichia coli* | P09183 | hypothetical protein 2 (insertion sequence is903)-*escherichia coli* |
| CONTIG415 | 6439528_f3_43 | 1660 | 7322 | 255 | 85 | 358 | 6.9(10)-33 | *Escherichia coli* | I77547 | [pn:partitioning system protein] [gn:parb] |
| CONTIG415 | 20984450_f3_49 | 1661 | 7323 | 468 | 156 | 618 | 1.8(10)-60 | *Escherichia coli* | S70162 | putative insertion sequence atp-binding protein y4iqVy4ndVy4sd, |
| CONTIG415 | 4875376_f3_58 | 1662 | 7324 | 585 | 195 | 265 | 4.9(10)-23 | *Haemophilus influenzae* | III1296 | [pn:hypothetical protein] |
| CONTIG415 | 21726630_c1_67 | 1663 | 7325 | 1536 | 512 | 802 | 6.2(10)-80 | *Rhizobium* sp. | P55501 | hypothetical 57.2 kd protein y4jaVy4neVy4se, |
| CONTIG415 | 31532840_c2_86 | 1664 | 7326 | 1101 | 367 | 787 | 2.3(10)-78 | *Yersinia pestis* | AF053947 | [de:*yersinia pestis* plasmid pmt1, complete plasmid sequence.] [pn:transposase] |
| CONTIG415 | 14704677_c2_87 | 1665 | 7327 | 990 | 330 | 1597 | 3.5(10)-164 | *Escherichia coli* | X02527 | or:*escherichia coli* le:199 re:1122 di:direct nt:orf1 (aa1-307) |
| CONTIG415 | 33992155_c3_92 | 1666 | 7328 | 1482 | 494 | 1385 | 1.0(10)-141 | *Escherichia coli* | b1961 | [pn:dna-cytosine methyltransferase] [gn:dcm] |
| CONTIG415 | 15750433_c3_99 | 1667 | 7329 | 786 | 262 | 474 | 3.5(10)-45 | *Rhizobium* sp. | P55500 | putative insertion sequence atp-binding protein y4iqVy4ndVy4sd, |
| CONTIG415 | 5117806_c3_101 | 1668 | 7330 | 1131 | 377 | 498 | 3.8(10)-93 | *Escherichia coli* | b2106 | [pn:hypothetical protein] |
| CONTIG416 | 16260012_f1_8 | 1669 | 7331 | 1026 | 342 | 1058 | 4.5(10)-107 | *Escherichia coli* | b3196 | [pn:hypothetical 34.7 kd protein in murz-rpon intergenic region] [gn:yrbg] |
| CONTIG416 | 32547880_f1_9 | 1670 | 7332 | 606 | 202 | 869 | 4.9(10)-87 | *Escherichia coli* | b3198 | [pn:hypothetical 20.0 kd protein in murz-rpon intergenic region] [gn:yhbn] |
| CONTIG416 | 1445325_f1_10 | 1671 | 7333 | 576 | 192 | 655 | 2.2(10)-64 | *Escherichia coli* | b3200 | [pn:17.3 kd protein in rpon 5'''' region precursor] [gn:yrbj] |
| CONTIG416 | 16828525_f1_11 | 1672 | 7334 | 732 | 244 | 1175 | 1.8(10)-119 | *Escherichia coli* | b3201 | [pn:probable abc transporter in ntra/rpon 5'''' region] [gn:yhbg] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG416 | 29928931_f1_12 | 1673 | 7335 | 417 | 139 | 339 | 7.0(10)-31 | Escherichia coli | b3203 | [pn:probable sigma [gn:yhbh] |
| CONTIG416 | 35556932_f1_13 | 1674 | 7336 | 372 | 124 | 438 | 2.2(10)-41 | Escherichia coli | b3206 | [pn:prophocarrier protein npr] [gn:ptso] |
| CONTIG416 | 13127067_f2_22 | 1675 | 7337 | 891 | 297 | 1242 | 1.5(10)-126 | Escherichia coli | b3187 | [pn:octaprenyl pyro] [gn:ispb] |
| CONTIG416 | 17540_f2_23 | 1676 | 7338 | 342 | 114 | 389 | 3.6(10)-36 | Escherichia coli | b3188 | [pn:ner-like protein] [gn:nlp] |
| CONTIG416 | 212966_f2_31 | 1677 | 7339 | 1062 | 354 | 1444 | 5.7(10)-148 | Escherichia coli | b3197 | [pn:hypothetical 35.2 kd protein in murz-rpon intergenic region] [gn:yhbh] |
| CONTIG416 | 25678166_f2_36 | 1678 | 7340 | 507 | 169 | 753 | 9.5(10)-75 | Escherichia coli | b3204 | [pn:enzyme iiantr] [gn:ptsn] |
| CONTIG416 | 36524205_f2_37 | 1679 | 7341 | 900 | 300 | 1357 | 9.5(10)-139 | Escherichia coli | b3205 | [pn:hypothetical protein] [gn:yhbj] |
| CONTIG416 | 1707418_f3_58 | 1680 | 7342 | 594 | 198 | 770 | 1.5(10)-76 | Escherichia coli | b3199 | [pn:hypothetical 21.7 kd protein in murz-rpon intergenic region] [gn:yhbk] |
| CONTIG416 | 21756342_f3_60 | 1681 | 7343 | 1473 | 491 | 1867 | 8.5(10)-193 | Escherichia coli | b3202 | [pn:sigma-n] [gn:rpon] |
| CONTIG416 | 34395429_c1_70 | 1682 | 7344 | 833 | 277 | 1192 | 2.8(10)-121 | Escherichia coli | b4262 | [pn:hypothetical 39.8 kd protein in pepa-gntv intergenic region] [gn:yjgq] |
| CONTIG416 | 24411837_c1_73 | 1683 | 7345 | 501 | 167 | 617 | 2.5(10)-60 | Escherichia coli | b3210 | [pn:aerobic respiration control sensor protein arcb] [gn:arcb] |
| CONTIG416 | 35438562_c1_74 | 1684 | 7346 | 759 | 253 | 917 | 4.0(10)-92 | Escherichia coli | b3208 | [pn:hypothetical 27.3 kd protein in ptso-arcb intergenic region] [gn:yrbm] |
| CONTIG416 | 13078568_c1_89 | 1685 | 7347 | 798 | 266 | 1236 | 6.2(10)-126 | Escherichia coli | b3194 | [pn:hypothetical 27.9 kd protein in murz-rpon intergenic region] [gn:yrbe] |
| CONTIG416 | 35750840_c1_90 | 1686 | 7348 | 357 | 119 | 371 | 2.8(10)-34 | Escherichia coli | b3191 | [pn:hypothetical 14.4 kd protein in murz-rpon intergenic region] [gn:yrbb] |
| CONTIG416 | 20875000_c1_91 | 1687 | 7349 | 381 | 127 | 412 | 1.3(10)-38 | Escherichia coli | b3190 | [pn:hypothetical 9.5 kd protein in murz-rpon intergenic region] [gn:yrba] |
| CONTIG416 | 7930_c2_96 | 1688 | 7350 | 702 | 234 | 792 | 7.0(10)-79 | Escherichia coli | b3209 | [pn:sigma cross-reacting protein 27a] [gn:yhbl] |
| CONTIG416 | 4978140_c2_108 | 1689 | 7351 | 567 | 189 | 610 | 1.3(10)-59 | Escherichia coli | b3193 | [pn:hypothetical protein] [gn:yrbd] |
| CONTIG416 | 24823250_c2_109 | 1690 | 7352 | 654 | 218 | 1004 | 2.3(10)-101 | Escherichia coli | b3192 | [pn:hypothetical 24.0 kd protein in murz-rpon intergenic region] [gn:yrbc] |
| CONTIG417 | 34381303_c3_112 | 1691 | 7353 | 1977 | 659 | 2853 | 2.7(10)-297 | Escherichia coli | b3210 | [pn:aerobic respiration control sensor protein arcb] [gn:arcb] |
| CONTIG417 | 14630327_c3_127 | 1692 | 7354 | 813 | 271 | 1182 | 3.2(10)-120 | Escherichia coli | b3195 | [pn:hypothetical protein] [gn:yrbf] |
| CONTIG417 | 16211468_c3_132 | 1693 | 7355 | 1305 | 435 | 1930 | 1.8(10)-199 | Escherichia coli | b3189 | [pn:udp-n-acetylglucosamine 1-carboxyvinyltransferase] [gn:mura] |
| CONTIG417 | 3337613_f1_3 | 1694 | 7356 | 1020 | 340 | 108 | 1.2(10)-5 | coliphage T4 | P39506 | hypothetical 9.5 kd protein in frd-gp32 intergenic region. |
| CONTIG417 | 10976425_f2_30 | 1695 | 7357 | 201 | 67 | 94 | 6.5(10)-5 | Escherichia coli | b1565 | [pn:hypothetical protein] |
| CONTIG417 | 21775383_f2_45 | 1696 | 7358 | 300 | 100 | 505 | 1.8(10)-48 | Bacteriophage lambda | J01735 | or:bacteriophage lambda le 525 re:851 di:direct sr:bacteriophage lambda kh100 is5 element nt:small gene |
| CONTIG417 | 21877261_f2_46 | 1697 | 7359 | 252 | 84 | 327 | 1.3(10)-29 | Escherichia coli | b1371 | [pn:hypothetical protein] |
| CONTIG417 | 33691012_c1_72 | 1698 | 7360 | 855 | 285 | 508 | 8.8(10)-49 | Rhizobium sp. | P55373 | putative transposase y4bf, |
| CONTIG417 | 4299217_c2_88 | 1699 | 7361 | 642 | 214 | 903 | 1.2(10)-90 | Enterobacter agglomerans | B38965 | hypothetical protein b (insertion sequence is1222)-enterobacter agglomerans |
| CONTIG417 | 2118828_c2_89 | 1700 | 7362 | 1053 | 351 | 301 | 4.2(10)-26 | Mycobacterium leprae | Z97369 | [PN:hypothetical protein MLCB250.18c] [GN:MLCB250.18c] [DE:Mycobacterium leprae cosmid B250] [NT:MLCB250.18c, unknown, len:596 aa; highly similar] [LE:5885] [RE:7675] [DI:complement] |
| CONTIG417 | 30204130_c2_90 | 1701 | 7363 | 279 | 93 | 109 | 9.8(10)-6 | Escherichia coli | U95365 | transposase,,is5b, |
| CONTIG417 | 34629052_c2_96 | 1702 | 7364 | 690 | 230 | 236 | 5.7(10)-20 | Escherichia coli | b1567 | [pn:hypothetical protein] |
| CONTIG417 | 160080_c2_97 | 1703 | 7365 | 948 | 316 | 747 | 4.0(10)-74 | Synechocystis sp. | P74068 | [GN:SLL1263] [SR:PCC6803,] [DE:HYPOTHETICAL 33.3 KD PROTEIN SLL1263] [SP:P74068] |
| CONTIG417 | 16837632_c2_98 | 1704 | 7366 | 294 | 98 | 473 | 4.5(10)-45 | Escherichia coli | b1563 | [pn:hypothetical rele protein] [gn:rele] |
| CONTIG417 | 4339135_c3_104 | 1705 | 7367 | 1026 | 342 | 1767 | 3.3(10)-182 | Escherichia coli | b1994 | [pn:insertion element is5 hypothetical 39.3 kd protein] |
| CONTIG417 | 25830_c3_115 | 1706 | 7368 | 1374 | 458 | 278 | 1.0(10)-22 | Streptomyces coelicolor | P14707 | mini-circle hypothetical 45.7 kd protein. |
| CONTIG417 | 33494038_c3_116 | 1707 | 7369 | 243 | 81 | 387 | 5.7(10)-36 | Escherichia coli | b1564 | [pn:relb protein] [gn:relb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG417 | 628161_c3_117 | 1708 | 7370 | 189 | 63 | 127 | 2.1(10)-8 | Escherichia coli | P23587 | flme protein homolog [pn:hypothetical protein] [gn:ugd] |
| CONTIG418 | 35314451_f1_2 | 1709 | 7371 | 1212 | 404 | 1621 | 1.0(10)-166 | Escherichia coli | b2028 | or:escherichia coli gn:yh1028w le:12646 re:12942 di:complement sr:escherichia coli (strain:k12) dna, clone lib.kohara lambda minise nt:orf_id:o350#11; similar to [swissprot accession |
| CONTIG418 | 14635416_f1_7 | 1710 | 7372 | 468 | 156 | 194 | 1.6(10)-15 | Escherichia coli | D90840 | |
| CONTIG418 | 2776938_f1_15 | 1711 | 7373 | 351 | 117 | 102 | 0.00046 | Homo sapiens | AC004493 | [de:homo sapiens chromosome 16, cosmid clone 373c8 (lanl), complete sequence.] [pn:kiaa0324] [gn:kiaa0324] |
| CONTIG418 | 17051316_f2_18 | 1712 | 7374 | 1143 | 381 | 1544 | 1.3(10)-158 | Escherichia coli | b2041 | [pn:dtdp-glucose 4,6-dehydratase] [gn:rfbb] |
| CONTIG418 | 32229077_f2_19 | 1713 | 7375 | 882 | 294 | 1314 | 3.3(10)-134 | Escherichia coli | b2039 | [pn:tdp-glucose pyrophosphorylase] [gn:rfba] |
| CONTIG418 | 6057958_f2_31 | 1714 | 7376 | 876 | 292 | 1133 | 5.2(10)-115 | Escherichia coli | b2016 | [pn:hypothetical protein] |
| CONTIG418 | 32553165_f3_32 | 1715 | 7377 | 1449 | 483 | 2300 | 1.1(10)-238 | Escherichia coli | b2029 | [pn:6-phosphogluconate dehydrogenase, decarboxylating] [gn:gnd] |
| CONTIG418 | 15113290_f3_39 | 1716 | 7378 | 1143 | 381 | 901 | 2.0(10)-90 | Escherichia coli | b2027 | [pn:hypothetical protein] |
| CONTIG418 | 31739687_c1_53 | 1717 | 7379 | 984 | 328 | 1450 | 1.3(10)-148 | Escherichia coli | b2019 | [pn:atp phosphoribosyltransferase] [gn:hisg] |
| CONTIG418 | 34188291_c1_58 | 1718 | 7380 | 1089 | 363 | 1666 | 1.7(10)-171 | Escherichia coli | b2022 | [pn:histidinol phosphatase] [gn:hisb] |
| CONTIG418 | 32424192_c1_59 | 1719 | 7381 | 933 | 311 | 1268 | 2.6(10)-129 | Escherichia coli | b2025 | [pn:hisf protein] [gn:hisf] |
| CONTIG418 | 31922662_c2_70 | 1720 | 7382 | 1140 | 380 | 1608 | 2.3(10)-165 | Escherichia coli | b2021 | [pn:imidazole] [gn:hisc] |
| CONTIG418 | 32678126_c2_75 | 1721 | 7383 | 816 | 272 | 915 | 6.5(10)-92 | Escherichia coli | b2024 | [pn:phosphoribosylformimino-5-aminoimidazole carboxamide ribotide] [gn:hisa] |
| CONTIG418 | 15734716_c2_77 | 1722 | 7384 | 330 | 110 | 97 | 3.1(10)-5 | Salmonella typhimurium | X03976 | or:salmonella typhimurium le:1 re:>173 di:direct nt:chimeric protein of hisf and hisie genes (57 aa) |
| CONTIG418 | 16620952_c2_80 | 1723 | 7385 | 1017 | 339 | 1466 | 2.7(10)-150 | Escherichia coli | Q04871 | hypothetical 37.6 kd protein in cld 5" region (orf2). |
| CONTIG418 | 35361063_c3_88 | 1724 | 7386 | 1326 | 442 | 1927 | 3.7(10)-199 | Escherichia coli | b2020 | [pn:histidinol dehydrogenase] [gn:hisd] |
| CONTIG418 | 2469541_c3_90 | 1725 | 7387 | 621 | 207 | 961 | 8.6(10)-97 | Escherichia coli | b2023 | [pn:amidotransferase] [gn:hish] |
| CONTIG418 | 6445253_c3_91 | 1726 | 7388 | 654 | 218 | 897 | 5.2(10)-90 | Escherichia coli | b2026 | [pn:phosphoribosyl-amp cyclohydrolase/phosphoribosyl-atp pyrophospholydrolase] [gn:hisi] |
| CONTIG419 | 4350678_f1_1 | 1727 | 7389 | 531 | 177 | 93 | 0.26 | Caenorhabditis elegans | L46861 | or:caenorhabditis elegans pn:talin le:3 re:7663 di:direct sr:caenorhabditis elegans (strain bristol) tissue library:whol |
| CONTIG419 | 22558287_f1_9 | 1728 | 7390 | 2559 | 853 | 2822 | 5.4(10)-294 | Escherichia coli | b0496 | [pn:hypothetical protein] [gn:ybbp] |
| CONTIG419 | 16458166_f2_24 | 1729 | 7391 | 735 | 245 | 814 | 3.2(10)-81 | Escherichia coli | b0490 | [pn:hypothetical protein] [gn:ybbl] |
| CONTIG419 | 33847266_f2_32 | 1730 | 7392 | 741 | 247 | 959 | 1.3(10)-96 | Escherichia coli | b0495 | [pn:hypothetical abc transporter] [gn:ybba] |
| CONTIG419 | 24791562_f2_42 | 1731 | 7393 | 642 | 214 | 581 | 1.6(10)-56 | Escherichia coli | U82664 | or:escherichia coli le:133380 re:134066 di:direct nt:hypothetical protein |
| CONTIG419 | 21525291_f3_54 | 1732 | 7394 | 864 | 288 | 909 | 2.7(10)-91 | Escherichia coli | b0491 | [pn:hypothetical protein] [gn:ybbm] |
| CONTIG419 | 21644141_f3_63 | 1733 | 7395 | 1167 | 389 | 99 | 0.033 | Escherichia coli | b1377 | [pn:hypothetical protein] |
| CONTIG419 | 24853550_f3_70 | 1734 | 7396 | 1581 | 527 | 2192 | 3.1(10)-227 | Escherichia coli | b0526 | [pn:cysteinyl-trna synthetase] [gn:cyss] |
| CONTIG419 | 2750412_c1_77 | 1735 | 7397 | 1554 | 518 | 1039 | 4.7(10)-105 | Bacillus subtilis | ptsG | [pn:phosphotransferase system] |
| CONTIG419 | 162701_c1_79 | 1736 | 7398 | 564 | 188 | 774 | 5.7(10)-77 | Escherichia coli | b0527 | [pn:phosphoribosyl-aminoimidazole carboxylase catalytic subunit] [gn:pure] |
| CONTIG419 | 31719580_c1_84 | 1737 | 7399 | 645 | 215 | 735 | 7.7(10)-73 | Escherichia coli | b0523 | [pn:hypothetical protein] [gn:ybcj] |
| CONTIG419 | 1272192_c1_95 | 1738 | 7400 | 297 | 99 | 92 | 0.00011 | Entamoeba histoytica | Y14328 | [PN:3E1 protein] [DE:Entamoeba histolytica mRNA for 3E1 protein.] [LE:32] [RE:418] [DI:direct] |
| CONTIG419 | 33169027_c1_98 | 1739 | 7401 | 813 | 271 | 1203 | 2.0(10)-122 | Escherichia coli | b0493 | [pn:hypothetical protein] [gn:ybbo] |
| CONTIG419 | 13015666_c1_103 | 1740 | 7402 | 531 | 177 | 553 | 1.5(10)-53 | Escherichia coli | b0489 | [pn:hypothetical protein] [gn:ybbk] |
| CONTIG419 | 33848817_c2_104 | 1741 | 7403 | 342 | 114 | 324 | 2.7(10)-29 | Escherichia coli | b0528 | [pn:hypothetical 7.4 kd protein in cyss-fold intergenic region] [gn:cyss] |
| CONTIG419 | 34173532_c2_126 | 1742 | 7404 | 876 | 292 | 1141 | 7.2(10)-116 | Escherichia coli | b0492 | [pn:hypothetical protein] [gn:ybbn] |
| CONTIG419 | 11228205_c3_134 | 1743 | 7405 | 249 | 83 | 330 | 6.4(10)-30 | Escherichia coli | b0529 | [pn:methylenetetrahydrofolate dehydrogenase] [gn:fold] |
| CONTIG419 | 36048591_c3_138 | 1744 | 7406 | 1173 | 391 | 498 | 1.0(10)-47 | Escherichia coli | b1620 | [pn:repressor protein] [gn:mali] |
| CONTIG419 | 4004186_c3_142 | 1745 | 7407 | 558 | 186 | 829 | 8.5(10)-83 | Escherichia coli | b0525 | [pn:peptidyl-prolyl cis-trans isomerase b] [gn:ppib] |
| CONTIG419 | 14978525_c3_143 | 1746 | 7408 | 726 | 242 | 1045 | 1.1(10)-105 | Escherichia coli | b0524 | [pn:hypothetical 26.9 kd protein in pure-ppib intergenic region] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG419 | 1610228l_c3_144 | 1747 | 7409 | 1089 | 363 | 1634 | 4.2(10)-168 | Escherichia coli | b0522 | [pn:phosphoribosylaminoimidazole carboxylase atpase subunit] [gn:purk] |
| CONTIG419 | 16113178_c3_145 | 1748 | 7410 | 1155 | 385 | 1365 | 1.3(10)-139 | Escherichia coli | b0503 | [pn:hypothetical 41.1 kd protein in rhsd-gel intergenic region] [gn:ybbb] |
| CONTIG420 | 24039076_c3_150 | 1749 | 7411 | 888 | 296 | 990 | 7.4(10)-100 | Escherichia coli | b0494 | [pn:acyl-coa thioesterase i] [gn:tesa] |
| CONTIG420 | 14629541_c1_70 | 1750 | 7412 | 630 | 210 | 722 | 1.8(10)-71 | Escherichia coli | b2051 | [pn:hypothetical 18.4 kd protein in cpsb 5'''' region] [gn:yefc] |
| CONTIG420 | 886252_c1_73 | 1751 | 7413 | 1422 | 474 | 2149 | 1.1(10)-222 | Escherichia coli | b2048 | [pn:phosphomannomutase] [gn:manb] |
| CONTIG420 | 32682807_c1_74 | 1752 | 7414 | 1497 | 499 | 2158 | 1.2(10)-223 | Escherichia coli | b2046 | [pn:hypothetical protein] |
| CONTIG420 | 17004375_c1_75 | 1753 | 7415 | 1296 | 432 | 1937 | 3.2(10)-200 | Escherichia coli | b2045 | [pn:hypothetical protein] [gn:wcak] |
| CONTIG420 | 24427167_c2_79 | 1754 | 7416 | 1035 | 345 | 1509 | 7.4(10)-155 | Escherichia coli | b2052 | [pn:hypothetical 36.1 kd protein in cpsb 5''' region] [gn:yefb] |
| CONTIG420 | 20330425_c2_94 | 1755 | 7417 | 936 | 312 | 1389 | 3.8(10)-142 | Escherichia coli | b2042 | [pn:utp-glucose-1-phosphate uridylyltransferase] [gn:galf] |
| CONTIG420 | 24251592_c3_95 | 1756 | 7418 | 1134 | 378 | 1888 | 5.0(10)-195 | Escherichia coli | b2053 | [pn:gdp-mannose 4,6-dehydratase] [gn:yefa] |
| CONTIG420 | 36417061_c3_98 | 1757 | 7419 | 1275 | 425 | 1634 | 4.2(10)-168 | Escherichia coli | b2050 | [pn:hypothetical 44.9 kd protein in cpsb 5''' region] [gn:yefd] |
| CONTIG420 | 21759652_c3_99 | 1758 | 7420 | 1440 | 480 | 2174 | 2.5(10)-225 | Escherichia coli | b2049 | [pn:mannose-1-phosphate guanylyltransferase] [gn:manc] |
| CONTIG420 | 11800807_c3_103 | 1759 | 7421 | 1467 | 489 | 2060 | 3.0(10)-213 | Escherichia coli | b2047 | [pn:hypothetical protein] [gn:wcaj] |
| CONTIG420 | 31505387_c3_109 | 1760 | 7422 | 1392 | 464 | 1689 | 6.2(10)-174 | Escherichia coli | b2044 | [pn:hypothetical protein] [gn:wcal] |
| CONTIG420 | 3158143_c3_110 | 1761 | 7423 | 1398 | 466 | 1857 | 9.8(10)-192 | Escherichia coli | b2043 | [pn:hypothetical protein] [gn:wcam] |
| CONTIG420 | 30672166_c3_111 | 1762 | 7424 | 1011 | 337 | 234 | 1.7(10)-18 | Saccharomyces cerevisiae | YGL001C | [pn:putative 3-beta-hydroxysteroid dehydrogenase] |
| CONTIG420 | 16991042_f1_3 | 1763 | 7425 | 438 | 146 | 91 | 0.00839 | Saccharomyces cerevisiae | YJR151C | [pn:similarity to mucin proteins, yk1224c, sta1p] [gnj2223] |
| CONTIG420 | 33331650_f1_5 | 1764 | 7426 | 696 | 232 | 907 | 4.5(10)-91 | Escherichia coli | b0046 | [pn:hypothetical nadph oxidoreductase in fixc-kefc intergenic region] [gn:yabf] |
| CONTIG421 | 6679631_f2_15 | 1765 | 7427 | 288 | 96 | 182 | 3.1(10)-14 | Escherichia coli | b2809 | [pn:hypothetical protein] |
| CONTIG421 | 31646007_f2_22 | 1766 | 7428 | 1977 | 659 | 2127 | 2.3(10)-220 | Escherichia coli | b0047 | [pn:glutathione-regulated potassium-efflux system protein kefc] [gn:kefc] |
| CONTIG421 | 964590_f2_23 | 1767 | 7429 | 513 | 171 | 804 | 3.7(10)-80 | Escherichia coli | b0048 | [pn:dihydrofolate reductase type i] [gn:fola] |
| CONTIG421 | 20996093_f3_33 | 1768 | 7430 | 834 | 278 | 1308 | 1.5(10)-133 | Escherichia coli | b0032 | [pn:carbamoyl-phosphate synthase small chain] [gn:cara] |
| CONTIG421 | 25524180_f3_34 | 1769 | 7431 | 3243 | 1081 | 5312 | 0 | Escherichia coli | b0033 | [pn:carbamoyl-phosphate synthase large chain] [gn:carb] |
| CONTIG421 | 34180387_c1_57 | 1770 | 7432 | 1299 | 433 | 1816 | 2.2(10)-187 | Escherichia coli | b0053 | [pn:survival protein sura precursor] [gn:sura] |
| CONTIG421 | 33866441_c1_66 | 1771 | 7433 | 501 | 167 | 98 | 0.0011 | Helicobacter pylori | AC000108 | or:helicobacter pylori pn:orf33 le:34041 re:34685 di:direct |
| CONTIG421 | 2371025_c2_75 | 1772 | 7434 | 1437 | 479 | 2091 | 1.6(10)-216 | Escherichia coli | b0054 | [pn:organic solvent tolerance protein precursor] [gn:imp] |
| CONTIG421 | 14881910_c2_76 | 1773 | 7435 | 828 | 276 | 1320 | 7.9(10)-135 | Escherichia coli | b0051 | [pn:dimethyladenosine transferase] [gn:ksga] |
| CONTIG421 | 25431533_c2_77 | 1774 | 7436 | 381 | 127 | 506 | 1.3(10)-48 | Escherichia coli | b0050 | [pn:apag protein] [gn:apag] |
| CONTIG421 | 24083442_c3_91 | 1775 | 7437 | 1050 | 350 | 1384 | 1.3(10)-141 | Escherichia coli | b0052 | [pn:pyridoxal phosphate biosynthetic protein pdxa] [gn:pdxa] |
| CONTIG421 | 31664075_c3_92 | 1776 | 7438 | 969 | 323 | 1366 | 1.1(10)-139 | Escherichia coli | b0049 | [pn:bis] [gn:apah] |
| CONTIG421 | 35854l5_c3_97 | 1777 | 7439 | 471 | 157 | 100 | 0.0076 | Caenorhabditis elegans | AF022974 | [de:caenorhabditis elegans cosmid f26g5.] [gn:f26g5.9] nt:contains similarity to c3hc4-type zinc |
| CONTIG422 | 23626562_c3_100 | 1778 | 7440 | 3102 | 1034 | 441 | 4.5(10)-65 | Escherichia coli | b1509 | [pn:hypothetical protein] |
| CONTIG422 | 10971967_f1_3 | 1779 | 7441 | 1221 | 407 | 2054 | 1.3(10)-212 | Escherichia coli | b2290 | [pn:hypothetical protein] |
| CONTIG422 | 21759631_f1_4 | 1780 | 7442 | 603 | 201 | 950 | 1.3(10)-95 | Escherichia coli | b2291 | [pn:hypothetical protein] |
| CONTIG422 | 2931592_f1_21 | 1781 | 7443 | 435 | 145 | 183 | 4.5(10)-14 | Escherichia coli | b3438 | [pn:gntukr operon regulator] [gn:gntr] |
| CONTIG422 | 25833401_f1_22 | 1782 | 7444 | 624 | 208 | 262 | 1.0(10)-22 | Escherichia coli | b3438 | [pn:gntukr operon regulator] [gn:gntr] |
| CONTIG422 | 33203141_f2_34 | 1783 | 7445 | 1239 | 413 | 1902 | 1.7(10)-196 | Escherichia coli | b2296 | [pn:acetate kinase] [gn:acka] |
| CONTIG422 | 31728832_f2_35 | 1784 | 7446 | 2145 | 715 | 3368 | 0 | Escherichia coli | b2297 | [pn:phosphate acetyltransferase] [gn:pta] |
| CONTIG422 | 31678191_c1_71 | 1785 | 7447 | 636 | 212 | 795 | 3.3(10)-79 | Escherichia coli | b2299 | [pn:hypothetical protein] |
| CONTIG422 | 2786715_c1_75 | 1786 | 7448 | 306 | 102 | 94 | 6.5(10)-5 | Escherichia coli | b4194 | [pn:hypothetical 10.9 kd protein in aidb-rpsf intergenic region] [gn:yjtf] |
| CONTIG422 | 2620418_c1_76 | 1787 | 7449 | 1404 | 468 | 435 | 4.7(10)-41 | Escherichia coli | b4193 | [pn:hypothetical 52.9 kd protein in aidb-rpsf intergenic region] [gn:yjfs] |
| CONTIG422 | 16683451_c1_77 | 1788 | 7450 | 1008 | 336 | 462 | 6.5(10)-44 | Methanococcus jannaschii | MJ0679 | [pn:transketolase''''''] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG422 | 4429018_c1_84 | 1789 | 7451 | 465 | 155 | 738 | 3.7(10)-73 | Escherichia coli | b2295 | [pn:hypothetical protein] |
| CONTIG422 | 26681415_c2_108 | 1790 | 7452 | 678 | 226 | 703 | 1.8(10)-69 | Escherichia coli | b2293 | [pn:hypothetical protein] |
| CONTIG422 | 6039881_c2_109 | 1791 | 7453 | 1845 | 615 | 2338 | 1.1(10)-242 | Escherichia coli | b2292 | [pn:hypothetical protein] [gn:yfbs] |
| CONTIG422 | 5111062_c2_111 | 1792 | 7454 | 894 | 298 | 1222 | 1.8(10)-124 | Escherichia coli | b2289 | [pn:nadh dehydrogenase operon transcriptional regulator] [gn:lrha] |
| CONTIG422 | 2931576_c3_112 | 1793 | 7455 | 555 | 185 | 835 | 2.0(10)-83 | Escherichia coli | b2300 | [pn:hypothetical protein] [gn:yfce] |
| CONTIG422 | 23853437_c3_114 | 1794 | 7456 | 447 | 149 | 238 | 3.6(10)-20 | Escherichia coli | b4195 | [pn:hypothetical phosphotransferase enzyme ii] [gn:ptxa] |
| CONTIG422 | 24507291_c3_117 | 1795 | 7457 | 858 | 286 | 462 | 6.5(10)-44 | Methanococcus jannaschii | MJ0681 | [pn:transketolase""] |
| CONTIG422 | 13725686_c3_122 | 1796 | 7458 | 549 | 183 | 797 | 2.1(10)-79 | Escherichia coli | b2294 | [pn:hypothetical protein] |
| CONTIG422 | 36125431_fl_7 | 1797 | 7459 | 216 | 72 | 105 | 4.5(10)-6 | Bacteriophage phi-80 | P17651 | adsorption-inhibiting cor protein. |
| CONTIG422 | 24222277_f2_27 | 1798 | 7460 | 1383 | 461 | 1955 | 4.0(10)-202 | Escherichia coli | b1784 | [pn:hypothetical protein] |
| CONTIG422 | 7151578_f3_45 | 1799 | 7461 | 264 | 88 | 429 | 3.7(10)-40 | Escherichia coli | b1783 | [pn:hypothetical protein] |
| CONTIG422 | 30522566_c1_70 | 1800 | 7462 | 3363 | 1121 | 248 | 6.0(10)-20 | Salmonella typhimurium | AF007380 | [PN:lambda phage II tail component homolog] [DE:Salmonella typhimurium lambda phage K tail component homolog gene, partial cds, lambda phage L tail components homolog, copper-zincsuperoxide dismutase (sodC), attachment and invasion prote |
| CONTIG423 | 6286331_c1_74 | 1801 | 7463 | 4020 | 1340 | 1029 | 2.7(10)-115 | Bacteriophage lambda | P03749 | host specificity protein j. |
| CONTIG423 | 665907_c2_89 | 1802 | 7464 | 762 | 254 | 329 | 8.1(10)-30 | Yersinia pestis | AF053947 | [de;yersinia pestis plasmid pmt1, complete plasmid sequence.] |
| CONTIG423 | 36534812_c2_91 | 1803 | 7465 | 609 | 203 | 128 | 2.3(10)-8 | Bacteriophage lambda | P03730 | [pn:phage lambda minor tail protein 1 homolog] tail assembly protein i. |
| CONTIG423 | 20916702_c2_100 | 1804 | 7466 | 672 | 224 | 93 | 0.066 | Bacillus subtilis | yhaU | [pn:hypothetical protein] |
| CONTIG423 | 26884831_c2_102 | 1805 | 7467 | 360 | 120 | 91 | 0.00013 | Salmonella typhimurium | P23831 | sama protein (ec 3.4.21.—). |
| CONTIG423 | 22948562_c3_106 | 1806 | 7468 | 1122 | 374 | 581 | 1.6(10)-56 | Bacteriophage HK97 | P49861 | major capsid protein precursor (gp5) (head protein) |
| CONTIG423 | 31728755_c3_112 | 1807 | 7469 | 387 | 129 | 136 | 2.2(10)-9 | Bacteriophage lambda | P03737 | minor tail protein m. |
| CONTIG423 | 25524180_c3_114 | 1808 | 7470 | 723 | 241 | 387 | 5.7(10)-36 | Coxiella burnetii | Y15898 | [de:coxiella burnetii plasmid qprs dna.] [pn:hypothetical protein] [gn:orf248] |
| CONTIG424 | 33641631_fl_6 | 1809 | 7471 | 1398 | 466 | 1791 | 9.6(10)-185 | Escherichia coli | b1002 | [pn:glucose-1-phosphatase precursor] [gn:agp] |
| CONTIG424 | 2846890_fl_8 | 1810 | 7472 | 195 | 65 | 210 | 3.2(10)-17 | Escherichia coli | b1259 | [pn:hypothetical protein in tonb-trpa intergenic region] [gn:ycig] |
| CONTIG424 | 3807708_fl_15 | 1811 | 7473 | 666 | 222 | 908 | 3.6(10)-91 | Escherichia coli | b1013 | [pn:hypothetical protein] [gn:ycdc] |
| CONTIG424 | 9776952_fl_19 | 1812 | 7474 | 651 | 217 | 136 | 2.2(10)-9 | Azospirillum brasilense | X70360 | or:azospirillum brasilense gn:carr le:59 re:580 di:direct nt:orf2 |
| CONTIG424 | 9964202_f2_33 | 1813 | 7475 | 534 | 178 | 151 | 5.9(10)-11 | Helicobacter pylori | HP0571 | [pn:conserved hypothetical integral membrane protein] |
| CONTIG424 | 33235452_f2_54 | 1814 | 7476 | 1509 | 503 | 2172 | 4.0(10)-225 | Escherichia coli | b1015 | [pn:sodium/proline symporter] [gn:putp] |
| CONTIG424 | 23862882_f3_62 | 1815 | 7477 | 975 | 325 | 151 | 1.3(10)-8 | Bacillus subtilis | yoaV | [pn:hypothetical protein] |
| CONTIG424 | 22266038_c1_80 | 1816 | 7478 | 1092 | 364 | 1129 | 1.3(10)-114 | Escherichia coli | b2393 | [pn:nucleoside permease nupe] [gn:nupe] |
| CONTIG424 | 13067881_c1_86 | 1817 | 7479 | 324 | 108 | 91 | 0.00479 | Escherichia coli | I53597 | proline dehydrogenase (ec 1.5.99.8)-escherichia coli |
| CONTIG424 | 32290750_c1_93 | 1818 | 7480 | 441 | 147 | 596 | 4.2(10)-58 | Escherichia coli | b1010 | [pn:hypothetical protein] |
| CONTIG424 | 32425751_c1_100 | 1819 | 7481 | 1116 | 372 | 870 | 3.7(10)-87 | Providencia stuartii | U23806 | or:providencia stuartii le:343 re:1413 di:direct nt:extended ord of mgtc gene; transcription from this |
| CONTIG424 | 14455001_c1_101 | 1820 | 7482 | 537 | 179 | 97 | 0.0038 | Bacillus subtilis | yxjL | [pn:hypothetical protein] |
| CONTIG424 | 4803205_c2_105 | 1821 | 7483 | 4092 | 1364 | 5754 | 0 | Escherichia coli | b1014 | [pn:proline oxidase] [gn:puta] |
| CONTIG424 | 23564416_c2_106 | 1822 | 7484 | 447 | 149 | 207 | 6.9(10)-17 | Sinorhizobium meliloti | P42879 | hypothetical 15.0 kd protein in ureb-urec intergenic region (orf5). |
| CONTIG424 | 31813125_c2_110 | 1823 | 7485 | 783 | 261 | 1104 | 6.0(10)-112 | Escherichia coli | b1011 | [pn:hypothetical protein] |
| CONTIG424 | 32619542_c2_111 | 1824 | 7486 | 858 | 286 | 1022 | 3.0(10)-103 | Escherichia coli | b1009 | [pn:hypothetical protein] |
| CONTIG424 | 1661427_c2_112 | 1825 | 7487 | 591 | 197 | 874 | 1.3(10)-87 | Escherichia coli | b1008 | [pn:hypothetical protein] |
| CONTIG424 | 16835915_c2_120 | 1826 | 7488 | 603 | 201 | 807 | 1.8(10)-80 | Escherichia coli | b1004 | [pn:hypothetical protein] |
| CONTIG424 | 34645256_c2_121 | 1827 | 7489 | 246 | 82 | 366 | 9.8(10)-34 | Escherichia coli | b1003 | [pn:trp repressor binding protein] [gn:wrba] |
| CONTIG424 | 32661281_c3_132 | 1828 | 7490 | 183 | 61 | 117 | 8.1(10)-6 | Escherichia coli | I53597 | proline dehydrogenase (ec 1.5.99.8)-escherichia coli |
| CONTIG424 | 23625786_c3_138 | 1829 | 7491 | 1179 | 393 | 1701 | 3.2(10)-175 | Escherichia coli | b1012 | [pn:hypothetical protein] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG424 | 4332318_c3_141 | 1830 | 7492 | 504 | 168 | 707 | 7.2(10)-70 | Escherichia coli | b1007 | [pn:hypothetical protein] |
| CONTIG424 | 33601030_c3_142 | 1831 | 7493 | 1344 | 448 | 1835 | 2.1(10)-189 | Escherichia coli | b1006 | [pn:hypothetical protein] [gn:ycdg] |
| CONTIG425 | 22659426_f1_1 | 1832 | 7494 | 2682 | 894 | 3783 | 0 | Escherichia coli | b1834 | [pn:hypothetical protein] |
| CONTIG425 | 11176451_f1_4 | 1833 | 7495 | 285 | 95 | 350 | 4.9(10)-32 | Escherichia coli | b1836 | [pn:hypothetical protein] |
| CONTIG425 | 35599132_f1_5 | 1834 | 7496 | 1104 | 368 | 524 | 1.8(10)-50 | Escherichia coli | b0877 | [pn:dna polymerase iii, theta subunit] [gn:hole] |
| CONTIG425 | 7159682_f1_10 | 1835 | 7497 | 273 | 91 | 333 | 3.1(10)-30 | Escherichia coli | b1842 | [pn:hypothetical protein] |
| CONTIG425 | 2605072_f1_11 | 1836 | 7498 | 684 | 228 | 332 | 2.0(10)-41 | Escherichia coli | b1843 | [pn:hypothetical protein] |
| CONTIG425 | 32635763_f1_12 | 1837 | 7499 | 678 | 226 | 1052 | 2.0(10)-106 | Escherichia coli | b1844 | [pn:hypothetical protein] |
| CONTIG425 | 4803751_f3_44 | 1838 | 7500 | 1314 | 438 | 1773 | 7.7(10)-183 | Escherichia coli | b1833 | [pn:hypothetical protein] |
| CONTIG425 | 29781327_f3_46 | 1839 | 7501 | 1464 | 488 | 2052 | 2.1(10)-212 | Escherichia coli | b1835 | [pn:hypothetical protein] |
| CONTIG425 | 24349067_f3_54 | 1840 | 7502 | 1275 | 425 | 1599 | 2.2(10)-164 | Escherichia coli | b1849 | [pn:phosphoribosylglycinamide formyltransferase 3] [gn:purt] |
| CONTIG425 | 33494665_c1_58 | 1841 | 7503 | 285 | 95 | 91 | 0.0027 | Triticum aestivum | JN0690 | [pn:glutenin, high-molecular-weight bx7 chain precursor - wheat the main wheat storage proteins are divided into two groups. the glutenins, composed of high- and low- molecular weight families, and the gliadins, composed of alpha or beta, gamma and omega fam |
| CONTIG425 | 3158387_c1_62 | 1842 | 7504 | 876 | 292 | 545 | 1.1(10)-52 | Escherichia coli | b1840 | [pn:hypothetical protein] |
| CONTIG425 | 7228508_c2_77 | 1843 | 7505 | 687 | 229 | 529 | 5.2(10)-51 | Escherichia coli | b1846 | [pn:hypothetical 23.7 kd protein in purt 5''' region] [gn:yebe] |
| CONTIG425 | 32225388_c2_78 | 1844 | 7506 | 2103 | 701 | 2793 | 6.64(10)-291 | Escherichia coli | b1845 | [pn:protease ii] [gn:ptrb] |
| CONTIG425 | 24415886_c2_82 | 1845 | 7507 | 342 | 114 | 444 | 5.2(10)-42 | Escherichia coli | b1839 | [pn:hypothetical protein] |
| CONTIG425 | 24025302_c2_93 | 1846 | 7508 | 501 | 167 | 754 | 7.5(10)-75 | Escherichia coli | b1832 | [pn:hypothetical protein] |
| CONTIG425 | 196055_c2_94 | 1847 | 7509 | 516 | 172 | 325 | 2.2(10)-29 | Haemophilus influenzae | H11670 | [pn:bifunctional protein] |
| CONTIG425 | 4976566_c3_104 | 1848 | 7510 | 390 | 130 | 272 | 9.0(10)-24 | Escherichia coli | b1841 | [pn:conjugative transfer co-repressor] [gn:fino] |
| CONTIG425 | 24897717_c3_110 | 1849 | 7511 | 777 | 259 | 704 | 2.3(10)-69 | Escherichia coli | b1838 | [pn:hypothetical protein] [gn:prpa] |
| CONTIG425 | 26460813_f1_27 | 1850 | 7512 | 216 | 72 | 178 | 8.1(10)-14 | Escherichia coli | b3537 | [pn:hypothetical protein] [gn:yhjt] |
| CONTIG425 | 25987562_f2_49 | 1851 | 7513 | 1587 | 529 | 2040 | 4.0(10)-211 | Escherichia coli | b3536 | [pn:hypothetical 59.4 kd protein in dcta-dppf intergenic region] |
| CONTIG425 | 23455028_c1_99 | 1852 | 7514 | 1713 | 571 | 2368 | 7.0(10)-246 | Escherichia coli | b3538 | [pn:hypothetical 62.0 kd protein in dcta-dppf intergenic region] |
| CONTIG425 | 16598131_c1_100 | 1853 | 7515 | 1014 | 338 | 1364 | 1.7(10)-139 | Escherichia coli | b3973 | [pn:bifunctional protein] [gn:bira] |
| CONTIG426 | 33719693_c2_102 | 1854 | 7516 | 2643 | 881 | 3852 | 0 | Escherichia coli | b4218 | [pn:hypothetical 101.6 kd protein in dcta-dppf intergenic region] |
| CONTIG426 | 16691707_c1_92 | 1855 | 7517 | 3507 | 1169 | 4218 | 0 | Escherichia coli | b3530 | [pn:hypothetical 125.7 kd protein in dcta-dppf intergenic region] |
| CONTIG426 | 35657127_c1_98 | 1856 | 7518 | 2100 | 700 | 2387 | 6.7(10)-248 | Escherichia coli | b3529 | [pn:hypothetical 73.1 kd protein in dcta-dppf intergenic region] |
| CONTIG426 | 23455028_c1_99 | 1857 | 7519 | 567 | 189 | 570 | 2.3(10)-55 | Escherichia coli | b3528 | [pn:c4-dicarboxylate transport protein] [gn:murb] |
| CONTIG426 | 14551878_c2_107 | 1858 | 7520 | 1176 | 392 | 1474 | 3.7(10)-151 | Escherichia coli | b3972 | [pn:udp-n-acetylenolpyruvoylglucosamine reductase] [gn:murb] |
| CONTIG426 | 21769375_c2_111 | 1859 | 7521 | 783 | 261 | 897 | 5.2(10)-90 | Escherichia coli | b3534 | [pn:hypothetical protein] [gn:yhjq] |
| CONTIG426 | 4650458_c2_112 | 1860 | 7522 | 2541 | 847 | 2874 | 0 | Escherichia coli | b3532 | [pn:hypothetical 86.0 kd protein in dcta-dppf intergenic region] |
| CONTIG426 | 32319840_c3_124 | 1861 | 7523 | 1113 | 371 | 1417 | 4.2(10)-145 | Escherichia coli | b3531 | [pn:hypothetical 41.7 kd protein in dcta-dppf intergenic region] [gn:yhjr] |
| CONTIG426 | 32035966_c3_137 | 1862 | 7524 | 249 | 83 | 245 | 6.5(10)-21 | Escherichia coli | b3535 | [pn:hypothetical protein] [gn:yhjr] |
| CONTIG427 | 4152178_f1_8 | 1863 | 7525 | 348 | 116 | 94 | 0.00095 | Pseudomonas sp. | D10769 | or:pseudomonas sp. pn:maltopentaose forming amylase le:717 re:2561 di:direct sr:pseudomonas sp. (strain ko-8940) (library: lambda 147) dna |
| CONTIG427 | 4823265_f2_20 | 1864 | 7526 | 1020 | 340 | 1216 | 8.3(10)-124 | Escherichia coli | b1320 | [pn:hypothetical protein] |
| CONTIG427 | 24266676_f2_22 | 1865 | 7527 | 807 | 269 | 1160 | 7.0(10)-118 | Escherichia coli | b1326 | [pn:hypothetical protein] [gn:yciji] |
| CONTIG427 | 31681349_c1_59 | 1866 | 7528 | 531 | 177 | 727 | 5.5(10)-72 | Escherichia coli | b1324 | [pn:thiol peroxidase] [gn:tpx] |
| CONTIG427 | 5350202_c1_60 | 1867 | 7529 | 838 | 279 | 1209 | 4.5(10)-123 | Escherichia coli | b1313 | [pn:hypothetical protein] |
| CONTIG427 | 7314416_c1_66 | 1868 | 7530 | 1077 | 359 | 1412 | 1.3(10)-144 | Escherichia coli | b1315 | [pn:hypothetical protein] |
| CONTIG427 | 32842_c1_68 | 1869 | 7531 | 765 | 255 | 596 | 4.2(10)-58 | Escherichia coli | b1317 | [pn:hypothetical protein] |
| CONTIG427 | 10634640_c1_76 | 1870 | 7532 | 927 | 309 | 990 | 7.4(10)-100 | Escherichia coli | b1319 | [pn:hypothetical protein] [gn:ompg] |
| CONTIG427 | | 1871 | 7533 | 1032 | 344 | 1162 | 4.4(10)-118 | Escherichia coli | b1325 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG427 | 5165892_c2_81 | 1872 | 7534 | 858 | 286 | 1201 | 3.2(10)-122 | Escherichia coli | b1314 | [pn:hypothetical protein] |
| CONTIG427 | 35236466_c2_84 | 1873 | 7535 | 1125 | 375 | 1378 | 5.5(10)-141 | Escherichia coli | b1318 | [pn:hypothetical protein] |
| CONTIG427 | 14885377_c2_89 | 1874 | 7536 | 1059 | 353 | 1256 | 4.7(10)-128 | Escherichia coli | b1322 | [pn:hypothetical protein in pspe-tyrr intergenic region] [gn:ycjf] |
| CONTIG427 | 3411330_c2_90 | 1875 | 7537 | 1638 | 546 | 2210 | 3.8(10)-229 | Escherichia coli | b1323 | [pn:transcriptional regulatory protein tyrr] [gn:tyrr] |
| CONTIG427 | 24505167_c3_96 | 1876 | 7538 | 2310 | 770 | 2548 | 5.9(10)-265 | Escherichia coli | b1316 | [pn:hypothetical protein] |
| CONTIG427 | 5213467_c3_100 | 1877 | 7539 | 1407 | 469 | 2285 | 4.4(10)-237 | Escherichia coli | b1321 | [pn:hypothetical protein] |
| CONTIG427 | 4157968_c3_108 | 1878 | 7540 | 1626 | 542 | 2510 | 6.2(10)-261 | Escherichia coli | b1329 | [pn:hypothetical protein] |
| CONTIG427 | 16932050_f1_22 | 1879 | 7541 | 1098 | 366 | 538 | 5.7(10)-52 | Bacillus subtilis | yesQ | [pn:hypothetical protein] |
| CONTIG428 | 13867963_f1_23 | 1880 | 7542 | 1140 | 380 | 818 | 1.2(10)-81 | Bacillus subtilis | msmX | [pn:multiple sugar-binding transport atp-binding protein] [gn:yxkg] |
| CONTIG428 | 4807327_f2_30 | 1881 | 7543 | 1023 | 341 | 1503 | 3.2(10)-154 | Escherichia coli | b2837 | [pn:galactose operon repressor] [gn:galr] |
| CONTIG428 | 32149135_f2_38 | 1882 | 7544 | 957 | 319 | 1322 | 4.5(10)-135 | Escherichia coli | b2839 | [pn:transcriptional activator protein lysr] [gn:lysr] |
| CONTIG428 | 24427336_f2_41 | 1883 | 7545 | 336 | 112 | 218 | 4.7(10)-18 | Erwinia chrysanthemi | Q05527 | pectin degradation protein kdgf. |
| CONTIG428 | 4345932_f2_47 | 1884 | 7546 | 1350 | 450 | 327 | 1.3(10)-29 | Bacillus subtilis | yesO | [pn:hypothetical protein] |
| CONTIG428 | 2468768_f3_59 | 1885 | 7547 | 1119 | 373 | 692 | 2.7(10)-68 | Bacillus subtilis | b2714 | [pn:asc operon repressor protein] [gn:ascg] |
| CONTIG428 | 2464253_f3_65 | 1886 | 7548 | 897 | 299 | 775 | 4.5(10)-77 | Bacillus subtilis | yesP | [pn:hypothetical protein] |
| CONTIG428 | 2402643_c1_81 | 1887 | 7549 | 1425 | 475 | 609 | 1.7(10)-59 | Bacillus subtilis | licC | [pn:phosphotransferase system] [gn:celb] |
| CONTIG428 | 21587562_c2_104 | 1888 | 7550 | 1494 | 498 | 958 | 1.8(10)-96 | Bacillus subtilis | ydhP | [pn:hypothetical protein] |
| CONTIG428 | 14257826_c2_105 | 1889 | 7551 | 795 | 265 | 560 | 2.7(10)-54 | Haemophilus influenzae | HI0054 | [pn:uxu operon regulator] [gn:uxur] |
| CONTIG428 | 4962950_c2_110 | 1890 | 7552 | 2322 | 774 | 3240 | 0 | Escherichia coli | b2836 | [pn:2-acylglycerophosphoethanolamine acyltransferase/acyl-acyl carrier protein synthetase] [gn:aas] |
| CONTIG428 | 9943775_c3_117 | 1891 | 7553 | 1215 | 405 | 1077 | 4.4(10)-109 | Escherichia coli | b0587 | [pn:ferric enterobactin transport protein fepe] [gn:fepe] |
| CONTIG428 | 34179511_c3_118 | 1892 | 7554 | 1185 | 395 | 895 | 8.5(10)-90 | Escherichia coli | b2840 | [pn:hypothetical 25.2 kd protein in lysr-arae intergenic region] [gn:ygea] |
| CONTIG428 | 4376958_c3_120 | 1893 | 7555 | 1365 | 455 | 1906 | 6.2(10)-197 | Escherichia coli | b2838 | [pn:diaminopimelate decarboxylase] [gn:lysa] |
| CONTIG428 | 1413592_c3_136 | 1894 | 7556 | 930 | 310 | 1155 | 2.3(10)-117 | Escherichia coli | b2835 | [pn:hypothetical protein in muth-aas intergenic region] [gn:yged] |
| CONTIG429 | 34664655_f1_2 | 1895 | 7557 | 540 | 180 | 420 | 1.8(10)-39 | Escherichia coli | b0419 | [pn:hypothetical protein] [gn:yajo] |
| CONTIG429 | 3414166_f1_3 | 1896 | 7558 | 363 | 121 | 225 | 1.1(10)-18 | Escherichia coli | b0419 | [pn:hypothetical protein] [gn:yajo] |
| CONTIG429 | 19964657_f1_22 | 1897 | 7559 | 609 | 203 | 217 | 6.0(10)-18 | Bacillus subtilis | yyaR | [pn:hypothetical protein] |
| CONTIG429 | 428316_f1_23 | 1898 | 7560 | 591 | 197 | 461 | 8.4(10)-44 | Bacillus subtilis | ylxD | [pn:hypothetical protein] [gn:yxbf] |
| CONTIG429 | 21954568_f2_24 | 1899 | 7561 | 1209 | 403 | 325 | 2.2(10)-29 | Bacillus subtilis | iolS | [pn:hypothetical protein] |
| CONTIG429 | 2819755_f2_25 | 1900 | 7562 | 1074 | 358 | 480 | 8.0(10)-46 | Synechocystis sp. | S76674 | [PN:hypothetical protein] [OR:Synechocystis sp.] [SR:PCC 6803, PCC 6803] [SR PCC 6803,] |
| CONTIG429 | 4890901_f2_26 | 1901 | 7563 | 582 | 194 | 291 | 8.6(10)-26 | Escherichia coli | b0046 | [pn:hypothetical nadph oxidoreductase in fixc-kefc intergenic region] [gn:yabf] |
| CONTIG429 | 6750016_f2_31 | 1902 | 7564 | 642 | 214 | 215 | 9.8(10)-18 | Bacillus subtilis | ywrO | [pn:hypothetical protein] |
| CONTIG429 | 24222287_f2_54 | 1903 | 7565 | 762 | 254 | 91 | 0.00052 | Escherichia coli | b1518 | [pn:hypothetical protein] |
| CONTIG429 | 5353556_f3_55 | 1904 | 7566 | 819 | 273 | 137 | 4.0(10)-9 | Methanobacterium thermoautotrophicum | MTH234 | [pn:gamma-carboxymuconolactone decarboxylase] |
| CONTIG429 | 30156668_f3_58 | 1905 | 7567 | 1491 | 497 | 597 | 3.2(10)-58 | Mycobacterium tuberculosis | b1828 | [pn:hypothetical protein] |
| CONTIG429 | 30329136_c1_90 | 1906 | 7568 | 549 | 183 | 398 | 4.0(10)-37 | Mycobacterium tuberculosis | Z95210 | unknown,, mtcy21c12.13, mtcy21c12.13, len |
| CONTIG429 | 33867840_c2_103 | 1907 | 7569 | 2484 | 828 | 965 | 1.3(10)-117 | Arthrobacter sp. | S65769 | maltooligosyl trehalose synthase - arthrobacter sp. (strainq36) |
| CONTIG429 | 14730330_c2_104 | 1908 | 7570 | 2091 | 697 | 1423 | 9.5(10)-146 | Escherichia coli | b3431 | [pn:glycogen operon protein glgx] [gn:glgx] |
| CONTIG429 | 10551037_c2_112 | 1909 | 7571 | 963 | 321 | 168 | 2.7(10)-10 | Escherichia coli | b0076 | [pn:leuo] |
| CONTIG429 | 20157792_c2_113 | 1910 | 7572 | 294 | 98 | 129 | 1.3(10)-8 | Mycobacterium tuberculosis | Z95210 | unknown,, mtcy21c12.12, mtcy21c12.12, len |
| CONTIG43 | 33601702_c3_120 | 1911 | 7573 | 1788 | 596 | 826 | 1.8(10)-82 | Sulfolobus solfataricus | S73087 | [pn:alpha-amylase, precursor] |
| CONTIG43 | 34018765_f2_1 | 1912 | 7574 | 663 | 221 | 1034 | 1.6(10)-104 | Escherichia coli | b3320 | [pn:50s ribosomal subunit protein 13] [gn:rplc] |
| CONTIG43 | 36517717_f3_3 | 1913 | 7575 | 368 | 123 | 510 | 5.4(10)-49 | Escherichia coli | b3319 | [pn:50s ribosomal subunit protein 14] [gn:rpld] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG430 | 25570176_f1_3 | 1914 | 7576 | 921 | 307 | 1276 | 3.6(10)-130 | Escherichia coli | b0428 | [pn:cytochrome o ubiquinol oxidase c subunit] [gn:cyoe] |
| CONTIG430 | 7089132_f1_4 | 1915 | 7577 | 1374 | 458 | 1801 | 8.5(10)-186 | Escherichia coli | b0427 | [pn:hypothetical protein] [gn:yajf] |
| CONTIG430 | 10835913_f3_18 | 1916 | 7578 | 615 | 205 | 677 | 1.1(10)-66 | Escherichia coli | b0412 | [pn:hypothetical 21.8 kd protein in tsx-ribd intergenic region] [gn:yajj] |
| CONTIG430 | 24869658_f2_19 | 1917 | 7579 | 2031 | 677 | 3197 | 0 | Escherichia coli | b0431 | [pn:cytochrome o ubiquinol oxidase subunit i] [gn:cyob] |
| CONTIG430 | 20801331_f2_20 | 1918 | 7580 | 423 | 141 | 297 | 2.0(10)-26 | Escherichia coli | b0429 | [pn:cytochrome o ubiquinol oxidase c subunit] [gn:cyod] |
| CONTIG430 | 519606_f2_23 | 1919 | 7581 | 921 | 307 | 1376 | 9.1(10)-141 | Escherichia coli | b0425 | [pn:apba protein] [gn:apba] |
| CONTIG430 | 235707_f2_26 | 1920 | 7582 | 1005 | 335 | 1531 | 3.5(10)-157 | Escherichia coli | b0419 | [pn:hypothetical protein] [gn:yajo] |
| CONTIG430 | 14587812_f3_37 | 1921 | 7583 | 618 | 206 | 937 | 3.0(10)-94 | Escherichia coli | b0430 | [pn:cytochrome o ubiquinol oxidase subunit iii] [gn:cyoc] |
| CONTIG430 | 34648537_f3_44 | 1922 | 7584 | 609 | 203 | 905 | 7.5(10)-91 | Escherichia coli | b0424 | [pn:thij protein] [gn:thij] |
| CONTIG430 | 12922775_f3_47 | 1923 | 7585 | 249 | 83 | 357 | 8.8(10)-33 | Escherichia coli | b0422 | [pn:exodeoxyribonuclease small subunit] [gn:xseb] |
| CONTIG430 | 10157952_f3_48 | 1924 | 7586 | 900 | 300 | 1234 | 1.0(10)-125 | Escherichia coli | b0421 | [pn:geranyltranstransferase] [gn:ispa] |
| CONTIG430 | 2147132_f3_49 | 1925 | 7587 | 1887 | 629 | 2952 | 0 | Escherichia coli | b0420 | [pn:hypothetical protein] [gn:yajp] |
| CONTIG430 | 5161562_c1_60 | 1926 | 7588 | 1209 | 403 | 1658 | 1.2(10)-170 | Escherichia coli | b0414 | [pn:riboflavin biosynthesis protein ridb] [gn:ribd] |
| CONTIG430 | 4182842_c1_61 | 1927 | 7589 | 480 | 160 | 580 | 2.1(10)-56 | Escherichia coli | b0415 | [pn:probably riboflavin synthase beta chain] [gn:ribh] |
| CONTIG430 | 23671835_c1_62 | 1928 | 7590 | 441 | 147 | 661 | 5.4(10)-65 | Escherichia coli | b0416 | [pn:nn utilization substance protein b] [gn:nusb] |
| CONTIG430 | 19781883_c2_99 | 1929 | 7591 | 555 | 185 | 775 | 4.5(10)-77 | Escherichia coli | b0426 | [pn:hypothetical protein] [gn:yajq] |
| CONTIG430 | 31430461_c3_108 | 1930 | 7592 | 462 | 154 | 723 | 1.3(10)-71 | Escherichia coli | b0413 | [pn:hypothetical 17.2 kd protein in tsx-ribd intergenic region] [gn:ybad] |
| CONTIG430 | 30212766_c3_109 | 1931 | 7593 | 975 | 325 | 1449 | 1.7(10)-148 | Escherichia coli | b0417 | [pn:hypothetical protein] [gn:thij] |
| CONTIG430 | 34005008_c3_116 | 1932 | 7594 | 1473 | 491 | 2182 | 3.6(10)-226 | Escherichia coli | b0423 | [pn:hypothetical protein] [gn:yajk] |
| CONTIG431 | 32236592_f1_4 | 1933 | 7595 | 2160 | 720 | 3307 | 0 | Escherichia coli | b2675 | [pn:ribonucleoside-diphosphate reductase 2 alpha chain] [gn:nrde] |
| CONTIG431 | 5320443_f1_5 | 1934 | 7596 | 969 | 323 | 1465 | 3.3(10)-150 | Escherichia coli | b2676 | [pn:ribonucleoside-diphosphate reductase 2 beta chain] [gn:nrdf] |
| CONTIG431 | 2067336_f1_7 | 1935 | 7597 | 1221 | 407 | 1908 | 3.8(10)-197 | Escherichia coli | b2677 | [pn:glycine betaine/l-proline transport atp-binding protein prov] |
| CONTIG431 | 35604561_f1_11 | 1936 | 7598 | 1212 | 404 | 954 | 4.7(10)-96 | Escherichia coli | b2681 | [pn:hypothetical protein] |
| CONTIG431 | 14070762_f3_59 | 1937 | 7599 | 1224 | 408 | 1632 | 6.7(10)-168 | Escherichia coli | b2685 | [pn:multidrg resistance protein a] [gn:emra] |
| CONTIG431 | 113537_f2_25 | 1938 | 7600 | 486 | 162 | 676 | 1.3(10)-66 | Escherichia coli | b2670 | [pn:hypothetical protein] |
| CONTIG431 | 31767930_f2_27 | 1939 | 7601 | 546 | 182 | 633 | 5.0(10)-62 | Escherichia coli | b2674 | [pn:hypothetical protein] [gn:nrdi] |
| CONTIG431 | 36004152_f2_31 | 1940 | 7602 | 1083 | 361 | 1416 | 5.2(10)-145 | Escherichia coli | b2678 | [pn:glycine betaine/l-proline transport system permease protein p] [gn:prow] |
| CONTIG431 | 5194693_f2_32 | 1941 | 7603 | 1005 | 335 | 1470 | 1.0(10)-150 | Escherichia coli | b2679 | [pn:glycine betaine-binding periplasmic protein precursor] [gn:prox] |
| CONTIG431 | 13007717_f2_34 | 1942 | 7604 | 1581 | 527 | 2347 | 1.2(10)-243 | Escherichia coli | b2686 | [pn:multidrg resistance protein b] [gn:emrb] |
| CONTIG431 | 22383582_f3_45 | 1943 | 7605 | 354 | 118 | 278 | 2.1(10)-24 | Escherichia coli | b2672 | [pn:hypothetical protein] [gn:ygam] |
| CONTIG431 | 32461077_f3_46 | 1944 | 7606 | 255 | 85 | 325 | 2.2(10)-29 | Escherichia coli | b2677 | [pn:hypothetical protein] [gn:ygam] |
| CONTIG431 | 35166511_f3_57 | 1945 | 7607 | 627 | 209 | 872 | 2.3(10)-87 | Escherichia coli | b2684 | [pn:transcriptional repressor mpra] [gn:mpra] |
| CONTIG431 | 14070762_f3_59 | 1946 | 7608 | 1695 | 565 | 1454 | 5.0(10)-149 | Saccharomyces cerevisiae | YNL104C | [pn:2-isopropylmalalate synthase] [gn:leu4] |
| CONTIG431 | 26046955_c1_66 | 1947 | 7609 | 435 | 145 | 559 | 3.5(10)-54 | Escherichia coli | b2690 | [pn:hypothetical protein] |
| CONTIG431 | 35355165_c1_67 | 1948 | 7610 | 462 | 154 | 576 | 5.5(10)-56 | Escherichia coli | b2689 | [pn:hypothetical protein] |
| CONTIG431 | 23681890_c1_69 | 1949 | 7611 | 885 | 295 | 301 | 7.5(10)-27 | Escherichia coli | b1790 | [pn:hypothetical 13.1 kd protein in stpa-nrde intergenic region] [gn:yeac] |
| CONTIG431 | 4117193_c1_89 | 1950 | 7612 | 354 | 118 | 527 | 8.5(10)-51 | Escherichia coli | b2671 | [pn:hypothetical protein] |
| CONTIG432 | 33383307_c2_94 | 1951 | 7613 | 315 | 105 | 297 | 2.0(10)-26 | Escherichia coli | b2690 | [pn:hypothetical protein] |
| CONTIG432 | 12752663_c2_97 | 1952 | 7614 | 519 | 173 | 845 | 1.7(10)-84 | Escherichia coli | b2687 | [pn:hypothetical protein in emrb 3"" region] [gn:gsha] |
| CONTIG432 | 25390686_c3_117 | 1953 | 7615 | 1572 | 524 | 2378 | 6.0(10)-247 | Escherichia coli | b2688 | [pn:glutamate-cysteine ligase] [gn:gsha] |
| CONTIG432 | 24425931_f1_4 | 1954 | 7616 | 357 | 119 | 296 | 2.6(10)-26 | Escherichia coli | b4023 | [pn:hypothetical 10.5 kd protein in pepe-lysc intergenic region] |
| CONTIG432 | 5917286_f2_24 | 1955 | 7617 | 1362 | 454 | 1766 | 4.2(10)-182 | Escherichia coli | b4024 | [pn:lysine-sensitive aspartokinase iii] [gn:lysc] |
| CONTIG432 | 5162807_f2_25 | 1956 | 7618 | 1020 | 340 | 559 | 3.5(10)-54 | Bacillus subtilis | yocS | [pn:hypothetical protein] |
| CONTIG432 | 30198511_f2_37 | 1957 | 7619 | 933 | 311 | 1323 | 3.7(10)-135 | Escherichia coli | b4018 | [pn:acetate operon repressor] [gn:iclr] |
| CONTIG432 | 34663402_f3_48 | 1958 | 7620 | 318 | 106 | 220 | 2.8(10)-18 | Haemophilus influenzae | HI1419 | [pn:hypothetical protein] |
| CONTIG432 | 22692827_f3_49 | 1959 | 7621 | 294 | 98 | 179 | 6.4(10)-14 | Haemophilus influenzae | HI1420 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG432 | 7218818_c1_67 | 1960 | 7622 | 942 | 314 | 1568 | 4.0(10)-161 | Escherichia coli | b4013 | [pn:homoserine o-succinyltransferase] [gn:meta] |
| CONTIG432 | 17051906_c1_71 | 1961 | 7623 | 1365 | 455 | 2134 | 4.4(10)-221 | Escherichia coli | b4015 | [pn:isocitrate lyase] [gn:acea] |
| CONTIG432 | 12203130_c1_72 | 1962 | 7624 | 1803 | 601 | 2698 | 7.5(10)-281 | Escherichia coli | b4016 | [pn:isocitrate dehydrogenase kinase/phosphatase] [gn:acek] |
| CONTIG432 | 36415708_c1_75 | 1963 | 7625 | 3702 | 1234 | 5941 | 0 | Escherichia coli | b4019 | [pn:b12-dependent homocysteine-n5-methyltetrahydrofolate transmethylase] [gn:meth] |
| CONTIG432 | 2207187_c1_78 | 1964 | 7626 | 954 | 318 | 1276 | 3.6(10)-130 | Escherichia coli | b4022 | [pn:hypothetical 32.5 kd protein in pepe-lysc intergenic region] |
| CONTIG432 | 13708462_c2_87 | 1965 | 7627 | 225 | 75 | 124 | 5.2(10)-7 | Escherichia coli | M18974 | or:escherichia coli gn:acek le:472 re:2205 di:direct sr:e. coli (strain k12) dna nt:isocitrate dehydrogenase kinase/phosphatase |
| CONTIG432 | 86625_c3_104 | 1966 | 7628 | 1629 | 543 | 2464 | 4.7(10)-256 | Escherichia coli | b4014 | [pn:malate synthase a] [gn:aceb] |
| CONTIG432 | 12993443_c3_113 | 1967 | 7629 | 1647 | 549 | 2060 | 3.0(10)-213 | Escherichia coli | b4020 | [pn:hypothetical 59.5 kd protein in meth-pepe intergenic region] [gn:yjbb] |
| CONTIG433 | 783_f1_7 | 1968 | 7630 | 432 | 144 | 631 | 8.0(10)-62 | Escherichia coli | b3167 | [pn:ribosome-binding factor a] [gn:rbfa] |
| CONTIG433 | 14901591_f1_9 | 1969 | 7631 | 525 | 175 | 413 | 1.0(10)-38 | Escherichia coli | b3165 | [pn:30s ribosomal subunit protein s15] [gn:rpso] |
| CONTIG433 | 33364211_f1_20 | 1970 | 7632 | 555 | 185 | 762 | 1.1(10)-75 | Escherichia coli | b3157 | [pn:hypothetical 19.7 kd protein in soha-mtr intergenic region] [gn:yhbt] |
| CONTIG433 | 13677326_f1_28 | 1971 | 7633 | 492 | 164 | 740 | 2.2(10)-73 | Escherichia coli | b3170 | [pn:hypothetical 16.8 kd protein in musa-mety intergenic region] [gn:yhbc] |
| CONTIG433 | 32694807_f2_34 | 1972 | 7634 | 1011 | 337 | 1485 | 2.6(10)-152 | Escherichia coli | b3163 | [pn:hypothetical 16.8 kd protein in musa-mety intergenic region] [gn:yhbm] |
| CONTIG433 | 13129803_f2_35 | 1973 | 7635 | 1935 | 645 | 2085 | 3.2(10)-256 | Escherichia coli | b3162 | [pn:dead] [gn:dead] |
| CONTIG433 | 35656427_f2_42 | 1974 | 7636 | 723 | 241 | 867 | 8.0(10)-87 | Escherichia coli | b3152 | [pn:hypothetical 24.8 kd protein in agai-mtr intergenic region] [gn:yrar] |
| CONTIG433 | 13086018_f3_47 | 1975 | 7637 | 1518 | 506 | 2280 | 1.5(10)-236 | Escherichia coli | b3169 | [pn:nnn utilization substance protein a] [gn:nusa] |
| CONTIG433 | 36069132_f3_48 | 1976 | 7638 | 2709 | 903 | 2853 | 0 | Escherichia coli | b3168 | [pn:protein chain initiation factor 2] [gn:infb] |
| CONTIG433 | 32317906_f3_49 | 1977 | 7639 | 978 | 326 | 1389 | 3.8(10)-142 | Escherichia coli | b3166 | [pn:trna pseudouridine 55 synthase] [gn:trub] |
| CONTIG433 | 30367705_f3_50 | 1978 | 7640 | 2220 | 740 | 3047 | 0 | Escherichia coli | b3164 | [pn:polynucleotide phosphorylase] [gn:pnp] |
| CONTIG433 | 16833293_f3_55 | 1979 | 7641 | 1251 | 417 | 1821 | 6.44(10)-188 | Escherichia coli | b3161 | [pn:tryptophan-specific permease] [gn:mtr] |
| CONTIG433 | 5103407_f3_60 | 1980 | 7642 | 507 | 169 | 753 | 9.5(10)-75 | Escherichia coli | b3156 | [pn:hypothetical protein] [gn:yhbs] |
| CONTIG433 | 24742838_f3_61 | 1981 | 7643 | 447 | 149 | 607 | 2.7(10)-59 | Escherichia coli | b3154 | [pn:hypothetical 16.8 kd protein in soha-mtr intergenic region] |
| CONTIG433 | 36422036_f3_64 | 1982 | 7644 | 738 | 246 | 757 | 3.6(10)-75 | Escherichia coli | b3151 | [pn:hypothetical 37.3 kd protein in soha-mtr intergenic region] [gn:yraq] |
| CONTIG433 | 6745840_c1_68 | 1983 | 7645 | 363 | 121 | 349 | 6.2(10)-32 | Escherichia coli | b3155 | [pn:hypothetical 11.3 kd protein in soha-mtr intergenic region] |
| CONTIG433 | 22902158_c1_72 | 1984 | 7646 | 1038 | 346 | 1437 | 3.2(10)-147 | Escherichia coli | b3159 | [pn:hypothetical 33.2 kd protein in soha-mtr intergenic region] |
| CONTIG433 | 14875383_c1_73 | 1985 | 7647 | 1014 | 338 | 1451 | 1.0(10)-148 | Escherichia coli | b3160 | [pn:hypothetical 37.1 kd protein in soha-mtr intergenic region] [gn:yhbw] |
| CONTIG433 | 7071032_c2_91 | 1986 | 7648 | 456 | 152 | 98 | 0.00479 | Caenorhabditis elegans | Z93395 | [de:caenorhabditis elegans cosmid zc101, complete sequence] [pn:zc101_1] [nt:similar to low-density lipoprotein receptor] |
| CONTIG434 | 24023542_c2_92 | 1987 | 7649 | 540 | 180 | 794 | 4.2(10)-79 | Escherichia coli | b3153 | [pn:hypothetical 20.3 kd protein in soha-mtr intergenic region] |
| CONTIG434 | 12001058_c2_128 | 1988 | 7650 | 1125 | 375 | 1780 | 1.3(10)-183 | Escherichia coli | b3172 | [pn:argininosuccinate synthetase] [gn:argg] |
| CONTIG434 | 3337752_c3_133 | 1989 | 7651 | 999 | 333 | 1494 | 2.8(10)-153 | Escherichia coli | b3158 | [pn:putative protease in soha-mtr intergenic region] [gn:yhbu] |
| CONTIG434 | 21675430_c3_166 | 1990 | 7652 | 321 | 107 | 406 | 5.7(10)-38 | Escherichia coli | b3172 | [pn:argininosuccinate synthetase] [gn:argg] |
| CONTIG434 | 16053507_f1_2 | 1991 | 7653 | 474 | 158 | 481 | 6.4(10)-46 | Escherichia coli | b1104 | [pn:hypothetical protein] |
| CONTIG434 | 4876342_f1_9 | 1992 | 7654 | 270 | 90 | 314 | 3.2(10)-28 | Escherichia coli | b1112 | [pn:hypothetical protein] |
| CONTIG434 | 25520382_f1_20 | 1993 | 7655 | 1269 | 423 | 1490 | 7.5(10)-153 | Escherichia coli | b1118 | [pn:hypothetical protein] |
| CONTIG434 | 35330125_f1_21 | 1994 | 7656 | 966 | 322 | 1287 | 2.5(10)-131 | Escherichia coli | b1119 | [pn:hypothetical protein] [gn:ycfx] |
| CONTIG434 | 23478157_f2_28 | 1995 | 7657 | 651 | 217 | 757 | 3.6(10)-75 | Escherichia coli | b1105 | [pn:hypothetical protein] |
| CONTIG434 | 11072040_f2_29 | 1996 | 7658 | 1068 | 356 | 1580 | 2.2(10)-162 | Escherichia coli | b1107 | [pn:hypothetical protein] |
| CONTIG434 | 7323500_f2_30 | 1997 | 7659 | 1320 | 440 | 1937 | 3.2(10)-200 | Escherichia coli | b1109 | [pn:nadh dehydrogenase] [gn:ndh] |
| CONTIG434 | 640966_f2_40 | 1998 | 7660 | 1944 | 648 | 1372 | 2.3(10)-140 | Escherichia coli | b1116 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG434 | 7226712_f3_49 | 1999 | 7661 | 372 | 124 | 584 | 7.7(10)-57 | Escherichia coli | b1103 | [pn:hypothetical protein in fhue-ndh intergenic region] [gn:ycfJ] |
| CONTIG434 | 33605040_f3_52 | 2000 | 7662 | 864 | 288 | 879 | 4.2(10)-88 | Escherichia coli | b1106 | [pn:hypothetical protein] |
| CONTIG434 | 15049141_f3_53 | 2001 | 7663 | 555 | 185 | 938 | 2.3(10)-94 | Escherichia coli | b1108 | [pn:hypothetical protein] |
| CONTIG434 | 421905_f3_55 | 2002 | 7664 | 612 | 204 | 697 | 8.1(10)-69 | Escherichia coli | b1110 | [pn:hypothetical 18.9 kd protein in ndh-mfd intergenic region] [gn:ycfJ] |
| CONTIG434 | 14973833_f3_63 | 2003 | 7665 | 900 | 300 | 1044 | 1.3(10)-105 | Escherichia coli | b1120 | [pn:hypothetical protein] |
| CONTIG434 | 29329666_f3_70 | 2004 | 7666 | 279 | 93 | 251 | 3.0(10)-21 | Escherichia coli | b1127 | [pn:peptidase t] [gn:pept] |
| CONTIG434 | 10195287_c1_74 | 2005 | 7667 | 1059 | 353 | 1637 | 2.0(10)-168 | Escherichia coli | b1123 | [pn:spermidine/putrescine-binding periplasmic protein precursor] [gn:potd] |
| CONTIG434 | 1195910_c1_84 | 2006 | 7668 | 1155 | 385 | 1221 | 2.3(10)-124 | Escherichia coli | b1115 | [pn:hypothetical protein] |
| CONTIG434 | 12362887_c2_99 | 2007 | 7669 | 1212 | 404 | 1650 | 8.5(10)-170 | Escherichia coli | b1126 | [pn:spermidine/putrescine transport atp-binding protein pota] [gn:pota] |
| CONTIG434 | 16689813_c2_101 | 2008 | 7670 | 807 | 269 | 943 | 7.0(10)-95 | Escherichia coli | b1124 | [pn:spermidine/putrescine transport system permease protein potc] [gn:potc] |
| CONTIG434 | 6485817_c2_108 | 2009 | 7671 | 3513 | 1171 | 5326 | 0 | Escherichia coli | b1114 | [pn:transcription-repair coupling factor] [gn:mfd] |
| CONTIG434 | 14460050_c2_109 | 2010 | 7672 | 1020 | 340 | 1377 | 7.2(10)-141 | Escherichia coli | b1113 | [pn:hypothetical protein] |
| CONTIG434 | 34657312_c3_120 | 2011 | 7673 | 882 | 294 | 1258 | 2.8(10)-128 | Escherichia coli | b1125 | [pn:spermidine/putrescine transport system permease protein potb] [gn:potb] |
| CONTIG435 | 24018801_c3_140 | 2012 | 7674 | 669 | 223 | 875 | 1.1(10)-87 | Escherichia coli | b1111 | [pn:hypothetical protein] |
| CONTIG435 | 21174136_f2_3 | 2013 | 7675 | 846 | 282 | 205 | 1.1(10)-16 | Bacillus subtilis | yloO | [pn:hypothetical protein] |
| CONTIG435 | 5214541_f1_9 | 2014 | 7676 | 2742 | 914 | 1145 | 2.7(10)-116 | Escherichia coli | b2592 | [pn:clpb protein] [gn:clpb] |
| CONTIG435 | 26681587_f1_10 | 2015 | 7677 | 1437 | 479 | 159 | 4.0(10)-8 | Saccharomyces cerevisiae | YOL045W | [pn:similarity to ser/thr protein kinase] |
| CONTIG435 | 25782568_f1_12 | 2016 | 7678 | 789 | 263 | 139 | 9.4(10)-8 | Serratia liquefaciens | P18954 | phlb protein precursor. |
| CONTIG435 | 3203567_f1_14 | 2017 | 7679 | 1194 | 398 | 223 | 1.6(10)-15 | Escherichia coli | AF044503 | [de:escherichia coli strain ec11 unknown (498), hcp gene, complete cds; and rhsg accessory genetic element vgrg protein, core component anddsorf-g1 genes, complete cds] [pn:vgrg protein] |
| CONTIG435 | 22832555_f2_15 | 2018 | 7680 | 1797 | 599 | 96 | 0.04399 | Bos taurus | U92535 | neuronal axonal membrane protein,,,nap-22 homolog |
| CONTIG436 | 16588251_f3_48 | 2019 | 7681 | 453 | 151 | 326 | 1.7(10)-29 | Escherichia coli | b2055 | [pn:hypothetical protein] [gn:wcae] |
| CONTIG436 | 292882_f2_49 | 2020 | 7682 | 1164 | 388 | 353 | 2.2(10)-32 | Azorhizobium caulinodans | S52856 | arac-like protein - azorhizobium caulinodans |
| CONTIG436 | 95380_f2_50 | 2021 | 7683 | 1089 | 363 | 955 | 3.7(10)-96 | Bacillus subtilis | gap | [pn:glyceraldehyde-3-phosphate dehydrogenase] |
| CONTIG436 | 11198311_f2_51 | 2022 | 7684 | 1725 | 575 | 2264 | 7.2(10)-235 | Escherichia coli | b1197 | [pn:periplasmic trehalase precursor] [gn:trea] |
| CONTIG436 | 29383457_c1_83 | 2023 | 7685 | 1725 | 575 | 391 | 2.8(10)-63 | Escherichia coli | b0150 | [pn:ferrichrome-iron receptor precursor] [gn:fhua] |
| CONTIG436 | 36035686_c1_93 | 2024 | 7686 | 3666 | 1222 | 170 | 3.3(10)-21 | Legionella pneumophila | Y15044 | [de:legionella pneumophila 22kd dna fragment from icm gene cluster,] [pn:icmf protein] [gn:icmf] |
| CONTIG436 | 14511687_c2_100 | 2025 | 7687 | 270 | 90 | 103 | 0.00012 | Escherichia coli | b0150 | [pn:ferrichrome-iron receptor precursor] [gn:fhua] |
| CONTIG436 | 4957906_c2_110 | 2026 | 7688 | 1269 | 423 | 165 | 4.2(10)-10 | Bacillus subtilis | motB | [pn:motility protein b] [gn:mot] |
| CONTIG437 | 24870905_f1_1 | 2027 | 7689 | 1032 | 344 | 766 | 4.0(10)-76 | Escherichia coli | b3826 | [pn:yigl] |
| CONTIG437 | 10995841_f1_11 | 2028 | 7690 | 660 | 220 | 828 | 1.1(10)-82 | Escherichia coli | b3834 | [pn:hypothetical 22.3 kd protein in udp-rfah intergenic region] [gn:yign] |
| CONTIG437 | 19956550_f1_15 | 2029 | 7691 | 282 | 94 | 288 | 1.8(10)-25 | Escherichia coli | b3836 | [pn:hypothetical 11.3 kd protein in udp-rfah intergenic region] |
| CONTIG437 | 25791025_f1_16 | 2030 | 7692 | 546 | 182 | 472 | 5.7(10)-45 | Escherichia coli | b3838 | [pn:hypothetical 15.6 kd protein in udp-rfah intergenic region] |
| CONTIG437 | 2112687_f1_22 | 2031 | 7693 | 520 | 174 | 686 | 1.2(10)-67 | Escherichia coli | b3554 | [pn:hypothetical 30.2 kd protein in bisc-cspa intergenic region] [gn:yiaf] |
| CONTIG437 | 4569713_f2_23 | 2032 | 7694 | 912 | 304 | 1307 | 1.8(10)-133 | Escherichia coli | b3827 | [pn:hypothetical 33.7 kd protein in pldb-metr intergenic region] [gn:yigm] |
| CONTIG437 | 197802_f2_25 | 2033 | 7695 | 2289 | 763 | 3781 | 0 | Escherichia coli | b3829 | [pn:5-methyltetrahydropteroyltriglutamate-homocysteine methyltransferase] [gn:mete] |
| CONTIG437 | 50892_f2_28 | 2034 | 7696 | 810 | 270 | 1241 | 1.8(10)-126 | Escherichia coli | b3831 | [pn:uridine phosphorylase] [gn:udp] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG437 | 12694067_f2_32 | 2035 | 7697 | 831 | 277 | 758 | 2.7(10)-75 | Escherichia coli | b3840 | [pn:yigw] |
| CONTIG437 | 33751042_f2_33 | 2036 | 7698 | 1515 | 505 | 2515 | 1.8(10)-261 | Escherichia coli | b3843 | [pn:hypothetical 55.3 kd protein in rfah-rfe intergenic region] [gn:yigc] |
| CONTIG437 | 22519382_f2_34 | 2037 | 7699 | 723 | 241 | 1083 | 1.0(10)-109 | Escherichia coli | b3844 | [pn:flavin reductase] [gn:ubiB] |
| CONTIG437 | 3601700_f2_35 | 2038 | 7700 | 1638 | 546 | 654 | 3.0(10)-64 | Streptomyces lincolnensis | S69834 | , |
| CONTIG437 | 3229836_c1_65 | 2039 | 7701 | 228 | 76 | 334 | 2.3(10)-30 | Escherichia coli | b3825 | [pn:lysophospholipase l2] [gn:pldb] |
| CONTIG437 | 25595458_f3_37 | 2040 | 7702 | 1602 | 534 | 2022 | 3.2(10)-209 | Escherichia coli | b3832 | [pn:hypothetical 54.7 kd protein in udp 3"" region precursor] [gn:yign] |
| CONTIG437 | 10444800_f3_48 | 2041 | 7703 | 771 | 257 | 1228 | 4.4(10)-125 | Escherichia coli | b3833 | [pn:hypothetical 28.1 kd protein in udp-rfah intergenic region] [gn:yigo] |
| CONTIG437 | 22062915_f3_49 | 2042 | 7704 | 1677 | 559 | 2532 | 2.8(10)-263 | Escherichia coli | b3835 | [pn:hypothetical 63.2 kd protein in udp-rfah intergenic region] [gn:yigh] |
| CONTIG437 | 4491042_f3_50 | 2043 | 7705 | 780 | 260 | 1000 | 6.4(10)-101 | Escherichia coli | b3839 | [pn:hypothetical 29.0 kd protein in udp-rfah intergenic region] [gn:yigi] |
| CONTIG437 | 6102030_c1_58 | 2044 | 7706 | 318 | 106 | 310 | 8.4(10)-28 | Escherichia coli | b3555 | [pn:hypothetical 11.0 kd protein in bisc-cspa intergenic region] |
| CONTIG437 | 2212816_c1_65 | 2045 | 7707 | 546 | 182 | 678 | 8.5(10)-67 | Escherichia coli | b3842 | [pn:transcriptional activator] [gn:rfaH] |
| CONTIG437 | 1971006_c1_79 | 2046 | 7708 | 861 | 287 | 850 | 5.0(10)-85 | Escherichia coli | b3830 | [pn:hypothetical protein] |
| CONTIG437 | 16830043_c2_110 | 2047 | 7709 | 444 | 148 | 157 | 4.9(10)-11 | Escherichia coli | b3830 | [pn:hypothetical protein] |
| CONTIG437 | 4297842_c2_114 | 2048 | 7710 | 963 | 321 | 1466 | 2.7(10)-150 | Escherichia coli | b3828 | [pn:trans-activator of metE and methJ] [gn:metr] |
| CONTIG437 | 12601687_f1_3 | 2049 | 7711 | 1506 | 502 | 566 | 6.2(10)-55 | Bacillus subtilis | yhdI | [pn:hypothetical protein] |
| CONTIG437 | 3220459_f1_13 | 2050 | 7712 | 666 | 222 | 750 | 2.0(10)-74 | Escherichia coli | b0464 | [pn:potential acrab operon repressor] [gn:acrr] |
| CONTIG437 | 13719682_f1_18 | 2051 | 7713 | 618 | 206 | 889 | 3.7(10)-89 | Escherichia coli | b0469 | [pn:adenine phosphoribosyltransferase] [gn:apt] |
| CONTIG437 | 34257891_f1_20 | 2052 | 7714 | 354 | 118 | 324 | 2.7(10)-29 | Escherichia coli | b0471 | [pn:hypothetical 12.0 kd protein in dnaX-recr intergenic region] [gn:bab] |
| CONTIG438 | 11816261_f2_52 | 2053 | 7715 | 1974 | 658 | 2630 | 1.2(10)-273 | Escherichia coli | b0470 | [pn:dna polymerase iii subunits gamma and tau] [gn:dnax] |
| CONTIG438 | 22554702_f2_54 | 2054 | 7716 | 1875 | 625 | 2946 | 0 | Escherichia coli | b0473 | [pn:heat shock protein htpg] [gn:htpg] |
| CONTIG438 | 10750312_f2_55 | 2055 | 7717 | 678 | 226 | 1060 | 2.7(10)-107 | Escherichia coli | b0474 | [pn:adenylate kinase] [gn:adk] |
| CONTIG438 | 22517057_f2_57 | 2056 | 7718 | 1410 | 470 | 2087 | 4.2(10)-216 | Escherichia coli | b0477 | [pn:inosine-guanosine kinase] [gn:gsk] |
| CONTIG438 | 12210058_f3_78 | 2057 | 7719 | 3483 | 1161 | 3978 | 0 | Escherichia coli | b0465 | [pn:hypothetical protein] [gn:aefa] |
| CONTIG438 | 268831_f3_79 | 2058 | 7720 | 405 | 135 | 359 | 5.4(10)-33 | Escherichia coli | b0468 | [pn:hypothetical 14.8 kd protein in pric-apt intergenic region] [gn:ybaa] |
| CONTIG438 | 1988513_f3_82 | 2059 | 7721 | 618 | 206 | 906 | 5.9(10)-91 | Escherichia coli | b0472 | [pb:recombination protein recr] [gn:recr] |
| CONTIG438 | 16970952_f3_86 | 2060 | 7722 | 963 | 321 | 1377 | 7.2(10)-141 | Escherichia coli | b0475 | [pn:ferrochelatase] [gn:hemh] |
| CONTIG438 | 16604206_f3_87 | 2061 | 7723 | 270 | 90 | 109 | 8.3(10)-6 | Escherichia coli | JU0314 | hypothetical 34.6k protein (visa 3 region)-escherichia coli |
| CONTIG438 | 3636577_f3_89 | 2062 | 7724 | 792 | 264 | 115 | 0.0014 | Saccharomyces cerevisiae | YIR019C | [pn:extracellular alpha-1,4-glucan glucosidase] [gn:sta1] |
| CONTIG438 | 20369535_c1_96 | 2063 | 7725 | 312 | 104 | 90 | 0.0011 | Homo sapiens | P29966 | myristoylated alanine-rich c-kinase substrate (marcks) (protein kinase c substrate, 80 kd protein light chain) (pkcsl) (80k-1 protein). |
| CONTIG438 | 29901058_c1_103 | 2064 | 7726 | 519 | 173 | 277 | 2.6(10)-24 | Escherichia coli | U82664 | or:escherichia coli le:73500 re:73877 di:complement nt:hypothetical |
| CONTIG438 | 110457_c1_109 | 2065 | 7727 | 555 | 185 | 486 | 1.8(10)-46 | Escherichia coli | b0467 | [pn:primosomal replication protein n] [gn:pric] |
| CONTIG438 | 3229836_c1_110 | 2066 | 7728 | 189 | 63 | 168 | 9.4(10)-13 | Escherichia coli | b0466 | [pn:hypothetical 6.0 kd protein in acrr-pric intergenic region] |
| CONTIG438 | 33815510_c1_116 | 2067 | 7729 | 1266 | 422 | 1539 | 4.9(10)-158 | Escherichia coli | b0463 | [pn:acriflavin resistance protein a precursor] [gn:acra] |
| CONTIG438 | 5085917_c1_120 | 2068 | 7730 | 201 | 67 | 103 | 7.2(10)-6 | Escherichia coli | U82664 | or:escherichia coli pn:hha protein gn:hha le:59538 re:59957 di:complement |
| CONTIG438 | 33673537_c1_121 | 2069 | 7731 | 573 | 191 | 761 | 1.3(10)-75 | Escherichia coli | b0459 | [pn:hypothetical protein] [gn:ylad] |
| CONTIG438 | 20100019_c2_126 | 2070 | 7732 | 278 | 92 | 277 | 2.6(10)-24 | Escherichia coli | b0479 | [pn:fosmidomycin resistance protein] [gn:fsr] |
| CONTIG438 | 23540913_c2_159 | 2071 | 7733 | 3114 | 1038 | 4072 | 0 | Escherichia coli | b0462 | [pn:acriflavin resistance protein b] [gn:acrb] |
| CONTIG438 | 31437757_c3_164 | 2072 | 7734 | 1740 | 580 | 2165 | 2.2(10)-224 | Escherichia coli | b0478 | [pn:hypothetical protein in gsk 3"" region] [gn:yba1] |
| CONTIG438 | 34431890_c3_188 | 2073 | 7735 | 414 | 138 | 633 | 5.0(10)-62 | Escherichia coli | b0461 | [pn:hypothetical 14.6 kd protein in hha-acrb intergenic region] [gn:ybaj] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG438 | 3914143_c3_189 | 2074 | 7736 | 228 | 76 | 357 | 8.8(10)-33 | Escherichia coli | b0460 | [pn:haemolysin expression modulating protein [gn:hha] |
| CONTIG438 | 4882717_c3_190 | 2075 | 7737 | 477 | 159 | 510 | 5.4(10)-49 | Escherichia coli | b0458 | [pn:hypothetical protein] [gn:ylac] |
| CONTIG438 | 2164755_c3_194 | 2076 | 7738 | 744 | 248 | 635 | 3.1(10)-62 | Saccharomyces cerevisiae | P40586 | hypothetical 27.4 kd protein in hyr1 3'' region] |
| CONTIG438 | 22395066_f1_2 | 2077 | 7739 | 798 | 266 | 1095 | 5.5(10)-111 | Escherichia coli | b0763 | [pn:24aa signal peptide] [gn:moda] |
| CONTIG438 | 836680_f1_7 | 2078 | 7740 | 1008 | 336 | 1444 | 5.7(10)-148 | Escherichia coli | b0767 | [pn:hypothetical 36.3 kd protein in modc-bioa intergenic region] [gn:ybhe] |
| CONTIG439 | 22297577_f1_11 | 2079 | 7741 | 1257 | 419 | 730 | 2.6(10)-72 | Bacillus subtilis | hutI | [pn:imidazolonepropionase] [gn:ee57b] |
| CONTIG439 | 10599075_f1_13 | 2080 | 7742 | 888 | 296 | 510 | 1.2(10)-99 | Klebsiella aerogenes | P12380 | histidine utilization repressor. |
| CONTIG439 | 34161325_f1_15 | 2081 | 7743 | 1581 | 527 | 1849 | 6.9(10)-191 | Pseudomonas putida | A35251 | histidine ammonia-lyase (ec:4.3.1.3) - pseudomonas putida |
| CONTIG439 | 31820791_f1_19 | 2082 | 7744 | 1194 | 398 | 1163 | 3.3(10)-118 | Escherichia coli | b0776 | [pn:8-amino-7-oxononanoate synthase] [gn:bioF] |
| CONTIG439 | 26845457_f2_29 | 2083 | 7745 | 1077 | 359 | 1508 | 9.5(10)-155 | Escherichia coli | b0765 | [pn:molybdenum transport atp-binding protein modc] [gn:modc] |
| CONTIG439 | 32441655_f2_30 | 2084 | 7746 | 354 | 118 | 202 | 2.2(10)-16 | Escherichia coli | U27192 | or:escherichia coli pn:modd gn:modd le:5360 re:6055 di:direct |
| CONTIG439 | 29389902_f2_36 | 2085 | 7747 | 1761 | 587 | 1861 | 3.7(10)-192 | Escherichia coli | hutU | [pn:urocanate hydratase] [gn:ee57a] |
| CONTIG439 | 14945407_f2_46 | 2086 | 7748 | 1080 | 360 | 1602 | 1.0(10)-164 | Bacillus subtilis | b0775 | [pn:biotin synthetase] [gn:biob] |
| CONTIG439 | 22913166_f2_49 | 2087 | 7749 | 810 | 270 | 741 | 1.8(10)-73 | Escherichia coli | b0777 | [pn:biotin synthesis protein bioc] [gn:bioc] |
| CONTIG439 | 5334457_f3_56 | 2088 | 7750 | 717 | 239 | 713 | 1.7(10)-70 | Escherichia coli | b0764 | [pn:molybdenum transport system permease protein modb] [gn:modb] |
| CONTIG439 | 5164052_f3_59 | 2089 | 7751 | 270 | 90 | 159 | 8.4(10)-12 | Escherichia coli | D90715 | or:escherichia coli pn:putative molybdenum transport protein modd gn:modd le:4270 re:4410 di:direct sr:escherichia coli (strain:k12) dna, clone:kohara clone #180 |
| CONTIG439 | 32033513_f3_63 | 2090 | 7752 | 999 | 333 | 643 | 4.2(10)-63 | Klebsiella aerogenes | P19452 | formiminoglutamase (ec 3.5.3.8) (formiminoglutamate hydrolase) (histidine utilization protein g) (fragment). |
| CONTIG440 | 14320833_f3_76 | 2091 | 7753 | 837 | 279 | 858 | 7.2(10)-86 | Escherichia coli | b0778 | [pn:dethiobiotin synthetase] [gn:biod] |
| CONTIG440 | 12582512_f3_77 | 2092 | 7754 | 351 | 117 | 364 | 8.5(10)-33 | Escherichia coli | b0779 | [pn:excision nuclease abc subunit b] [gn:uvrb] |
| CONTIG440 | 23531503_c1_78 | 2093 | 7755 | 828 | 276 | 275 | 4.2(10)-24 | Escherichia coli | b3454 | [pn:high-affinity branched-chain amino acid transport atp-binding] [gn:livf] |
| CONTIG440 | 25970953_c1_87 | 2094 | 7756 | 498 | 166 | 705 | 1.2(10)-69 | Escherichia coli | b0773 | [pn:hypothetical 17.1 kd protein in bioa 5'''' region] [gn:ybhb] |
| CONTIG440 | 2945417_c1_101 | 2095 | 7757 | 1137 | 379 | 1440 | 1.5(10)-147 | Escherichia coli | b0772 | [pn:hypothetical protein in bioa 5'''' region] [gn:ybhc] |
| CONTIG440 | 31306950_c2_119 | 2096 | 7758 | 1350 | 450 | 1866 | 1.1(10)-192 | Escherichia coli | b0774 | [pn:adenosylmethionine-8-amino-7-oxononanoate aminotransferase] [gn:bioa] |
| CONTIG440 | 16601510_c2_135 | 2097 | 7759 | 501 | 167 | 258 | 6.2(10)-22 | Escherichia coli | b0772 | [pn:hypothetical protein in bioa 5'''' region] [gn:ybhc] |
| CONTIG440 | 31694127_c3_162 | 2098 | 7760 | 903 | 301 | 1093 | 9.0(10)-111 | Escherichia coli | b0766 | [pn:hypothetical 30.2 kd protein in modc-bioa intergenic region] [gn:ybhc] |
| CONTIG440 | 29432965_f3_3 | 2099 | 7761 | 555 | 185 | 220 | 2.7(10)-17 | Escherichia coli | b3966 | [pn:vitamin b12 receptor precursor] [gn:btub] |
| CONTIG440 | 29298500_f1_1 | 2100 | 7762 | 258 | 86 | 400 | 2.3(10)-37 | Escherichia coli | b3637 | [pn:50s ribosomal subunit protein 128] [gn:rpmb] |
| CONTIG440 | 24484713_f1_28 | 2101 | 7763 | 775 | 259 | 257 | 5.0(10)-22 | Haemophilus influenzae | HI0653 | [pn:pir] |
| CONTIG440 | 23633567_f3_46 | 2102 | 7764 | 183 | 61 | 246 | 5.0(10)-21 | Escherichia coli | b3636 | [pn:50s ribosomal subunit protein 133] [gn:rpmg] |
| CONTIG440 | 4141380_f3_47 | 2103 | 7765 | 876 | 292 | 1324 | 3.0(10)-135 | Escherichia coli | b3635 | [pn:formamidopyrimidine-dna glycosylase] [gn:mutm] |
| CONTIG440 | 31525267_f3_67 | 2104 | 7766 | 1395 | 465 | 1853 | 2.6(10)-191 | Escherichia coli | b3617 | [pn:2-amino-3-ketobutyrate coenzyme a ligase] [gn:kbl] |
| CONTIG440 | 51277068_f3_68 | 2105 | 7767 | 1038 | 346 | 1563 | 1.3(10)-160 | Escherichia coli | b3616 | [pn:threonine 3-dehydrogenase] [gn:tdh] |
| CONTIG440 | 31901006_c1_81 | 2106 | 7768 | 1137 | 379 | 1636 | 2.6(10)-168 | Escherichia coli | b3620 | [pn:adp-heptose--lps heptosyltransferase ii] [gn:rfaf] |
| CONTIG440 | 7290966_c1_82 | 2107 | 7769 | 987 | 329 | 1267 | 3.2(10)-129 | Escherichia coli | b3621 | [pn:lipopolysaccharide heptosyltransferase-1] [gn:rfac] |
| CONTIG440 | 19806531_c1_83 | 2108 | 7770 | 1113 | 371 | 164 | 1.3(10)-9 | Helicobacter pylori | HP1191 | [pn:adp-heptose--lps heptosyltransferase iii] [gn:rfaf] |
| CONTIG440 | 25910910_c1_92 | 2109 | 7771 | 1086 | 362 | 716 | 8.0(10)-71 | Escherichia coli | b3632 | [pn:lipopolysaccharide core biosynthesis protein rfaq] [gn:rfaq] |
| CONTIG440 | 12892041_c1_95 | 2110 | 7772 | 1047 | 349 | 606 | 3.6(10)-59 | Escherichia coli | b3615 | [pn:hypothetical 40.5 kd protein in sccb-tdh 5'''' region] [gn:yibd] |
| CONTIG440 | 16893762_c1_96 | 2111 | 7773 | 1311 | 437 | 1727 | 5.9(10)-178 | Escherichia coli | b3633 | [pn:3-deoxy-d-manno-octulosonic-acid transferase] [gn:kdta] |
| CONTIG440 | 9979011_c2_99 | 2112 | 7774 | 1221 | 407 | 198 | 3.2(10)-13 | Methanococcus jannaschii | MJ1059 | [pn:capsular polysaccharide biosynthesis protein m] |
| CONTIG440 | 20603766_c2_103 | 2113 | 7775 | 975 | 325 | 1601 | 1.3(10)-164 | Escherichia coli | b3619 | [pn:adp-l-glycero-d-mannoheptose-6-epimerase] [gn:rfad] |
| CONTIG440 | 26594043_c2_110 | 2114 | 7776 | 1218 | 406 | 219 | 2.2(10)-16 | Escherichia coli | b3622 | [pn:rfaI] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG440 | 23860312_c2_114 | 2115 | 7777 | 1152 | 384 | 192 | 1.3(10)-12 | Methanococcus jannaschii | MJ1059 | [pn:capsular polysaccharide biosynthesis protein m] |
| CONTIG440 | 4691452_c3_124 | 2116 | 7778 | 576 | 192 | 103 | 0.0038 | Homo sapiens | Z34277 | or*homo sapiens* pn:mucin gn:muc5ac le:<1 re:>1431 di:direct |
| CONTIG440 | 32285666_c3_130 | 2117 | 7779 | 930 | 310 | 126 | 1.5(10)-5 | Haemophilus influenzae | HI1578 | [pn:glycosyl transferase] [gn:gtd] |
| CONTIG440 | 2205040_c3_132 | 2118 | 7780 | 1161 | 387 | 224 | 1.8(10)-16 | Escherichia coli | b3631 | [pn:lipopolysaccharide core biosynthesis protein rfag] [gn:rfag] |
| CONTIG440 | 10672642_c3_136 | 2119 | 7781 | 849 | 283 | 637 | 1.8(10)-62 | Haemophilus influenzae | HI0653 | [pn:pir] |
| CONTIG440 | 14337783_c3_137 | 2120 | 7782 | 483 | 161 | 685 | 1.5(10)-67 | Escherichia coli | b3634 | [pn:lipopolysaccharide core biosynthesis protein kdtb] [gn:kdtb] |
| CONTIG441 | 31447255_f1_8 | 2121 | 7783 | 402 | 134 | 280 | 1.3(10)-24 | Escherichia coli | b2824 | [pn:hypothetical 13.5 kd protein in ppdc-ppdb intergenic region] [gn:ygdb] |
| CONTIG441 | 25645890_f1_15 | 2122 | 7784 | 2907 | 969 | 4170 | 0 | Escherichia coli | b2821 | [pn:protease in precursor] [gn:ptr] |
| CONTIG441 | 19585327_f1_22 | 2123 | 7785 | 1338 | 446 | 1912 | 1.5(10)-197 | Escherichia coli | b2817 | [pn:hypothetical protein] |
| CONTIG441 | 33790961_f2_25 | 2124 | 7786 | 879 | 293 | 1386 | 8.0(10)-142 | Escherichia coli | b2828 | [pn:prolipoprotein diacylglyceryl transferase] [gn:lgt] |
| CONTIG441 | 24644068_f2_26 | 2125 | 7787 | 801 | 267 | 1401 | 2.1(10)-143 | Escherichia coli | b2827 | [pn:thymidylate synthetase] [gn:thya] |
| CONTIG441 | 34645790_f2_28 | 2126 | 7788 | 579 | 193 | 495 | 2.1(10)-47 | Escherichia coli | b2825 | [pn:prepilin peptidase dependent protein b precursor] [gn:ppdb] |
| CONTIG441 | 33828506_f2_36 | 2127 | 7789 | 1851 | 617 | 2175 | 2.0(10)-225 | Escherichia coli | b2819 | [pn:exonuclease v alpha-subunit] [gn:recd] |
| CONTIG441 | 477591_f3_40 | 2128 | 7790 | 360 | 120 | 541 | 2.7(10)-52 | Escherichia coli | b2830 | [pn:hypothetical protein] [gn:ygdp] |
| CONTIG441 | 4869633_f3_41 | 2129 | 7791 | 2259 | 753 | 3278 | 0 | Escherichia coli | b2829 | [pn:phosphoenolpyruvate-protein phosphotransferase] [gn:ptsp] |
| CONTIG441 | 281892_f3_46 | 2130 | 7792 | 516 | 172 | 410 | 2.1(10)-38 | Escherichia coli | b2826 | [pn:prepilin peptidase dependent protein a precursor] [gn:ppda] |
| CONTIG441 | 16182818_f3_48 | 2131 | 7793 | 336 | 112 | 239 | 2.7(10)-20 | Escherichia coli | b2823 | [pn:prepilin peptidase dependent protein c precursor] [gn:ppdc] |
| CONTIG441 | 1305455_f3_49 | 2132 | 7794 | 3387 | 1129 | 4626 | 0 | Escherichia coli | b2822 | [pn:exonuclease v subunit] [gn:recc] |
| CONTIG441 | 14883438_f3_51 | 2133 | 7795 | 3549 | 1183 | 4526 | 0 | Escherichia coli | b2820 | [pn:exonuclease v subunit] [gn:recb] |
| CONTIG441 | 23550057_c3_124 | 2134 | 7796 | 1353 | 451 | 2120 | 1.3(10)-219 | Escherichia coli | b2818 | [pn:amino-acid acetyltransferase] [gn:arga] |
| CONTIG441 | 35750680_f1_1 | 2135 | 7797 | 726 | 242 | 1115 | 4.2(10)-113 | Escherichia coli | b2777 | [pn:hypothetical protein] [gn:ygcf] |
| CONTIG442 | 33463508_f1_10 | 2136 | 7798 | 1752 | 584 | 2661 | 6.2(10)-277 | Escherichia coli | b2763 | [pn:nadph hemoprotein alpha subunit] [gn:cysj] |
| CONTIG442 | 7242681_f1_11 | 2137 | 7799 | 750 | 250 | 1236 | 6.2(10)-126 | Escherichia coli | b2762 | [pn:3"",5""-phosphoadenosine 5""-phosphosulfate sulfotransferase] |
| CONTIG442 | 6769537_f1_18 | 2138 | 7800 | 375 | 125 | 403 | 1.2(10)-37 | Escherichia coli | b2748 | [pn:hypothetical protein] |
| CONTIG442 | 25664010_f1_19 | 2139 | 7801 | 558 | 186 | 578 | 3.3(10)-56 | Escherichia coli | b2746 | [pn:hypothetical 16.9 kd protein in sure-cysc intergenic region] [gn:ygb] |
| CONTIG442 | 19806956_f1_20 | 2140 | 7802 | 843 | 281 | 1240 | 2.3(10)-126 | Escherichia coli | b2744 | [pn:stationary-phase survival protein sure] [gn:sure] |
| CONTIG442 | 11760791_f1_21 | 2141 | 7803 | 199 | 67 | 109 | 3.0(10)-6 | Escherichia coli | b2743 | [pn:1-isoaspartyl protein carboxyl methyltransferase type ii] |
| CONTIG442 | 36017966_f2_22 | 2142 | 7804 | 642 | 214 | 274 | 5.5(10)-24 | Escherichia coli | b3223 | [pn:hypothetical protein] [gn:yhcj] |
| CONTIG442 | 14880191_f2_29 | 2143 | 7805 | 1812 | 604 | 2693 | 2.5(10)-280 | Escherichia coli | b2764 | [pn:nadph flavoprotein beta subunit] [gn:cysj] |
| CONTIG442 | 16109558_f2_41 | 2144 | 7806 | 651 | 217 | 876 | 8.9(10)-88 | Escherichia coli | b2750 | [pn:adenosine 5-phosphosulfate kinase] [gn:cysc] |
| CONTIG442 | 17052176_f2_42 | 2145 | 7807 | 810 | 270 | 1063 | 1.3(10)-107 | Escherichia coli | b2747 | [pn:hypothetical protein] [gn:ybgo] |
| CONTIG442 | 17010938_f3_44 | 2146 | 7808 | 273 | 91 | 197 | 5.0(10)-15 | Escherichia coli | b1101 | [pn:pts system, glucoase-specific iibc component] [gn:ptsg] |
| CONTIG442 | 16679668_f3_50 | 2147 | 7809 | 2397 | 799 | 150 | 7.2(10)-7 | Bacillus subtilis | yesS | [pn:hypothetical protein] |
| CONTIG442 | 11753301_f3_57 | 2148 | 7810 | 1443 | 481 | 975 | 5.9(10)-107 | Escherichia coli | b3368 | [pn:siroheme synthase] [gn:cysg] |
| CONTIG442 | 3963443_f3_58 | 2149 | 7811 | 918 | 306 | 1473 | 4.7(10)-151 | Escherichia coli | b2752 | [pn:atp sulfurylase] [gn:cysd] |
| CONTIG442 | 4426068_f3_59 | 2150 | 7812 | 1434 | 478 | 2131 | 9.0(10)-221 | Escherichia coli | b2751 | [pn:atp sulfurylase] [gn:cysn] |
| CONTIG442 | 14119653_f3_61 | 2151 | 7813 | 348 | 116 | 407 | 4.4(10)-38 | Escherichia coli | b2749 | [pn:hypothetical protein in sure-cysc intergenic region] [gn:ybge] |
| CONTIG442 | 16298917_f3_64 | 2152 | 7814 | 1080 | 360 | 1563 | 1.3(10)-160 | Escherichia coli | b2745 | [pn:hypothetical protein] [gn:cysn] |
| CONTIG442 | 35596015_f3_65 | 2153 | 7815 | 363 | 121 | 453 | 5.9(10)-43 | Escherichia coli | b2743 | [pn:1-isoaspartyl protein carboxyl methyltransferase type ii] |
| CONTIG442 | 4018943_c2_107 | 2154 | 7816 | 1053 | 351 | 1448 | 2.2(10)-148 | Escherichia coli | b2753 | [pn:iap] 8 gn:iap] |
| CONTIG442 | 4142201_c2_120 | 2155 | 7817 | 1293 | 431 | 573 | 1.1(10)-55 | Bacillus subtilis | yhaA | [pn:hypothetical protein] |
| CONTIG442 | 9866650_c2_121 | 2156 | 7818 | 1425 | 475 | 271 | 2.2(10)-21 | Bacillus subtilis | mmr | [pn:methylenomycin a resistance protein] |
| CONTIG442 | 400675_c3_148 | 2157 | 7819 | 534 | 178 | 634 | 3.8(10)-62 | Escherichia coli | b2765 | [pn:hypothetical protein] |
| CONTIG443 | 1705011_f1_1 | 2158 | 7820 | 324 | 108 | 555 | 9.1(10)-54 | Plasmid R478 | L38824 | or:plasmid r478 gn:tera le:751 re:1776 di:direct sr:plasmid r478 dna nt:putative |
| CONTIG443 | 3932668_f1_13 | 2159 | 7821 | 306 | 102 | 97 | 3.1(10)-5 | Escherichia coli | b1508 | [pn:hipb protein] [gn:hipb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG443 | 23870438_f1_15 | 2160 | 7822 | 828 | 276 | 93 | 0.065 | Rattus norvegicus | S15674 | cell surface glycoprotein ox47 precursor - rat |
| CONTIG443 | 25567885_f1_18 | 2161 | 7823 | 525 | 175 | 898 | 4.0(10)-90 | Escherichia coli | b0264 | [pn:insertion element is1 protein insb] [gn:insb_2] |
| CONTIG443 | 16914082_f2_23 | 2162 | 7824 | 588 | 196 | 749 | 2.5(10)-74 | Plasmid R478 | L38824 | orplasmid r478 gn:terb le:1799 re:2254 di:direct sr:plasmid r478 dna nt:putative |
| CONTIG443 | 12268751_f2_25 | 2163 | 7825 | 633 | 211 | 429 | 2.1(10)-40 | Bacillus subtilis | yceD | [pn:hypothetical protein] |
| CONTIG443 | 33632805_f2_26 | 2164 | 7826 | 1263 | 421 | 2036 | 1.1(10)-210 | Plasmid R478 | L38824 | orplasmid r478 gn:terf le:5017 re:6258 di:direct sr:plasmid r478 dna nt:putative |
| CONTIG443 | 22676377_f2_38 | 2165 | 7827 | 1359 | 453 | 832 | 4.0(10)-83 | Escherichia coli | b1507 | [pn:hipa protein] [gn:hipa] |
| CONTIG443 | 6735393_f2_43 | 2166 | 7828 | 285 | 95 | 446 | 3.2(10)-42 | Escherichia coli | b4294 | [pn:insertion element is1f protein insa] [gn:insa_7] |
| CONTIG443 | 9822137_f3_46 | 2167 | 7829 | 1044 | 348 | 1530 | 4.4(10)-157 | Plasmid R478 | L38824 | orplasmid r478 gn:terc le:2277 re:3317 di:direct sr:plasmid r478 dna nt:putative |
| CONTIG443 | 23347182_f3_47 | 2168 | 7830 | 606 | 202 | 549 | 4.0(10)-53 | Bacillus subtilis | yceD | [pn:hypothetical protein] |
| CONTIG443 | 2911290_f3_65 | 2169 | 7831 | 234 | 78 | 370 | 3.7(10)-34 | Escherichia coli | S40546 | hypothetical protein - escherichia coli |
| CONTIG443 | 23947168_c1_88 | 2170 | 7832 | 2043 | 681 | 328 | 2.0(10)-26 | Bacillus subtilis | yjcD | [pn:hypothetical protein] |
| CONTIG443 | 16125182_c2_94 | 2171 | 7833 | 2448 | 816 | 3998 | 0 | Escherichia coli | P08504 | transposase for transposon tn2501. |
| CONTIG443 | 31284383_c2_95 | 2172 | 7834 | 1026 | 342 | 1577 | 4.5(10)-162 | Enterobacter aerogenes | U67194 | or:enterobacter aerogenes pn:tnpa gn:tnpa le:10303 re:11307 di:complement |
| CONTIG443 | 14885165_c2_97 | 2173 | 7835 | 297 | 99 | 390 | 2.7(10)-36 | Escherichia coli | D93826 | hypothetical 11k protein (insertion sequence is1) - escherichia coli this protein is coded by the insertion sequence is1. |
| CONTIG444 | 22315333_c2_113 | 2174 | 7836 | 1083 | 361 | 100 | 0.027 | Saccharomyces cerevisiae | P25040 | hypothetical protein in ifm1 3' region (fragment). |
| CONTIG444 | 6341_f1_13 | 2175 | 7837 | 2628 | 876 | 4054 | 0 | Escherichia coli | b3806 | [pn:adenylate cyclase] [gn:cyaa] |
| CONTIG444 | 25886466_f1_14 | 2176 | 7838 | 888 | 296 | 1326 | 1.8(10)-135 | Escherichia coli | b3809 | [pn:diaminopimelate epimerase] [gn:dapf] |
| CONTIG444 | 10677291_f1_17 | 2177 | 7839 | 750 | 250 | 1051 | 2.5(10)-106 | Escherichia coli | b3812 | [pn:hypothetical 27.1 kd protein in xerc-uvrd intergenic region] [gn:yigj] |
| CONTIG444 | 14656965_f1_23 | 2178 | 7840 | 1023 | 341 | 1516 | 1.5(10)-155 | Escherichia coli | b3816 | [pn:magnesium and cobalt transport protein cora] [gn:cora] |
| CONTIG444 | 15097887_f1_26 | 2179 | 7841 | 924 | 308 | 1440 | 1.5(10)-147 | Escherichia coli | b3821 | [pn:phospholipase a1 precursor] [gn:plda] |
| CONTIG444 | 1368832_f1_27 | 2180 | 7842 | 1896 | 632 | 2840 | 6.7(10)-296 | Escherichia coli | b3822 | [pn:dna-dependent atpase, dna helicase] [gn:recq] |
| CONTIG444 | 3619627_f1_30 | 2181 | 7843 | 471 | 157 | 703 | 1.8(10)-69 | Escherichia coli | b3825 | [pn:lysophospholipase 12] [gn:pldb] |
| CONTIG444 | 11932643_f2_46 | 2182 | 7844 | 459 | 153 | 206 | 8.8(10)-17 | Escherichia coli | P39166 | hypothetical 7.2 kd protein in cyay-dapf intergenic region] |
| CONTIG444 | 14877083_f2_48 | 2183 | 7845 | 909 | 303 | 1308 | 1.5(10)-133 | Escherichia coli | b3811 | [pn:integrase/recombinase xerc] [gn:xerc] |
| CONTIG444 | 35158886_f2_50 | 2184 | 7846 | 2217 | 739 | 3493 | 0 | Escherichia coli | b3813 | [pn:dna helicase ii] [gn:uvrd] |
| CONTIG444 | 829026_f2_57 | 2185 | 7847 | 651 | 217 | 446 | 3.2(10)-42 | Escherichia coli | b3823 | [pn:hypothetical 13.3 kd protein in recq 3''" region] [gn:yigj] |
| CONTIG444 | 11875466_f3_72 | 2186 | 7848 | 723 | 241 | 992 | 4.5(10)-100 | Escherichia coli | b3810 | [pn:hypothetical 26.7 kd protein in dapf-xerc intergenic region] [gn:yigi] |
| CONTIG444 | 5198312_c1_89 | 2187 | 7849 | 645 | 215 | 547 | 6.5(10)-53 | Escherichia coli | b3824 | [pn:hypothetical 15.4 kd protein in recq-pldb intergenic region] [gn:hcmx] |
| CONTIG444 | 22520812_c1_120 | 2188 | 7850 | 1254 | 418 | 1123 | 5.9(10)-114 | Escherichia coli | b3803 | [pn:uroporphyrinogen iii methylase] [gn:hcmx] |
| CONTIG444 | 11744501_c2_126 | 2189 | 7851 | 555 | 185 | 727 | 5.5(10)-72 | Escherichia coli | b3820 | [pn:hypothetical 17.1 kd protein in rard-plda intergenic region] [gn:yigi] |
| CONTIG445 | 12109716_c2_127 | 2190 | 7852 | 909 | 303 | 1197 | 8.5(10)-122 | Escherichia coli | b3819 | [pn:rard protein] [gn:rard] |
| CONTIG445 | 12242841_c2_141 | 2191 | 7853 | 756 | 252 | 924 | 7.2(10)-93 | Escherichia coli | b3804 | [pn:uroporphyrinogen iii synthase] [gn:hend] |
| CONTIG445 | 15735641_c3_169 | 2192 | 7854 | 360 | 120 | 431 | 1.2(10)-40 | Escherichia coli | b3807 | [pn:cyay protein] [gn:cyay] |
| CONTIG445 | 4728191_c3_173 | 2193 | 7855 | 966 | 322 | 1447 | 2.7(10)-148 | Escherichia coli | b3805 | [pn:porphobilinogen deaminase] [gn:hemc] |
| CONTIG445 | 16145837_c3_177 | 2194 | 7856 | 1224 | 408 | 1682 | 3.3(10)-173 | Escherichia coli | b3802 | [pn:heme protein] [gn:hemy] |
| CONTIG445 | 6282962_c3_178 | 2195 | 7857 | 1224 | 408 | 189 | 2.1(10)-13 | Erwinia herbicola | Q01334 | hypothetical 29.9 kd protein in crtc 3' region (orf3). |
| CONTIG445 | 23634781_f1_4 | 2196 | 7858 | 3081 | 1027 | 485 | 1.6(10)-52 | Serratia marcescens | JC5568 | [pn:serine proteinase h1, precursor] [gn:ssp-h1] |
| CONTIG445 | 10052331_f1_15 | 2197 | 7859 | 819 | 273 | 737 | 4.7(10)-73 | Escherichia coli | b2805 | [pn:1-fucose operon activator] [gn:fucr] |
| CONTIG445 | 24868825_f1_24 | 2198 | 7860 | 348 | 116 | 128 | 1.6(10)-8 | Escherichia coli | b3004 | [pn:hypothetical protein] |
| CONTIG445 | 32035208_f2_31 | 2199 | 7861 | 2013 | 671 | 1321 | 2.0(10)-186 | Escherichia coli | b1023 | [pn:hypothetical protein] [gn:ycdr] |
| CONTIG445 | 9948592_f2_34 | 2200 | 7862 | 447 | 149 | 208 | 5.4(10)-17 | Yersinia pestis | U22837 | or:yersinia pestis pn:hmss gn:hmss le:7025 re:7492 di:direct nt:hypothetical and essential protein, pi 6.68; 17.5 |
| CONTIG445 | 16613762_f2_39 | 2201 | 7863 | 1212 | 404 | 1574 | 9.5(10)-162 | Escherichia coli | b3001 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG445 | 6410751_f3_44 | 2202 | 7864 | 2424 | 808 | 1529 | 5.5(10)-157 | Escherichia coli | b1024 | [pn:hypothetical protein] [gn:ycds] |
| CONTIG445 | 24304207_f3_48 | 2203 | 7865 | 1434 | 478 | 1459 | 1.5(10)-149 | Escherichia coli | b1022 | [pn:hypothetical protein] [gn:ycdq] |
| CONTIG445 | 441008_f3_51 | 2204 | 7866 | 537 | 179 | 91 | 0.049 | Klebsiella pneumoniae | P06218 | nitrogen regulation protein ntrb (ec 2.7.3.—). |
| CONTIG445 | 7241576_f3_53 | 2205 | 7867 | 981 | 327 | 1332 | 4.2(10)-136 | Escherichia coli | b2989 | [pn:hypothetical protein] |
| CONTIG445 | 25990684_c1_61 | 2206 | 7868 | 281 | 93 | 274 | 5.5(10)-24 | Escherichia coli | b3005 | [pn:biopolymer transport exbd protein] [gn:exbd] |
| CONTIG445 | 32604711_c1_81 | 2207 | 7869 | 531 | 177 | 91 | 0.03599 | Neisseria gonorrhoeae | S16613 | [PN:opacity protein opaB] |
| CONTIG445 | 11854837_c1_85 | 2208 | 7870 | 645 | 215 | 198 | 6.2(10)-16 | Haemophilus influenzae | H0726 | [pn:nitrate/nitrite response regulator protein] [gn:narp] |
| CONTIG445 | 33615888_c2_87 | 2209 | 7871 | 528 | 176 | 749 | 2.5(10)-74 | Escherichia coli | b3002 | [pn:hypothetical protein] [gn:ydha] |
| CONTIG445 | 14659377_c2_90 | 2210 | 7872 | 1677 | 559 | 746 | 5.2(10)-74 | Escherichia coli | b1421 | [pn:methyl-accepting chemotaxis protein iii] [gn:trg] |
| CONTIG445 | 4477253_c2_94 | 2211 | 7873 | 1872 | 624 | 2696 | 1.2(10)-280 | Escherichia coli | b2988 | [pn:glutathionylspermidine synthetase/amidase] [gn:gsp] |
| CONTIG445 | 24862907_c3_110 | 2212 | 7874 | 390 | 130 | 157 | 5.7(10)-11 | Pseudomonas sp. | P18896 | increased glyphosate resistance protein. |
| CONTIG446 | 14222077_f1_7 | 2213 | 7875 | 1062 | 354 | 1563 | 1.3(10)-160 | Escherichia coli | b4269 | [pn:hypothetical zinc-type alcohol dehydrogenase-like protein] [gn:yjgb] |
| CONTIG446 | 35711006_f2_24 | 2214 | 7876 | 2880 | 960 | 4657 | 0 | Escherichia coli | b4258 | [pn:valyl-trna synthetase] [gn:vals] |
| CONTIG446 | 475468_f2_25 | 2215 | 7877 | 597 | 199 | 422 | 1.1(10)-39 | Escherichia coli | b4256 | [pn:hypothetical protein] |
| CONTIG446 | 21992143_f3_40 | 2216 | 7878 | 603 | 201 | 708 | 5.5(10)-70 | Escherichia coli | b4259 | [pn:dna polymerase iii chi subunit] [gn:holc] |
| CONTIG446 | 16172193_f3_50 | 2217 | 7879 | 1572 | 524 | 2108 | 2.5(10)-218 | Escherichia coli | b4263 | [pn:hypothetical 54.3 kd protein in pepa-gntv intergenic region] |
| CONTIG446 | 36381892_f3_52 | 2218 | 7880 | 4503 | 1501 | 7200 | 0 | Escherichia coli | b3212 | [pn:glutamate synthase] [gn:gltb] |
| CONTIG446 | 5250318_f3_53 | 2219 | 7881 | 1428 | 476 | 2377 | 7.7(10)-247 | Escherichia coli | b3213 | [pn:glutamate synthase] [gn:gltd] |
| CONTIG446 | 29304682_c1_71 | 2220 | 7882 | 1665 | 555 | 1540 | 3.7(10)-158 | Citrobacter freundii | P45510 | dihydroxyacetone kinase (ec 2.7.1.29) (glycerone kinase). |
| CONTIG446 | 33682087_c2_90 | 2221 | 7883 | 1032 | 344 | 1515 | 1.7(10)-155 | Escherichia coli | b3211 | [pn:hypothetical 34.6 kd protein in arcb-gltb intergenic region] |
| CONTIG446 | 21954086_c2_91 | 2222 | 7884 | 948 | 316 | 181 | 5.0(10)-12 | Pseudomonas aeruginosa | D86947 | [de:pseudomonas aeruginosa gene for chemotactic transducer, complete cds.] [pn:hydrophilic protein] [nt:orf1] |
| CONTIG447 | 24415936_c3_102 | 2223 | 7885 | 675 | 225 | 244 | 8.3(10)-21 | Escherichia coli | b3219 | [pn:hypothetical protein] [gn:yhcf] |
| CONTIG447 | 15128800_f1_1 | 2224 | 7886 | 540 | 180 | 801 | 7.7(10)-80 | Escherichia coli | b0812 | [pn:dna protection during starvation protein] [gn:dps] |
| CONTIG447 | 25604712_f1_3 | 2225 | 7887 | 741 | 247 | 1104 | 6.0(10)-112 | Escherichia coli | b0809 | [pn:glutamine transport atp-binding protein glnq] [gn:glnq] |
| CONTIG447 | 26288066_f1_4 | 2226 | 7888 | 2328 | 776 | 2857 | 1.1(10)-297 | Escherichia coli | b0808 | [pn:glutamine-binding periplasmic protein precursor] [gn:glnh] |
| CONTIG447 | 12586088_f1_6 | 2227 | 7889 | 300 | 100 | 285 | 3.7(10)-25 | Escherichia coli | b0806 | [pn:hypothetical protein] |
| CONTIG447 | 861407_f1_9 | 2228 | 7890 | 2583 | 861 | 1504 | 2.5(10)-154 | Escherichia coli | b3144 | [pn:hypothetical outer membrane usher protein in agaI-mtr intergenic region] [gn:yraj] |
| CONTIG447 | 4488453_f1_11 | 2229 | 7891 | 513 | 171 | 197 | 7.9(10)-16 | Escherichia coli | b4319 | [pn:fimg protein precursor] [gn:fimg] |
| CONTIG447 | 13161462_f1_24 | 2230 | 7892 | 1224 | 408 | 1395 | 8.9(10)-143 | Escherichia coli | b0793 | [pn:hypothetical protein] |
| CONTIG447 | 25964387_f2_25 | 2231 | 7893 | 816 | 272 | 1210 | 3.6(10)-123 | Escherichia coli | b0811 | [pn:glutamine-binding periplasmic protein precursor] [gn:glnp] |
| CONTIG447 | 16852916_f2_26 | 2232 | 7894 | 729 | 243 | 744 | 8.5(10)-74 | Escherichia coli | b0810 | [pn:glutamine transport system permease protein glnp] [gn:glnp] |
| CONTIG447 | 36033312_f2_38 | 2233 | 7895 | 582 | 194 | 209 | 4.2(10)-17 | Escherichia coli | b4314 | [pn:type 1 fimbrial subunit] [gn:fima] |
| CONTIG447 | 3909688_f2_39 | 2234 | 7896 | 684 | 228 | 408 | 3.5(10)-38 | Escherichia coli | b3143 | [pn:hypothetical 25.73 kd fimbrial chaperone in agaI-mtr intergeni] [gn:yrai] |
| CONTIG447 | 24494091_f2_46 | 2235 | 7897 | 1065 | 355 | 114 | 7.4(10)-5 | Escherichia coli | b0942 | [pn:hypothetical protein] |
| CONTIG447 | 15720380_f2_56 | 2236 | 7898 | 1035 | 345 | 1194 | 1.8(10)-121 | Escherichia coli | b0795 | [pn:hypothetical protein] |
| CONTIG447 | 26736057_f3_73 | 2237 | 7899 | 285 | 95 | 401 | 1.8(10)-37 | Escherichia coli | b0803 | [pn:hypothetical 9.8 kd protein in ding/rarb 3'''' region] [gn:ybii] |
| CONTIG447 | 14650256_f3_74 | 2238 | 7900 | 264 | 88 | 193 | 2.1(10)-15 | Escherichia coli | b0802 | [pn:hypothetical 8.6 kd protein in ding/rarb 3'''' region] [gn:ybij] |
| CONTIG447 | 23437800_f3_89 | 2239 | 7901 | 696 | 232 | 874 | 1.3(10)-87 | Escherichia coli | b0796 | [pn:hypothetical transcriptional regulator in moae-rhle intergenic region] [LE:32] [PN:3E1 protein] |
| CONTIG447 | 24900957_f3_92 | 2240 | 7902 | 1755 | 585 | 2686 | 1.3(10)-279 | Escherichia coli | b0794 | [pn:hypothetical protein] |
| CONTIG447 | 32713215_c2_138 | 2241 | 7903 | 1407 | 469 | 1801 | 8.5(10)-186 | Escherichia coli | b0797 | [pn:putative atp-dependent rna helicase] [gn:rhlc] |
| CONTIG447 | 5177157_c3_156 | 2242 | 7904 | 309 | 103 | 378 | 5.2(10)-35 | Entamoeba histolytica | Y14328 | [DE:Entamoeba histolytica mRNA for 3E1 protein.] [LE:32] [RE:418] [DI:direct] |
| CONTIG447 | 29933406_c3_157 | 2243 | 7905 | 435 | 145 | 95 | 0.05299 | Caenorhabditis elegans | U39852 | or:caenorhabditis elegans gn:k10c2.1 le:join (2542 re:2988,309 di:complement sr:caenorhabditis elegans strain = bristol n2 nt:coded |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG447 | 136417_c3_164 | 2244 | 7906 | 2256 | 752 | 3206 | 0 | Escherichia coli | b0799 | for by c. elegans cdna cm20c9; coded for by [pn:probable atp-dependent helicase ding] [gn:ding] |
| CONTIG447 | 15829811_c3_172 | 2245 | 7907 | 996 | 332 | 1122 | 7.5(10)-114 | Escherichia coli | b0800 | [pn:hypothetical 35.0 kd protein in ding/rarb 3'''' region] [gn:yhib] |
| CONTIG447 | 26206586_c3_174 | 2246 | 7908 | 1026 | 342 | 1341 | 4.7(10)-137 | Escherichia coli | b0807 | [pn:hypothetical protein] |
| CONTIG448 | 2510268_f1_7 | 2247 | 7909 | 444 | 148 | 137 | 1.8(10)-9 | Escherichia coli | b4347 | [pn:hypothetical 14.6 kd protein in mcrb-hsds intergenic region] [gn:yjiw] |
| CONTIG448 | 26251502_f1_14 | 2248 | 7910 | 735 | 245 | 96 | 0.01499 | Escherichia coli | b4365 | [pn:hypothetical 27.0 kd protein in dnat-hold intergenic region] |
| CONTIG448 | 35807665_f1_15 | 2249 | 7911 | 771 | 257 | 385 | 9.5(10)-36 | Escherichia coli | b0939 | [pn:hypothetical protein] |
| CONTIG448 | 24408336_f1_21 | 2250 | 7912 | 1110 | 370 | 155 | 9.6(10)-11 | Escherichia coli | b4314 | [pn:type 1 fimbrial subunit] [gn:fimA] |
| CONTIG448 | 17007156_f1_25 | 2251 | 7913 | 1209 | 403 | 97 | 0.05899 | Helicobacter pylori | HP1079 | [pn:h] |
| CONTIG448 | 25432962_f2_37 | 2252 | 7914 | 498 | 166 | 164 | 2.5(10)-12 | Vibrio cholerae | S81006 | or:vibrio cholerae pn:hcp gn:hcp le:690 re:1208 di:direct sr:vibrio cholerae o17 nt:28 kda secreted hydrophilic protein; this sequence |
| CONTIG448 | 12766056_f2_42 | 2253 | 7915 | 645 | 215 | 193 | 2.1(10)-15 | Escherichia coli | b4314 | [pn:type 1 fimbrial subunit] [gn:fimA] |
| CONTIG448 | 32599061_f2_45 | 2254 | 7916 | 693 | 231 | 240 | 2.2(10)-20 | Escherichia coli | b0943 | [pn:hypothetical protein] |
| CONTIG448 | 473413_f2_50 | 2255 | 7917 | 753 | 251 | 481 | 6.4(10)-46 | Escherichia coli | b2127 | [pn:hypothetical transcriptional regulator in molr-bglx intergenic region] [gn:yehv] |
| CONTIG448 | 31250052_f2_51 | 2256 | 7918 | 474 | 158 | 354 | 1.8(10)-32 | Escherichia coli | b1970 | [pn:hypothetical protein] |
| CONTIG448 | 7245763_f2_52 | 2257 | 7919 | 978 | 326 | 405 | 7.2(10)-38 | Escherichia coli | b0707 | [pn:hypothetical 20.2 kd protein in phrb 5'''' region] [gn:ybga] |
| CONTIG448 | 5963256_f2_72 | 2258 | 7920 | 252 | 84 | 96 | 0.0004 | Volvox carteri | S22697 | extensin-volvox carteri (fragment) |
| CONTIG448 | 36568816_f3_74 | 2259 | 7921 | 2598 | 866 | 1593 | 9.3(10)-164 | Escherichia coli | b0940 | [pn:hypothetical protein] |
| CONTIG448 | 4494031_c1_99 | 2260 | 7922 | 783 | 261 | 644 | 3.3(10)-63 | Bacillus subtilis | yddR | [pn:hypothetical protein] |
| CONTIG448 | 1055337_c1_127 | 2261 | 7923 | 504 | 168 | 349 | 6.2(10)-32 | Escherichia coli | b3657 | [pn:hypothetical 51.0 kd protein in glts-selc intergenic region] [gn:yicj] |
| CONTIG448 | 24659636_c2_131 | 2262 | 7924 | 1257 | 419 | 180 | 3.7(10)-11 | Escherichia coli | P22519 | colicin v secretion protein cvaa. |
| CONTIG448 | 26758592_c2_133 | 2263 | 7925 | 1005 | 335 | 146 | 8.3(10)-8 | Haemophilus influenzae | HI1052 | [pn:arac-like transcription regulator] |
| CONTIG448 | 21960077_c2_149 | 2264 | 7926 | 855 | 285 | 274 | 5.5(10)-24 | Escherichia coli | b2847 | [pn:hypothetical protein] |
| CONTIG448 | 6132827_c2_150 | 2265 | 7927 | 990 | 330 | 152 | 1.8(10)-8 | Bacillus subtilis | yflF | [pn:hypothetical protein] |
| CONTIG448 | 22272552_c2_151 | 2266 | 7928 | 492 | 164 | 231 | 2.0(10)-19 | Escherichia coli | b4012 | [pn:hypothetical 16.4 kd protein in rrfe-meta intergenic region] |
| CONTIG448 | 16135200_c2_155 | 2267 | 7929 | 1161 | 387 | 1062 | 1.7(10)-107 | Escherichia coli | b3657 | [pn:hypothetical 51.0 kd protein in glts-selc intergenic region] [gn:yicj] |
| CONTIG448 | 2506660_c3_162 | 2268 | 7930 | 1200 | 400 | 374 | 4.0(10)-34 | Bacillus subtilis | yknV | [pn:hypothetical protein] |
| CONTIG448 | 6929702_c3_177 | 2269 | 7931 | 540 | 180 | 614 | 5.0(10)-60 | Escherichia coli | b4149 | [pn:hypothetical 19.9 kd protein in suge-ampc intergenic region] |
| CONTIG448 | 33334717_c3_184 | 2270 | 7932 | 492 | 164 | 123 | 5.5(10)-8 | Escherichia coli | b2848 | [pn:hypothetical protein] |
| CONTIG448 | 9900640_c3_190 | 2271 | 7933 | 435 | 145 | 541 | 2.7(10)-52 | Escherichia coli | b3657 | [pn:hypothetical 51.0 kd protein in glts-selc intergenic region] [gn:yicj] |
| CONTIG448 | 34582963_c3_191 | 2272 | 7934 | 2379 | 793 | 3661 | 0 | Escherichia coli | b3656 | [pn:hypothetical 88.1 kd protein in glts-selc intergenic region] [gn:yici] |
| CONTIG449 | 14843818_f2_51 | 2273 | 7935 | 1017 | 339 | 921 | 1.5(10)-92 | Escherichia coli | b2321 | [pn:div protein] [gn:div] |
| CONTIG449 | 7235901_f2_77 | 2274 | 7936 | 1017 | 339 | 818 | 9.4(10)-126 | Escherichia coli | b2344 | [pn:long-chain fatty acid transport protein precursor] [gn:fadl] |
| CONTIG449 | 16065700_f3_78 | 2275 | 7937 | 183 | 61 | 110 | 1.3(10)-6 | Escherichia coli | D90862 | or:escherichia coli pn:glycine-rich cell wall structural protein gn:dedd le:14996 re:15160 di:direct sr:escherichia coli (strain:k12) dna, clone_lib:kohara minise nt:similar to [swissprot accession number p27483] |
| CONTIG449 | 16285206_f3_89 | 2276 | 7938 | 303 | 101 | 95 | 0.00025 | Rattus norvegicus | S24169 | mucin - rat |
| CONTIG449 | 6431430_f3_95 | 2277 | 7939 | 2172 | 724 | 2644 | 3.8(10)-275 | Escherichia coli | b2324 | [pn:hypothetical protein] |
| CONTIG449 | 24415941_f3_102 | 2278 | 7940 | 555 | 185 | 900 | 2.5(10)-90 | Escherichia coli | b2331 | [pn:hypothetical protein] |
| CONTIG449 | 30729686_c1_117 | 2279 | 7941 | 501 | 167 | 745 | 6.7(10)-74 | Escherichia coli | b2340 | [pn:hypothetical protein] |
| CONTIG449 | 111308_c1_121 | 2280 | 7942 | 822 | 274 | 1148 | 1.3(10)-116 | Escherichia coli | b2327 | [pn:hypothetical 28.6 kd protein in mepa 5'''' region] [gn:yfca] |
| CONTIG449 | 19558455_c1_123 | 2281 | 7943 | 366 | 122 | 369 | 4.7(10)-34 | Escherichia coli | b2325 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG449 | 15882827_c1_127 | 2282 | 7944 | 1218 | 406 | 1807 | 2.0(10)-186 | Escherichia coli | b2323 | [pn:3-oxoacyl-acyl-carrier-protein synthase i] [gn:fabb] |
| CONTIG449 | 897890_c1_138 | 2283 | 7945 | 1002 | 334 | 1330 | 6.9(10)-136 | Escherichia coli | b2316 | [pn:acetyl-coa carboxylase beta subunit] [gn:accd] |
| CONTIG449 | 2191887_c2_142 | 2284 | 7946 | 372 | 124 | 96 | 0.00025 | Escherichia coli | D90864 | or:escherichia coli pn:mitochondrial trifunctional enzyme beta subunit gn:hadhb le:13075 re:14127 di:complement sr:escherichia coli (strain:k12) dna, clone_lib:kohara lambda minise nt:similar to [swissprot accession number |
| CONTIG449 | 14665927_c2_145 | 2285 | 7947 | 2151 | 717 | 2730 | 3.0(10)-284 | Escherichia coli | b2341 | [pn:hypothetical protein] |
| CONTIG449 | 16850312_c2_148 | 2286 | 7948 | 216 | 72 | 174 | 1.2(10)-12 | Escherichia coli | b2330 | [pn:hypothetical adenine-specific methylase in aroc 3'''' region] [gn:yfcb] |
| CONTIG449 | 22048513_c2_149 | 2287 | 7949 | 975 | 325 | 1123 | 5.9(10)-114 | Escherichia coli | b2328 | [pn:penicillin-insensitive nurein endopeptidase precursor] [gn:mepa] |
| CONTIG449 | 6767933_c2_162 | 2288 | 7950 | 912 | 304 | 1251 | 1.6(10)-127 | Escherichia coli | b2318 | [pn:pseudouridylate synthase i] [gn:trua] |
| CONTIG449 | 4588311_c2_166 | 2289 | 7951 | 1281 | 427 | 1748 | 3.5(10)-180 | Escherichia coli | b2315 | [pn:folylpolyglutamate synthase] [gn:folc] |
| CONTIG449 | 23712758_c3_168 | 2290 | 7952 | 288 | 96 | 411 | 1.7(10)-38 | Escherichia coli | b2343 | [pn:hypothetical protein] |
| CONTIG449 | 24088515_c3_169 | 2291 | 7953 | 1344 | 448 | 1984 | 3.3(10)-205 | Escherichia coli | b2342 | [pn:hypothetical protein] |
| CONTIG449 | 14976381_c3_172 | 2292 | 7954 | 1023 | 341 | 1544 | 1.3(10)-158 | Escherichia coli | b2330 | [pn:hypothetical adenine-specific methylase in aroc 3'''' region] [gn:yfcb] |
| CONTIG449 | 3411530_c3_173 | 2293 | 7955 | 1146 | 382 | 1557 | 6.0(10)-160 | Escherichia coli | b2329 | [pn:chorismate synthase] [gn:aroc] |
| CONTIG449 | 10751892_c3_176 | 2294 | 7956 | 540 | 180 | 134 | 7.0(10)-9 | Escherichia coli | D90863 | or:escherichia coli le:14845 re:15579 di:complement sr:escherichia coli (strain:k12) dna, clone_lib:kohara lambda minise nt:similar to [swissprot accession number |
| CONTIG449 | 15085211_c3_177 | 2295 | 7957 | 588 | 196 | 914 | 8.3(10)-92 | Escherichia coli | b2326 | [pn:hypothetical protein] |
| CONTIG449 | 33470092_c3_183 | 2296 | 7958 | 1239 | 413 | 1402 | 1.6(10)-143 | Escherichia coli | b2322 | [pn:hypothetical protein] |
| CONTIG449 | 2348128_c3_185 | 2297 | 7959 | 1167 | 389 | 1630 | 1.1(10)-167 | Escherichia coli | b2320 | [pn:erythronate-4-phosphate dehydrogenase] [gn:pdxb] |
| CONTIG449 | 10972782_c3_186 | 2298 | 7960 | 1020 | 340 | 1386 | 8.0(10)-142 | Escherichia coli | b2319 | [pn:usg] [gn:usg] |
| CONTIG449 | 24037543_c3_187 | 2299 | 7961 | 672 | 224 | 756 | 4.5(10)-75 | Escherichia coli | b2317 | [pn:-1 protein] [gn:usg] |
| CONTIG449 | 36588465_c3_190 | 2300 | 7962 | 339 | 113 | 251 | 1.5(10)-21 | Escherichia coli | b2314 | [pn:deda protein] [gn:deda] |
| CONTIG449 | 20132828_f3_3 | 2301 | 7963 | 771 | 257 | 301 | 8.0(10)-31 | Escherichia coli | b2412 | [pn:dedd protein] [gn:dedd] |
| CONTIG449 | 1689727_f1_1 | 2302 | 7964 | 813 | 271 | 1166 | 1.6(10)-118 | Escherichia coli | b4364 | [pn:hypothetical protein] [gn:zipa] |
| CONTIG449 | 2406731 8_f1_12 | 2303 | 7965 | 1479 | 493 | 2489 | 1.0(10)-258 | Escherichia coli | Z37980 | [pn:hypothetical 30.5 kd protein in dnat-hold intergenic region] or:escherichia coli pn:5-carboxy-2-hydroxymuconate semialdehyde gn:hpae le:2137 re:3603 di:direct |
| CONTIG450 | 32052067_f1_16 | 2304 | 7966 | 330 | 110 | 90 | 0.0015 | Zea mays | U28017 | orzea mays pn:globulin 1 gn:glb1 le:join (421 re:922, 1010 di:direct sr:maize nt:allele glb1-hb; a null allele caused by the |
| CONTIG450 | 35713343_f1_30 | 2305 | 7967 | 342 | 114 | 344 | 2.1(10)-31 | Escherichia coli | b4353 | [pn:hypothetical 7.7 kd protein in mrr-tsr intergenic region] |
| CONTIG450 | 5897876_f2_34 | 2306 | 7968 | 489 | 163 | 320 | 7.2(10)-29 | Bacillus subtilis | ykmA | [pn:hypothetical protein] |
| CONTIG450 | 12714138_f2_35 | 2307 | 7969 | 444 | 148 | 593 | 8.5(10)-58 | Acinetobacter calcoaceticus | Y09102 | or:acinetobacter calcoaceticus pn:unknown protein le:621 re:1052 di:direct nt:orf2 |
| CONTIG450 | 34449090_f2_36 | 2308 | 7970 | 756 | 252 | 1072 | 1.5(10)-108 | Escherichia coli | b4361 | [pn:dna replication protein dnac] [gn:dnac] |
| CONTIG450 | 2664902_f2_37 | 2309 | 7971 | 489 | 163 | 348 | 7.9(10)-32 | Escherichia coli | b4360 | [pn:hypothetical 17.5 kd protein in mdob-dnac intergenic region] [gn:yjja] |
| CONTIG450 | 22861262_f2_39 | 2310 | 7972 | 531 | 177 | 113 | 6.2(10)-7 | Bacillus subtilis | yvbK | [pn:hypothetical protein] |
| CONTIG450 | 3183576 2_f2_43 | 2311 | 7973 | 1314 | 438 | 1646 | 2.2(10)-169 | Escherichia coli | Z37980 | or:escherichia coli pn:5-oxo-1,2,5-tricarboxilic-3-penten acid gn:hpag le:851 re:2140 di:direct |
| CONTIG450 | 4120187_f2_48 | 2312 | 7974 | 819 | 273 | 1318 | 1.3(10)-134 | Escherichia coli | AF036583 | [de:escherichia coli 2-oxo-hept-4-ene-1,7-dioate hydratase (hpcg) gene, complete cds] [pn:2-oxo-hept-4-ene-1,7-dioate hydratase] [gn:hpcg] [nt:ohcd hydratase] |
| CONTIG450 | 4891633_f2_59 | 2313 | 7975 | 540 | 180 | 764 | 6.5(10)-76 | Escherichia coli | C55349 | 4-hydroxyphenylacetate 3-monooxygenase (ec 1.14.13.3) smallchain - escherichia coli (atcc 11105) |
| CONTIG450 | 2456431_f2_61 | 2314 | 7976 | 2319 | 773 | 2860 | 5.0(10)-298 | Escherichia coli | b4354 | [pn:hypothetical 77.9 kd protein in mrr-tsr intergenic region] [gn:yjiy] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG450 | 24632126_f2_62 | 2315 | 7977 | 699 | 233 | 721 | 2.3(10)-71 | Escherichia coli | b4352 | [pn:f2] [gn:yjia] |
| CONTIG450 | 34156635_f3_65 | 2316 | 7978 | 588 | 196 | 500 | 6.2(10)-48 | Escherichia coli | b4363 | [pn:p14 protein] [gn:yjib] |
| CONTIG450 | 3955313_f3_67 | 2317 | 7979 | 555 | 185 | 677 | 1.1(10)-66 | Escherichia coli | b4362 | [pn:primosomal protein i] [gn:dnat] |
| CONTIG450 | 31906558_f3_69 | 2318 | 7980 | 2334 | 778 | 3278 | 0 | Escherichia coli | b4359 | [phosphoglycerol transferase i] [gn:mdob] |
| CONTIG450 | 35820818_f3_79 | 2319 | 7981 | 1140 | 380 | 1460 | 1.2(10)-149 | Escherichia coli | Z37980 | or:escherichia coli pn:homoprotocatechuate deoxygenase gn:hpad 1e:3605 re:4456 di:direct |
| CONTIG450 | 3956693_f3_80 | 2320 | 7982 | 390 | 130 | 572 | 1.5(10)-55 | Escherichia coli | S10709 | 5-carboxymethyl-2-hydroxymuconate isomerase - escherichia coli |
| CONTIG450 | 12776580_f3_82 | 2321 | 7983 | 1017 | 339 | 703 | 1.8(10)-69 | Escherichia coli | b2245 | [pn:hypothetical protein] |
| CONTIG450 | 6066957_f3_83 | 2322 | 7984 | 1365 | 455 | 1480 | 8.8(10)-152 | Escherichia coli | Z37980 | or:escherichia coli pn:hypothetical 4-hydroxyphenylacetate permease gn:hpax 1e:6734 re:8110 di:direct |
| CONTIG450 | 4035443_f3_84 | 2323 | 7985 | 942 | 314 | 1372 | 2.3(10)-140 | Escherichia coli | Z37980 | or:escherichia coli pn:regulator or the 4hpa-hydroxylase operon gn:hpaa 1e:8120 re:9007 di:direct |
| CONTIG450 | 24737630_f3_85 | 2324 | 7986 | 1686 | 562 | 2653 | 4.4(10)-276 | Escherichia coli | B55349 | 4-hydroxyphenylacetate 3-monooxygenase (ec 1.14.13.3) largechain - escherichia coli (atcc 11105) |
| CONTIG450 | 3228125_c1_108 | 2325 | 7987 | 1704 | 568 | 141 | 2.1(10)-8 | Azospirillum brasilense | X70360 | or:azospirillum brasilense gn:carr 1e:<1 re:588 di:direct |
| CONTIG450 | 12698757_c1_111 | 2326 | 7988 | 1788 | 596 | 1893 | 1.5(10)-195 | Escherichia coli | b4355 | [pn:methyl-accepting chemotaxis protein i] [gn:tsr] |
| CONTIG450 | 24901515_c2_138 | 2327 | 7989 | 456 | 152 | 617 | 2.5(10)-60 | Escherichia coli | Q07095 | homoprotocatechuate degradative operon repressor. |
| CONTIG450 | 5911250_f1_1 | 2328 | 7990 | 825 | 275 | 1103 | 7.7(10)-112 | Escherichia coli | b3528 | [pm:c4-dicarboxylate transport protein] [gn:dcta] |
| CONTIG450 | 21542930_f1_2 | 2329 | 7991 | 1503 | 501 | 1973 | 5.0(10)-204 | Escherichia coli | b3527 | [pn:53.1 kd protein in kdgk-delta intergenic region precursor] [gn:ylij] |
| CONTIG451 | 25986526_f1_5 | 2330 | 7992 | 822 | 274 | 998 | 1.0(10)-100 | Escherichia coli | b3525 | [pn:hypothetical 29.7 kd protein in treg-kdgk intergenic region] [gn:ylij] |
| CONTIG451 | 25665877_f1_11 | 2331 | 7993 | 762 | 254 | 360 | 4.2(10)-33 | Bacillus subtilis | fabG | [pn:3-oxoacyl-acyl-carrier protein reductase] [gn:ylpf] |
| CONTIG451 | 10272250_f1_12 | 2332 | 7994 | 687 | 229 | 481 | 6.4(10)-46 | Escherichia coli | b3520 | [pn:hypothetical transcriptional regulator in tref-kdgk intergenic region] [gn:ylij] |
| CONTIG451 | 207877_f1_21 | 2333 | 7995 | 2229 | 743 | 3076 | 0 | Escherichia coli | b3498 | [pn:oligopeptidase a] [gn:prlc] |
| CONTIG451 | 5328530_f1_22 | 2334 | 7996 | 462 | 154 | 551 | 2.3(10)-53 | Escherichia coli | b3494 | [pn:hypothetical 13.0 kd protein in pit-uspa intergenic region] [gn:yhio] |
| CONTIG451 | 5864762_f1_26 | 2335 | 7997 | 1287 | 429 | 1518 | 8.1(10)-156 | Escherichia coli | b3492 | [pn:hypothetical 43.8 kd protein in rhsb-pit intergenic region] [gn:yhin] |
| CONTIG451 | 7166656_f2_54 | 2336 | 7998 | 861 | 287 | 1222 | 1.8(10)-124 | Escherichia coli | b3497 | [pn:hypothetical protein in uspa-prlc intergenic region] [gn:yhiq] |
| CONTIG451 | 4338393_f2_60 | 2337 | 7999 | 852 | 284 | 286 | 2.8(10)-25 | Thiobacillus ferrooxidans | AF032884 | [de:thiobacillus ferrooxidans n-acetylglucosamine-1-phosphateuridyltransferase (glmu) gene, partial cds; glucosamine synthase (glms)"] [pn:transposition complex] [gn:tnsa] |
| CONTIG451 | 4958318_f2_61 | 2338 | 8000 | 945 | 315 | 292 | 3.2(10)-25 | Thiobacillus ferrooxidans | AF032884 | [de:thiobacillus ferrooxidans n-acetylglucosamine-1-phosphateuridyltransferase (glmu) gene, partial cds; glucosamine synthase (glms) and recg (recg) genes, complete sequence"] [gn:tnsc] |
| CONTIG451 | 53382_f3_70 | 2339 | 8001 | 2085 | 695 | 2730 | 3.0(10)-284 | Escherichia coli | b3524 | [pn:hypothetical 75.1 kd protein in tref-kdgk intergenic region] |
| CONTIG451 | 26601457_f3_95 | 2340 | 8002 | 1701 | 567 | 466 | 6.5(10)-44 | Thiobacillus ferrooxidans | AF032884 | [de:thiobacillus ferrooxidans n-acetylglucosamine-1-phosphateuridyltransferase (glmu) gene, partial cds; glucosamine synthase (glms) and recg (recg) genes, complete cds; and transposon tn5468, complete"] [pn:tnsb] |
| CONTIG451 | 3157016_c1_104 | 2341 | 8003 | 1506 | 502 | 2144 | 3.7(10)-222 | Escherichia coli | b3493 | [pn:pita] [gn:pita] |
| CONTIG451 | 30555383_c1_109 | 2342 | 8004 | 1443 | 481 | 2148 | 1.3(10)-222 | Escherichia coli | b3500 | [pn:glutathione oxidoreductase] [gn:gor] |
| CONTIG451 | 3939063_c1_120 | 2343 | 8005 | 1332 | 444 | 1671 | 5.0(10)-172 | Escherichia coli | b3523 | [pn:hypothetical metabolite transport protein in tref-kdgk intergenic region] [gn:yhje] |
| CONTIG451 | 23714693_c2_132 | 2344 | 8006 | 453 | 151 | 724 | 1.1(10)-71 | Escherichia coli | b3495 | [pn:universal stress protein a] [gn:uspa] |
| CONTIG451 | 35678462_c2_140 | 2345 | 8007 | 1707 | 569 | 2503 | 3.3(10)-260 | Escherichia coli | b3519 | [pn:probable cytoplasmic trehalase] [gn:tref] |
| CONTIG451 | 3242338_c2_144 | 2346 | 8008 | 351 | 117 | 141 | 6.7(10)-10 | Salmonella typhimurium | X67137 | or:salmonella typhimurium pn:gp19 protein gn:gene 19 1e:578 |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG451 | 11034506_c2_148 | 2347 | 8009 | 675 | 225 | 643 | 4.2(10)-63 | Escherichia coli | b3522 | re:1018 di:direct [pn:hypothetical 37.9 kd protein in tref-kdgk intergenic region] |
| CONTIG451 | 598951_c2_149 | 2348 | 8010 | 468 | 156 | 559 | 3.5(10)-54 | Escherichia coli | b3522 | [pn:hypothetical 37.9 kd protein in tref-kdgk intergenic region] |
| CONTIG451 | 24355307_c3_174 | 2349 | 8011 | 882 | 294 | 1353 | 2.5(10)-138 | Escherichia coli | b3499 | [pn:hypothetical 31.9 kd protein in prlc-gor intergenic region] [gn:yhir] |
| CONTIG451 | 23594561_c3_182 | 2350 | 8012 | 573 | 191 | 156 | 1.8(10)-11 | Bacillus subtilis | ynaD | [pn:hypothetical protein] |
| CONTIG451 | 3991556_c3_184 | 2351 | 8013 | 909 | 303 | 1012 | 3.3(10)-102 | Escherichia coli | b3521 | [pn:hypothetical transcriptional regulator in tref-kdgk intergenic region] [gn:yhjc] |
| CONTIG451 | 24254075_c3_191 | 2352 | 8014 | 990 | 330 | 1340 | 6.0(10)-137 | Escherichia coli | b3526 | [pn:2-dehydro-3-deoxygluconokinase] [gn:kdgk] |
| CONTIG451 | 21900187_f1_9 | 2353 | 8015 | 318 | 106 | 115 | 1.1(10)-6 | Pseudomonas aeruginosa | JQ0133 | hypothetical 26.4k protein - pseudomonas aeruginosa |
| CONTIG451 | 11020661_f2_35 | 2354 | 8016 | 702 | 234 | 746 | 2.6(10)-74 | Escherichia coli | b0396 | [pn:araj protein precursor] [gn:araj] |
| CONTIG452 | 4870402_f2_51 | 2355 | 8017 | 909 | 303 | 314 | 3.2(10)-28 | Escherichia coli | b3521 | [pn:hypothetical transcriptional regulator in tref-kdgk intergenic region] [gn:yhjc] |
| CONTIG452 | 34648408_f2_52 | 2356 | 8018 | 447 | 149 | 642 | 5.5(10)-63 | Escherichia coli | b1482 | [pn:osmotically inducible protein c] [gn:osmc] |
| CONTIG452 | 14636666_f2_54 | 2357 | 8019 | 795 | 265 | 568 | 3.7(10)-55 | Bacillus subtilis | ykvO | [pn:hypothetical protein] |
| CONTIG452 | 12163286_f2_62 | 2358 | 8020 | 378 | 126 | 107 | 2.3(10)-5 | Xenopus laevis | P17437 | skin secretory protein xp2 precursor (apeg protein). |
| CONTIG452 | 36656837_f2_68 | 2359 | 8021 | 1506 | 502 | 104 | 0.0066 | Bacillus subtilis | ytpA | [pn:hypothetical protein] |
| CONTIG452 | 36429028_f2_69 | 2360 | 8022 | 1215 | 405 | 691 | 3.6(10)-68 | Escherichia coli | b1163 | [pn:hypothetical protein] |
| CONTIG452 | 1306533_f3_73 | 2361 | 8023 | 513 | 171 | 143 | 4.2(10)-10 | Escherichia coli | b4178 | [pn:hypothetical 15.6 kd protein in pura-vacb intergenic region] [gn:yjeb] |
| CONTIG452 | 35290831_c1_106 | 2362 | 8024 | 1536 | 512 | 947 | 2.7(10)-95 | Escherichia coli | b1485 | [pn:hypothetical protein] |
| CONTIG452 | 17053875_c1_109 | 2363 | 8025 | 987 | 329 | 1160 | 7.0(10)-118 | Escherichia coli | b1483 | [pn:hypothetical protein] |
| CONTIG452 | 5292305_c1_111 | 2364 | 8026 | 921 | 307 | 404 | 9.1(10)-38 | Escherichia coli | b3521 | [pn:hypothetical transcriptional regulator in tref-kdgk intergenic region] [gn:yhjc] |
| CONTIG452 | 14945160_c1_115 | 2365 | 8027 | 1785 | 595 | 2635 | 3.5(10)-274 | Escherichia coli | b1479 | [pn:nad-linked malic enzyme] [gn:sfca] |
| CONTIG452 | 34413433_c1_116 | 2366 | 8028 | 1716 | 572 | 455 | 4.9(10)-52 | Bacillus subtilis | ydiF | [pn:hypothetical protein] |
| CONTIG452 | 22010303_c2_128 | 2367 | 8029 | 1050 | 350 | 1476 | 2.2(10)-151 | Escherichia coli | b1486 | [pn:hypothetical protein] |
| CONTIG452 | 35836461_c2_147 | 2368 | 8030 | 867 | 289 | 126 | 1.1(10)-5 | Escherichia coli | b1853 | [pn:hypothetical 32.0 kd protein in pyka-zwf intergenic region] [gn:yebk] |
| CONTIG452 | 16692842_c3_148 | 2369 | 8031 | 585 | 195 | 662 | 4.2(10)-65 | Escherichia coli | b1488 | [pn:hypothetical protein] |
| CONTIG452 | 12386275_c3_149 | 2370 | 8032 | 1548 | 516 | 2261 | 1.5(10)-234 | Escherichia coli | b1487 | [pn:hypothetical protein] |
| CONTIG452 | 32656630_c3_153 | 2371 | 8033 | 1044 | 348 | 1241 | 1.8(10)-126 | Escherichia coli | b1484 | [pn:hypothetical protein] |
| CONTIG452 | 5953808_c3_161 | 2372 | 8034 | 930 | 310 | 94 | 0.03699 | Bacillus subtilis | yobT | [pn:hypothetical protein] |
| CONTIG452 | 41502_c3_163 | 2373 | 8035 | 267 | 89 | 307 | 1.7(10)-27 | Escherichia coli | b1481 | [pn:hypothetical protein] |
| CONTIG452 | 22464212_c3_167 | 2374 | 8036 | 1023 | 341 | 1349 | 6.7(10)-138 | Escherichia coli | b1478 | [pn:hypothetical protein] |
| CONTIG452 | 36125916_c3_168 | 2375 | 8037 | 1221 | 407 | 558 | 4.4(10)-54 | Mycobacterium tuberculosis | Z96073 | dehydrogenase,, mtcy16f9.02, mtcy16f9.02, probable dehydrogenase, len |
| CONTIG453 | 22113932_f3_71 | 2376 | 8038 | 2112 | 704 | 1761 | 1.5(10)-181 | Escherichia coli | b0779 | [pn:excision nuclease abc subunit b] [gn:uvrb] |
| CONTIG453 | 35335183_f3_75 | 2377 | 8039 | 2709 | 903 | 133 | 6.7(10)-5 | Archaeoglobus fulgidus | H69378 | [pn:purine ntpase homolog] |
| CONTIG453 | 11722916_c1_80 | 2378 | 8040 | 441 | 147 | 293 | 2.5(10)-25 | Rhizobium sp. | P50360 | hypothetical 29.3 kd protein in region 2 of sym plasmid (no1265). |
| CONTIG453 | 2047880_c1_81 | 2379 | 8041 | 1050 | 350 | 1581 | 1.7(10)-162 | Yersinia pestis | AF053945 | [de:yersinia pestis plasmid ppcp1, complete plasmid sequence.] [pn:transposase] |
| CONTIG453 | 5286516_c1_88 | 2380 | 8042 | 243 | 81 | 283 | 6.0(10)-25 | Salmonella dublin | S22685 | vagc protein - salmonella dublin virulence plasmid. |
| CONTIG453 | 2932082_c1_90 | 2381 | 8043 | 762 | 254 | 391 | 2.2(10)-36 | Saccharomyces cerevisiae | P40586 | hypothetical 27.4 kd protein in hyr1 3' region. |
| CONTIG453 | 4726577_c1_91 | 2382 | 8044 | 267 | 89 | 145 | 2.6(10)-10 | Escherichia coli | b1892 | [pn:flagellar transcriptional activator flhd] [gn:flhd] |
| CONTIG453 | 10744011_c1_95 | 2383 | 8045 | 1113 | 371 | 1628 | 1.8(10)-167 | Escherichia coli | b0356 | [pn:alcohol—acetaldehyde dehydrogenase] [gn:adhc] |
| CONTIG453 | 33644826_c1_97 | 2384 | 8046 | 1362 | 454 | 91 | 0.53 | Helicobacter pylori | IIP0870 | [pn:flagellar hook flge] [gn:flge] |
| CONTIG453 | 26255200_c1_98 | 2385 | 8047 | 372 | 124 | 203 | 1.8(10)-16 | Haemophilus influenzae | HI0184 | [pn:hypothetical protein] |
| CONTIG453 | 24306507_c2_130 | 2386 | 8048 | 2655 | 885 | 1136 | 5.4(10)-163 | Bacillus subtilis | uvrA | [pn:excinuclease abc] |
| CONTIG453 | 33697188_c2_132 | 2387 | 8049 | 279 | 93 | 412 | 1.3(10)-38 | Escherichia coli | b0357 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG453 | 22672286_c3_135 | 2388 | 8050 | 804 | 268 | 1260 | 1.8(10)-128 | Yersinia pestis | AF053945 | [de:yersinia pestis plasmid ppcp1, complete plasmid sequence] [pn:transposase] |
| CONTIG453 | 24025381_c3_144 | 2389 | 8051 | 219 | 73 | 271 | 1.1(10)-23 | Salmonella dublin | S22686 | vagd protein - salmonella dublin virulence plasmid |
| CONTIG453 | 10727336_c3_147 | 2390 | 8052 | 288 | 96 | 249 | 2.3(10)-21 | Escherichia coli | b0357 | [pn:hypothetical protein] |
| CONTIG453 | 19767826_c3_149 | 2391 | 8053 | 621 | 207 | 683 | 2.5(10)-67 | Escherichia coli | b0355 | [pn:hypothetical protein] [gn:yaim] |
| CONTIG454 | 15829957_f1_4 | 2392 | 8054 | 633 | 211 | 731 | 2.1(10)-72 | Escherichia coli | b3249 | [pn:rod shape-determining protein mred] [gn:mred] |
| CONTIG454 | 3984837_f1_5 | 2393 | 8055 | 603 | 201 | 864 | 1.7(10)-86 | Escherichia coli | b3248 | [pn:hypothetical 21.5 kd protein in cafa-mred intergenic region] [gn:ylde] |
| CONTIG454 | 24627202_f1_10 | 2394 | 8056 | 1446 | 482 | 2135 | 3.3(10)-221 | Escherichia coli | b3244 | [pn:tldd protein] [gn:tldd] |
| CONTIG454 | 10179131_f1_11 | 2395 | 8057 | 231 | 77 | 366 | 9.8(10)-34 | Escherichia coli | b3242 | [pn:hypothetical protein] [gn:yher] |
| CONTIG454 | 36042040_f1_14 | 2396 | 8058 | 2031 | 677 | 2286 | 3.3(10)-237 | Escherichia coli | b3240 | [pn:hypothetical 73.6 kd protein in argr-cafa intergenic region] [gn:yhcp] |
| CONTIG454 | 23614003_f1_17 | 2397 | 8059 | 963 | 321 | 1415 | 6.7(10)-145 | Escherichia coli | b3236 | [pn:malate dehydrogenase] [gn:mdh] |
| CONTIG454 | 13087756_f2_33 | 2398 | 8060 | 1020 | 340 | 1207 | 7.4(10)-123 | Escherichia coli | b3250 | [pn:rod shape-determining protein mrec] [gn:mrec] |
| CONTIG454 | 14453433_f2_35 | 2399 | 8061 | 1506 | 502 | 2182 | 3.6(10)-226 | Escherichia coli | b3247 | [pn:cytoplasmic axial filament protein] [gn:cafa] |
| CONTIG454 | 16026457_f2_36 | 2400 | 8062 | 3849 | 1283 | 3981 | 0 | Escherichia coli | b3245 | [pn:hypothetical 107.7 kd protein in argr-cafa intergenic region] |
| CONTIG454 | 30208260_f2_41 | 2401 | 8063 | 960 | 320 | 1415 | 6.7(10)-145 | Escherichia coli | b3241 | [pn:hypothetical 34.8 kd protein in argr-cafa intergenic region] [gn:yhcq] |
| CONTIG454 | 15647540_f3_55 | 2402 | 8064 | 1983 | 661 | 2669 | 8.8(10)-278 | Escherichia coli | b3252 | [pn:hypothetical 73.3 kd protein in mreb-accb intergenic region] [gn:yhda] |
| CONTIG454 | 32230311_f3_56 | 2403 | 8065 | 1170 | 390 | 1827 | 1.5(10)-188 | Escherichia coli | b3251 | [pn:rod shape-determining protein mreb] [gn:mreb] |
| CONTIG454 | 35282183_f3_70 | 2404 | 8066 | 1674 | 558 | 1376 | 9.1(10)-141 | Escherichia coli | b2661 | [pn:succinate-semialdehyde dehydrogenase] [gn:gabd] |
| CONTIG454 | 22917932_f3_71 | 2405 | 8067 | 315 | 105 | 302 | 5.9(10)-27 | Escherichia coli | b3239 | [pn:hypothetical protein] [gn:yhco] |
| CONTIG454 | 23650765_c1_77 | 2406 | 8068 | 1125 | 375 | 1305 | 3.1(10)-133 | Escherichia coli | b3235 | [pn:protease precursor] [gn:degs] |
| CONTIG454 | 16265886_c1_110 | 2407 | 8069 | 1062 | 354 | 1419 | 2.6(10)-145 | Escherichia coli | b1971 | [pn:hypothetical protein] |
| CONTIG454 | 14455203_c1_111 | 2408 | 8070 | 243 | 81 | 309 | 1.1(10)-27 | Escherichia coli | b1972 | [pn:hypothetical protein] |
| CONTIG454 | 6070136_c2_112 | 2409 | 8071 | 1425 | 475 | 1622 | 7.9(10)-167 | Escherichia coli | b3234 | [pn:protease precursor] [gn:degq] |
| CONTIG454 | 3424001_c2_116 | 2410 | 8072 | 219 | 73 | 124 | 4.2(10)-8 | Escherichia coli | b3237 | [pn:arginine repressor] [gn:argr] |
| CONTIG454 | 4144568_c2_146 | 2411 | 8073 | 984 | 328 | 1280 | 1.3(10)-130 | Escherichia coli | b3253 | [pn:hypothetical 34.7 kd protein in mreb-accb intergenic region] [gn:yhdi] |
| CONTIG454 | 12585313_c3_149 | 2412 | 8074 | 474 | 158 | 540 | 3.6(10)-52 | Escherichia coli | b3233 | [pn:hypothetical 15.2 kd protein in rplm-hhoa intergenic region] [gn:yhcb] |
| CONTIG454 | 24220842_c3_150 | 2413 | 8075 | 438 | 146 | 632 | 6.4(10)-62 | Escherichia coli | b3238 | [pn:arginine repressor] [gn:argr] |
| CONTIG454 | 24664052_c3_151 | 2414 | 8076 | 270 | 90 | 176 | 1.3(10)-13 | Escherichia coli | b3238 | [pn:hypothetical protein] [gn:yhen] |
| CONTIG454 | 13683312_c3_155 | 2415 | 8077 | 537 | 179 | 164 | 2.5(10)-12 | Acospirillum brasilense | X70360 | orazospirillum brasilense gn:carr 1e:59 re:580 di:direct nt:orf2 |
| CONTIG454 | 32244052_c3_161 | 2416 | 8078 | 930 | 310 | 1440 | 1.5(10)-147 | Escherichia coli | b3243 | [pn:hypothetical protein] [gn:yhcs] |
| CONTIG454 | 23642302_f1_27 | 2417 | 8079 | 1731 | 577 | 2126 | 3.1(10)-220 | Escherichia coli | b0445 | [pn:hypothetical 65.0 kd protein in hupb-cof intergenic region] |
| CONTIG454 | 32228380_f1_28 | 2418 | 8080 | 699 | 233 | 1133 | 5.2(10)-115 | Escherichia coli | b0444 | [pn:hypothetical protein] [gn:ybax] |
| CONTIG455 | 7686_f2_62 | 2419 | 8081 | 1107 | 369 | 976 | 2.2(10)-98 | Mycobacterium tuberculosis | AL022121 | [de:mycobacterium tuberculosis sequence v025.] [nt:mtv025.032, lyase] [gn:mtv025.032] [pn:hypothetical protein] [gn:ylab] |
| CONTIG455 | 32458412_f3_76 | 2420 | 8082 | 1566 | 522 | 1507 | 1.2(10)-154 | Escherichia coli | b0457 | [pn:hypothetical protein] [gn:ylab] |
| CONTIG455 | 24254782_f3_85 | 2421 | 8083 | 1539 | 513 | 284 | 4.5(10)-25 | Escherichia coli | b1439 | [pn:hypothetical protein] [gn:ybaz] |
| CONTIG455 | 36066375_f3_87 | 2422 | 8084 | 330 | 110 | 484 | 3.1(10)-46 | Escherichia coli | b0454 | [pn:hypothetical protein] [gn:ybaz] |
| CONTIG455 | 13751263_f3_88 | 2423 | 8085 | 942 | 314 | 1283 | 6.5(10)-131 | Escherichia coli | b0452 | [pn:acyl-coa thioestrase ii] [gntesb] |
| CONTIG455 | 31439416_c1_105 | 2424 | 8086 | 504 | 168 | 550 | 3.1(10)-53 | Escherichia coli | b0443 | [pn:hypothetical protein] [gn:ybaw] |
| CONTIG455 | 24500877_c1_106 | 2425 | 8087 | 363 | 121 | 128 | 1.6(10)-8 | Haemophilus influenzae | HI1420 | [pn:hypothetical protein] |
| CONTIG455 | 3913580_c1_115 | 2426 | 8088 | 621 | 207 | 794 | 4.2(10)-79 | Escherichia coli | b0447 | [pn:hypothetical protein] |
| CONTIG455 | 4875126_c1_116 | 2427 | 8089 | 1785 | 595 | 2281 | 1.2(10)-236 | Escherichia coli | b0448 | [pn:mdla] |
| CONTIG455 | 35582912_c1_126 | 2428 | 8090 | 582 | 194 | 627 | 2.2(10)-61 | Escherichia coli | b0453 | [pn:hypothetical protein] [gn:ybay] |
| CONTIG455 | 29877090_c1_134 | 2429 | 8091 | 1122 | 374 | 279 | 1.1(10)-29 | Haemophilus influenzae | HI1635 | [pn:purine nucleotide synthesis repressor protein] [gn:purr] |
| CONTIG455 | 4140_c2_140 | 2430 | 8092 | 2034 | 678 | 2534 | 1.8(10)-263 | Escherichia coli | b0441 | [pn:hypothetical protein] [gn:ybau] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG455 | 5120650_c2_148 | 2431 | 8093 | 2046 | 682 | 2330 | 7.4(10)-242 | Escherichia coli | b0449 | [pn:mdlb] |
| CONTIG455 | 6536566_c2_150 | 2432 | 8094 | 1338 | 446 | 1687 | 1.0(10)-173 | Escherichia coli | b0451 | [pn:hypothetical protein in mdl-tesb intergenic region] [gn:amtb] |
| CONTIG455 | 4509562_c2_157 | 2433 | 8095 | 678 | 226 | 309 | 1.1(10)-27 | Haemophilus influenzae | HI0522 | [pn:sp] |
| CONTIG455 | 24078333_c2_160 | 2434 | 8096 | 3111 | 1037 | 3614 | 0 | Escherichia coli | b0344 | [pn:beta-galactosidase] [gn:lacz] |
| CONTIG455 | 1269806_c3_164 | 2435 | 8097 | 522 | 174 | 827 | 1.3(10)-82 | Escherichia coli | b0439 | [pn:lon protease] [gn:lon] |
| CONTIG455 | 33860768_c3_165 | 2436 | 8098 | 360 | 120 | 292 | 6.7(10)-26 | Escherichia coli | b0440 | [pn:dna-binding protein hu-beta] [gn:hupb] |
| CONTIG455 | 24344391_c3_166 | 2437 | 8099 | 501 | 167 | 339 | 7.0(10)-31 | Escherichia coli | b0442 | [pn:hypothetical protein] |
| CONTIG455 | 34257212_c3_168 | 2438 | 8100 | 381 | 127 | 130 | 1.0(10)-8 | Haemophilus influenzae | HI1419 | [pn:hypothetical protein] |
| CONTIG455 | 4470206_c3_170 | 2439 | 8101 | 843 | 281 | 1105 | 4.7(10)-112 | Escherichia coli | b0446 | [pn:cof protein] [gn:cof] |
| CONTIG455 | 886451_c3_177 | 2440 | 8102 | 375 | 125 | 540 | 3.6(10)-52 | Escherichia coli | b0450 | [pn:nitrogen regulatory protein p-ii] [gn:glnk] |
| CONTIG456 | 1709787_f1_4 | 2441 | 8103 | 1119 | 373 | 1812 | 5.7(10)-187 | Escherichia coli | b2806 | [pn:hypothetical 41.9 kd protein in fucr-gcva intergenic region] [gn:ygde] |
| CONTIG456 | 14339808_f1_12 | 2442 | 8104 | 462 | 154 | 381 | 2.5(10)-35 | Escherichia coli | b2792 | [pn:hypothetical protein] |
| CONTIG456 | 24726386_f1_18 | 2443 | 8105 | 1383 | 461 | 2148 | 1.3(10)-222 | Escherichia coli | b2788 | [pn:hypothetical protein] [gn:ygcy] |
| CONTIG456 | 1404837_f1_19 | 2444 | 8106 | 1350 | 450 | 2115 | 4.5(10)-219 | Escherichia coli | b2787 | [pn:hypothetical protein] [gn:ygcx] |
| CONTIG456 | 1440751_f1_31 | 2445 | 8107 | 1653 | 551 | 2559 | 4.0(10)-266 | Escherichia coli | b2780 | [pn:ctp synthase] [gn:pyrg] |
| CONTIG456 | 960000_f1_31 | 2446 | 8108 | 1350 | 450 | 749 | 2.5(10)-74 | Escherichia coli | b1621 | [pn:pts system, maltose and glucose-specific ii abc component] [gn:malx] |
| CONTIG456 | 24480282_f2_49 | 2447 | 8109 | 1389 | 463 | 2172 | 4.0(10)-225 | Escherichia coli | b2789 | [pn:hypothetical protein] |
| CONTIG456 | 35347826_f2_61 | 2448 | 8110 | 1566 | 522 | 1626 | 3.0(10)-167 | Escherichia coli | b2785 | [pn:hypothetical rna methyltransferase in rela-bara intergenic region] [gn:gca] |
| CONTIG456 | 5886253_f2_62 | 2449 | 8111 | 2280 | 760 | 3496 | 0 | Escherichia coli | b2784 | [pn:gtp pyrophosphokinase] [gn:rela] |
| CONTIG456 | 16208537_f2_66 | 2450 | 8112 | 1371 | 457 | 1985 | 2.7(10)-205 | Escherichia coli | b2779 | [pn:lase] [gn:eno] |
| CONTIG456 | 22147011_f3_71 | 2451 | 8113 | 936 | 312 | 1509 | 7.4(10)-155 | Escherichia coli | b2808 | [pn:regulatory protein for glycine cleavage pathway] [gn:gcva] |
| CONTIG456 | 15868766_f3_72 | 2452 | 8114 | 435 | 145 | 613 | 6.5(10)-60 | Escherichia coli | b2807 | [pn:hypothetical 14.3 kd protein in fucr-gcva intergenic region] [gn:ygdd] |
| CONTIG456 | 33750181_f3_83 | 2453 | 8115 | 606 | 202 | 679 | 6.7(10)-67 | Escherichia coli | b2793 | [pn:syd] [gn:syd] |
| CONTIG456 | 14880066_f3_85 | 2454 | 8116 | 792 | 264 | 1145 | 2.7(10)-116 | Escherichia coli | b2791 | [pn:hypothetical protein] [gn:yqcb] |
| CONTIG456 | 22870800_f3_86 | 2455 | 8117 | 465 | 155 | 622 | 7.2(10)-61 | Escherichia coli | b2790 | [pn:hypothetical protein] |
| CONTIG456 | 3933193_f3_89 | 2456 | 8118 | 1155 | 385 | 1206 | 9.5(10)-123 | Escherichia coli | b3124 | [pn:hypothetical 42.1 kd protein in mpb-soha intergenic region] [gn:yhad] |
| CONTIG456 | 16145293_f3_99 | 2457 | 8119 | 834 | 278 | 1014 | 2.1(10)-102 | Escherichia coli | b2781 | [pn:mazg protein] [gn:mazg] |
| CONTIG456 | 563568_c1_137 | 2458 | 8120 | 1374 | 458 | 2203 | 2.1(10)-228 | Escherichia coli | b2795 | [pn:hypothetical protein in sdac 5"" region] [gn:sdac] |
| CONTIG456 | 4298457_c1_138 | 2459 | 8121 | 1371 | 457 | 1818 | 1.3(10)-187 | Escherichia coli | b2796 | [pn:putative serine transporter] [gn:sdac] |
| CONTIG456 | 34664182_c1_140 | 2460 | 8122 | 774 | 258 | 1130 | 1.1(10)-114 | Escherichia coli | b2798 | [pn:potential 5""-3"" nuclease] [gn:exo] |
| CONTIG456 | 4563193_c2_147 | 2461 | 8123 | 834 | 278 | 323 | 3.5(10)-29 | Haemophilus influenzae | HI0143 | [pn:gb] |
| CONTIG456 | 19619623_c2_175 | 2462 | 8124 | 846 | 282 | 1306 | 2.3(10)-133 | Escherichia coli | b2794 | [pn:hypothetical protein] [gn:yqcd] |
| CONTIG456 | 13707307_c3_188 | 2463 | 8125 | 1299 | 433 | 200 | 3.0(10)-13 | Schizosaccharomyces pombe | L37084 | or:schizosaccharomyces pombe pn:phosphopyruvate hydratase ec.4.2.1.11 le:2 re:1342 di:complement sr:schizosaccharomyces pombe cdna to mrna |
| CONTIG457 | 25831336_c3_191 | 2464 | 8126 | 1398 | 466 | 175 | 5.2(10)-12 | Escherichia coli | A30374 | hypothetical 77k protein (spot 3' region) - escherichia coli |
| CONTIG457 | 4379716_c3_195 | 2465 | 8127 | 2769 | 923 | 3912 | 0 | Escherichia coli | b2786 | [pn:sensor protein bara] [gn:bara] |
| CONTIG457 | 32314042_c3_212 | 2466 | 8128 | 1383 | 461 | 2082 | 1.3(10)-215 | Escherichia coli | b2797 | [pn:1-serine dehydratase 2] [gn:sdab] |
| CONTIG457 | 47891_f1_26 | 2467 | 8129 | 501 | 167 | 597 | 3.2(10)-58 | Escherichia coli | b3355 | [pn:phosphoribulokinase] [gn:prkb] |
| CONTIG457 | 35792657_f1_36 | 2468 | 8130 | 822 | 274 | 262 | 1.0(10)-22 | Escherichia coli | U82664 | or:escherichia coli le:133380 re:134066 di:direct nt:hypothetical protein |
| CONTIG457 | 26759702_f2_37 | 2469 | 8131 | 222 | 74 | 321 | 5.7(10)-29 | Escherichia coli | b3348 | [pn:slyx protein] [gn:slyx] |
| CONTIG457 | 24412918_f2_38 | 2470 | 8132 | 654 | 218 | 539 | 4.5(10)-52 | Escherichia coli | B49988 | hypothetical protein 159 - escherichia coli |
| CONTIG457 | 3947187_f2_64 | 2471 | 8133 | 222 | 74 | 318 | 1.2(10)-28 | Escherichia coli | b3354 | [pn:hypothetical 8.5 kd protein in kfb-prkb intergenic region] |
| CONTIG457 | 568755_f2_65 | 2472 | 8134 | 531 | 177 | 653 | 3.7(10)-64 | Escherichia coli | b3355 | [pn:phosphoribulokinase] [gn:prkb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG457 | 7067711_f2_68 | 2473 | 8135 | 639 | 213 | 1070 | 2.5(10)-108 | Escherichia coli | b3357 | [pn:cyclic amp receptor protein] [gn:crp] |
| CONTIG457 | 24308275_f2_69 | 2474 | 8136 | 2145 | 715 | 2846 | 1.6(10)-296 | Escherichia coli | b3358 | [pn:hypothetical 79.5 kd protein in crp-argd intergenic region] [gn:yhfK] |
| CONTIG457 | 4484686_f3_78 | 2475 | 8137 | 1938 | 646 | 2854 | 2.2(10)-297 | Escherichia coli | b3352 | [pn:hypothetical abc transporter in kifb-prkb intergenic region] |
| CONTIG457 | 34660411_f3_79 | 2476 | 8138 | 948 | 316 | 1171 | 4.9(10)-119 | Klebsiella pneumoniae | U95087 | [PN:MdcR] [GN:mdcR] [FN:regulates expression of malonate decarboxylase gene cluster (mdcA, mdcB, mdcC, mdcD, mdcE, mdcF, mdcG, mdcH, mdcR) genes, complete cds.] [NT:transcriptional regul |
| CONTIG457 | 34103250_f3_91 | 2477 | 8139 | 1050 | 350 | 1317 | 1.6(10)-134 | Escherichia coli | b3353 | [pn:hypothetical 38.5 kd protein in kifb-prkb intergenic region] |
| CONTIG457 | 132825_f3_92 | 2478 | 8140 | 318 | 106 | 137 | 9.3(10)-9 | Escherichia coli | U18997 | or:escherichia coli le:265033 di:direct nt:266106 di:direct nt:orf_o357; codon usage statistics poor where o72 |
| CONTIG457 | 21678790_c1_100 | 2479 | 8141 | 573 | 191 | 737 | 4.7(10)-73 | Escherichia coli | b3363 | [pn:peptidyl-prolyl cis-trans isomerase a] [gn:ppia] |
| CONTIG457 | 21925080_c1_101 | 2480 | 8142 | 690 | 230 | 542 | 2.2(10)-52 | Escherichia coli | b3361 | [pn:cell filamentation protein] [gn:fic] |
| CONTIG457 | 16933387_c1_102 | 2481 | 8143 | 594 | 198 | 804 | 3.7(10)-79 | Escherichia coli | b3360 | [pn:para-aminobenzoate synthetase] [gn:paba] |
| CONTIG457 | 21485675_c1_103 | 2482 | 8144 | 1266 | 422 | 1917 | 4.2(10)-198 | Escherichia coli | b3359 | [pn:acetylornitine delta-aminotransferase] [gn:argd] |
| CONTIG457 | 22689078_c1_106 | 2483 | 8145 | 411 | 137 | 641 | 7.0(10)-63 | Escherichia coli | b3356 | [pn:hypothetical protein] [gn:yhfa] |
| CONTIG457 | 26019656_c1_111 | 2484 | 8146 | 885 | 295 | 985 | 2.5(10)-99 | Klebsiella pneumoniae | U95087 | [PN:MdcB] [GN:mdcB] [FN:involved in biosynthesis of the prosthetic] [DE:Klebsiella pneumoniae malonate decarboxylase gene cluster (mdcA, mdcB, mdcC, mdcD, mdcE, mdcF, mdcG, mdcH, mdcR) genes, complete cds.] [NT:similar to CitG proteins |
| CONTIG457 | 3954838_c1_112 | 2485 | 8147 | 309 | 103 | 366 | 9.8(10)-34 | Klebsiella pneumoniae | U95087 | [PN:MdcC] [GN:mdcC] [DE:Klebsiella pneumoniae malonate decarboxylase gene cluster (mdcA, mdcB, mdcC, mdcD, mdcE, mdcF, mdcG, mdcH, mdcR) genes, complete cds.] [NT:acyl carrier protein; delta subunit of malonate] [LE:2803] [RE:3102] [DI: |
| CONTIG457 | 29297917_c1_113 | 2486 | 8148 | 828 | 276 | 1026 | 1.1(10)-103 | Klebsiella pneumoniae | U95087 | [PN:MdcE] [GN:mdcE] [DE:Klebsiella pneumoniae malonate decarboxylase gene cluster (mdcA, mdcB, mdcC, mdcD, mdcE, mdcF, mdcG, mdcH, mdcR) genes, complete cds.] [NT:decarboxylase subunit; gamma subunit of malonate] [LE:3928] [RE:4728] [DI: |
| CONTIG457 | 19650250_c1_114 | 2487 | 8149 | 963 | 321 | 1138 | 1.5(10)-115 | Klebsiella pneumoniae | U95087 | [PN:MdcF] [GN:mdcF] [FN:putative malonate transporter] [DE:Klebsiella pneumoniae malonate decarboxylase gene cluster (mdcA, mdcB, mdcC, mdcD, mdcE, mdcF, mdcG, mdcH, mdcR) genes, complete cds.] [NT:encodes ten hydrophobic domains] [LE:4 |
| CONTIG457 | 35832883_c1_122 | 2488 | 8150 | 1950 | 650 | 2271 | 1.3(10)-235 | Escherichia coli | b3350 | [pn:glutathione-regulated potassium-efflux system protein] [gn:kefb] |
| CONTIG457 | 1449027_c2_138 | 2489 | 8151 | 1671 | 557 | 2587 | 4.2(10)-269 | Klebsiella pneumoniae | U95087 | [PN:MdcA] [GN:mdcA] [DE:Klebsiella pneumoniae malonate decarboxylase gene cluster (mdcA, mdcB, mdcC, mdcD, mdcE, mdcF, mdcG, mdcH, mdcR) genes, complete cds.] [NT:acyl carrier protein transferase; alpha subunit of] [LE:288] [RE:1943] [D |
| CONTIG457 | 25650277_c2_140 | 2490 | 8152 | 837 | 279 | 1180 | 5.4(10)-120 | Klebsiella pneumoniae | U95087 | [PN:MdcD] [GN:mdcD] [DE:Klebsiella pneumoniae malonate decarboxylase gene cluster (mdcA, mdcB, mdcC, mdcD, mdcE, mdcF, mdcG, mdcH, mdcR) genes, complete cds.] [NT:decarboxylase subunit; beta subunit of malonate] [LE:3095] [RE:3928] [DI: |
| CONTIG457 | 10444826_c2_142 | 2491 | 8153 | 1059 | 353 | 1145 | 2.7(10)-116 | Klebsiella pneumoniae | U56096 | or:klebsiella pneumoniae pn:mdcg gn:mdcg le:6354 re:7337 di:direct nt:similar to malonyl coa-acyl carrier protein |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG457 | 2625166_c2_147 | 2492 | 8154 | 792 | 264 | 330 | 6.4(10)-30 | Pseudomonas aeruginosa | JQ0133 | hypothetical 26.4k protein - pseudomonas aeruginosa |
| CONTIG457 | 14960906_c2_148 | 2493 | 8155 | 597 | 199 | 882 | 2.0(10)-88 | Escherichia coli | b3351 | [pn:hypothetical nadph oxidoreductase in kitb-prkb intergenic region] [gn:yher] |
| CONTIG457 | 14461081_c3_160 | 2494 | 8156 | 564 | 188 | 537 | 7.4(10)-52 | Erwinia chrysanthemi | X89443 | [GN:ORF3] [DE:E. chrysanthemi DNA for crp gene.] [LE:1200] [RE:1874] [DI:complement] |
| CONTIG457 | 3928590_c3_161 | 2495 | 8157 | 198 | 66 | 145 | 2.6(10)-10 | Erwinia chrysanthemi | X89443 | [GN:ORF3] [DE:E. chrysanthemi DNA for crp gene.] [LE:1200] [RE:1874] [DI:complement] |
| CONTIG457 | 15752042_c3_173 | 2496 | 8158 | 696 | 232 | 643 | 4.2(10)-63 | Klebsiella pneumoniae | U95087 | [PN:MdcG] [GN:mdcG] [FN:involved in formation of the holo-acyl carrier] [DE:Klebsiella pneumoniae malonate decarboxylase gene cluster (mdcA, mdcB, mdcC, mdcD, mdcE, mdcF, mdcG, mdcH, mdcR) genes, complete cds.] [LE:5828] [RE:6445] [DI:d |
| CONTIG458 | 33984378_c3_186 | 2497 | 8159 | 672 | 224 | 742 | 1.3(10)-73 | Escherichia coli | b3349 | [pn:probable fkbp-type peptidyl-prolyl cis-trans isomerase] [gn:slyd] |
| CONTIG458 | 36150466_f1_9 | 2498 | 8160 | 423 | 141 | 320 | 7.2(10)-29 | Escherichia coli | b1926 | [pn:flagellar protein flf] [gn:flf] |
| CONTIG458 | 12601516_f1_16 | 2499 | 8161 | 1713 | 571 | 1997 | 1.3(10)-206 | Escherichia coli | b1938 | [pn:flagellar basal-body m-ring protein] [gn:flfl] |
| CONTIG458 | 2847202_f1_19 | 2500 | 8162 | 1215 | 405 | 430 | 1.0(10)-49 | Escherichia coli | b1943 | [pn:hook-length control protein] [gn:flk] |
| CONTIG458 | 13933302_f1_22 | 2501 | 8163 | 441 | 147 | 267 | 3.0(10)-23 | Escherichia coli | b1947 | [pn:flagellar protein flio] [gn:flio] |
| CONTIG458 | 12362590_f1_24 | 2502 | 8164 | 387 | 129 | 292 | 6.7(10)-26 | Escherichia coli | b1949 | [pn:flagellar biosynthetic protein fliq] [gn:fliq] |
| CONTIG458 | 3166591_f1_25 | 2503 | 8165 | 792 | 264 | 919 | 2.5(10)-92 | Escherichia coli | b1950 | [pn:flagellar biosynthetic protein flir] [gn:flir] |
| CONTIG458 | 4423218_f1_26 | 2504 | 8166 | 633 | 211 | 916 | 5.0(10)-92 | Escherichia coli | b1951 | [pn:colanic acid capsullar biosynthesis activation protein a] [gn:rcsa] |
| CONTIG458 | 3962502_f1_29 | 2505 | 8167 | 927 | 309 | 821 | 6.0(10)-82 | Escherichia coli | b1955 | [pn:hypothetical protein] |
| CONTIG458 | 4100318_f2_42 | 2506 | 8168 | 1422 | 474 | 1613 | 7.0(10)-166 | Escherichia coli | b1924 | [pn:flagellar hook associated protein 2] [gn:flid] |
| CONTIG458 | 33631457_f2_43 | 2507 | 8169 | 438 | 146 | 481 | 6.4(10)-46 | Escherichia coli | b1925 | [pn:flagellar protein flis] [gn:flis] |
| CONTIG458 | 911533_f2_51 | 2508 | 8170 | 1077 | 359 | 1487 | 1.6(10)-152 | Escherichia coli | b1939 | [pn:flagellar motor switch protein flig] [gn:flig] |
| CONTIG458 | 35242718_f2_53 | 2509 | 8171 | 1443 | 481 | 2199 | 5.5(10)-228 | Escherichia coli | b1941 | [pn:flagellum-specific atp synthase] [gn:flii] |
| CONTIG458 | 34620911_f2_54 | 2510 | 8172 | 465 | 155 | 635 | 3.1(10)-62 | Escherichia coli | b1942 | [pn:flagellar flij protein] [gn:flij] |
| CONTIG458 | 35727283_f2_56 | 2511 | 8173 | 528 | 176 | 552 | 1.8(10)-53 | Escherichia coli | b1944 | [pn:flif protein] [gn:flif] |
| CONTIG458 | 22007193_f2_57 | 2512 | 8174 | 426 | 142 | 633 | 5.0(10)-62 | Escherichia coli | b1946 | [pn:flagellar motor switch protein flin] [gn:flin] |
| CONTIG458 | 10015706_f3_74 | 2513 | 8175 | 1560 | 520 | 2350 | 5.5(10)-244 | Escherichia coli | b1927 | [pn:cytoplasmic alpha-amylase] [gn:amya] |
| CONTIG458 | 2669825_f3_78 | 2514 | 8176 | 729 | 243 | 608 | 7.0(10)-71 | Escherichia coli | b1940 | [pn:flagellar assembly protein flh] [gn:flh] |
| CONTIG458 | 2535457_f3_82 | 2515 | 8177 | 1068 | 356 | 1634 | 4.2(10)-168 | Escherichia coli | b1945 | [pn:cg site no. 774] [gn:flm] |
| CONTIG458 | 12397666_f3_84 | 2516 | 8178 | 804 | 268 | 730 | 6.2(10)-72 | Escherichia coli | b1948 | [pn:flagellar biosynthetic protein flip] [gn:flip] |
| CONTIG458 | 32306326_f3_87 | 2517 | 8179 | 258 | 86 | 272 | 9.0(10)-24 | Escherichia coli | b1953 | [pn:hypothetical protein] |
| CONTIG458 | 29359465_c1_93 | 2518 | 8180 | 348 | 116 | 306 | 2.2(10)-27 | Escherichia coli | b1952 | [pn:dsrb protein] [gn:dsrb] |
| CONTIG458 | 4332291_c1_105 | 2519 | 8181 | 309 | 103 | 131 | 7.7(10)-9 | Bacillus subtilis | S14505 | hypothetical protein 12 (flaa operon) - bacillus subtilis |
| CONTIG458 | 21910312_c1_112 | 2520 | 8182 | 336 | 112 | 406 | 5.7(10)-38 | Escherichia coli | b1937 | [pn:flagellar hook-basal body complex protein flie] [gn:flie] |
| CONTIG458 | 4006555_c1_113 | 2521 | 8183 | 489 | 163 | 486 | 1.8(10)-46 | Escherichia coli | b1928 | [pn:hypothetical 15.0 kd protein in amya-flie intergenic region] [gn:yedd] |
| CONTIG458 | 9800156_c1_123 | 2522 | 8184 | 810 | 270 | 1133 | 5.2(10)-115 | Escherichia coli | b1922 | [pn:rna polymerase sigma transcription factor for flagellar operon] [gn:flia] |
| CONTIG458 | 6928936_c1_124 | 2523 | 8185 | 567 | 189 | 718 | 4.9(10)-71 | Escherichia coli | b1921 | [pn:fliz protein] [gn:fliz] |
| CONTIG458 | 20837_c1_125 | 2524 | 8186 | 1059 | 353 | 1369 | 5.0(10)-140 | Escherichia coli | b1919 | [pn:hypothetical protein] |
| CONTIG458 | 33491312_c1_126 | 2525 | 8187 | 690 | 230 | 966 | 2.6(10)-97 | Escherichia coli | b1918 | [pn:yecc] |
| CONTIG458 | 33991554_c2_129 | 2526 | 8188 | 509 | 169 | 528 | 2.6(10)-51 | Escherichia coli | b1956 | [pn:hypothetical protein] |
| CONTIG458 | 24507182_c2_179 | 2527 | 8189 | 1728 | 576 | 2023 | 2.5(10)-209 | Escherichia coli | U47614 | or:escherichia coli pn:flagellin gn:flic le:1 re:1758 di:direct |
| CONTIG458 | 32692516_c3_181 | 2528 | 8190 | 855 | 285 | 1110 | 1.3(10)-112 | Escherichia coli | b1920 | [pn:fliy protein precursor] [gn:fliy] |
| CONTIG458 | 34414030_c3_184 | 2529 | 8191 | 759 | 253 | 1160 | 7.0(10)-118 | Escherichia coli | b1917 | [pn:hypothetical protein] [gn:yecc] |
| CONTIG459 | 3239041_f1_4 | 2530 | 8192 | 444 | 148 | 141 | 6.7(10)-10 | Azospirillum brasilense | X70360 | or:azospirillum brasilense gn:carr1 le:59 re:580 di:direct nt:orf2 |
| CONTIG459 | 26735180_f1_7 | 2531 | 8193 | 933 | 311 | 1015 | 1.7(10)-102 | Haemophilus influenzae | HI0362 | [pn:adhesin b precursor] [gn:fima] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG459 | 24422707_f1_10 | 2532 | 8194 | 1167 | 389 | 635 | 3.1(10)-62 | Haemophilus influenzae | HI0359 | [pn:gb] |
| CONTIG459 | 13163556_f1_12 | 2533 | 8195 | 1380 | 460 | 1480 | 8.8(10)-152 | Escherichia coli | b0585 | [pn:enterochelin esterase] [gn:fes] |
| CONTIG459 | 781658_f1_13 | 2534 | 8196 | 3885 | 1295 | 4972 | 0 | Escherichia coli | b0586 | [pn:enterobactin synthetase component f] [gn:entf] |
| CONTIG459 | 21505208_f2_35 | 2535 | 8197 | 954 | 318 | 669 | 7.5(10)-66 | Haemophilus influenzae | HI0360 | [pn:hydrophobic membrane protein] |
| CONTIG459 | 33875656_f2_42 | 2536 | 8198 | 249 | 83 | 262 | 1.0(10)-22 | Escherichia coli | B31958 | hypothetical 8k protein (fes 3' region) - escherichia coli or azospirillum brasilense gn:carr 1e:<1 re:588 di:direct |
| CONTIG459 | 1425657_f3_61 | 2537 | 8199 | 1521 | 507 | 90 | 0.12 | Acospirillum brasilense | X70360 | |
| CONTIG459 | 5316943_f3_62 | 2538 | 8200 | 2043 | 681 | 3181 | 0 | Escherichia coli | b0314 | [pn:high-affinity choline transport protein] [gn:bett] |
| CONTIG459 | 20318790_f3_63 | 2539 | 8201 | 348 | 116 | 114 | 5.0(10)-7 | Escherichia coli | b3555 | [pn:hypothetical 11.0 kd protein in bisc-cspa intergenic region] |
| CONTIG459 | 12370787_f3_66 | 2540 | 8202 | 948 | 316 | 819 | 9.6(10)-82 | Haemophilus influenzae | HI0361 | [pn:iii dicitrate transport atp-binding protein fece] [gn:fece] |
| CONTIG459 | 6539591_f3_81 | 2541 | 8203 | 354 | 118 | 91 | 0.00129 | Mus musculus | P21952 | octamer-binding transcription factor 6 (oct-6) (pou-domain transcription factor scip). |
| CONTIG459 | 679507_f3_87 | 2542 | 8204 | 1263 | 421 | 1338 | 9.8(10)-137 | Escherichia coli | b0591 | [pn:hypothetical membrane protein p43] [gn:ybda] |
| CONTIG459 | 1054188_c1_91 | 2543 | 8205 | 996 | 332 | 1279 | 1.7(10)-130 | Escherichia coli | b0592 | [pn:ferrienterobactin-binding periplasmic protein precursor] [gn:fepb] |
| CONTIG459 | 31848911_c1_95 | 2544 | 8206 | 1320 | 440 | 1102 | 1.0(10)-111 | Escherichia coli | b0589 | [pn:ferric enterobactin transport protein fepg] [gn:fepg] |
| CONTIG459 | 19538413_c1_115 | 2545 | 8207 | 663 | 221 | 911 | 1.7(10)-91 | Escherichia coli | b0586 | [pn:regulatory protein beti] [gn:beti] |
| CONTIG459 | 5267181_c2_127 | 2546 | 8208 | 1059 | 353 | 1010 | 5.5(10)-102 | Escherichia coli | b0590 | [pn:ferric enterobactin transport protein fepd] [gn:fepd] |
| CONTIG459 | 29979075_c2_146 | 2547 | 8209 | 1593 | 531 | 2240 | 2.6(10)-232 | Escherichia coli | b0312 | [pn:betaine aldehyde dehydrogenase] [gn:betb] |
| CONTIG459 | 16970218_c3_156 | 2548 | 8210 | 720 | 240 | 275 | 4.2(10)-24 | Escherichia coli | P21500 | very hypothetical 18.0 kd protein in fepb 3' region. |
| CONTIG459 | 16270216_c3_161 | 2549 | 8211 | 978 | 326 | 1127 | 2.2(10)-114 | Escherichia coli | b0588 | [pn:ferric enterobactin transport atp-binding protein fepc] [gn:fepc] |
| CONTIG459 | 16219582_c3_162 | 2550 | 8212 | 327 | 109 | 92 | 0.0011 | Nicotiana alata | U88587 | [denicotiana alata 120 kda style glycoprotein (napp5) mma, complete cds.] [pn:120 kda style glycoprotein] [gn:napp5] [tt:style-specific protein possessing features of] |
| CONTIG460 | 24254052_c3_172 | 2551 | 8213 | 2265 | 755 | 2862 | 3.1(10)-298 | Escherichia coli | b0584 | [pn:ferrienterobactin receptor precursor] [gn:fepa] |
| CONTIG460 | 12134390_c3_173 | 2552 | 8214 | 762 | 254 | 465 | 3.2(10)-44 | Escherichia coli | b0583 | [pn:enterobactin synthetase component d] [gn:entd] |
| CONTIG460 | 33678892_c3_184 | 2553 | 8215 | 1722 | 574 | 2774 | 6.5(10)-289 | Escherichia coli | b0311 | [pn:choline dehydrogenase] [gn:beta] |
| CONTIG46 | 25397792_f2_2 | 2554 | 8216 | 435 | 145 | 462 | 6.5(10)-44 | Escherichia coli | b0814 | [pn:outer membrane protein x precursor] [gn:ompx] |
| CONTIG460 | 4392308_f2_11 | 2555 | 8217 | 531 | 177 | 624 | 4.5(10)-61 | Escherichia coli | b3995 | [pn:thic protein] [gn:yjae] |
| CONTIG460 | 13759633_f1_12 | 2556 | 8218 | 1899 | 633 | 3132 | 0 | Escherichia coli | b3994 | [pn:thic protein] [gn:thic] |
| CONTIG460 | 32661541_f1_14 | 2557 | 8219 | 945 | 315 | 799 | 1.3(10)-79 | Escherichia coli | b3992 | [pn:thif] |
| CONTIG460 | 35267665_f1_19 | 2558 | 8220 | 357 | 119 | 189 | 5.5(10)-15 | Bacillus subtilis | licA | [pn:phosphotransferase system] [gn:celc] |
| CONTIG460 | 16510407_f2_52 | 2559 | 8221 | 237 | 79 | 173 | 2.7(10)-13 | Escherichia coli | S77700 | [PN:thiG1 protein] |
| CONTIG460 | 13073963_f2_53 | 2560 | 8222 | 1800 | 600 | 1706 | 9.9(10)-176 | Escherichia coli | b3990 | [pn:thih protein] [gn:thih] |
| CONTIG460 | 1019027_f2_54 | 2561 | 8223 | 1656 | 552 | 245 | 3.8(10)-20 | Escherichia coli | b1535 | [pn:ydeh] |
| CONTIG460 | 24256925_f2_55 | 2562 | 8224 | 342 | 114 | 219 | 3.7(10)-18 | Bacillus subtilis | ydhM | [pn:hypothetical protein] |
| CONTIG460 | 10199957_f3_65 | 2563 | 8225 | 1734 | 578 | 2535 | 1.3(10)-263 | Escherichia coli | b4006 | [pn:phosphoribosylaminoimidazolecarboxamide formyltransferase and imp cyclohydrolase] |
| CONTIG460 | 22869525_f3_66 | 2564 | 8226 | 1308 | 436 | 2030 | 4.5(10)-210 | Escherichia coli | b4005 | [pn:phosphoribosylglycineamide synthetase] [gn:purd] |
| CONTIG460 | 35339517_f3_74 | 2565 | 8227 | 717 | 239 | 899 | 3.2(10)-90 | Escherichia coli | b3993 | [pn:thie protein] [gn:thie] |
| CONTIG460 | 32245792_f3_77 | 2566 | 8228 | 885 | 295 | 1226 | 7.2(10)-125 | Escherichia coli | b3991 | [pn:thig protein] [gn:thig] |
| CONTIG460 | 24647902_c1_92 | 2567 | 8229 | 4167 | 1389 | 6740 | 0 | Escherichia coli | b3987 | [pn:dna-directed rna polymerase, beta-subunit] [gn:rpob] |
| CONTIG460 | 31291250_c1_112 | 2568 | 8230 | 612 | 204 | 886 | 7.7(10)-89 | Escherichia coli | b3999 | [pn:hypothetical 22.6 kd protein in heme-hupa intergenic region] [gn:yjag] |
| CONTIG460 | 24025251_c1_113 | 2569 | 8231 | 276 | 92 | 424 | 7.0(10)-40 | Escherichia coli | b4000 | [pn:histonelike dna-binding protein hu-alpha] [gn:hupa] |
| CONTIG460 | 16525791_c2_126 | 2570 | 8232 | 4266 | 1422 | 6482 | 0 | Escherichia coli | b3988 | [pn:dna-directed rna polymerase, beta""-subunit] [gn:rpoc] |
| CONTIG460 | 16219716_c2_140 | 2571 | 8233 | 1092 | 364 | 1701 | 3.2(10)-175 | Escherichia coli | b3997 | [pn:uroporphyrinogen decarboxylase] [gn:heme] |
| CONTIG460 | 3962943_c2_141 | 2572 | 8234 | 681 | 227 | 1077 | 4.4(10)-109 | Escherichia coli | b3998 | [pn:hypothetical 24.9 kd protein in heme-hupa intergenic region] [gn:yjaf] |
| CONTIG460 | 13792203_c3_147 | 2573 | 8235 | 258 | 86 | 382 | 2.0(10)-35 | Escherichia coli | b3985 | [pn:50s ribosomal subunit protein 110] [gn:rpli] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG460 | 14094452_c3_148 | 2574 | 8236 | 366 | 122 | 372 | 2.2(10)-34 | Escherichia coli | b3986 | [pn:50s ribosomal subunit protein 17/112] [gn:rpll] |
| CONTIG460 | 33492292_c3_162 | 2575 | 8237 | 795 | 265 | 1160 | 7.0(10)-118 | Escherichia coli | b3996 | [pn:hypothetical 29.8 kd protein in thic-hemc intergenic region] [gn:yjad] |
| CONTIG460 | 6508428_c3_168 | 2576 | 8238 | 708 | 236 | 906 | 5.9(10)-91 | Escherichia coli | b4001 | [pn:hypothetical 26.3 kd protein in hupa-hydh intergenic region] [gn:yjah] |
| CONTIG461 | 36428933_f1_16 | 2577 | 8239 | 897 | 299 | 944 | 5.5(10)-95 | Escherichia coli | b0826 | [pn:molybdopterin biosynthesis moeb protein] [gn:moeb] |
| CONTIG461 | 24120405_f1_19 | 2578 | 8240 | 915 | 305 | 1322 | 4.7(10)-135 | Escherichia coli | b0824 | [pn:hypothetical protein] |
| CONTIG461 | 26041332_f1_31 | 2579 | 8241 | 2403 | 801 | 560 | 2.7(10)-52 | Saccharomyces cerevisiae | YBR229C | [pn:glucosidase ii, catalytic subunit] [gn:rot2] |
| CONTIG461 | 24103381_f2_39 | 2580 | 8242 | 1329 | 443 | 2083 | 1.1(10)-215 | Escherichia coli | b0835 | [pn:hypothetical protein] [gn:ylig] |
| CONTIG461 | 32229531_f2_40 | 2581 | 8243 | 555 | 185 | 101 | 0.00072 | Streptococcus pneumoniae | L29323 | or:streptococcus pneumoniae pn:methyl transferase le:508 re:1125 di:complement sr:transposon tn5252 dna; and streptococcus pneumoniae (strain sp1000 nt:member of the mtr gene cluster; putative |
| CONTIG461 | 19633331_f2_50 | 2582 | 8244 | 1173 | 391 | 1531 | 3.5(10)-157 | Escherichia coli | b0823 | [pn:hypothetical protein] |
| CONTIG461 | 11845627_f2_52 | 2583 | 8245 | 879 | 293 | 1168 | 1.0(10)-118 | Escherichia coli | b0822 | [pn:hypothetical protein] |
| CONTIG461 | 2540786_f2_57 | 2584 | 8246 | 1347 | 449 | 923 | 9.3(10)-93 | Escherichia coli | b3093 | [pn:hexuronate transporter] [gn:exut] |
| CONTIG461 | 24620452_f2_61 | 2585 | 8247 | 1236 | 412 | 161 | 7.7(10)-10 | Pseudomonas aeruginosa | JQ0133 | hypothetical 26.4k protein - pseudomonas aeruginosa |
| CONTIG461 | 287575_f3_64 | 2586 | 8248 | 690 | 230 | 837 | 1.2(10)-83 | Escherichia coli | b0838 | [pn:hypothetical protein] |
| CONTIG461 | 9770206_f3_77 | 2587 | 8249 | 1287 | 429 | 1701 | 3.2(10)-175 | Escherichia coli | b0827 | [pn:molybdopterin biosynthesis moea protein] [gn:moea] |
| CONTIG461 | 16101557_f3_81 | 2588 | 8250 | 1455 | 485 | 2307 | 2.0(10)-239 | Escherichia coli | b0823 | [pn:hypothetical protein] |
| CONTIG461 | 2734432_f3_82 | 2589 | 8251 | 1293 | 431 | 1983 | 4.4(10)-205 | Escherichia coli | b0821 | [pn:hypothetical protein] |
| CONTIG461 | 22949052_c1_113 | 2590 | 8252 | 1887 | 629 | 2443 | 7.9(10)-254 | Escherichia coli | b0829 | [pn:hypothetical protein] |
| CONTIG461 | 16832768_c1_118 | 2591 | 8253 | 414 | 138 | 358 | 6.9(10)-33 | Escherichia coli | b0836 | [pn:hypothetical protein] |
| CONTIG461 | 23573328_c2_137 | 2592 | 8254 | 690 | 230 | 955 | 3.7(10)-96 | Escherichia coli | b0825 | [pn:hypothetical protein] |
| CONTIG461 | 34414165_c2_142 | 2593 | 8255 | 945 | 315 | 1234 | 1.0(10)-125 | Escherichia coli | b0828 | [pn:hypothetical protein in moea-grxa intergenic region] [gn:yebi] |
| CONTIG461 | 23446041_c2_147 | 2594 | 8256 | 942 | 314 | 1292 | 7.2(10)-132 | Escherichia coli | b0831 | [pn:hypothetical protein] |
| CONTIG461 | 22146880_c2_151 | 2595 | 8257 | 1152 | 384 | 1539 | 4.9(10)-158 | Escherichia coli | b0837 | [pn:hypothetical protein] |
| CONTIG461 | 13704165_c2_153 | 2596 | 8258 | 345 | 115 | 248 | 5.9(10)-21 | Escherichia coli | b0839 | [pn:penicillin-binding protein 6 precursor] [gn:dacc] |
| CONTIG461 | 19583290_c3_154 | 2597 | 8259 | 1632 | 544 | 2615 | 4.7(10)-272 | Escherichia coli | b0820 | [pn:hypothetical protein] |
| CONTIG461 | 20179036_c3_164 | 2598 | 8260 | 1125 | 375 | 244 | 8.5(10)-20 | Escherichia coli | b3934 | [pn:transcriptional repressor cytr] [gn:cytr] |
| CONTIG461 | 31730393_c3_180 | 2599 | 8261 | 1623 | 541 | 2250 | 2.2(10)-233 | Escherichia coli | b0830 | [pn:hypothetical protein] |
| CONTIG461 | 30511340_c3_182 | 2600 | 8262 | 963 | 321 | 1247 | 4.2(10)-127 | Escherichia coli | b0832 | [pn:hypothetical protein] |
| CONTIG461 | 15132125_f1_2 | 2601 | 8263 | 828 | 276 | 907 | 4.5(10)-91 | Escherichia coli | b1859 | [pn:hypothetical 27.8 kd protein in msbb-ruvb intergenic region] [gn:yebj] |
| CONTIG462 | 24330036_f1_10 | 2602 | 8264 | 300 | 100 | 325 | 2.2(10)-29 | Salmonella typhimurium | Q56031 | virulence protein msga. |
| CONTIG462 | 14879752_f1_33 | 2603 | 8265 | 762 | 254 | 1110 | 1.3(10)-112 | Escherichia coli | b1858 | [pn:hypothetical protein] [gn:yebm] |
| CONTIG462 | 21677187_f3_66 | 2604 | 8266 | 594 | 198 | 794 | 4.2(10)-79 | Escherichia coli | b1867 | [pn:hypothetical 21.8 kd protein in asps 5'''' region] [gn:yecd] |
| CONTIG462 | 35604677_f3_68 | 2605 | 8267 | 822 | 274 | 155 | 7.7(10)-10 | Bacteriophage M1 | P08231 | tail fiber protein gp37 (fragment). |
| CONTIG462 | 36125431_f3_71 | 2606 | 8268 | 216 | 72 | 93 | 8.3(10)-5 | Bacteriophage phi-80 | P17651 | adsorption-inhibiting cor protein. |
| CONTIG462 | 22163441_c1_92 | 2607 | 8269 | 396 | 132 | 156 | 1.8(10)-11 | Bacteriophage lambda | P03737 | minor tail protein m. |
| CONTIG462 | 6062568_c1_94 | 2608 | 8270 | 597 | 199 | 198 | 6.2(10)-16 | Yersinia pestis | AF053947 | [de:yersinia pestis plasmid pmt1, complete plasmid sequence] [pn:unknown] |
| CONTIG462 | 34574067_c1_103 | 2609 | 8271 | 465 | 155 | 685 | 1.5(10)-67 | Escherichia coli | b1865 | [pn:datp pyrophosphohydrolase] [gn:ntpa] |
| CONTIG462 | 5208563_c1_104 | 2610 | 8272 | 768 | 256 | 1208 | 5.7(10)-123 | Escherichia coli | b1864 | [pn:hypothetical 26.4 kd protein in nuvc-asps intergenic region] [gn:yebc] |
| CONTIG462 | 24430416_c1_106 | 2611 | 8273 | 870 | 290 | 810 | 8.6(10)-81 | Escherichia coli | b1861 | [pn:holliday junction dna helicase ruva] [gn:ruva] |
| CONTIG462 | 116702_c2_110 | 2612 | 8274 | 3492 | 1164 | 228 | 8.5(10)-18 | Salmonella typhimurium | AF007380 | [PN:lambda phage H tail component homolog] [DE:Salmonella typhimurium lambda phage K tail component homolog gene, partial |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG462 | 1063557_c2_111 | 2613 | 8275 | 762 | 254 | 434 | 6.0(10)-41 | *Coxiella burnetii* | Y15898 | cds, lambda phage L tail component homolog, copper-zincsuperoxide dismutase (sodC), attachment and invasion prote [de:*coxiella burnetii* plasmid qprs dna] [pn:hypothetical protein] [gn:orf248] |
| CONTIG462 | 26966_c2_113 | 2614 | 8276 | 3873 | 1291 | 1007 | 4.4(10)-101 | *Yersinia pestis* | AF053947 | [de:*yersinia pestis* plasmid pmt1, complete plasmid sequence.] [pn:phage lambda host specific protein j] |
| CONTIG462 | 33828125_c2_120 | 2615 | 8277 | 606 | 202 | 736 | 6.0(10)-73 | *Escherichia coli* | b1158 | [pn:dna-invertase pin] [gn:pin] |
| CONTIG462 | 33752027_c2_125 | 2616 | 8278 | 543 | 181 | 750 | 2.0(10)-74 | *Escherichia coli* | b1863 | [pn:crossover junction endodeoxyribonuclease ruvc] [gn:ruvc] |
| CONTIG462 | 31875053_c2_129 | 2617 | 8279 | 477 | 159 | 442 | 8.6(10)-42 | *Escherichia coli* | b1857 | [pn:31.1 kd protein in msbb-ruvb intergenic region] [gn:yebl] |
| CONTIG462 | 3393908_c3_137 | 2618 | 8280 | 855 | 285 | 319 | 9.4(10)-29 | *Yersinia pestis* | AF053947 | [de:*yersinia pestis* plasmid pmt1, complete plasmid sequence.] [pn:phage lambda minor tail protein 1 homolog] |
| CONTIG462 | 22541631_c3_148 | 2619 | 8281 | 1821 | 607 | 2868 | 7.2(10)-299 | *Escherichia coli* | b1866 | [pn:aspartyl-trna synthetase] [gn:asps] |
| CONTIG462 | 25431592_c3_149 | 2620 | 8282 | 1014 | 338 | 1623 | 6.2(10)-167 | *Escherichia coli* | b1860 | [pn:holliday junction dna helicase ruvb] [gn:ruvb] |
| CONTIG463 | 32605317_f1_1 | 2621 | 8283 | 591 | 197 | 428 | 2.6(10)-40 | *Shigella flexneri* | P20102 | mercuric resistance protein merd |
| CONTIG463 | 4788505_f1_3 | 2622 | 8284 | 1323 | 441 | 1941 | 1.2(10)-200 | *Pseudomonas aeruginosa* | U49101 | or:*pseudomonas aeruginosa* pn:tnia gn:tnia le:6735 re:8450 |
| CONTIG463 | 13162887_f1_4 | 2623 | 8285 | 495 | 165 | 675 | 1.8(10)-66 | *Klebsiella pneumoniae* | S32177 | transposase - *klebsiella pneumoniae* |
| CONTIG463 | 12111286_f1_9 | 2624 | 8286 | 1563 | 521 | 2589 | 2.7(10)-269 | *Pseudomonas aeruginosa* | Q57541 | transposase for insertion sequences is1326/is1353. |
| CONTIG463 | 24644811_f1_15 | 2625 | 8287 | 1020 | 340 | 1583 | 1.1(10)-162 | *Corynebacterium glutamicum* | Y14748 | [de:*corynebacterium glutamicum* plasmid pcg4 integron (incg) sequence.] [gn:int] |
| CONTIG463 | 26614682_f2_25 | 2626 | 8288 | 510 | 170 | 810 | 8.6(10)-81 | *Escherichia coli* | L29404 | or:*escherichia coli* pn:mercuric reductase gn:mera le:<1 re:663 di:direct sr:*escherichia coli* (strain dh1) dna nt:putative |
| CONTIG463 | 16141561_f2_27 | 2627 | 8289 | 927 | 309 | 1060 | 2.7(10)-107 | *Escherichia coli* | L29404 | or:*escherichia coli* le:1273 re:1980 di:direct sr:*escherichia coli* (strain dh1) dna nt:urf2; putative |
| CONTIG463 | 11891882_f2_29 | 2628 | 8290 | 738 | 246 | 1268 | 2.6(10)-129 | *Salmonella ordonez* | S34451 | hypothetical protein (insertion sequence is261)-*salmonella ordonez* plasmid pip173 |
| CONTIG463 | 24500431_f2_32 | 2629 | 8291 | 276 | 92 | 269 | 7.2(10)-23 | *Klebsiella pneumoniae* | S32179 | hypothetical protein 6 - *klebsiella pneumoniae* |
| CONTIG463 | 30494567_f2_37 | 2630 | 8292 | 204 | 68 | 111 | 5.7(10)-6 | *Ralstonia eutropha* | D64144 | or:*ralstonia eutropha* le:777 re:1793 di:direct sr:alcaligenes eutrophus (strain:nh9) plasmid:penh91 dna nt:orfa2 |
| CONTIG463 | 4401693_f2_39 | 2631 | 8293 | 795 | 265 | 1327 | 1.3(10)-135 | Insertion sequence IS1326 | U38187 | or:insertion sequence is1326 pn:istb le:1618 re:2403 di:direct nt:contains ntp binding domain motifs |
| CONTIG463 | 2838312_f2_44 | 2632 | 8294 | 348 | 116 | 258 | 2.7(10)-22 | *Citrobacter freundii* | Z54241 | or:*citrobacter freundii* pn:dna integrase gn:int le:<1 re:285 di:complement |
| CONTIG463 | 21667626_f2_49 | 2633 | 8295 | 3024 | 1008 | 4907 | 0 | *Escherichia coli* | P13694 | transposase for transposon tn3926. |
| CONTIG463 | 135818_f2_50 | 2634 | 8296 | 1032 | 344 | 1554 | 1.3(10)-159 | *Enterobacter aerogenes* | U67194 | or:*enterobacter aerogenes* pn:tnpa gn:tnpa le:10303 re:11307 di:complement |
| CONTIG463 | 25683166_f3_52 | 2635 | 8297 | 561 | 187 | 326 | 1.7(10)-29 | *Escherichia coli* | L29404 | or:*escherichia coli* le:1040 re:1276 di:direct sr:*escherichia coli* (strain dh1) dna nt:urf1; putative |
| CONTIG463 | 16462943_f3_57 | 2636 | 8298 | 873 | 291 | 1197 | 8.5(10)-122 | *Pseudomonas aeruginosa* | U49101 | or:*pseudomonas aeruginosa* pn:tnibdelta] [gn:tnibdelta] le:5872 re:6732 di:complement nt:truncated version of tnib found in tn402, embl |
| CONTIG463 | 9929075_f3_70 | 2637 | 8299 | 618 | 206 | 838 | 9.4(10)-84 | *Enterobacter cloacae* | Y09025 | resolvase family recombinase,, tnpr, |
| CONTIG463 | 35629583_c1_84 | 2638 | 8300 | 435 | 145 | 708 | 5.5(10)-70 | *Escherichia coli* | P10017 | hypothetical 14.4 kd protein (orf1). |
| CONTIG463 | 12398261_c1_85 | 2639 | 8301 | 447 | 149 | 667 | 1.2(10)-65 | *Escherichia coli* | P10018 | hypothetical 14.7 kd protein (orf2). |
| CONTIG463 | 3416040_c1_87 | 2640 | 8302 | 930 | 310 | 1401 | 2.1(10)-143 | *Mycobacterium fortuitum* | S10928 | dihydropteroate synthase (ec 2.5.1.15) - *mycobacterium fortuitum* transposon tn610 |
| CONTIG463 | 10415891_c2_110 | 2641 | 8303 | 753 | 251 | 1335 | 2.0(10)-136 | unidentified bacterium | X04555 | or:unidentified bacterium sp.p10019 le:1080 re:1829 di:direct nt:aad(2) (aa 1–249) |
| CONTIG463 | 4723833_c2_111 | 2642 | 8304 | 387 | 129 | 581 | 1.6(10)-56 | Plasmid pDGO100 | L06418 | or:plasmid pdgo100 pn:quaternary ammonium compound-resistance protein gn:suli le:1986 re:2333 di:direct sr:plasmid |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG463 | 7050966_c2_113 | 2643 | 8305 | 603 | 201 | 889 | 3.7(10)-89 | Pseudomonas aeruginosa | U12338 | pdgo100 (clone: integron in7) dna nt:orf4; putative or:pseudomonas aeruginosa pn:unknown le:6192 re:6692 di:direct nt:orf5 |
| CONTIG463 | 36520917_c2_123 | 2644 | 8306 | 411 | 137 | 151 | 5.9(10)-11 | Xanthomonas sp. | S32799 | hypothetical protein 1 -xanthomonas sp. transposon tn5053 (fragment) |
| CONTIG463 | 33332337_c2_124 | 2645 | 8307 | 204 | 68 | 187 | 9.0(10)-15 | Xanthomonas sp. | S32799 | hypothetical protein 1 -xanthomonas sp. transposon tn5053 (fragment) |
| CONTIG463 | 10582283_c2_125 | 2646 | 8308 | 210 | 70 | 94 | 0.00013 | Xanthomonas sp. | S32799 | hypothetical protein 1 -xanthomonas sp. transposon tn5053 (fragment) |
| CONTIG463 | 2660405_c2_128 | 2647 | 8309 | 477 | 159 | 90 | 0.00519 | Mycobacterium tuberculosis | AL009198 | [de:mycobacterium tuberculosis sequence v004.] [pn:pgrs-family protein] [gn:mtv004.01c] [nt:mtv004.01c, member of the m. tuberculosis pgrs] |
| CONTIG463 | 10970768_c3_130 | 2648 | 8310 | 411 | 137 | 374 | 1.3(10)-34 | Escherichia coli | b2669 | [pn:dna-binding protein stpa] [gn:stpa] |
| CONTIG463 | 9931525_c3_151 | 2649 | 8311 | 1548 | 516 | 1540 | 3.7(10)-158 | Insertion sequence IS1353 | U40482 | or:insertion sequence is1353 le:671 re:1585 di:direct nt:orb; possible alternate start site at nt 686 |
| CONTIG463 | 21666540_c3_154 | 2650 | 8312 | 714 | 238 | 1128 | 1.8(10)-114 | Transposon Tn1525 | M12900 | or:transposon tn1525 gn:p12 le:996 re:>1721 di:direct sr:transposon tn1525 dna nt:putative |
| CONTIG464 | 4333406_f1_3 | 2651 | 8313 | 1233 | 411 | 94 | 0.33 | Gallus gallus | D88828 | [de:gallus gallus mrna for chicken rabaptin-5, complete cds.] [pn:chicken rabaptin-5] |
| CONTIG464 | 4329843_f1_4 | 2652 | 8314 | 651 | 217 | 991 | 5.7(10)-100 | Plasmid R478 | U49054 | or:plasmid r478 pn:terx gn:terx le:1800 re:2441 di:direct nt:shows similarity to r478 terz, terd, and tere |
| CONTIG464 | 3912918_f2_16 | 2653 | 8315 | 1152 | 384 | 873 | 1.8(10)-87 | Serratia marcescens | U59239 | or:serratia marcescens is5 le:820 re:1413 di:complement nt:orf3 |
| CONTIG464 | 568791_f2_29 | 2654 | 8316 | 186 | 62 | 279 | 1.6(10)-24 | Escherichia coli | b3503 | [pn:arsenate reductase] [gn:arsc] |
| CONTIG464 | 30157255_f2_31 | 2655 | 8317 | 279 | 93 | 99 | 0.00012 | Escherichia coli | U95365 | transposase,, is5b, |
| CONTIG464 | 26770126_f3_35 | 2656 | 8318 | 1191 | 397 | 810 | 8.6(10)-81 | Serratia marcescens | U59239 | or:serratia marcescens le:<1 re:715 di:complement nt:orf4 |
| CONTIG464 | 33402312_f3_36 | 2657 | 8319 | 1035 | 345 | 100 | 0.01499 | Haemophilus influenzae | HI0023 | [pn:citrate lyase beta chain] [gn:citc] |
| CONTIG464 | 12297782_f3_37 | 2658 | 8320 | 501 | 167 | 666 | 1.6(10)-65 | Plasmid R478 | U49054 | or:plasmid r478 pn:tery gn:tery le:205 re:672 di:direct |
| CONTIG464 | 2140678_f3_38 | 2659 | 8321 | 747 | 249 | 944 | 5.5(10)-95 | Plasmid R478 | U49054 | or:plasmid r478 pn:tery gn:tery le:1184 re:1777 di:direct |
| CONTIG464 | 4956283_f3_39 | 2660 | 8322 | 687 | 229 | 373 | 1.8(10)-34 | Plasmid R478 | U49054 | or:plasmid r478 pn:tery gn:tery le:1184 re:1777 di:direct |
| CONTIG464 | 34194711_f3_40 | 2661 | 8323 | 1125 | 375 | 195 | 4.2(10)-15 | Escherichia coli | b2073 | [pn:hypothetical protein] |
| CONTIG464 | 672833_f3_43 | 2662 | 8324 | 1590 | 530 | 114 | 0.0014 | Saccharomyces cerevisiae | YKL166C | [pn:camp-dependent protein kinase 3, catalytic chain] [gn:tpk3] |
| CONTIG464 | 4339135_f3_47 | 2663 | 8325 | 1026 | 342 | 1684 | 2.1(10)-173 | Escherichia coli | b1370 | [pn:insertion element is5 hypothetical protein] [gn:yi52_5] |
| CONTIG464 | 35212692_c1_54 | 2664 | 8326 | 1236 | 412 | 679 | 6.7(10)-67 | Escherichia coli | b1650 | [pn:hypothetical protein] [gn:nema] |
| CONTIG464 | 10563465_c1_59 | 2665 | 8327 | 420 | 140 | 102 | 9.3(10)-6 | Escherichia coli | b2861 | [pn:insertion element is2 hypothetical 13.4 kd protein] |
| CONTIG464 | 24783465_c2_79 | 2666 | 8328 | 786 | 262 | 315 | 1.5(10)-28 | Bacillus subtilis | ykvO | [pn:hypothetical protein] |
| CONTIG464 | 21775383_c2_82 | 2667 | 8329 | 300 | 100 | 446 | 3.2(10)-42 | Escherichia coli | D90774 | or:escherichia coli gn:is5 le:13994 re:14362 di:direct sr:escherichia coli (strain:k12) dna, clone_lib:kohara lambda mini:se nt.orf_id:o263#20; similar to [swissprot accession |
| CONTIG464 | 22458580_c2_83 | 2668 | 8330 | 384 | 128 | 490 | 7.0(10)-47 | Escherichia coli | b1371 | [pn:hypothetical protein] |
| CONTIG464 | 3940943_c3_106 | 2669 | 8331 | 711 | 237 | 90 | 0.05299 | Pseudomonas syringae | AF036929 | [de:pseudomonas syringae disulfide oxidoreductase (dsba) gene, complete cds.] [pn:disulfide oxidoreductase] [gn:dsba] [nt:dsba] |
| CONTIG465 | 10411407_c3_108 | 2670 | 8332 | 483 | 161 | 298 | 1.6(10)-26 | Rhizobium sp. | S34667 | hypothetical protein 140 - rhizobium sp. |
| CONTIG465 | 25572937_c3_109 | 2671 | 8333 | 1623 | 541 | 759 | 2.2(10)-75 | Rhizobium sp. | P50360 | hypothetical protein 29.3 kd protein in region 2 of sym plasmid (no1265). |
| CONTIG465 | 22837807_f1_36 | 2672 | 8334 | 828 | 276 | 1294 | 4.5(10)-132 | Escherichia coli | b0166 | [pn:2,3,4,5-tetrahydropyridine-2-carboxylate n-succinyltransferase] |
| CONTIG465 | 35971925_f1_37 | 2673 | 8335 | 423 | 141 | 640 | 9.0(10)-63 | Escherichia coli | b0163 | [pn:hypothetical 15.1 kd protein in lrta-dapd intergenic region] |
| CONTIG465 | 34256578_f2_78 | 2674 | 8336 | 2742 | 914 | 4041 | 0 | Escherichia coli | b0167 | [pn:uridylyltransferase] [gn:glnd] |
| CONTIG465 | 33407706_f2_87 | 2675 | 8337 | 747 | 249 | 1114 | 5.2(10)-113 | Escherichia coli | b0159 | [pn:pfs protein] [gn:pfs] |
| CONTIG465 | 13067707_f2_89 | 2676 | 8338 | 723 | 241 | 886 | 7.7(10)-89 | Escherichia coli | b0157 | [pn:hypothetical protein in heml-pfs intergenic region] [gn:yadh] |
| CONTIG465 | 24470635_f3_124 | 2677 | 8339 | 831 | 277 | 1239 | 3.0(10)-126 | Escherichia coli | b0168 | [pn:methionine aminopeptidase] [gn:map] |
| CONTIG465 | 12698840_f3_131 | 2678 | 8340 | 840 | 280 | 1023 | 2.2(10)-103 | Escherichia coli | b0158 | [pn:hypothetical 29.4 kd protein in heml-pfs intergenic region] [gn:yaeh] |
| CONTIG465 | 35625650_c1_134 | 2679 | 8341 | 360 | 120 | 403 | 1.2(10)-37 | Escherichia coli | b0155 | [pn:hypothetical protein in heml-pfs intergenic region] [gn:yadq] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG465 | 22773593_c1_141 | 2680 | 8342 | 1545 | 515 | 2268 | 2.7(10)-235 | Escherichia coli | b0160 | [pn:deoxyguanosinetriphosphate triphosphohydrolase] [gn:dgt] |
| CONTIG465 | 25476662_c1_142 | 2681 | 8343 | 1491 | 497 | 1973 | 5.0(10)-204 | Escherichia coli | b0161 | [pn:heat shock protein htra] [gn:htra] |
| CONTIG465 | 26735086_c1_151 | 2682 | 8344 | 648 | 216 | 651 | 6.2(10)-64 | Escherichia coli | b0171 | [pn:uridine 5''''-monophosphate kinase] [gn:pyrh] |
| CONTIG465 | 9776538_c1_152 | 2683 | 8345 | 582 | 194 | 769 | 1.8(10)-76 | Escherichia coli | b0172 | [pn:ribosome recycling factor] [gn:frr] |
| CONTIG465 | 31797711_c1_154 | 2684 | 8346 | 1428 | 476 | 1850 | 5.4(10)-191 | Escherichia coli | b0176 | [pn:hypothetical protein in cdsa 3'''' region] [gn:yael] |
| CONTIG465 | 31445208_c1_155 | 2685 | 8347 | 585 | 195 | 689 | 5.7(10)-68 | Escherichia coli | b0180 | [pn:3-hydroxymyristol acyl carrier protein dehydrase] [gn:fabz] |
| CONTIG465 | 25431660_c1_156 | 2686 | 8348 | 792 | 264 | 1258 | 2.8(10)-128 | Escherichia coli | b0181 | [pn:udp-n-acetylglucosamine o-acyltransferase] [gn:lpxa] |
| CONTIG465 | 26822803_c1_159 | 2687 | 8349 | 3501 | 1167 | 5547 | 0 | Escherichia coli | b0184 | [pn:dna polymerase iii, alpha chain] [gn:dnae] |
| CONTIG465 | 13870910_c1_160 | 2688 | 8350 | 972 | 324 | 1391 | 2.3(10)-142 | Escherichia coli | b0185 | [pn:acetyl-coenzyme a carboxylase carboxyl transferase subunit alpha] [gn:acca] |
| CONTIG465 | 20885086_c2_163 | 2689 | 8351 | 372 | 124 | 480 | 8.0(10)-46 | Escherichia coli | b0156 | [pn:hypothetical 12.1 kd protein in heml-pfs intergenic region] [gn:yadr] |
| CONTIG465 | 32074135_c2_177 | 2690 | 8352 | 777 | 259 | 1210 | 3.6(10)-123 | Escherichia coli | b0169 | [pn:30s ribosomal protein s2] [gn:rpsb] |
| CONTIG465 | 22011677_c2_178 | 2691 | 8353 | 936 | 312 | 1253 | 9.9(10)-128 | Escherichia coli | b0170 | [pn:elongation factor ts] [gn:tsf] |
| CONTIG465 | 12985030_c2_179 | 2692 | 8354 | 330 | 110 | 438 | 2.2(10)-41 | Escherichia coli | b0171 | [pn:uridine 5''''-monophosphate kinase] [gn:pyrh] |
| CONTIG465 | 3958312_c2_181 | 2693 | 8355 | 768 | 256 | 1206 | 9.5(10)-123 | Escherichia coli | b0174 | [pn:hypothetical protein] [gn:yaes] |
| CONTIG465 | 24634376_c2_182 | 2694 | 8356 | 861 | 287 | 1074 | 9.1(10)-109 | Escherichia coli | b0175 | [pn:phosphatidate cytidylyltransferase] [gn:cdsa] |
| CONTIG465 | 4534813_c2_184 | 2695 | 8357 | 1449 | 483 | 2171 | 5.2(10)-225 | Escherichia coli | b0177 | [pn:hypothetical protein] [gn:yaet] |
| CONTIG465 | 25441525_c2_185 | 2696 | 8358 | 1002 | 334 | 1484 | 3.2(10)-152 | Escherichia coli | b0178 | [pn:hypothetical protein] [gn:yaet] |
| CONTIG465 | 2595412_c2_186 | 2697 | 8359 | 561 | 187 | 605 | 4.5(10)-59 | Escherichia coli | b0178 | [pn:histone-like protein hlp-1 precursor] [gn:hlpa] |
| CONTIG465 | 9869053_c2_187 | 2698 | 8360 | 1029 | 343 | 1513 | 2.7(10)-155 | Escherichia coli | b0179 | [pn:udp-3-o-3-hydroxymyristoyl glucosamine n-acyltransferase] [gn:lpxd] |
| CONTIG465 | 31927308_c2_189 | 2699 | 8361 | 630 | 210 | 927 | 3.5(10)-93 | Escherichia coli | b0183 | [pn:ribonuclease hiii] [gn:rnhb] |
| CONTIG465 | 4494032_c2_193 | 2700 | 8362 | 2136 | 712 | 3424 | 0 | Escherichia coli | b0186 | [pn:lysine decarboxylase] [gn:ldcc] |
| CONTIG465 | 14664812_c2_194 | 2701 | 8363 | 402 | 134 | 538 | 5.7(10)-52 | Escherichia coli | b0187 | [pn:hypothetical protein] |
| CONTIG465 | 12114076_c3_202 | 2702 | 8364 | 1200 | 400 | 1846 | 1.3(10)-190 | Escherichia coli | b0162 | [pn:hypothetical 44.3 kd protein in htra-dapd intergenic region] [gn:yaeg] |
| CONTIG465 | 33603957_c3_210 | 2703 | 8365 | 1272 | 424 | 1767 | 3.3(10)-182 | Escherichia coli | b0173 | [pn:hypothetical protein in frr 3'''' region] [gn:yaem] |
| CONTIG465 | 12300082_c3_219 | 2704 | 8366 | 1176 | 392 | 1661 | 5.7(10)-171 | Escherichia coli | b0182 | [pn:lipid-a-disaccharide synthase] [gn:lpxb] |
| CONTIG465 | 14875750_c3_225 | 2705 | 8367 | 1077 | 359 | 1052 | 2.0(10)-106 | Escherichia coli | b0188 | [pn:cell cycle protein mesj] [gn:mesj] |
| CONTIG466 | 4792812_f1_1 | 2706 | 8368 | 273 | 91 | 426 | 4.2(10)-40 | Escherichia coli | b3704 | [pn:rnase p, protein component] [gn:rnpa] |
| CONTIG466 | 2567628_f1_2 | 2707 | 8369 | 1137 | 379 | 1798 | 1.8(10)-185 | Escherichia coli | b3705 | [pn:60 kd protein] [gn:thdf] |
| CONTIG466 | 14586582_f1_3 | 2708 | 8370 | 1377 | 459 | 2050 | 3.5(10)-212 | Escherichia coli | b3706 | [pn:50 kd protein] [gn:thdf] |
| CONTIG466 | 4697650_f1_4 | 2709 | 8371 | 1287 | 429 | 1260 | 1.8(10)-128 | Escherichia coli | b3710 | [pn:hypothetical 41.5 kd protein in tnab 3''' region] [gn:yidy] |
| CONTIG466 | 14954081_f1_5 | 2710 | 8372 | 777 | 259 | 802 | 6.2(10)-80 | Escherichia coli | b3712 | [pn:hypothetical 28.0 kd protein in tnab-bglb intergenic region] [gn:yidy] |
| CONTIG466 | 36503539_f1_6 | 2711 | 8373 | 603 | 201 | 867 | 8.0(10)-87 | Escherichia coli | b3713 | [pn:hypothetical protein] [gn:yief] |
| CONTIG466 | 14729535_f2_30 | 2712 | 8374 | 606 | 202 | 629 | 1.3(10)-61 | Escherichia coli | b3705 | [pn:60 kd protein] [gn:yidc] |
| CONTIG466 | 12601081_f2_33 | 2713 | 8375 | 306 | 102 | 178 | 4.7(10)-13 | A38160 | thdf protein - escherichia coli (fragment) |
| CONTIG466 | 16454200_f2_36 | 2714 | 8376 | 1029 | 343 | 1163 | 3.3(10)-118 | Escherichia coli | b3711 | [pn:hypothetical transcriptional regulator in tnab-bglb intergenic region] [gn:yidz] |
| CONTIG466 | 2036331_f3_68 | 2715 | 8377 | 288 | 96 | 236 | 5.7(10)-20 | Haemophilus influenzae | HI1000 | [pn:hypothetical protein] |
| CONTIG466 | 20317500_f3_74 | 2716 | 8378 | 741 | 247 | 1004 | 2.3(10)-101 | Escherichia coli | b3715 | [pn:hypothetical protein] [gn:yieh] |
| CONTIG466 | 34587752_c1_100 | 2717 | 8379 | 594 | 198 | 198 | 6.2(10)-16 | Escherichia coli | b0530 | [pn:hypothetical protein] [gn:sfma] |
| CONTIG466 | 15759625_c1_107 | 2718 | 8380 | 963 | 321 | 1357 | 9.5(10)-139 | Escherichia coli | b3727 | [pn:phosphate transport system permease protein pstc] [gn:pstc] |
| CONTIG466 | 20573253_c1_109 | 2719 | 8381 | 831 | 277 | 1170 | 6.2(10)-119 | Escherichia coli | b3724 | [pn:peripheral membrane protein u] [gn:phou] |
| CONTIG466 | 28557318_c2_126 | 2720 | 8382 | 399 | 133 | 598 | 2.5(10)-58 | Escherichia coli | b3738 | [pn:atp synthase f0 subunit a] [gn:atpb] |
| CONTIG466 | 34647257_c2_127 | 2721 | 8383 | 555 | 185 | 782 | 8.0(10)-78 | Escherichia coli | b3735 | [pn:atp synthase f1 delta subunit] [gn:atph] |
| CONTIG466 | 34614218_c2_128 | 2722 | 8384 | 1554 | 518 | 2381 | 2.8(10)-247 | Escherichia coli | b3734 | [pn:atp synthase f1 alpha subunit] [gn:atpa] |
| CONTIG466 | 35831955_c2_129 | 2723 | 8385 | 915 | 305 | 1381 | 2.7(10)-141 | Escherichia coli | b3733 | [pn:atp synthase f1 gamma subunit] [gn:atpg] |

TABLE 2-continued

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG466 | 25682955_c2_130 | 2724 | 8386 | 432 | 144 | 661 | 5.4(10)-65 | Escherichia coli | b3731 | [pn:atp synthase f1 epsilon subunit] [gn:atpc] |
| CONTIG466 | 22843762_c2_131 | 2725 | 8387 | 1425 | 475 | 2082 | 1.3(10)-215 | Escherichia coli | b3730 | [pn:udp-n-acetylglucosamine pyrophosphorylase] [gn:glmu] |
| CONTIG466 | 4102305_c2_132 | 2726 | 8388 | 1845 | 615 | 2868 | 7.2(10)-299 | Escherichia coli | b3729 | [pn:glutamine amidotransferase] |
| CONTIG466 | 11142193_c2_139 | 2727 | 8389 | 786 | 262 | 1220 | 3.1(10)-124 | Escherichia coli | b3725 | [pn:phosphate transport atp-binding protein pstb] [gn:pstb] |
| CONTIG466 | 2589638_c2_141 | 2728 | 8390 | 1377 | 459 | 1938 | 2.6(10)-200 | Escherichia coli | b3714 | [pn:hypothetical 46.9 kd protein in tnab-bglb intergenic region] |
| CONTIG466 | 10659431_c2_147 | 2729 | 8391 | 480 | 160 | 90 | 0.11 | Saccharomyces cerevisiae | YNR044W | [pn:a-agglutinin anchor subunit] [gn:aga1] |
| CONTIG466 | 6585912_c3_150 | 2730 | 8392 | 258 | 86 | 130 | 1.0(10)-8 | Haemophilus influenzae | HI0484 | [pn:atp synthase c chain] [gn:atpe] |
| CONTIG466 | 13082037_c3_151 | 2731 | 8393 | 507 | 169 | 601 | 1.2(10)-58 | Escherichia coli | b3736 | [pn:atp synthase f0 subunit b] [gn:atpf] |
| CONTIG466 | 2964050_c3_155 | 2732 | 8394 | 1506 | 502 | 2132 | 7.0(10)-221 | Escherichia coli | b3732 | [pn:atp synthase f1 beta subunit] [gn:atpd] |
| CONTIG466 | 5313943_c3_158 | 2733 | 8395 | 696 | 232 | 348 | 7.9(10)-32 | Escherichia coli | b3143 | [pn:hypothetical 25.7 kd fimbrial chaperone in agai-nntr intergeni] [gn:yrai] |
| CONTIG466 | 35370308_c3_159 | 2734 | 8396 | 2538 | 846 | 1405 | 7.7(10)-144 | Escherichia coli | b0532 | [pn:hypothetical protein] [gn:sfmd] |
| CONTIG466 | 5267193_c3_160 | 2735 | 8397 | 1086 | 362 | 177 | 3.2(10)-11 | Escherichia coli | b0941 | [pn:hypothetical protein] |
| CONTIG466 | 19572182_c3_161 | 2736 | 8398 | 1074 | 358 | 1554 | 1.3(10)-159 | Escherichia coli | b3728 | [pn:periplasmic phosphate-binding protein] [gn:psts] |
| CONTIG466 | 36617687_c3_164 | 2737 | 8399 | 909 | 303 | 1153 | 1.3(10)-117 | Escherichia coli | b3726 | [pn:phosphate transport system permease protein psta] [gn:psta] |
| CONTIG467 | 1275005_f1_42 | 2738 | 8400 | 303 | 101 | 91 | 0.005 | Saccharomyces cerevisiae | YIR019C | [pn:extracellular alpha-1,4-glucan glucosidase] [gn:sta1] |
| CONTIG467 | 33461682_c1_117 | 2739 | 8401 | 2181 | 727 | 446 | 7.5(10)-42 | Bacillus subtilis | yknV | [pn:hypothetical protein] |
| CONTIG467 | 6835407_c2_118 | 2740 | 8402 | 18048 | 6016 | 2534 | 3.1(10)-269 | Synechocystis sp. | S76109 | [PN:hypothetical protein] [OR.:Synechocystis sp.] [SR:PCC 6803., PCC 6803] [SR:PCC 6803.] cyad protein. |
| CONTIG467 | 35742257_c3_137 | 2741 | 8403 | 1197 | 399 | 360 | 4.2(10)-33 | Bordetella pertussis | P11091 | or:klebsiella pneumoniae pn:fimbrial adhesin gn:fimk le:1139 re:2380 di:direct sr:klebsiella pneumoniae |
| CONTIG467 | 6054666_c3_139 | 2742 | 8404 | 783 | 261 | 143 | 1.8(10)-7 | Klebsiella pneumoniae | L23111 | [pn:hypothetical protein] |
| CONTIG468 | 5133412_f1_2 | 2743 | 8405 | 330 | 110 | 391 | 2.2(10)-36 | Escherichia coli | b0379 | [pn:yaih] |
| CONTIG468 | 20397016_f1_8 | 2744 | 8406 | 1335 | 445 | 1652 | 5.2(10)-170 | Escherichia coli | b0376 | [pn:yaih] |
| CONTIG468 | 33212805_f1_13 | 2745 | 8407 | 1728 | 576 | 299 | 4.7(10)-26 | Prevotella melaninogenica | U27587 | or:prevotella melaninogenica pn:hemolysin a gn:hly le:188 re:1186 di:direct nt:zymogram analysis confirms the hemolytic glycoprotein x precursor. |
| CONTIG468 | 24477091_f1_21 | 2746 | 8408 | 876 | 292 | 95 | 0.14999 | Equine herpesvirus 1 | P28968 | [pn:membrane protein] |
| CONTIG468 | 3986527_f1_23 | 2747 | 8409 | 1155 | 385 | 183 | 6.0(10)-12 | Helicobacter pylori | HP0567 | [pn:hypothetical 41.5 kd protein in feci-fimb intergenic region] [gn:yaic] |
| CONTIG468 | 21878332_f1_24 | 2748 | 8410 | 1821 | 607 | 279 | 1.0(10)-23 | Escherichia coli | b0385 | [pn:hypothetical 27.4 kd protein in psif-proc intergenic region] |
| CONTIG468 | 16025932_f1_26 | 2749 | 8411 | 789 | 263 | 1178 | 8.8(10)-120 | Escherichia coli | b4306 | [pn:d-alanine] [gn:ddla] |
| CONTIG468 | 20432_f2_36 | 2750 | 8412 | 1221 | 407 | 1549 | 4.2(10)-159 | Escherichia coli | b0381 | [pn:delta-aminolevulinic acid dehydratase] [gn:hemb] |
| CONTIG468 | 4460882_f2_43 | 2751 | 8413 | 1095 | 365 | 1513 | 2.7(10)-155 | Escherichia coli | b0369 | [pn:hypothetical protein] [gn:ycir] |
| CONTIG468 | 21537927_f2_59 | 2752 | 8414 | 1959 | 653 | 644 | 3.3(10)-63 | Escherichia coli | b1285 | [pn:hypothetical 43.2 kd protein in perr-argf intergenic region] |
| CONTIG468 | 864080_f2_64 | 2753 | 8415 | 183 | 61 | 129 | 3.6(10)-8 | Podospora anserina | X55026 | or:mitochondrion podospora anserina le:44740 re:45549 di:complement sr:podospora anserina nt:orf16; no atg start codon; author- |
| CONTIG468 | 26830152_f2_65 | 2754 | 8416 | 444 | 148 | 446 | 3.2(10)-42 | Escherichia coli | U70214 | or:escherichia coli le:102767 re:103075 di:complement nt:hypothetical protein |
| CONTIG468 | 12915832_f3_107 | 2755 | 8417 | 423 | 141 | 676 | 1.3(10)-66 | Escherichia coli | U70214 | or:escherichia coli le:102415 re:102852 di:complement nt:hypothetical protein |
| CONTIG468 | 32227262_c1_109 | 2756 | 8418 | 522 | 174 | 703 | 1.8(10)-69 | Escherichia coli | b0257 | [pn:hypothetical protein] [gn:ykfc] |
| CONTIG468 | 5078942_c1_111 | 2757 | 8419 | 1530 | 510 | 1823 | 3.8(10)-188 | Escherichia coli | b0258 | [pn:hypothetical protein] [gn:ykfc] |
| CONTIG468 | 14880168_c1_112 | 2758 | 8420 | 210 | 70 | 100 | 1.5(10)-5 | Escherichia coli | b4286 | [pn:hypothetical protein] [gn:taud] |
| CONTIG468 | 35267890_c1_131 | 2759 | 8421 | 957 | 319 | 1238 | 3.8(10)-126 | Escherichia coli | b0368 | [pn:hypothetical protein] [gn:yaiu] |
| CONTIG468 | 2931593_c1_138 | 2760 | 8422 | 432 | 144 | 549 | 4.0(10)-53 | Escherichia coli | b0374 | [pn:hypothetical protein] [gn:yaiu] |
| CONTIG468 | 36148311_c1_142 | 2761 | 8423 | 1239 | 413 | 1814 | 3.5(10)-187 | Escherichia coli | b0377 | [pn:sbma protein] [gn:sbma] |
| CONTIG468 | 15664812_c1_143 | 2762 | 8424 | 1110 | 370 | 1475 | 3.0(10)-151 | Escherichia coli | b0378 | [pn:hypothetical protein] [gn:yaiw] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG468 | 16532656_c2_149 | 2763 | 8425 | 396 | 132 | 404 | 9.1(10)-38 | Escherichia coli | b0255 | [pn:hypothetical protein] |
| CONTIG468 | 32066327_c2_160 | 2764 | 8426 | 1425 | 475 | 2146 | 2.2(10)-222 | Escherichia coli | b0260 | [pn:hypothetical 51.5 kd transport protein in perr-argf intergenic region] [gn:ykfd] |
| CONTIG468 | 3191_c2_161 | 2765 | 8427 | 1038 | 346 | 1487 | 1.6(10)-152 | Escherichia coli | b0365 | [pn:hypothetical protein] [gn:tauc] |
| CONTIG468 | 36229058_c2_164 | 2766 | 8428 | 846 | 282 | 793 | 5.5(10)-79 | Escherichia coli | b0367 | [pn:hypothetical protein] [gn:yaiu] |
| CONTIG468 | 585340_c2_170 | 2767 | 8429 | 2391 | 797 | 996 | 1.7(10)-100 | Escherichia coli | b0374 | [pn:hypothetical protein] [gn:yaiv] |
| CONTIG468 | 30136001_c2_171 | 2768 | 8430 | 639 | 213 | 510 | 5.4(10)-49 | Escherichia coli | b0375 | [pn:hypothetical protein] |
| CONTIG468 | 16176655_c3_178 | 2769 | 8431 | 507 | 169 | 797 | 2.1(10)-79 | Escherichia coli | Y07545 | [de:e coli plasmid po157 dna, 5''''-region of the ehec-hemolysin operon.] [gn:orfS] |
| CONTIG468 | 31803342_c3_179 | 2770 | 8432 | 276 | 92 | 93 | 0.00063 | Xenopus laevis | S31719 | proline-rich protein - african clawed frog |
| CONTIG468 | 34645806_c3_189 | 2771 | 8433 | 951 | 317 | 1268 | 2.6(10)-129 | Escherichia coli | b0261 | [pn:hypothetical 33.4 kd protein in perr-argf intergenic region] |
| CONTIG468 | 17089012_c3_191 | 2772 | 8434 | 783 | 261 | 1139 | 1.2(10)-115 | Escherichia coli | b0366 | [pn:hypothetical protein] [gn:taub] |
| CONTIG468 | 267338_c3_202 | 2773 | 8435 | 252 | 84 | 297 | 2.0(10)-26 | Escherichia coli | b0380 | [pn:hypothetical protein] |
| CONTIG468 | 25910005_c3_206 | 2774 | 8436 | 672 | 224 | 524 | 1.8(10)-50 | Escherichia coli | b1053 | [pn:hypothetical 43.9 kd protein in msyb-htrb intergenic region] [gn:ycee] |
| CONTIG469 | 25992268_f1_1 | 2775 | 8437 | 1167 | 389 | 1708 | 6.0(10)-176 | Escherichia coli | b4375 | [pn:peptide-chain-release factor 3] [gn:prfc] |
| CONTIG469 | 24632962_f1_10 | 2776 | 8438 | 732 | 244 | 1185 | 1.6(10)-120 | Escherichia coli | b4384 | [pn:purine-nucleoside phosphorylase] [gn:deod] |
| CONTIG469 | 24744157_f1_18 | 2777 | 8439 | 1389 | 463 | 2188 | 8.3(10)-227 | Escherichia coli | b4389 | [pn:sms protein] [gn:rada] |
| CONTIG469 | 1206557_f1_22 | 2778 | 8440 | 906 | 302 | 332 | 3.8(10)-30 | Escherichia coli | b3243 | [pn:hypothetical protein] [gn:yhcs] |
| CONTIG469 | 34478458_f1_27 | 2779 | 8441 | 414 | 138 | 423 | 8.9(10)-40 | Escherichia coli | b4393 | [pn:trpr] [gn:trpr] |
| CONTIG469 | 19729541_f1_28 | 2780 | 8442 | 432 | 144 | 192 | 2.7(10)-15 | Escherichia coli | J01715 | or:escherichia coli 1e:765 re:1178 di:direct sr:escherichia coli dna [1],[2] and mrna [2] |
| CONTIG469 | 34179716_f1_29 | 2781 | 8443 | 571 | 191 | 775 | 4.5(10)-77 | Escherichia coli | b4395 | [pn:probable phosphoglycerate mutase 2] [gn:gpmb] |
| CONTIG469 | 24604651_f2_30 | 2782 | 8444 | 642 | 214 | 726 | 7.0(10)-72 | Escherichia coli | b4376 | [pn:periplasmic protein] [gn:osmy] |
| CONTIG469 | 35242941_f2_32 | 2783 | 8445 | 327 | 109 | 292 | 6.7(10)-26 | Escherichia coli | P39408 | hypothetical 28.9 kd protein in oxny-dcoc intergenic region. |
| CONTIG469 | 1353888_f2_33 | 2784 | 8446 | 468 | 156 | 666 | 1.6(10)-65 | Escherichia coli | b4378 | [pn:yijv] |
| CONTIG469 | 14730178_f2_39 | 2785 | 8447 | 1239 | 413 | 2087 | 4.2(10)-216 | Escherichia coli | b4383 | [pn:phosphopentomutase] [gn:deob] |
| CONTIG469 | 3381262_f2_48 | 2786 | 8448 | 1071 | 357 | 1457 | 2.3(10)-149 | Escherichia coli | b4388 | [pn:phosphoserine phosphatase] [gn:serb] |
| CONTIG469 | 14588437_f2_51 | 2787 | 8449 | 1770 | 590 | 115 | 0.0004 | Pseudomonas aeruginosa | JQ0133 | hypothetical 26.4k protein - pseudomonas aeruginosa |
| CONTIG469 | 36428938_f3_59 | 2788 | 8450 | 1113 | 371 | 1490 | 7.5(10)-153 | Escherichia coli | b4377 | [pn:hypothetical 39.8 kd protein in osmy-deoc intergenic region] [gn:yijul] |
| CONTIG469 | 23476055_f3_65 | 2789 | 8451 | 948 | 316 | 1135 | 3.2(10)-115 | Escherichia coli | b4381 | [pn:deoxyribose-phosphate aldolase] [gn:deoc] |
| CONTIG469 | 12898503_f3_66 | 2790 | 8452 | 1422 | 474 | 2050 | 3.5(10)-212 | Escherichia coli | b4382 | [pn:thymidine phosphorylase] [gn:deoa] |
| CONTIG469 | 16305762_f3_77 | 2791 | 8453 | 258 | 86 | 95 | 0.00129 | Nephila clavipes | AF027735 | [de:nephila clavipes minor ampullate silk protein misp1 mrna, partial cds.] [pn:minor ampullate silk protein misp1] |
| CONTIG469 | 10634625_f3_78 | 2792 | 8454 | 1236 | 412 | 1967 | 2.2(10)-203 | Escherichia coli | b4390 | [pn:transcriptional regulator nadr] [gn:nadr] |
| CONTIG469 | 15036641_f3_84 | 2793 | 8455 | 1983 | 661 | 3026 | 0 | Escherichia coli | b4392 | [pn:soluble lytic transglycosylase] [gn:slt] |
| CONTIG469 | 1011_c1_87 | 2794 | 8456 | 567 | 189 | 644 | 3.3(10)-63 | Escherichia coli | b4394 | [pn:hypothetical 18.6 kd protein in trpr-gpmb intergenic region] |
| CONTIG469 | 23849007_c1_97 | 2795 | 8457 | 1041 | 347 | 192 | 3.5(10)-13 | Escherichia coli | b4051 | [pn:quinone oxidoreductase] [gn:qor] |
| CONTIG469 | 5094427_c2_141 | 2796 | 8458 | 321 | 107 | 133 | 6.2(10)-9 | Escherichia coli | b3215 | [pn:hypothetical 25.3 kd fimbrial chaperone in gltf-nant intergenic region] [gn:yhca] |
| CONTIG469 | 32673426_c2_148 | 2797 | 8459 | 1629 | 543 | 2363 | 2.3(10)-245 | Escherichia coli | b4380 | [pn:hypothetical 58.0 kd protein in osmy-deoc intergenic region] |
| CONTIG469 | 32285036_c3_161 | 2798 | 8460 | 1764 | 588 | 2632 | 7.4(10)-274 | Escherichia coli | b4391 | [pn:abc transporter in nadr-slt intergenic region] [gn:yjjk] |
| CONTIG469 | 33865627_c3_169 | 2799 | 8461 | 663 | 221 | 788 | 1.8(10)-78 | Escherichia coli | b4387 | [pn:smp protein precursor] [gn:smp] |
| CONTIG469 | 5339642_c3_170 | 2800 | 8462 | 1050 | 350 | 1653 | 4.0(10)-170 | Escherichia coli | b4386 | [pn:lipoate-protein ligase a] [gn:pla] |
| CONTIG469 | 5193818_c3_171 | 2801 | 8463 | 696 | 232 | 223 | 1.3(10)-18 | Escherichia coli | b3219 | [pn:hypothetical protein] [gn:yhcf] |
| CONTIG469 | 4804068_c3_172 | 2802 | 8464 | 699 | 233 | 252 | 1.2(10)-21 | Escherichia coli | b3219 | [pn:hypothetical protein] [gn:yhcf] |
| CONTIG469 | 33790903_c3_181 | 2803 | 8465 | 864 | 288 | 1010 | 5.5(10)-102 | Escherichia coli | b4379 | [pn:hypothetical 31.5 kd protein in osmy-deoc intergenic region] [gn:yijw] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG47 | 25814591_f2_2 | 2804 | 8466 | 315 | 105 | 395 | 8.3(10)-37 | Escherichia coli | b1183 | [pn:umud protein] [gn:umud] |
| CONTIG470 | 19714505_f1_5 | 2805 | 8467 | 570 | 190 | 355 | 1.3(10)-32 | Escherichia coli | b0892 | [pn:hypothetical protein in sers 5"" region] [gn:ycaj] |
| CONTIG470 | 24640653_f1_8 | 2806 | 8468 | 2451 | 817 | 3753 | 0 | Escherichia coli | b0894 | [pn:anaerobic dimethyl sulfoxide reductase chain a precursor] [gn:dmsa] |
| CONTIG470 | 14181530_f1_10 | 2807 | 8469 | 1152 | 384 | 1451 | 1.0(10)-148 | Escherichia coli | b0898 | [pn:hypothetical protein in dmsc 3"" region] [gn:ycap] |
| CONTIG470 | 10572341_f1_20 | 2808 | 8470 | 768 | 256 | 838 | 9.4(10)-84 | Escherichia coli | b0906 | [pn:hypothetical protein] [gn:ycap] |
| CONTIG470 | 1836093_f1_21 | 2809 | 8471 | 1095 | 365 | 1718 | 5.2(10)-177 | Escherichia coli | b0907 | [pn:phosphoserine aminotransferase] [gn:serc] |
| CONTIG470 | 32422910_f2_33 | 2810 | 8472 | 468 | 156 | 708 | 5.5(10)-70 | Escherichia coli | b0889 | [pn:leucine-responsive regulatory protein] [gn:lrp] |
| CONTIG470 | 33882161_f2_34 | 2811 | 8473 | 3705 | 1235 | 2299 | 0 | Escherichia coli | b0890 | [pn:cell division protein ftsk] [gn:ftsk] |
| CONTIG470 | 14572206_f2_41 | 2812 | 8474 | 621 | 207 | 1113 | 6.7(10)-113 | Escherichia coli | b0895 | [pn:anaerobic dimethyl sulfoxide reductase chain b] [gn:dmsb] |
| CONTIG470 | 9802290_f2_49 | 2813 | 8475 | 495 | 165 | 443 | 6.2(10)-42 | Escherichia coli | b0910 | [pn:cytidylate kinase] [gn:cmk] |
| CONTIG470 | 3297258_f2_50 | 2814 | 8476 | 327 | 109 | 469 | 1.2(10)-44 | Escherichia coli | b0912 | [pn:integration host factor beta-subunit] [gn:ihimd] |
| CONTIG470 | 31104137_f2_55 | 2815 | 8477 | 993 | 331 | 1183 | 2.6(10)-120 | Escherichia coli | b0915 | [pn:hypothetical 35.6 kd protein in msba-kdsb intergenic region] [gn:yeah] |
| CONTIG470 | 14072667_f2_57 | 2816 | 8478 | 780 | 260 | 1130 | 1.1(10)-114 | Escherichia coli | b0918 | [pn:3-deoxy-manno-octulosonate cytidylyltransferase] [gn:kdsb] |
| CONTIG470 | 4803443_f3_63 | 2817 | 8479 | 624 | 208 | 923 | 9.3(10)-93 | Escherichia coli | b0891 | [pn:outer membrane lipoprotein carrier protein precursor] [gn:lola] |
| CONTIG470 | 2536578_f3_64 | 2818 | 8480 | 1182 | 394 | 1760 | 1.8(10)-181 | Escherichia coli | b0892 | [pn:hypothetical protein in sers 5"" region] [gn:ycaj] |
| CONTIG470 | 22845400_f3_65 | 2819 | 8481 | 1314 | 438 | 2080 | 2.2(10)-215 | Escherichia coli | b0893 | [pn:seryl-trna synthetase] [gn:sers] |
| CONTIG470 | 14473425_f3_68 | 2820 | 8482 | 936 | 312 | 1206 | 9.5(10)-123 | Escherichia coli | b0896 | [pn:anaerobic dimethyl sulfoxide reductase chain c] [gn:dmsc] |
| CONTIG470 | 275088_f3_76 | 2821 | 8483 | 1296 | 432 | 1752 | 1.3(10)-180 | Escherichia coli | b0908 | [pn:3-phosphoshikimate 1-carboxyvinyltransferase] [gn:aroa] |
| CONTIG470 | 36526905_f3_77 | 2822 | 8484 | 444 | 148 | 564 | 1.0(10)-54 | Escherichia coli | b0910 | [pn:cytidylate kinase] [gn:cmk] |
| CONTIG470 | 4490692_f3_78 | 2823 | 8485 | 1683 | 561 | 2321 | 6.7(10)-241 | Escherichia coli | b0911 | [pn:30s ribosomal protein s1] [gn:rpsa] |
| CONTIG470 | 7244037_f3_80 | 2824 | 8486 | 2280 | 760 | 2325 | 2.5(10)-241 | Escherichia coli | b0913 | [pn:hypothetical protein in msba 5"" region] [gn:ycai] |
| CONTIG470 | 25970202_f3_81 | 2825 | 8487 | 1749 | 583 | 2574 | 1.0(10)-267 | Escherichia coli | b0914 | [pn:probable transport atp-binding protein msba] [gn:msba] |
| CONTIG470 | 24507201_f3_82 | 2826 | 8488 | 1245 | 415 | 1670 | 6.4(10)-172 | Escherichia coli | b0916 | [pn:hypothetical protein] [gn:ycao] |
| CONTIG470 | 6058562_f3_83 | 2827 | 8489 | 228 | 76 | 264 | 6.2(10)-23 | Escherichia coli | b0917 | [pn:hypothetical protein] |
| CONTIG470 | 26595130_f3_85 | 2828 | 8490 | 900 | 300 | 1423 | 9.5(10)-146 | Escherichia coli | b0919 | [pn:hypothetical protein] |
| CONTIG470 | 30363283_c1_105 | 2829 | 8491 | 777 | 259 | 1312 | 5.5(10)-134 | Escherichia coli | b0902 | [pn:pyruvate formate-lyase 1 activating enzyme] [gn:pfla] |
| CONTIG470 | 36621094_c2_127 | 2830 | 8492 | 302 | 100 | 403 | 1.2(10)-37 | Escherichia coli | b0913 | [pn:hypothetical protein in kdsb-kieb intergenic region] [gn:ycbc] |
| CONTIG470 | 24084592_c2_148 | 2831 | 8493 | 1968 | 656 | 2744 | 1.0(10)-285 | Escherichia coli | b0905 | [pn:probable formate transporter] [gn:foca] |
| CONTIG470 | 22376412_c2_149 | 2832 | 8494 | 969 | 323 | 1304 | 3.8(10)-133 | Escherichia coli | b0904 | [pn:formate acetyltransferase 1] [gn:pflb] |
| CONTIG470 | 30736688_c2_150 | 2833 | 8495 | 2298 | 766 | 3671 | 0 | Escherichia coli | b0903 | [pn:hypothetical protein] [gn:yifc] |
| CONTIG470 | 15100141_c2_165 | 2834 | 8496 | 318 | 106 | 94 | 0.00052 | Caenorhabditis elegans | Z74033 | or:caenorhabditis elegans pn:cdna est yk117e9.5 comes from this gene; cdna est 22931 di:direct nt:cdna est yk117e9.5 comes from this gene; le:join (22734 re:22880, 22931 di:direct |
| CONTIG471 | 1992161_f1_6 | 2835 | 8497 | 1689 | 563 | 1476 | 2.2(10)-151 | Escherichia coli | b3767 | [pn:acetohydroxy acid synthase ii, large subunit] [gn:ilvg__] |
| CONTIG471 | 4147812_f1_10 | 2836 | 8498 | 186 | 62 | 92 | 0.0016 | Escherichia coli | M32253 | or:escherichia coli gn:ilvd le:3652 re:5499 di:direct sr:escherichia coli (strain k-12) dna |
| CONTIG471 | 32145043_f2_26 | 2837 | 8499 | 222 | 74 | 235 | 7.5(10)-20 | synthetic construct | M15619 | or:artificial sequence le:29 re:>232 di:direct src. coli (strain se5000) synthetic dna, clone pkb1 nt:orf16-lacz fusion protein |
| CONTIG471 | 31662801_f2_30 | 2838 | 8500 | 390 | 130 | 551 | 2.3(10)-53 | Escherichia coli | M15619 | [pn:hypothetical 13.1 kd protein in pssr-tlvl intergenic region] [gn:yific] |
| CONTIG471 | 3417882_f2_38 | 2839 | 8501 | 1560 | 520 | 2459 | 1.6(10)-255 | Escherichia coli | b3772 | [pn:threonine dehydratase biosynthetic] [gn:ilva] |
| CONTIG471 | 22444682_f2_41 | 2840 | 8502 | 1503 | 501 | 2319 | 1.1(10)-240 | Escherichia coli | b3774 | [pn:ketol-acid reductoisomerase] [gn:ilvc] |
| CONTIG471 | 35986463_f3_48 | 2841 | 8503 | 432 | 144 | 113 | 6.2(10)-7 | Escherichia coli | M87049 | or:escherichia coli gn:ol37 le:1223 re:1636 di:direct |
| CONTIG471 | 15819651_f3_55 | 2842 | 8504 | 288 | 96 | 381 | 2.5(10)-35 | Escherichia coli | b3769 | [pn:acetohydroxy acid synthase ii, small subunit] [gn:ilvm] |
| CONTIG471 | 24426711_f3_56 | 2843 | 8505 | 942 | 314 | 1571 | 2.0(10)-161 | Escherichia coli | b3770 | [pn:branched-chain amino-acid aminotransferase] [gn:ilve] |
| CONTIG471 | 23540917_f3_57 | 2844 | 8506 | 1854 | 618 | 2677 | 1.3(10)-278 | Escherichia coli | b3771 | [pn:dihydroxyacid dehydratase] [gn:ilvd] |
| CONTIG471 | 30352281_c1_66 | 2845 | 8507 | 426 | 142 | 437 | 2.8(10)-41 | Escherichia coli | b3605 | [pn:lctd] [gn:illdd] |
| CONTIG471 | 14845313_c1_67 | 2846 | 8508 | 1428 | 476 | 893 | 1.3(10)-89 | Pseudomonas putida | U10895 | or:pseudomonas putida pn:pcak gn:pcak le:261 re:1607 di:direct |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG471 | 4567968_c1_68 | 2847 | 8509 | 483 | 161 | 787 | 2.3(10)-78 | *Escherichia coli* | b3606 | [pn:hypothetical 17.7 kd protein in lctd-cyse intergenic region] [gn:yibk] |
| CONTIG471 | 14959652_c1_81 | 2848 | 8510 | 855 | 285 | 776 | 3.5(10)-77 | *Escherichia coli* | b3762 | [pn:hypothetical 22.4 kd protein in trpt-pssr intergenic region] [gn:yifa] |
| CONTIG471 | 6932937_c2_95 | 2849 | 8511 | 909 | 303 | 1490 | 7.5(10)-153 | *Escherichia coli* | b3773 | [pn:transcriptional activator protein ilvy] [gn:ilvy] |
| CONTIG471 | 12773450_c3_117 | 2850 | 8512 | 228 | 76 | 99 | 0.00014 | *Escherichia coli* | b3605 | [pn:lctd] [gn:lldd] |
| CONTIG471 | 33386290_c3_138 | 2851 | 8513 | 1551 | 517 | 1973 | 5.0(10)-204 | *Escherichia coli* | b3765 | [pn:hypothetical 56.2 kd protein in pssr-ilvl intergenic region] [gn:yifb] |
| CONTIG471 | 12781963_c3_148 | 2852 | 8514 | 189 | 63 | 101 | 1.2(10)-5 | *Homo sapiens* | A44803 | pg1 protein - human (fragment) |
| CONTIG471 | 24350086_f1_14 | 2853 | 8515 | 1488 | 496 | 1897 | 5.7(10)-196 | *Escherichia coli* | b1439 | [pn:hypothetical protein] |
| CONTIG472 | 35428135_f1_21 | 2854 | 8516 | 267 | 89 | 272 | 9.0(10)-24 | *Escherichia coli* | b1445 | [pn:hypothetical protein] |
| CONTIG472 | 22113325_f2_45 | 2855 | 8517 | 834 | 278 | 252 | 1.2(10)-21 | *Escherichia coli* | P52646 | hypothetical 5.0 kd protein in hslj 3' region. |
| CONTIG472 | 22461461_f2_53 | 2856 | 8518 | 1461 | 487 | 2002 | 4.2(10)-207 | *Escherichia coli* | b1444 | [pn:hypothetical protein] |
| CONTIG472 | 4806693_f2_62 | 2857 | 8519 | 243 | 81 | 331 | 5.0(10)-30 | *Escherichia coli* | b1446 | [pn:hypothetical protein] |
| CONTIG472 | 4348510_f2_64 | 2858 | 8520 | 585 | 195 | 133 | 4.7(10)-9 | *Escherichia coli* | b1434 | [pn:hypothetical protein] |
| CONTIG472 | 26070290_f2_65 | 2859 | 8521 | 1101 | 367 | 1462 | 7.0(10)-150 | *Escherichia coli* | b1449 | [pn:hypothetical protein] |
| CONTIG472 | 24251918_f3_85 | 2860 | 8522 | 798 | 266 | 123 | 1.2(10)-5 | *Bacillus subtilis* | ybfK | [pn:hypothetical protein] |
| CONTIG472 | 5098387_f3_96 | 2861 | 8523 | 1689 | 563 | 1524 | 1.8(10)-156 | *Escherichia coli* | b3544 | [pn:periplasmic dipeptide transport protein precursor] [gn:dppa] |
| CONTIG472 | 25519182_f3_101 | 2862 | 8524 | 714 | 238 | 469 | 1.2(10)-44 | *Escherichia coli* | b1450 | [pn:hypothetical protein] |
| CONTIG472 | 10944025_c1_106 | 2863 | 8525 | 693 | 231 | 760 | 1.7(10)-75 | *Escherichia coli* | b1448 | [pn:hypothetical protein] |
| CONTIG472 | 135836_c1_119 | 2864 | 8526 | 351 | 117 | 461 | 8.4(10)-44 | *Escherichia coli* | b1797 | [pn:hypothetical protein] |
| CONTIG472 | 23957058_c1_120 | 2865 | 8527 | 381 | 127 | 384 | 1.2(10)-35 | *Escherichia coli* | b1796 | [pn:hypothetical protein] |
| CONTIG472 | 23728427_c1_121 | 2866 | 8528 | 186 | 62 | 129 | 1.3(10)-8 | *Escherichia coli* | b1796 | [pn:hypothetical protein] |
| CONTIG472 | 6366068_c1_130 | 2867 | 8529 | 1023 | 341 | 1031 | 3.2(10)-104 | *Pseudomonas aeruginosa* | Y10528 | PN:cyanide insensitive terminal oxidase] [GN:cioB] DE:*P. aeruginosa* cioA and cioB genes.] [LE:1746] [RE:2753] DI:direct] |
| CONTIG472 | 6131633_c1_138 | 2868 | 8530 | 243 | 81 | 249 | 5.4(10)-21 | *Escherichia coli* | b1345 | [pn:hypothetical protein] |
| CONTIG472 | 511665_c2_139 | 2869 | 8531 | 387 | 129 | 482 | 6.9(10)-46 | *Escherichia coli* | b1451 | [pn:hypothetical protein] |
| CONTIG472 | 11753260_c2_159 | 2870 | 8532 | 1452 | 484 | 1827 | 1.5(10)-188 | *Pseudomonas aeruginosa* | Y10528 | PN:cyanide insensitive terminal oxidase] [GN:cioA] DE:*P. aeruginosa* cioA and cioB genes.] [LE:276] [RE:1742] DI:direct] |
| CONTIG472 | 24415937_c2_161 | 2871 | 8533 | 441 | 147 | 363 | 2.0(10)-33 | *Escherichia coli* | b1379 | [pn:beta-lactamase precursor] [gn:hslj] |
| CONTIG472 | 10807708_c3_171 | 2872 | 8534 | 474 | 158 | 647 | 1.6(10)-63 | *Escherichia coli* | b1447 | [pn:hypothetical protein] |
| CONTIG472 | 11955093_c3_192 | 2873 | 8535 | 3537 | 1179 | 5614 | 0 | *Escherichia coli* | b1378 | [pn:hypothetical protein] [gn:ydbk] |
| CONTIG472 | 29876562_c3_193 | 2874 | 8536 | 1155 | 385 | 1487 | 1.6(10)-152 | *Escherichia coli* | b1377 | [pn:1-acyl-glycerol-3-phosphate acyltransferase] [gn:plsc] |
| CONTIG472 | 20586437_f1_1 | 2875 | 8537 | 567 | 189 | 712 | 2.1(10)-70 | *Escherichia coli* | b3033 | [pn:hypothetical 16.5 kd protein in icc-tolc intergenic region] [gn:yqjb] |
| CONTIG473 | 176443_f1_2 | 2876 | 8538 | 837 | 279 | 1158 | 1.2(10)-117 | *Escherichia coli* | b3032 | [pn:icc protein] [gn:icc] |
| CONTIG473 | 22775277_f1_3 | 2877 | 8539 | 1896 | 632 | 2898 | 4.7(10)-302 | *Escherichia coli* | b3030 | [pn:topoisomerase iv subunit] [gn:pare] |
| CONTIG473 | 10761003_f1_13 | 2878 | 8540 | 2277 | 759 | 3581 | 0 | *Escherichia coli* | b3019 | [pn:topoisomerase iv subunit] [gn:parc] |
| CONTIG473 | 5991325_f1_14 | 2879 | 8541 | 768 | 256 | 988 | 1.2(10)-99 | *Escherichia coli* | b3018 | [pn:1-acyl-glycerol-3-phosphate acyltransferase] [gn:plsc] |
| CONTIG473 | 4142253_f1_26 | 2880 | 8542 | 235 | 79 | 163 | 3.2(10)-12 | *Escherichia coli* | b3005 | [pn:biopolymer transport exbd protein] [gn:exbd] |
| CONTIG473 | 22232181_f2_27 | 2881 | 8543 | 702 | 234 | 965 | 3.2(10)-97 | *Escherichia coli* | b3034 | [pn:hypothetical protein] [gn:yqje] |
| CONTIG473 | 35678406_f2_33 | 2882 | 8544 | 1359 | 453 | 720 | 3.0(10)-71 | *Enterobacter cloacae* | AB000622 | or:*enterobacter cloacae* pn:mely gn:mely le:481 re:1758 di:direct sr:*enterobacter cloacae* (strain:nid977) dna |
| CONTIG473 | 4703276_f2_37 | 2883 | 8545 | 303 | 101 | 264 | 6.2(10)-23 | *Escherichia coli* | I80320 | hypothetical protein 1 - *escherichia coli* |
| CONTIG473 | 1692407_f2_38 | 2884 | 8546 | 417 | 139 | 347 | 1.0(10)-31 | *Escherichia coli* | I80320 | hypothetical protein 1 - *escherichia coli* |
| CONTIG473 | 4565840_f2_47 | 2885 | 8547 | 1539 | 513 | 2084 | 8.6(10)-216 | *Escherichia coli* | b3017 | [pn:sufi protein precursor] [gn:sufi] |
| CONTIG473 | 31924155_f2_54 | 2886 | 8548 | 618 | 206 | 121 | 1.6(10)-5 | *Escherichia coli* | b3010 | [pn:hypothetical protein] |
| CONTIG473 | 24648451_f2_55 | 2887 | 8549 | 906 | 302 | 1230 | 2.7(10)-125 | *Escherichia coli* | b3010 | [pn:hypothetical protein] |
| CONTIG473 | 32444783_f2_61 | 2888 | 8550 | 726 | 242 | 927 | 3.5(10)-93 | *Escherichia coli* | b3031 | [pn:hypothetical 15.2 kd protein in icc 3''' region] [gn:yqja] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG473 | 29787518_f3_78 | 2889 | 8551 | 453 | 151 | 387 | 5.7(10)-36 | Escherichia coli | b3024 | [pn:hypothetical protein] [gn:ygjw] |
| CONTIG473 | 13070218_f3_83 | 2890 | 8552 | 2265 | 755 | 1968 | 1.7(10)-203 | Escherichia coli | b3015 | [pn:hypothetical protein] |
| CONTIG473 | 29776000_f3_89 | 2891 | 8553 | 753 | 251 | 960 | 1.1(10)-96 | Escherichia coli | b3006 | [pn:biopolymer transport exbb protein] [gn:exbb] |
| CONTIG473 | 189540_c1_91 | 2892 | 8554 | 1347 | 449 | 1771 | 1.3(10)-182 | Escherichia coli | b3008 | [pn:cystathionine beta-lyase] [gn:metc] |
| CONTIG473 | 11047306_c1_119 | 2893 | 8555 | 840 | 280 | 184 | 4.5(10)-12 | Haloferax sp. | P21562 | hypothetical 80.2 kd protein in the 5' region of gyra and gyrb (orf4). |
| CONTIG473 | 23488836_c1_122 | 2894 | 8556 | 378 | 126 | 191 | 5.0(10)-14 | Haloferax sp. | P21562 | hypothetical 80.2 kd protein in the 5' region of gyra and gyrb (orf4). |
| CONTIG473 | 9771052_c2_125 | 2895 | 8557 | 669 | 223 | 140 | 8.6(10)-10 | Escherichia coli | M16489 | or:escherichia coli le:627 re:1199 di:complement sr:escherichia coli dna nt:orf 4; putative |
| CONTIG473 | 29720016_c2_128 | 2896 | 8558 | 690 | 230 | 857 | 9.0(10)-86 | Escherichia coli | b3009 | [pn:hypothetical 24.1 kd protein in metc-sufi intergenic region] [gn:yghb] |
| CONTIG473 | 2931541_c2_145 | 2897 | 8559 | 1353 | 451 | 1330 | 6.9(10)-136 | Escherichia coli | b3026 | [pn:hypothetical protein] [gn:ygjy] |
| CONTIG473 | 35370336_c2_148 | 2898 | 8560 | 453 | 151 | 498 | 1.0(10)-47 | Escherichia coli | b2665 | [pn:hypothetical protein] [gn:ygau] |
| CONTIG473 | 2422013_c2_154 | 2899 | 8561 | 900 | 300 | 175 | 1.7(10)-11 | Bacillus subtilis | ydeC | [pn:hypothetical protein] |
| CONTIG473 | 16118916_c3_166 | 2900 | 8562 | 1242 | 414 | 1761 | 1.5(10)-181 | Escherichia coli | b3011 | [pn:hypothetical protein] |
| CONTIG473 | 36144333_c3_167 | 2901 | 8563 | 846 | 282 | 1175 | 1.8(10)-119 | Escherichia coli | b3012 | [pn:hypothetical protein] |
| CONTIG473 | 36110841_c3_178 | 2902 | 8564 | 678 | 226 | 918 | 3.1(10)-92 | Escherichia coli | b3025 | [pn:hypothetical protein] [gn:ygjx] |
| CONTIG473 | 35288206_c3_180 | 2903 | 8565 | 699 | 233 | 959 | 1.3(10)-96 | Escherichia coli | b3028 | [pn:modulator of drug activity b] [gn:mdab] |
| CONTIG473 | 4698587_c3_181 | 2904 | 8566 | 327 | 109 | 459 | 1.3(10)-43 | Escherichia coli | b3029 | [pn:hypothetical 11.5 kd protein in mdab 3"" region] [gn:ygjn] |
| CONTIG473 | 14957706_f1_7 | 2905 | 8567 | 1239 | 413 | 314 | 3.2(10)-28 | Bacillus subtilis | ydeR | [pn:hypothetical protein] |
| CONTIG473 | 14179715_f1_22 | 2906 | 8568 | 714 | 238 | 644 | 3.3(10)-63 | Escherichia coli | b1072 | [pn:flagellar basal body p-ring protein flga precursor] [gn:flga] |
| CONTIG473 | 27792015_f1_23 | 2907 | 8569 | 336 | 112 | 358 | 6.9(10)-33 | Escherichia coli | b1071 | [pn:anti-sigma factor] [gn:flgm] |
| CONTIG473 | 25488888_f1_31 | 2908 | 8570 | 621 | 207 | 784 | 5.0(10)-78 | Escherichia coli | b1063 | [pn:hypothetical 20.5 kd protein in pyrc 3"" region] [gn:yceb] |
| CONTIG473 | 16495826_f2_33 | 2909 | 8571 | 360 | 120 | 189 | 5.5(10)-15 | Haemophilus influenzae | U20229 | or:haemophilus influenzae pn:unknown nt:orf121 di:complement nt:orf121 |
| CONTIG474 | 24650878_f2_38 | 2910 | 8572 | 3123 | 1041 | 2554 | 0 | Escherichia coli | b1084 | [pn:ribonuclease e] [gn:rne] |
| CONTIG474 | 22771150_f2_56 | 2911 | 8573 | 465 | 155 | 485 | 2.3(10)-46 | Escherichia coli | b1070 | [pn:flagella synthesis protein flgn] [gn:flgn] |
| CONTIG474 | 15729168_f2_65 | 2912 | 8574 | 1632 | 544 | 1518 | 8.1(10)-156 | Escherichia coli | b1065 | [pn:hypothetical protein] |
| CONTIG474 | 2923912_f2_66 | 2913 | 8575 | 357 | 119 | 320 | 7.2(10)-29 | Escherichia coli | b1061 | [pn:dna-damage-inducible protein i] [gn:dini] |
| CONTIG474 | 22896012_f3_68 | 2914 | 8576 | 624 | 208 | 788 | 1.8(10)-78 | Escherichia coli | b1087 | [pn:hypothetical 23.2 kd protein in me-rpmf intergenic region] [gn:ycej] |
| CONTIG474 | 35564750_f3_99 | 2915 | 8577 | 1104 | 368 | 1539 | 4.9(10)-158 | Escherichia coli | b1062 | [pn:dihydroorotase] [gn:pyrc] |
| CONTIG474 | 2477266_c1_106 | 2916 | 8578 | 1068 | 356 | 1299 | 1.3(10)-132 | Escherichia coli | b1068 | [pn:virulence factor mviм homolog] [gn:mvim] |
| CONTIG474 | 31901507_c1_107 | 2917 | 8579 | 1620 | 540 | 2017 | 1.1(10)-208 | Escherichia coli | b1069 | [pn:virulence factor mvin homolog] [gn:mvin] |
| CONTIG474 | 26377035_c1_110 | 2918 | 8580 | 768 | 256 | 772 | 9.3(10)-77 | Escherichia coli | b1075 | [pn:flagellar hook formation protein flgd] [gn:flgd] |
| CONTIG474 | 35235306_c1_112 | 2919 | 8581 | 816 | 272 | 1108 | 2.2(10)-112 | Escherichia coli | b1078 | [pn:flagellar basal-body rod protein flgg] [gn:flgg] |
| CONTIG474 | 31772608_c1_113 | 2920 | 8582 | 756 | 252 | 1075 | 7.2(10)-109 | Escherichia coli | b1079 | [pn:flagellar l-ring protein precursor] [gn:flgh] |
| CONTIG474 | 23603381_c1_114 | 2921 | 8583 | 1101 | 367 | 1484 | 3.2(10)-152 | Escherichia coli | b1080 | [pn:flagellar p-ring protein precursor] [gn:flgi] |
| CONTIG474 | 25900202_c1_115 | 2922 | 8584 | 954 | 318 | 1165 | 2.1(10)-118 | Escherichia coli | b1081 | [pn:flagellar protein flgj] [gn:flgj] |
| CONTIG474 | 36022506_c1_116 | 2923 | 8585 | 1683 | 561 | 2059 | 3.8(10)-213 | Escherichia coli | b1082 | [pn:flagellar hook-associated protein 1] [gn:flgk] |
| CONTIG474 | 13862837_c1_127 | 2924 | 8586 | 195 | 65 | 135 | 2.8(10)-9 | Escherichia coli | b1088 | [pn:hypothetical protein] |
| CONTIG474 | 12369760_c1_131 | 2925 | 8587 | 534 | 178 | 757 | 3.6(10)-75 | Escherichia coli | b1066 | [pn:hypothetical 19.3 kd protein in me-rpmf intergenic region] [gn:rimj] |
| CONTIG474 | 22866711_c2_135 | 2926 | 8588 | 621 | 207 | 996 | 1.7(10)-100 | Escherichia coli | b1067 | [pn:ribosomal-protein-alanine acetyltransferase] [gn:rimj] |
| CONTIG474 | 5273568_c2_136 | 2927 | 8589 | 660 | 220 | 786 | 3.1(10)-78 | Escherichia coli | b1067 | [pn:hypothetical protein in rimj 3"" region] [gn:yceh] |
| CONTIG474 | 4312512_c2_142 | 2928 | 8590 | 441 | 147 | 526 | 1.1(10)-50 | Escherichia coli | b1068 | [pn:putative flagellar basal-body rod protein flgb] [gn:flgb] |
| CONTIG474 | 3129202_c2_143 | 2929 | 8591 | 405 | 135 | 643 | 4.2(10)-63 | Escherichia coli | b1074 | [pn:putative flagellar basal-body rod protein flgc] [gn:flgc] |
| CONTIG474 | 16289216_c2_147 | 2930 | 8592 | 768 | 256 | 1134 | 4.0(10)-115 | Escherichia coli | b1077 | [pn:putative flagellar basal-body rod protein flgf] [gn:flgf] |
| CONTIG474 | 4165937_c2_153 | 2931 | 8593 | 957 | 319 | 1123 | 5.9(10)-114 | Escherichia coli | b1083 | [pn:flagellar hook-associated protein 3] [gn:flgl] |
| CONTIG474 | 35369016_c2_156 | 2932 | 8594 | 957 | 319 | 329 | 8.1(10)-30 | Escherichia coli | b3060 | [pn:hypothetical protein] [gn:ygip] |
| CONTIG474 | 11209818_c2_162 | 2933 | 8595 | 186 | 62 | 284 | 4.7(10)-25 | Escherichia coli | b1089 | [pn:50s ribosomal protein l32] [gn:rpmf] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG474 | 33645805_c2_163 | 2934 | 8596 | 321 | 107 | 218 | 7.0(10)-18 | Escherichia coli | b1090 | [pn:plsx protein] [gn:plsx] |
| CONTIG474 | 525278_c3_173 | 2935 | 8597 | 1212 | 404 | 1547 | 7.0(10)-159 | Escherichia coli | b1076 | [pn:flagellar hook protein flge] [gn:flge] |
| CONTIG474 | 34557338_c3_191 | 2936 | 8598 | 270 | 90 | 197 | 7.9(10)-16 | Escherichia coli | b1085 | [pn:hypothetical protein] |
| CONTIG474 | 26173166_c3_192 | 2937 | 8599 | 969 | 323 | 1383 | 1.7(10)-141 | Escherichia coli | b1086 | [pn:hypothetical 36.0 kd protein in me-rpmf intergenic region] [gn:ycee] |
| CONTIG474 | 21501261_f1_10 | 2938 | 8600 | 1218 | 406 | 114 | 0.00051 | Escherichia coli | b1053 | [pn:hypothetical 43.9 kd protein in msyb-htrb intergenic region] [gn:ycee] |
| CONTIG475 | 12538181_f1_32 | 2939 | 8601 | 1206 | 402 | 328 | 1.0(10)-29 | Escherichia coli | b2214 | [pn:hypothetical 38.5 kd protein in ada-ompc intergenic region] |
| CONTIG475 | 5206911_f1_38 | 2940 | 8602 | 1014 | 338 | 450 | 1.2(10)-42 | Escherichia coli | b2428 | [pn:hypothetical protein] [gn:yfeu] |
| CONTIG475 | 6328406_f1_43 | 2941 | 8603 | 1506 | 502 | 1915 | 7.0(10)-198 | Escherichia coli | b1961 | [pn:dna-cytosine methyltransferase] [gn:dcm] |
| CONTIG475 | 21884378_f1_47 | 2942 | 8604 | 963 | 321 | 1088 | 3.0(10)-110 | Escherichia coli | b1958 | [pn:hypothetical protein in vsr 5'''' region] [gn:yedi] |
| CONTIG475 | 163125_f2_70 | 2943 | 8605 | 1008 | 336 | 164 | 5.5(10)-10 | Escherichia coli | b0338 | [pn:cyn operon transcriptional activator] [gn:cynr] |
| CONTIG475 | 29926551_f2_90 | 2944 | 8606 | 552 | 184 | 681 | 4.0(10)-67 | Escherichia coli | b1960 | [pn:patch repair protein] [gn:vsr] |
| CONTIG475 | 19540756_f2_93 | 2945 | 8607 | 1182 | 394 | 959 | 1.3(10)-96 | Escherichia coli | b1956 | [pn:hypothetical protein] |
| CONTIG475 | 19610027_f3_110 | 2946 | 8608 | 942 | 314 | 492 | 4.4(10)-47 | Escherichia coli | b0768 | [pn:hypothetical transcriptional regulator in modc-bioa intergenic region] [gn:ybhd] |
| CONTIG475 | 1365625_f3_123 | 2947 | 8609 | 2805 | 935 | 706 | 9.1(10)-70 | Bacillus subtilis | yqjG | [pn:hypothetical protein] |
| CONTIG475 | 782525_f3_128 | 2948 | 8610 | 771 | 257 | 712 | 2.1(10)-70 | Escherichia coli | b1962 | [pn:hypothetical protein in sem-dcm intergenic region] [gn:yedj] |
| CONTIG475 | 14064562_f3_135 | 2949 | 8611 | 213 | 71 | 205 | 1.1(10)-16 | Escherichia coli | b1957 | [pn:hypothetical protein] |
| CONTIG475 | 16207680_f3_136 | 2950 | 8612 | 258 | 86 | 193 | 1.8(10)-14 | Escherichia coli | b1956 | [pn:hypothetical protein] |
| CONTIG475 | 11197708_c1_146 | 2951 | 8613 | 519 | 173 | 267 | 3.0(10)-23 | Escherichia coli | P09183 | very hypothetical 20.3 kd protein in dcm 3' region (orf3). |
| CONTIG475 | 6453252_c1_147 | 2952 | 8614 | 648 | 216 | 132 | 6.0(10)-9 | Escherichia coli | P09183 | very hypothetical 20.3 kd protein in dcm 3' region (orf3). |
| CONTIG475 | 4070467_c1_148 | 2953 | 8615 | 1179 | 393 | 1096 | 4.2(10)-111 | Escherichia coli | b1377 | [pn:hypothetical protein] |
| CONTIG475 | 15656_c1_151 | 2954 | 8616 | 1644 | 548 | 1602 | 1.0(10)-164 | Escherichia coli | b4125 | [pn:hypothetical 60.6 kd protein in dcub-lysu intergenic region] |
| CONTIG475 | 25437258_c1_166 | 2955 | 8617 | 1455 | 485 | 1821 | 6.4(10)-188 | Klebsiella pneumoniae | P16482 | citrate-proton symport (citrate transporter) (citrate carrier protein). |
| CONTIG475 | 3159530_c1_167 | 2956 | 8618 | 795 | 265 | 107 | 0.0011 | Bacillus subtilis | yvgL | [pn:hypothetical protein] |
| CONTIG475 | 175006_c1_169 | 2957 | 8619 | 837 | 279 | 1212 | 2.2(10)-123 | Escherichia coli | b1976 | [pn:hypothetical protein] |
| CONTIG475 | 4022768_c1_173 | 2958 | 8620 | 1752 | 584 | 1683 | 2.7(10)-173 | Escherichia coli | S44018 | iuca protein - escherichia coli |
| CONTIG475 | 9766281_c1_176 | 2959 | 8621 | 705 | 235 | 730 | 2.6(10)-72 | Escherichia coli | AF016586 | [de:escherichia coli plasmid pcolv-k311 lysine n6-hydroxylase (aera) gene, complete cds.] [pn:lysine n6-hydroxylase] [gn:aera] [nt:monooxygenase] |
| CONTIG475 | 36525756_c1_177 | 2960 | 8622 | 555 | 185 | 462 | 6.5(10)-44 | Escherichia coli | AF016587 | [de:escherichia coli plasmid pcolv-k311 lysine n6-hydroxylase mutant (aera) gene, complete cds.] [pn:lysine n6-hydroxylase mutant] [gn:acra] [nt:monooxygenase, p14g site-directed mutant] |
| CONTIG475 | 32454093_c2_184 | 2961 | 8623 | 921 | 307 | 1095 | 5.5(10)-111 | Escherichia coli | b1959 | [pn:hypothetical 32.2 kd protein in vsr 5'''' region] [gn:yeda] |
| CONTIG475 | 4939042_c2_197 | 2962 | 8624 | 1569 | 523 | 928 | 2.7(10)-93 | Escherichia coli | b3063 | [pn:hypothetical 52.9 kd protein in ttdb-rpsu intergenic region] [gn:ygjc] |
| CONTIG475 | 2398507_c2_201 | 2963 | 8625 | 1329 | 443 | 363 | 2.0(10)-33 | Plasmid pNAD2 | D10678 | or:plasmid pnad2 pn:6-aminohexanoate-dimer hydrolase gn:nylb ec:3.5.1.46 le:611 re:1801 di:direct sr:plasmid pnad2 dna |
| CONTIG475 | 35729157_c2_208 | 2964 | 8626 | 1908 | 636 | 1971 | 8.1(10)-204 | Escherichia coli | S50883 | iucc protein - escherichia coli |
| CONTIG475 | 16828512_c3_216 | 2965 | 8627 | 282 | 94 | 94 | 7.7(10)-5 | Drosophila melanogaster | P13238 | vitelline membrane protein vm26ab precursor (protein tu-4) (protein sv23). |
| CONTIG475 | 20526691_c3_219 | 2966 | 8628 | 735 | 245 | 882 | 2.0(10)-88 | Escherichia coli | b4124 | [pn:hypothetical 27.4 kd protein in dcub-lysu intergenic region] |
| CONTIG475 | 4510206_c3_223 | 2967 | 8629 | 1695 | 565 | 2482 | 5.7(10)-258 | Escherichia coli | b4122 | [pn:fumarate hydratase class i, anaerobic] [gn:fumb] |
| CONTIG475 | 6539193_c3_237 | 2968 | 8630 | 960 | 320 | 1100 | 1.6(10)-111 | Escherichia coli | S44019 | iucb protein - escherichia coli |
| CONTIG475 | 12314388_c3_240 | 2969 | 8631 | 459 | 153 | 91 | 0.023 | Escherichia coli | AF016587 | [de:escherichia coli plasmid pcolv-k311 lysine n6-hydroxylase mutant (aera) gene, complete cds.] [pn:lysine n6-hydroxylase mutant] [gn:aera] [nt:monooxygenase, p14g site-directed mutant] |
| CONTIG476 | 23625277_c3_241 | 2970 | 8632 | 1221 | 407 | 1254 | 7.7(10)-128 | Escherichia coli | S01042 | cloacin receptor precursor - escherichia coli plasmid pcolv-k30 |
| CONTIG476 | 3400177_f1_1 | 2971 | 8633 | 714 | 238 | 168 | 9.4(10)-13 | Escherichia coli | b0375 | [pn:hypothetical protein] [gn:yaiv] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG476 | 3912575_f1_18 | 2972 | 8634 | 207 | 69 | 140 | 8.6(10)-10 | Escherichia coli | b1705 | [pn:hypothetical 7.1 kd protein in aroh-nlpc intergenic region] |
| CONTIG476 | 16538217_f1_20 | 2973 | 8635 | 1197 | 399 | 1487 | 1.6(10)-152 | Shigella dysenteriae | U64516 | [de:shigella dysenteriae shuv, shuu, shuy, shux, shuw pseudogene, shut, outer membrane heme receptor shua (shua), and shus genes, complete cds.] [pn:unknown] [gn:shus] |
| CONTIG476 | 11110830_f2_37 | 2974 | 8636 | 684 | 228 | 182 | 3.1(10)-14 | Escherichia coli | b0375 | [pn:hypothetical protein] [gn:yaiv] |
| CONTIG476 | 12689051_f2_60 | 2975 | 8637 | 2067 | 689 | 2705 | 1.3(10)-281 | Shigella dysenteriae | U64516 | or:shigella dysenterie pn:outer membrane heme receptor shua gn:shua le:491 re:2473 di:direct |
| CONTIG476 | 15724136_f2_64 | 2976 | 8638 | 1071 | 357 | 722 | 1.8(10)-71 | Yersinia enterocolitica | S54438 | hemin permease - yersinia enterocolitica |
| CONTIG476 | 7157942_f3_91 | 2977 | 8639 | 1176 | 392 | 1187 | 9.8(10)-121 | Escherichia coli | b1688 | [pn:hypothetical protein] |
| CONTIG476 | 581252_f3_99 | 2978 | 8640 | 1059 | 353 | 1279 | 1.7(10)-130 | Escherichia coli | b1703 | [pn:hypothetical 19.8 kd protein in ppsa-aroh intergenic region] [gn:ydia] |
| CONTIG476 | 976542_f3_100 | 2979 | 8641 | 1071 | 357 | 1553 | 1.6(10)-159 | Escherichia coli | b1704 | [pn:3-deoxy-d-arabinoheptulosonate 7-phosphate synthase] or:yersinia enterocolitica pn:hemin binding protein gn:hemt le:1175 re:2014 di:direct |
| CONTIG476 | 16219541_f3_108 | 2980 | 8642 | 846 | 282 | 741 | 1.8(10)-73 | Yersinia enterocolitica | X77867 | |
| CONTIG476 | 35397915_f3_110 | 2981 | 8643 | 972 | 324 | 370 | 3.7(10)-34 | Escherichia coli | b0151 | [pn:ferrichrome transport atp-binding protein fhuc] [gn:fhuc] |
| CONTIG476 | 3031908_c1_121 | 2982 | 8644 | 1071 | 357 | 1601 | 1.3(10)-164 | Escherichia coli | b1714 | [pn:phenylalanyl-trna synthetase alpha chain] [gn:phes] |
| CONTIG476 | 13164051_c1_123 | 2983 | 8645 | 1074 | 358 | 1188 | 7.7(10)-121 | Escherichia coli | b1711 | [pn:vitamin b12 transport system permease protein btuc] [gn:btuc] |
| CONTIG476 | 4032843_c1_124 | 2984 | 8646 | 561 | 187 | 738 | 3.7(10)-73 | Escherichia coli | b1710 | [pn:vitamin b12 transport periplasmic protein btue] [gn:btue] |
| CONTIG476 | 21752052_c1_138 | 2985 | 8647 | 2433 | 811 | 3905 | 0 | Escherichia coli | b1702 | [pn:phosphoenolpyruvate synthase] [gn:ppsa] |
| CONTIG476 | 2618785_c1_139 | 2986 | 8648 | 1485 | 495 | 1219 | 4.0(10)-124 | Escherichia coli | b0270 | [pn:hypothetical 50.6 kd protein in perr-argf intergenic region] [gn:bglx] |
| CONTIG476 | 15744032_c1_140 | 2987 | 8649 | 2379 | 793 | 992 | 4.5(10)-100 | Escherichia coli | b2132 | [pn:periplasmic beta-glucosidase precursor] [gn:bglx] |
| CONTIG476 | 35234831_c2_151 | 2988 | 8650 | 2280 | 760 | 3516 | 0 | Escherichia coli | b1713 | [pn:phenylalanyl-trna synthetase beta chain] [gn:phet] |
| CONTIG476 | 34105290_c2_155 | 2989 | 8651 | 729 | 243 | 608 | 2.2(10)-59 | Escherichia coli | b1707 | [pn:hypothetical protein] |
| CONTIG476 | 12986466_c2_182 | 2990 | 8652 | 453 | 151 | 532 | 2.5(10)-51 | Escherichia coli | b1686 | [pn:hypothetical protein] |
| CONTIG476 | 12703468_c3_188 | 2991 | 8653 | 312 | 104 | 491 | 5.5(10)-47 | Escherichia coli | b1712 | [pn:integration host factor alpha-subunit] [gn:hima] |
| CONTIG476 | 35676636_c3_190 | 2992 | 8654 | 813 | 271 | 812 | 5.4(10)-81 | Escherichia coli | b1709 | [pn:vitamin b12 transport atp-binding protein btud] [gn:btud] |
| CONTIG476 | 34191502_c3_191 | 2993 | 8655 | 504 | 168 | 653 | 3.7(10)-64 | Escherichia coli | b1708 | [pn:probable lipoprotein in nlpc precursor] [gn:nlpc] |
| CONTIG476 | 38136_c3_193 | 2994 | 8656 | 1584 | 528 | 1970 | 1.0(10)-203 | Escherichia coli | b1706 | [pn:hypothetical protein] |
| CONTIG476 | 6054688_c3_213 | 2995 | 8657 | 3129 | 1043 | 4774 | 0 | Escherichia coli | b1687 | [pn:hypothetical protein] [gn:ydij] |
| CONTIG476 | 21766510_c3_215 | 2996 | 8658 | 231 | 77 | 238 | 3.6(10)-20 | Escherichia coli | b1685 | [pn:type 1 fimbrial subunit] [gn:fima] |
| CONTIG476 | 36439017_c3_216 | 2997 | 8659 | 546 | 182 | 243 | 1.1(10)-20 | Escherichia coli | b4314 | [pn:nitrate/nitrite sensor protein narx] [gn:narx] |
| CONTIG476 | 35187530_f1_3 | 2998 | 8660 | 1884 | 628 | 2268 | 2.7(10)-235 | Escherichia coli | b1222 | [pn:nitrate/nitrite response regulator protein narl] [gn:narl] |
| CONTIG477 | 15817592_f1_23 | 2999 | 8661 | 678 | 226 | 537 | 7.4(10)-52 | Escherichia coli | b1219 | [pn:hypothetical 12.7 kd protein in chac-narl intergenic region] [gn:ychn] |
| CONTIG477 | 12632675_f1_27 | 3000 | 8662 | 1131 | 377 | 1379 | 4.4(10)-141 | Escherichia coli | b1216 | [pn:putative calcium/proton antiporter] [gn:chaa] |
| CONTIG477 | 21994077_f1_33 | 3001 | 8663 | 870 | 290 | 1241 | 1.8(10)-126 | Escherichia coli | b1208 | [pn:hypothetical 30.9 kd protein in hemm-prs intergenic region] [gn:ychb] |
| CONTIG477 | 24656552_f1_34 | 3002 | 8664 | 1686 | 562 | 2131 | 9.0(10)-221 | Escherichia coli | b1206 | [pn:hypothetical protein in pth-prs intergenic region] [gn:ychm] |
| CONTIG477 | 26753326_f2_41 | 3003 | 8665 | 669 | 223 | 865 | 1.3(10)-86 | Escherichia coli | b1221 | [pn:nitrate/nitrite response regulator protein narl] [gn:narl] |
| CONTIG477 | 11988405_f2_47 | 3004 | 8666 | 246 | 82 | 102 | 0.00012 | Murine herpesvirus 68 | U97553 | [de:murine herpesvirus 68 strain wumms, complete genome.] [pn:unknown] [gn:gammahv.mf6] |
| CONTIG477 | 23625001_f2_62 | 3005 | 8667 | 1899 | 633 | 565 | 8.0(10)-55 | Escherichia coli | b4355 | [pn:methyl-accepting chemotaxis protein j] [gn:tsr] |
| CONTIG477 | 12643832_f2_78 | 3006 | 8668 | 522 | 174 | 638 | 1.5(10)-62 | Escherichia coli | b1209 | [pn:hemm protein] [gn:hemm] |
| CONTIG477 | 5197277_f2_81 | 3007 | 8669 | 588 | 196 | 818 | 1.2(10)-81 | Escherichia coli | b1204 | [pn:peptidyl-trna hydrolase] [gn:pth] |
| CONTIG477 | 26175318_f2_82 | 3008 | 8670 | 1107 | 369 | 1584 | 8.4(10)-163 | Escherichia coli | b1203 | [pn:ribose-phosphate pyrophosphokinase] [gn:ppsa] |
| CONTIG477 | 33228141_f3_131 | 3009 | 8671 | 1017 | 339 | 1563 | 1.3(10)-160 | Escherichia coli | b1207 | [pn:hypothetical gtp-binding protein in pth 3'''' region] [gn:ychf] |
| CONTIG477 | 32228386_c1_148 | 3010 | 8672 | 279 | 93 | 433 | 7.7(10)-41 | Escherichia coli | b1205 | [pn:hypothetical 10.5 kd protein in pth-prs intergenic region] [gn:ychh] |
| CONTIG477 | 23694406_c1_149 | 3011 | 8673 | 1116 | 372 | 507 | 1.1(10)-48 | Klebsiella oxytoca | P10488 | albicidin resistance protein. |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG477 | 15876283_c1_159 | 3012 | 8674 | 888 | 296 | 972 | 5.9(10)-98 | Escherichia coli | b1212 | [pn:possibly protoporphyrinogen oxidase] [gn:hemk] |
| CONTIG477 | 32690636_c1_163 | 3013 | 8675 | 843 | 281 | 1020 | 4.9(10)-103 | Escherichia coli | b1218 | [pn:cation transport protein chac] [gn:chac] |
| CONTIG477 | 12062836_c1_170 | 3014 | 8676 | 1365 | 455 | 1689 | 6.2(10)-174 | Klebsiella pneumoniae | L27431 | [de:klebsiella pneumoniae nitrate transporter component (nasf), nitrate transporter component (nase), nitrate transporter atpase component (nasd), and"] [pn:nitrate transporter component] [gn:nasf] |
| CONTIG477 | 6047667_c1_186 | 3015 | 8677 | 1440 | 480 | 1753 | 1.0(10)-180 | Escherichia coli | b1223 | [pn:nitrite extrusion protein] [gn:nark] |
| CONTIG477 | 24032082_c2_203 | 3016 | 8678 | 1164 | 388 | 1698 | 6.9(10)-175 | Escherichia coli | b1211 | [pn:peptide chain release factor 1] [gn:prfa] |
| CONTIG477 | 34585931_c2_209 | 3017 | 8679 | 249 | 83 | 251 | 1.5(10)-21 | Escherichia coli | b1217 | [pn:cation transport regulator chab] [gn:chab] |
| CONTIG477 | 24724187_c2_212 | 3018 | 8680 | 1227 | 409 | 900 | 2.5(10)-90 | Klebsiella pneumoniae | A55859 | regulatory protein nasr - klebsiella pneumoniae |
| CONTIG477 | 25672942_c2_226 | 3019 | 8681 | 2505 | 835 | 732 | 1.6(10)-72 | Methanobacterium thermoautotrophicum | MTH1552 | [pn:formate dehydrogenase, alpha subunit homolog] |
| CONTIG477 | 1291575_c2_227 | 3020 | 8682 | 1419 | 473 | 1532 | 2.7(10)-157 | Escherichia coli | b1220 | [pn:hypothetical protein in narl 5'''' region] [gn:ychp] |
| CONTIG477 | 3144165_c3_243 | 3021 | 8683 | 1302 | 434 | 1913 | 1.1(10)-197 | Escherichia coli | b1210 | [pn:glutamyl-trna reductase] [gn:hema] |
| CONTIG477 | 16219457_c3_248 | 3022 | 8684 | 417 | 139 | 395 | 8.3(10)-37 | Escherichia coli | b1213 | [pn:hypothetical protein] |
| CONTIG477 | 11212778_c3_249 | 3023 | 8685 | 813 | 271 | 1139 | 1.2(10)-115 | Escherichia coli | b1214 | [pn:hypothetical protein in hemk-kdsa] [gn:ycha] |
| CONTIG477 | 4001668_c3_250 | 3024 | 8686 | 864 | 288 | 1362 | 2.7(10)-139 | Escherichia coli | b1215 | [pn:2-dehydro-3-deoxyphosphooctonate aldolase] [gn:kdsa] |
| CONTIG477 | 34396092_c3_265 | 3025 | 8687 | 891 | 297 | 895 | 8.5(10)-90 | Klebsiella pneumoniae | L27431 | [de:klebsiella pneumoniae nitrate transporter component (nasf), nitrate transporter component (nase), nitrate transporter atpase component (nasd), and nitrate reductase small"] [pn:nitrate transporter component] [gn:nase] |
| CONTIG478 | 5275443_c3_266 | 3026 | 8688 | 798 | 266 | 1270 | 1.6(10)-129 | Klebsiella pneumoniae | L27431 | [de:klebsiella pneumoniae nitrate transporter component (nasf), nitrate transporter component (nase), nitrate transporter atpase component (nasd"] [pn:nitrate transporter atpase component] [gn:nasd] |
| CONTIG478 | 5192968_c3_267 | 3027 | 8689 | 3996 | 1332 | 2499 | 9.1(10)-260 | Escherichia coli | b3365 | [pn:nadh-nitrate oxidoreductase apoprotein] [gn:nirb] |
| CONTIG478 | 32453438_f1_1 | 3028 | 8690 | 582 | 194 | 111 | 7.2(10)-5 | Bacillus subtilis | pksA | [pn:transcriptional regulator] |
| CONTIG478 | 12548567_f1_15 | 3029 | 8691 | 918 | 306 | 878 | 5.4(10)-88 | Escherichia coli | b1466 | [pn:respiratory nitrate reductase 2 delta chain] [gn:narw] |
| CONTIG478 | 12213952_f1_18 | 3030 | 8692 | 765 | 255 | 854 | 1.8(10)-85 | Escherichia coli | b1462 | [pn:hypothetical protein] |
| CONTIG478 | 6735393_f1_19 | 3031 | 8693 | 285 | 95 | 446 | 3.2(10)-42 | Escherichia coli | b4294 | [pn:insertion element is1f protein insa] [gn:insa_7] |
| CONTIG478 | 2242625_f2_52 | 3032 | 8694 | 219 | 73 | 251 | 1.5(10)-21 | Escherichia coli | b2215 | [pn:outer membrane protein c precursor] [gn:ompc] |
| CONTIG478 | 4725761_f2_57 | 3033 | 8695 | 1473 | 491 | 1795 | 3.7(10)-185 | Escherichia coli | b1469 | [pn:nitrite extrusion protein] [gn:naru] |
| CONTIG478 | 32315576_f2_62 | 3034 | 8696 | 1590 | 530 | 2635 | 3.5(10)-274 | Escherichia coli | b1467 | [pn:respiratory nitrate reductase 2 beta chain] [gn:nary] |
| CONTIG478 | 2911290_f2_67 | 3035 | 8697 | 234 | 78 | 296 | 2.6(10)-26 | Escherichia coli | S40546 | hypothetical protein - escherichia coli |
| CONTIG478 | 25437756_f2_71 | 3036 | 8698 | 345 | 115 | 237 | 4.5(10)-20 | Bacillus subtilis | yczG | [pn:hypothetical protein] |
| CONTIG478 | 1207287_f2_89 | 3037 | 8699 | 897 | 299 | 693 | 2.2(10)-68 | Escherichia coli | b1328 | [pn:hypothetical protein] [gn:ycjz] |
| CONTIG478 | 22929826_f2_90 | 3038 | 8700 | 1599 | 533 | 2129 | 1.5(10)-220 | Escherichia coli | b1453 | [pn:hypothetical protein] [gn:ansp] |
| CONTIG478 | 10315956_f2_93 | 3039 | 8701 | 996 | 332 | 1314 | 3.3(10)-134 | Escherichia coli | b1451 | [pn:hypothetical protein] |
| CONTIG478 | 2456415_f3_100 | 3040 | 8702 | 3783 | 1261 | 6042 | 0 | Escherichia coli | b1468 | [pn:respiratory nitrate reductase 2 alpha chain] [gn:marz] |
| CONTIG478 | 31508556_f3_105 | 3041 | 8703 | 729 | 243 | 885 | 9.9(10)-89 | Escherichia coli | b1465 | [pn:respiratory nitrate reductase 2 gamma chain] [gn:marv] |
| CONTIG478 | 25567885_f3_108 | 3042 | 8704 | 525 | 175 | 898 | 4.0(10)-90 | Escherichia coli | b0264 | [pn:insertion element is1 protein insb] [gn:insb_2] |
| CONTIG478 | 21500925_f3_110 | 3043 | 8705 | 537 | 179 | 237 | 3.5(10)-19 | Eikenella corrodens | P35649 | hypothetical 66.3 kd protein in hag2 5' region |
| CONTIG478 | 16987716_f3_111 | 3044 | 8706 | 270 | 90 | 185 | 1.5(10)-13 | Eikenella corrodens | P35649 | hypothetical 66.3 kd protein in hag2 5' region |
| CONTIG478 | 21970417_f3_112 | 3045 | 8707 | 954 | 318 | 479 | 1.0(10)-45 | Eikenella corrodens | P35649 | hypothetical 66.3 kd protein in hag2 5' region |
| CONTIG478 | 4884652_c1_148 | 3046 | 8708 | 402 | 134 | 102 | 9.3(10)-6 | Enterobacter aerogenes | U67194 | or:enterobacter aerogenes pn:pep1 gn:tnpa le:12071 re:12071 di:complement nt:orf1 |
| CONTIG478 | 26426653_c1_151 | 3047 | 8709 | 1020 | 340 | 539 | 4.5(10)-52 | Bacillus subtilis | ytmO | [pn:hypothetical protein] |
| CONTIG478 | 24667250_c1_154 | 3048 | 8710 | 1329 | 443 | 1352 | 3.2(10)-138 | Bacillus subtilis | ytmJ | [pn:hypothetical protein] |
| CONTIG478 | 35664657_c1_158 | 3049 | 8711 | 837 | 279 | 559 | 3.5(10)-54 | Escherichia coli | b1917 | [pn:hypothetical protein] [gn:yecc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG478 | 5260443_c1_159 | 3050 | 8712 | 897 | 299 | 165 | 1.2(10)-10 | Escherichia coli | b1920 | [pn:fliy protein precursor] [gn:fliy] |
| CONTIG478 | 6439130_c1_160 | 3051 | 8713 | 273 | 91 | 244 | 8.3(10)-21 | Escherichia coli | b1461 | [pn:hypothetical 8.7 kd protein in rhse-narv intergenic region] [gn:ydce] |
| CONTIG478 | 189212_c1_161 | 3052 | 8714 | 1017 | 339 | 1053 | 1.6(10)-106 | Escherichia coli | b1054 | [pn:membrane protein affecting cell division, growth and high temperature survival] [gn:htrb] |
| CONTIG478 | 33787750_c1_169 | 3053 | 8715 | 882 | 294 | 1153 | 3.8(10)-117 | Escherichia coli | b1463 | [pn:hypothetical protein] |
| CONTIG478 | 4329693_c2_205 | 3054 | 8716 | 2112 | 704 | 2500 | 7.2(10)-260 | Escherichia coli | b3340 | [pn:fusa] [gn:fusa] |
| CONTIG478 | 5899187_c3_232 | 3055 | 8717 | 1074 | 358 | 1425 | 5.9(10)-146 | Escherichia coli | b1452 | [pn:hypothetical protein] |
| CONTIG478 | 1267275_c3_237 | 3056 | 8718 | 576 | 192 | 97 | 0.00259 | Bacillus subtilis | yqaC | [pn:hypothetical protein] |
| CONTIG478 | 19821086_c3_239 | 3057 | 8719 | 1137 | 379 | 879 | 4.2(10)-88 | Bacillus subtilis | yxeP | [pn:hypothetical protein] [gn:lp9h] |
| CONTIG478 | 15908556_c3_241 | 3058 | 8720 | 1062 | 354 | 206 | 1.7(10)-16 | Escherichia coli | b1920 | [pn:fliy protein precursor] [gn:fliy] |
| CONTIG478 | 4036693_c3_242 | 3059 | 8721 | 519 | 173 | 134 | 3.7(10)-9 | Methanobacterium thermoautotrophicum | MTH676 | [pn:unknown] |
| CONTIG478 | 5197943_c3_243 | 3060 | 8722 | 936 | 312 | 215 | 9.8(10)-18 | Escherichia coli | b1918 | [pn:yecc] |
| CONTIG478 | 4489843_c3_244 | 3061 | 8723 | 627 | 209 | 851 | 3.8(10)-85 | Escherichia coli | b1454 | [pn:hypothetical protein] |
| CONTIG478 | 14885165_c3_249 | 3062 | 8724 | 297 | 99 | 390 | 2.7(10)-36 | Escherichia coli | D93826 | hypothetical 11k protein (insertion sequence is1) escherichia coli this protein is coded by the insertion sequence is1. |
| CONTIG479 | 1290917_c3_265 | 3063 | 8725 | 1395 | 465 | 1230 | 2.7(10)-125 | Salmonella typhimurium | P37594 | methyl viologen resistance protein smva. |
| CONTIG479 | 26175336_c3_266 | 3064 | 8726 | 216 | 72 | 137 | 1.8(10)-9 | Bacteriophage PA2 | E25647 | hypothetical le protein - phage pa2 |
| CONTIG479 | 34552086_f1_3 | 3065 | 8727 | 786 | 262 | 1064 | 1.1(10)-107 | Escherichia coli | b1868 | [pn:hypothetical protein in asps 5'''' region] [gn:yece] |
| CONTIG479 | 4423942_f1_4 | 3066 | 8728 | 429 | 143 | 581 | 1.6(10)-56 | Escherichia coli | b1869 | [pn:hypothetical protein] |
| CONTIG479 | 10167501_f1_5 | 3067 | 8729 | 1011 | 337 | 1481 | 6.9(10)-152 | Escherichia coli | b1871 | [pn:hypothetical protein] |
| CONTIG479 | 7206518_f1_8 | 3068 | 8730 | 1743 | 581 | 2582 | 1.5(10)-268 | Escherichia coli | b1876 | [pn:arginyl-tma synthetase] [gn:args] |
| CONTIG479 | 16048255_f2_45 | 3069 | 8731 | 1347 | 449 | 1223 | 1.5(10)-124 | Escherichia coli | b1579 | [pn:hypothetical protein] |
| CONTIG479 | 3364465_f2_47 | 3070 | 8732 | 840 | 280 | 1190 | 4.7(10)-121 | Escherichia coli | b1870 | [pn:hypothetical protein] |
| CONTIG479 | 39052_f2_76 | 3071 | 8733 | 1317 | 439 | 646 | 2.1(10)-63 | Escherichia coli | b4077 | [pn:glutamate-aspartate carrier] [gn:gltp] |
| CONTIG479 | 6104837_f3_140 | 3072 | 8734 | 441 | 147 | 516 | 1.2(10)-49 | Escherichia coli | b1895 | [pn:hypothetical 17.1 kd protein in flhd-otsa intergenic region] |
| CONTIG479 | 24645818_c1_144 | 3073 | 8735 | 936 | 312 | 1293 | 5.7(10)-132 | Escherichia coli | b1889 | [pn:chemotaxis motb protein] [gn:motb] |
| CONTIG479 | 35330006_c1_149 | 3074 | 8736 | 792 | 264 | 103 | 0.0023 | Escherichia coli | b0944 | [pn:hypothetical fimbrial chaperone in pepn-pyrd intergenic region] [gn:ycbf] |
| CONTIG479 | 13080431_c1_161 | 3075 | 8737 | 465 | 155 | 371 | 2.8(10)-34 | Escherichia coli | b1882 | [pn:chemotaxis protein chey] [gn:chey] |
| CONTIG479 | 35188562_c2_181 | 3076 | 8738 | 1431 | 477 | 1957 | 2.5(10)-202 | Escherichia coli | b1896 | [pn:alpha trehalose phosphate synthase] [gn:otsa] |
| CONTIG479 | 26661516_c2_183 | 3077 | 8739 | 606 | 202 | 934 | 6.2(10)-94 | Escherichia coli | b1868 | [pn:flagellar transcriptional activator] [gn:flhc] |
| CONTIG479 | 2564716_c2_184 | 3078 | 8740 | 903 | 301 | 1159 | 9.0(10)-118 | Escherichia coli | b1869 | [pn:chemotaxis mota protein] [gn:mota] |
| CONTIG479 | 36349037_c2_186 | 3079 | 8741 | 2076 | 692 | 2572 | 1.7(10)-267 | Escherichia coli | b1888 | [pn:chemotaxis protein chea] [gn:chea] |
| CONTIG479 | 2449202_c2_187 | 3080 | 8742 | 573 | 191 | 102 | 0.0004 | Myxococcus xanthus | P27755 | protein u precursor |
| CONTIG479 | 15760407_c2_197 | 3081 | 8743 | 1635 | 545 | 1629 | 1.3(10)-167 | Escherichia coli | b1885 | [pn:methyl-accepting chemotaxis protein iv] [gn:tap] |
| CONTIG479 | 4570318_c2_199 | 3082 | 8744 | 1059 | 353 | 1653 | 4.0(10)-170 | Escherichia coli | b1883 | [pn:protein-glutamate methylesterase] [gn:cheb] |
| CONTIG479 | 12579542_c2_200 | 3083 | 8745 | 720 | 240 | 795 | 3.3(10)-79 | Escherichia coli | b1881 | [pn:chemotaxis protein chez] [gn:chez] |
| CONTIG479 | 3407752_c2_201 | 3084 | 8746 | 1173 | 391 | 1419 | 2.6(10)-145 | Escherichia coli | b1880 | [pn:flagellar transcriptional activator flhd] [gn:flhd] |
| CONTIG479 | 9929581_c2_205 | 3085 | 8747 | 432 | 144 | 472 | 5.7(10)-45 | Escherichia coli | b1878 | [pn:flagellar transcriptional activator] [gn:flhe] |
| CONTIG479 | 14855425_c2_206 | 3086 | 8748 | 1599 | 533 | 197 | 1.2(10)-12 | Escherichia coli | b3657 | [pn:hypothetical 51.0 kd protein in glts-selc intergenic region] [gn:yicj] |
| CONTIG479 | 24744006_c2_212 | 3087 | 8749 | 564 | 188 | 860 | 4.4(10)-86 | Escherichia coli | b1875 | [pn:hypothetical protein] [gn:yecm] |
| CONTIG479 | 23445328_c2_213 | 3088 | 8750 | 765 | 255 | 478 | 1.3(10)-45 | Escherichia coli | b1874 | [pn:copper homeostasis protein] [gn:cutc] |
| CONTIG479 | 30101377_c3_221 | 3089 | 8751 | 462 | 154 | 503 | 3.0(10)-48 | Escherichia coli | b1892 | [pn:flagellar transcriptional activator flhd] [gn:flhd] |
| CONTIG479 | 23726553_c3_224 | 3090 | 8752 | 519 | 173 | 693 | 2.2(10)-68 | Escherichia coli | b1887 | [pn:purine binding chemotaxis protein] [gn:chew] |
| CONTIG479 | 31806341_c3_227 | 3091 | 8753 | 609 | 203 | 119 | 3.1(10)-6 | Myxococcus xanthus | P27755 | protein u precursor. |
| CONTIG479 | 20604540_c3_229 | 3092 | 8754 | 2400 | 800 | 169 | 7.2(10)-9 | Escherichia coli | b3144 | [pn:hypothetical outer membrane usher protein in agal-mtr |

US 7,041,814 B1

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG479 | 11056950_c3_230 | 3093 | 8755 | 1773 | 591 | 1501 | 5.2(10)-154 | Escherichia coli | b1886 | intergenic region] [gn:yraj] |
| CONTIG479 | 4036688_c3_232 | 3094 | 8756 | 876 | 292 | 1309 | 1.2(10)-133 | Escherichia coli | b1884 | [pn:methyl-accepting chemotaxis protein ii] [gn:tar] |
| CONTIG479 | 15117832_c3_237 | 3095 | 8757 | 2094 | 698 | 2605 | 5.4(10)-271 | Escherichia coli | b1879 | [pn:chemotaxis protein methyltransferase] [gn:cher] |
| CONTIG479 | 13852002_c3_239 | 3096 | 8758 | 1167 | 389 | 422 | 1.1(10)-39 | Bacillus subtilis | yesR | [pn:flagellar biosynthesis protein flha] [gn:flha] |
| CONTIG48 | 6023461_c1_7 | 3097 | 8759 | 333 | 111 | 110 | 1.3(10)-6 | Bacteriophage P1 | L01408 | [pn:hypothetical protein] orbacteriophage p1 pn:partition protein gn:parb ie:<1 re:456 di:direct sr:bacteriophage p1 (individual isolate p1ke) dna |
| CONTIG480 | 26740760_f1_13 | 3098 | 8760 | 621 | 207 | 631 | 8.0(10)-62 | Helicobacter pylori | HP1563 | [pn:alkyl hydroperoxide reductase] |
| CONTIG480 | 24477316_f1_35 | 3099 | 8761 | 3147 | 1049 | 2369 | 5.5(10)-246 | Escherichia coli | b0397 | [pn:exonuclease sbcc] [gn:sbcc] |
| CONTIG480 | 24038875_f1_39 | 3100 | 8762 | 942 | 314 | 1343 | 2.8(10)-137 | Escherichia coli | b0393 | [pn:hypothetical 34.0 kd protein in arom-araj intergenic region] |
| CONTIG480 | 6461591_f1_45 | 3101 | 8763 | 822 | 274 | 1206 | 9.5(10)-123 | Escherichia coli | b0386 | [pn:pyrroline-5-carboxylate reductase] [gn:proc] |
| CONTIG480 | 4580282_f2_49 | 3102 | 8764 | 900 | 300 | 1472 | 6.2(10)-151 | Escherichia coli | b0411 | [pn:nucleoside-specific channel-forming protein tsx precursor] [gn:tsx] |
| CONTIG480 | 2547211_f2_80 | 3103 | 8765 | 1323 | 441 | 1708 | 6.0(10)-176 | Escherichia coli | b0398 | [pn:exonuclease sbcd] [gn:sbcd] |
| CONTIG480 | 21611505_f3_104 | 3104 | 8766 | 639 | 213 | 798 | 1.6(10)-79 | Escherichia coli | b0404 | [pn:hypothetical 23.0 kd protein in malz-quca intergenic region] [gn:yajb] |
| CONTIG480 | 14329693_c1_138 | 3105 | 8767 | 273 | 91 | 306 | 2.2(10)-27 | Escherichia coli | b0382 | [pn:hypothetical protein fragment in ddla-phoa intergenic region] |
| CONTIG480 | 14556508_c1_141 | 3106 | 8768 | 195 | 65 | 284 | 4.7(10)-25 | Escherichia coli | b0389 | [pn:hypothetical 7.3 kd protein in arol-arom intergenic region] |
| CONTIG480 | 21875076_c1_145 | 3107 | 8769 | 1107 | 369 | 1330 | 6.9(10)-136 | Escherichia coli | b0394 | [pn:hypothetical protein in araj-arom intergenic region] [gn:yajf] |
| CONTIG480 | 25945251_c1_157 | 3108 | 8770 | 717 | 239 | 1153 | 3.8(10)-117 | Escherichia coli | b0399 | [pn:phosphate regulon transcriptional regulatory protein |
| CONTIG480 | 26587916_c1_158 | 3109 | 8771 | 1299 | 433 | 1920 | 2.1(10)-198 | Escherichia coli | b0400 | [pn:phosphate regulon sensor protein phor] [gn:phor] |
| CONTIG480 | 14875018_c1_159 | 3110 | 8772 | 1326 | 442 | 1898 | 4.4(10)-196 | Escherichia coli | b0401 | [pn:branched chain amino acid transport system ii carrier protein] [gn:brnq] |
| CONTIG480 | 14588430_c1_160 | 3111 | 8773 | 1455 | 485 | 1858 | 7.7(10)-192 | Escherichia coli | b0402 | [pn:hypothetical protein] [gn:proy] |
| CONTIG480 | 21492016_c1_161 | 3112 | 8774 | 1845 | 615 | 2711 | 3.1(10)-282 | Escherichia coli | b0403 | [pn:maltodextrin glucosidase] [gn:malz] |
| CONTIG480 | 6536691_c1_165 | 3113 | 8775 | 474 | 158 | 97 | 0.0008 | Nephila clavipes | AF027735 | [de:nephila clavipes minor ampullate silk protein misp1 mrna, partial cds] [pn:minor ampullate silk protein misp1] |
| CONTIG480 | 12994007_c1_172 | 3114 | 8776 | 1107 | 369 | 1748 | 3.5(10)-180 | Escherichia coli | b0405 | [pn:trna ribosyltransferase-isomerase] [gn:quca] |
| CONTIG480 | 5327_c1_175 | 3115 | 8777 | 333 | 111 | 531 | 3.2(10)-51 | Escherichia coli | b0407 | [pn:hypothetical 11.9 kd protein in tgt-secd intergenic region] [gn:yajc] |
| CONTIG480 | 23280_c1_176 | 3116 | 8778 | 1875 | 625 | 2610 | 1.6(10)-271 | Escherichia coli | b0408 | [pn:protein-export membrane protein secd] [gn:secd] |
| CONTIG480 | 36073311_c1_178 | 3117 | 8779 | 384 | 128 | 130 | 2.3(10)-8 | Mycobacterium tuberculosis | Z95210 | unknown,, mtcy21c12.05, mtcy21c12.05. 1cn |
| CONTIG480 | 15055465_c2_187 | 3118 | 8780 | 471 | 157 | 613 | 6.5(10)-60 | Escherichia coli | b0387 | [pn:yaii] |
| CONTIG480 | 35629031_c2_188 | 3119 | 8781 | 669 | 223 | 569 | 3.0(10)-55 | Escherichia coli | b0388 | [pn:shikimate kinase ii] [gn:arol] |
| CONTIG480 | 1953465_c2_189 | 3120 | 8782 | 321 | 107 | 435 | 4.7(10)-41 | Escherichia coli | b0391 | [pn:hypothetical 10.2 kd protein in arom-araj intergenic region] |
| CONTIG480 | 13911282_c2_215 | 3121 | 8783 | 1026 | 342 | 1414 | 8.5(10)-145 | Escherichia coli | b0409 | [pn:protein-export membrane protein secf] [gn:secf] |
| CONTIG480 | 12501906_c2_217 | 3122 | 8784 | 744 | 248 | 218 | 4.7(10)-18 | Bacillus subtilis | yobV | [pn:hypothetical protein] |
| CONTIG480 | 35251317_c3_219 | 3123 | 8785 | 591 | 197 | 549 | 4.0(10)-53 | Escherichia coli | b1053 | [pn:hypothetical 43.9 kd protein in msyb-htrb intergenic region] [gn:ycee] |
| CONTIG480 | 3004066_c3_220 | 3124 | 8786 | 363 | 121 | 447 | 2.6(10)-42 | Escherichia coli | b0384 | [pn:phosphate starvation-inducible protein psif] [gn:psif] |
| CONTIG480 | 21759841_c3_221 | 3125 | 8787 | 1200 | 400 | 996 | 1.7(10)-100 | Escherichia coli | b0385 | [pn:hypothetical 41.5 kd protein in psif-proc intergenic region] [gn:yaic] |
| CONTIG481 | 5214091_c3_225 | 3126 | 8788 | 693 | 231 | 799 | 1.3(10)-79 | Escherichia coli | b0390 | [pn:arom protein] [gn:arom] |
| CONTIG481 | 36380083_c3_251 | 3127 | 8789 | 1197 | 399 | 1968 | 1.7(10)-203 | Escherichia coli | b0406 | [pn:queuine trna-ribosyltransferase] [gn:tgt] |
| CONTIG481 | 34042063_f1_6 | 3128 | 8790 | 1419 | 473 | 2247 | 4.5(10)-233 | Escherichia coli | b3962 | [pn:unknown dehydrogenase a] [gn:udha] |
| CONTIG481 | 14541018_f1_13 | 3129 | 8791 | 1164 | 388 | 1789 | 1.6(10)-184 | Escherichia coli | b3957 | [pn:acetylornithine deacetylase] [gn:arge] |
| CONTIG481 | 9806318_f1_26 | 3130 | 8792 | 2523 | 841 | 2841 | 5.2(10)-296 | Escherichia coli | b3947 | [pn:phosphoenolpyruvate-protein phosphotransferase ptsa] [gn:ptsa] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG481 | 29892965_f2_59 | 3131 | 8793 | 2670 | 890 | 4102 | 0 | Escherichia coli | b3956 | [pn:phosphoenolpyruvate carboxylase] [gn:ppc] |
| CONTIG481 | 27137_f2_60 | 3132 | 8794 | 912 | 304 | 1168 | 1.0(10)-118 | Escherichia coli | b3954 | [pn:hypothetical transcriptional regulator in glda-ppc intergenic] [gn:yijO] |
| CONTIG481 | 4428176_f3_85 | 3133 | 8795 | 1179 | 393 | 1788 | 2.0(10)-184 | Escherichia coli | b3965 | [pn:uracil-5-methyltransferase] [gn:trmA] |
| CONTIG481 | 33620166_f3_116 | 3134 | 8796 | 732 | 244 | 900 | 2.5(10)-90 | Escherichia coli | b3946 | [pn:transaldolase-like protein] [gn:talC] |
| CONTIG481 | 5977218_f3_117 | 3135 | 8797 | 1116 | 372 | 1734 | 1.1(10)-178 | Escherichia coli | b3945 | [pn:glycerol dehydrogenase] [gn:glda] |
| CONTIG481 | 4103427_c1_149 | 3136 | 8798 | 921 | 307 | 1508 | 9.5(10)-155 | Escherichia coli | b3961 | [pn:hydrogen peroxide-inducible genes activator] [gn:oxyr] |
| CONTIG481 | 10004056_c1_158 | 3137 | 8799 | 885 | 295 | 1324 | 3.0(10)-135 | Escherichia coli | b3967 | [pn:glutamate racemase] [gn:murI] |
| CONTIG481 | 29484442_c2_159 | 3138 | 8800 | 2487 | 829 | 3802 | 0 | Escherichia coli | b3940 | [pn:aspartokinase ii/homoserine dehydrogenase ii] [gn:metL] |
| CONTIG481 | 26775951_c2_174 | 3139 | 8801 | 339 | 113 | 436 | 3.7(10)-41 | Escherichia coli | b3950 | [pn:phosphotransfera] [gn:frwB] |
| CONTIG481 | 16110041_c2_175 | 3140 | 8802 | 2349 | 783 | 3547 | 0 | Escherichia coli | b3951 | [pn:formate acetyltransferase 2] [gn:pflD] |
| CONTIG481 | 26050393_c2_177 | 3141 | 8803 | 420 | 140 | 437 | 2.8(10)-41 | Escherichia coli | b3953 | [pn:phosphotransferase] [gn:frwD] |
| CONTIG481 | 5176592_c2_187 | 3142 | 8804 | 1014 | 338 | 1561 | 2.2(10)-160 | Escherichia coli | b3958 | [pn:n-acetyl-gamma-glutamyl-phosphate reductase] [gn:argC] |
| CONTIG481 | 5119143_c2_188 | 3143 | 8805 | 783 | 261 | 1143 | 4.5(10)-116 | Escherichia coli | b3959 | [pn:acetylglutamate kinase] [gn:argB] |
| CONTIG481 | 22135833_c2_189 | 3144 | 8806 | 1419 | 473 | 2100 | 1.7(10)-217 | Escherichia coli | b3960 | [pn:argininosuccinate lyase] [gn:argH] |
| CONTIG481 | 24788962_c2_192 | 3145 | 8807 | 807 | 269 | 942 | 9.0(10)-95 | Escherichia coli | b3963 | [pn:hypothetical 26.6 kd protein in udha-trma intergenic region] |
| CONTIG481 | 22462803_c2_193 | 3146 | 8808 | 378 | 126 | 463 | 5.2(10)-44 | Escherichia coli | b3964 | [pn:hypothetical 13.0 kd protein in udha-trma intergenic region] |
| CONTIG481 | 477291_c3_199 | 3147 | 8809 | 624 | 208 | 888 | 4.7(10)-89 | Escherichia coli | b3939 | [pn:cystathionine gamma-synthase] [gn:metB] |
| CONTIG481 | 665893_c3_206 | 3148 | 8810 | 894 | 298 | 1444 | 5.7(10)-148 | Escherichia coli | b3941 | [pn:5,10 methylenetetrahydrofolate reductase] [gn:metF] |
| CONTIG481 | 36126974_c3_207 | 3149 | 8811 | 2202 | 734 | 3234 | 0 | Escherichia coli | b3942 | [pn:catalase hydroperoxidase 1] [gn:katG] |
| CONTIG481 | 5891450_c3_214 | 3150 | 8812 | 1131 | 377 | 1281 | 1.1(10)-130 | Escherichia coli | b3949 | [pn:phosphotransferase] [gn:frwE] |
| CONTIG481 | 22464582_c3_219 | 3151 | 8813 | 987 | 329 | 1123 | 5.9(10)-114 | Escherichia coli | b3952 | [pn:probable pyruvate formate-lyase 2 activating enzyme] [gn:pflC] |
| CONTIG481 | 22915793_c3_239 | 3152 | 8814 | 1890 | 630 | 2190 | 5.0(10)-227 | Escherichia coli | b3966 | [pn:vitamin b12 receptor precursor] [gn:btuB] |
| CONTIG481 | 820216_f1_1 | 3153 | 8815 | 984 | 328 | 300 | 9.6(10)-27 | Haemophilus influenzae | HI1248 | [pn:hypothetical protein] |
| CONTIG482 | 5115718_f1_6 | 3154 | 8816 | 1002 | 334 | 961 | 8.6(10)-97 | Escherichia coli | b3909 | [pn:2-keto-3-deoxygluconate permease] [gn:kdgT] |
| CONTIG482 | 2423878_f1_12 | 3155 | 8817 | 531 | 177 | 608 | 2.2(10)-59 | Escherichia coli | b4107 | [pn:protein] [gn:phnB] |
| CONTIG482 | 26602316_f1_13 | 3156 | 8818 | 1029 | 343 | 1594 | 7.2(10)-164 | Escherichia coli | b4105 | [pn:carbon phosphorus lyase] [gn:phnD] |
| CONTIG482 | 14317706_f1_18 | 3157 | 8819 | 669 | 223 | 837 | 1.2(10)-83 | Escherichia coli | b4100 | [pn:phnH protein] [gn:phnH] |
| CONTIG482 | 24066662_f1_21 | 3158 | 8820 | 870 | 290 | 1440 | 1.5(10)-147 | Escherichia coli | b4098 | [pn:phnJ protein] [gn:phnJ] |
| CONTIG482 | 34239388_f1_25 | 3159 | 8821 | 648 | 216 | 641 | 7.0(10)-63 | Escherichia coli | b4094 | [pn:phosphonates transport atp-binding protein phnn] [gn:phnN] |
| CONTIG482 | 17054132_f1_37 | 3160 | 8822 | 1080 | 360 | 499 | 7.9(10)-48 | Bacillus subtilis | rbsC | [pn:ribose abc transporter] |
| CONTIG482 | 884702_f1_38 | 3161 | 8823 | 864 | 288 | 566 | 6.2(10)-55 | Bacillus subtilis | fbaA | [pn:fructose-1,6-bisphosphate aldolase] [gn:tsr] |
| CONTIG482 | 2644438_f1_45 | 3162 | 8824 | 492 | 164 | 412 | 1.3(10)-38 | Escherichia coli | b4078 | [pn:hypothetical 25.1 kd protein in gltp-fdhf intergenic region] [gn:yjcO] |
| CONTIG482 | 32612590_f1_46 | 3163 | 8825 | 189 | 63 | 263 | 8.0(10)-23 | Escherichia coli | b4078 | [pn:hypothetical 25.1 kd protein in gltp-fdhf intergenic region] [gn:yjcO] |
| CONTIG482 | 10987586_f2_54 | 3164 | 8826 | 492 | 164 | 568 | 3.7(10)-55 | Escherichia coli | b4108 | [pn:phnA protein] [gn:phnA] |
| CONTIG482 | 2125183_f2_61 | 3165 | 8827 | 759 | 253 | 1098 | 2.6(10)-111 | Escherichia coli | b4102 | [pn:phnF protein] [gn:phnF] |
| CONTIG482 | 25785827_f2_62 | 3166 | 8828 | 453 | 151 | 522 | 2.8(10)-50 | Escherichia coli | b4101 | [pn:phnG protein] [gn:phnG] |
| CONTIG482 | 33854562_f2_69 | 3167 | 8829 | 1266 | 422 | 1630 | 1.1(10)-167 | Escherichia coli | b4095 | [pn:phnM protein] [gn:phnM] |
| CONTIG482 | 12927258_f2_70 | 3168 | 8830 | 774 | 258 | 598 | 2.5(10)-58 | Escherichia coli | b4093 | [pn:phnO protein] [gn:phnO] |
| CONTIG482 | 3958592_f2_71 | 3169 | 8831 | 768 | 256 | 1084 | 8.0(10)-110 | Escherichia coli | b4092 | [pn:phnP protein] [gn:phnP] |
| CONTIG482 | 4116642_f2_75 | 3170 | 8832 | 1548 | 516 | 1154 | 3.1(10)-117 | Escherichia coli | rbsA | [pn:ribose abc transporter] |
| CONTIG482 | 13866580_f2_77 | 3171 | 8833 | 1008 | 336 | 332 | 3.8(10)-30 | Escherichia coli | rbsB | [pn:ribose abc transporter] |
| CONTIG482 | 19567043_f3_99 | 3172 | 8834 | 816 | 272 | 1144 | 3.5(10)-116 | Escherichia coli | b4106 | [pn:phosphonates transport atp-binding protein] [gn:phnC] |
| CONTIG482 | 6767917_f3_102 | 3173 | 8835 | 846 | 282 | 607 | 2.7(10)-59 | Escherichia coli | b4104 | [pn:phnC] |
| CONTIG482 | 16661008_f3_106 | 3174 | 8836 | 1170 | 390 | 1563 | 1.3(10)-160 | Escherichia coli | b4099 | [pn:phnI protein] [gn:phnI] |
| CONTIG482 | 35283517_f3_108 | 3175 | 8837 | 840 | 280 | 1119 | 1.6(10)-113 | Escherichia coli | b4097 | [pn:phosphonates transport atp-binding protein phnk] [gn:phnK] |
| CONTIG482 | 4488588_f3_109 | 3176 | 8838 | 690 | 230 | 1003 | 3.1(10)-101 | Escherichia coli | b4096 | [pn:phosphonates transport atp-binding protein phnl] [gn:phnL] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG482 | 19708567_f3_123 | 3177 | 8839 | 1083 | 361 | 152 | 2.0(10)-8 | Bacillus subtilis | ydjE | [pn:hypothetical protein] |
| CONTIG482 | 23447063_f3_127 | 3178 | 8840 | 444 | 148 | 701 | 3.1(10)-69 | Escherichia coli | b4079 | [pn:formate dehydrogenase, formate-hydrogen-lyase-linked, selenocysteine-containing polypeptide] [gn:fdhf] |
| CONTIG482 | 10646036_f3_128 | 3179 | 8841 | 1728 | 576 | 2902 | 1.8(10)-302 | Escherichia coli | b4079 | [pn:formate dehydrogenase, formate-hydrogen-lyase-linked, selenocysteine-containing polypeptide] [gn:fdhf] |
| CONTIG482 | 2756663_c2_176 | 3180 | 8842 | 189 | 63 | 175 | 1.0(10)-12 | Escherichia coli | b4077 | [pn:glutamate-aspartate carrier] [gn:gltp] |
| CONTIG482 | 14629593_c2_194 | 3181 | 8843 | 2310 | 770 | 593 | 8.5(10)-58 | Rhizobium leguminosarum | Z70305 | or:rhizobium leguminosarum pn:fix1 gn:fix1 le:1546 re:3471 di:direct nt:putative heme-binding, oxygen sensing protein |
| CONTIG482 | 10337827_c2_205 | 3182 | 8844 | 237 | 79 | 276 | 3.3(10)-24 | Escherichia coli | B35720 | hypothetical 28.6k protein - escherichia coli |
| CONTIG482 | 4375276_c2_215 | 3183 | 8845 | 417 | 139 | 94 | 6.5(10)-5 | Escherichia coli | C35720 | hypothetical 12.4k protein - escherichia coli |
| CONTIG482 | 2538135_c2_221 | 3184 | 8846 | 909 | 303 | 788 | 1.8(10)-78 | Escherichia coli | b4110 | [pn:hypothetical 31.8 kd protein in phna-prop intergenic region] [gn:yjcz] |
| CONTIG482 | 22736068_c2_225 | 3185 | 8847 | 1587 | 529 | 2169 | 8.5(10)-225 | Escherichia coli | b4111 | [pn:proline/betaine transporter] [gn:prop] |
| CONTIG482 | 15807841_c3_231 | 3186 | 8848 | 744 | 248 | 369 | 4.7(10)-34 | Escherichia coli | b3405 | [pn:ompr] [gn:ompr] |
| CONTIG482 | 14112961_c3_242 | 3187 | 8849 | 240 | 80 | 173 | 2.7(10)-13 | Escherichia coli | D35720 | hypothetical 13.7k protein - escherichia coli |
| CONTIG482 | 25833337_c3_256 | 3188 | 8850 | 1023 | 341 | 172 | 3.5(10)-13 | Escherichia coli | A35720 | hypothetical 16.1k protein (phnq 3 region) - escherichia coli |
| CONTIG482 | 135968_c3_261 | 3189 | 8851 | 2370 | 790 | 1679 | 9.0(10)-228 | Escherichia coli | b4109 | [pn:hypothetical 84.2 kd protein in phna-prop intergenic region] [gn:yjda] |
| CONTIG483 | 22834691_f1_6 | 3190 | 8852 | 891 | 297 | 1234 | 1.0(10)-125 | Escherichia coli | b3455 | [pn:high-affinity branched-chain amino acid transport atp-binding protein livg] [gn:livg] |
| CONTIG483 | 10677010_f1_8 | 3191 | 8853 | 1350 | 450 | 2061 | 2.3(10)-213 | Escherichia coli | b3453 | [pn:glycerol-3-phosphate-binding periplasmic protein precursor] [gn:ugpb] |
| CONTIG483 | 10634631_f1_9 | 3192 | 8854 | 891 | 297 | 1261 | 1.3(10)-128 | Escherichia coli | b3452 | [pn:sn-glycerol-3-phosphate transport system permease protein] [gn:ugpe] |
| CONTIG483 | 16286306_f1_10 | 3193 | 8855 | 1119 | 373 | 1701 | 3.2(10)-175 | Escherichia coli | b3450 | [pn:sn-glycerol-3-phosphate transport atp-binding protein] |
| CONTIG483 | 2534500_f1_18 | 3194 | 8856 | 1083 | 361 | 1456 | 3.1(10)-149 | Escherichia coli | b3438 | [pn:gntukr operon regulator] [gn:gntr] |
| CONTIG483 | 25509436_f1_19 | 3195 | 8857 | 549 | 183 | 687 | 9.4(10)-68 | Escherichia coli | b3437 | [pn:thermoresistant glucokinase] [gn:gntk] |
| CONTIG483 | 13946878_f1_20 | 3196 | 8858 | 1344 | 448 | 1223 | 1.5(10)-124 | Escherichia coli | b3436 | [pn:gntu_1] |
| CONTIG483 | 13132087_f1_25 | 3197 | 8859 | 2049 | 683 | 2777 | 3.2(10)-289 | Escherichia coli | b3431 | [pn:glycogen operon protein g|gx] [gn:g|gx] |
| CONTIG483 | 34010260_f2_35 | 3198 | 8860 | 927 | 309 | 1431 | 1.3(10)-146 | Escherichia coli | b3458 | [pn:leucine-specific binding protein precursor] [gn:livk] |
| CONTIG483 | 6142567_f2_39 | 3199 | 8861 | 1362 | 454 | 1638 | 1.6(10)-168 | Escherichia coli | b3456 | [pn:high-affinity branched-chain amino acid transport permease protein livm] [gn:livm] |
| CONTIG483 | 13854155_f2_40 | 3200 | 8862 | 741 | 247 | 1145 | 2.7(10)-116 | Escherichia coli | b3454 | [pn:high-affinity branched-chain amino acid transport atp-binding] [gn:livf] |
| CONTIG483 | 5348437_f2_60 | 3201 | 8863 | 2205 | 735 | 3757 | 0 | Escherichia coli | b3432 | [pn:1,4-alpha-glucan branching enzyme] [gn:glgb] |
| CONTIG483 | 35555135_f2_66 | 3202 | 8864 | 1647 | 549 | 2222 | 2.1(10)-230 | Escherichia coli | b3429 | [pn:glycogen synthase] [gn:glga] |
| CONTIG483 | 6849191_f2_67 | 3203 | 8865 | 2466 | 822 | 3732 | 0 | Escherichia coli | b3428 | [pn:alpha-glucan phosphorylase] [gn:glgp] |
| CONTIG483 | 22658562_f3_72 | 3204 | 8866 | 939 | 313 | 1163 | 3.3(10)-118 | Escherichia coli | b3457 | [pn:high-affinity branched-chain amino acid transport permease protein livh] [gn:livh] |
| CONTIG483 | 12526018_f3_79 | 3205 | 8867 | 858 | 286 | 1098 | 2.6(10)-111 | Escherichia coli | b3451 | [pn:sn-glycerol-3-phosphate transport system permease protein] [gn:ugpa] |
| CONTIG483 | 14574037_f3_84 | 3206 | 8868 | 756 | 252 | 1016 | 1.3(10)-102 | Escherichia coli | b3449 | [pn:glycerophosphoryl diester phosphodiesterase] [gn:ugpq] |
| CONTIG483 | 4105458_f3_85 | 3207 | 8869 | 1782 | 594 | 2482 | 5.7(10)-258 | Escherichia coli | b3447 | [pn:gamma-glutamyltranspeptidase] [gn:ggt] |
| CONTIG483 | 2853408_f3_88 | 3208 | 8870 | 1041 | 347 | 1700 | 4.2(10)-175 | Escherichia coli | b3440 | [pn:hypothetical 38.8 kd protein in gntr-ggt intergenic region] [gn:yhhx] |
| CONTIG483 | 16914058_f3_89 | 3209 | 8871 | 819 | 273 | 1145 | 2.7(10)-116 | Escherichia coli | b3439 | [pn:hypothetical 26.3 kd protein in gntr-ggt intergenic region] |
| CONTIG483 | 20445390_f3_95 | 3210 | 8872 | 1173 | 391 | 1793 | 6.0(10)-185 | Escherichia coli | b3433 | [pn:aspartate semialdehyde dehydrogenase] [gn:asd] |
| CONTIG483 | 19767905_f3_104 | 3211 | 8873 | 1374 | 458 | 1994 | 3.0(10)-206 | Escherichia coli | b3430 | [pn:glucose-1-phosphate adenylyltransferase] [gn:glgc] |
| CONTIG483 | 12605291_f3_113 | 3212 | 8874 | 258 | 86 | 94 | 0.00077 | Saccharomyces cerevisiae | YNL138W | [pn:adenylate cyclase-associated protein, 70 kda] [gn:srv2] |
| CONTIG483 | 20411717_c1_144 | 3213 | 8875 | 477 | 159 | 159 | 4.9(10)-17 | Escherichia coli | b3448 | [pn:hypothetical 16.6 kd protein in ggt-ugpq intergenic region precursor] [gn:yihha] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG483 | 13019705_c2_186 | 3214 | 8876 | 318 | 106 | 104 | 5.7(10)-6 | Escherichia coli | D90866 | or:escherichia coli pn:d-serine dehydratase transcriptional activator gn:dsdc le:10864 re:11133 di:complement sr:escherichia coli (strain:k12) dna, clone_lib:kohara lambda minise nt:similar to [pir accession number a28674]; |
| CONTIG483 | 17000951_c2_191 | 3215 | 8877 | 507 | 169 | 724 | 1.1(10)-71 | Escherichia coli | b3441 | [pn:hypothetical protein] [gn:yhly] |
| CONTIG483 | 24725008_c3_207 | 3216 | 8878 | 1536 | 512 | 2144 | 3.7(10)-222 | Escherichia coli | b3426 | [pn:aerobic glycerol-3-phosphate dehydrogenase] [gn:glpd] |
| CONTIG483 | 34417125_c3_229 | 3217 | 8879 | 600 | 200 | 763 | 8.3(10)-76 | Escherichia coli | b3434 | [pn:hypothetical protein] [gn:yhgn] |
| CONTIG483 | 22737668_f1_1 | 3218 | 8880 | 639 | 213 | 782 | 8.0(10)-78 | Escherichia coli | b0687 | [pn:seqa protein] [gn:seqa] |
| CONTIG484 | 21665656_f1_2 | 3219 | 8881 | 1665 | 555 | 2446 | 3.7(10)-254 | Escherichia coli | b0688 | [pn:phosphoglucomutase] [gn:pgm] |
| CONTIG484 | 975428_f1_21 | 3220 | 8882 | 303 | 101 | 315 | 2.5(10)-28 | Escherichia coli | b0699 | [pn:hypothetical 8.3 kd protein in rhsc 5"" region] [gn:ybfa] |
| CONTIG484 | 25494783_f1_25 | 3221 | 8883 | 1125 | 375 | 1214 | 1.3(10)-123 | Escherichia coli | b0712 | [pn:hypothetical protein] [gn:ybgk] |
| CONTIG484 | 16618761_f1_31 | 3222 | 8884 | 501 | 167 | 604 | 5.9(10)-59 | Escherichia coli | b0721 | [pn:succinate dehydrogenase cytochrome b-556 subunit] [gn:sdhc] |
| CONTIG484 | 15663465_f2_67 | 3223 | 8885 | 1434 | 478 | 1878 | 5.9(10)-194 | Escherichia coli | b0708 | [pn:deoxyribodipyrimidine photolyase] [gn:phrb] |
| CONTIG484 | 16667078_f2_68 | 3224 | 8886 | 657 | 219 | 989 | 9.4(10)-100 | Escherichia coli | b0711 | [pn:hypothetical protein] [gn:ybgi] |
| CONTIG484 | 33887962_f2_69 | 3225 | 8887 | 792 | 264 | 887 | 6.0(10)-89 | Escherichia coli | b0713 | [pn:hypothetical protein] [gn:ybgl] |
| CONTIG484 | 23629837_f2_70 | 3226 | 8888 | 804 | 268 | 1138 | 1.5(10)-115 | Escherichia coli | b0714 | [pn:endonuclease viii, dna n-glycosylase with an ap lyase activity] [gn:nei] |
| CONTIG484 | 26063532_f2_72 | 3227 | 8889 | 1860 | 620 | 2955 | 0 | Escherichia coli | b0723 | [pn:succinate dehydrogenase flavoprotein subunit] [gn:sdha] |
| CONTIG484 | 33805415_f2_73 | 3228 | 8890 | 732 | 244 | 1234 | 1.0(10)-125 | Escherichia coli | b0724 | [pn:succinate dehydrogenase iron-sulfur protein] [gn:sdhb] |
| CONTIG484 | 32235416_f2_75 | 3229 | 8891 | 1260 | 420 | 1765 | 5.5(10)-182 | Escherichia coli | b0727 | [pn:e2] [gn:sucb] |
| CONTIG484 | 25495836_f2_76 | 3230 | 8892 | 948 | 316 | 1117 | 2.6(10)-113 | Escherichia coli | b0729 | [pn:succinyl-coa synthetase alpha chain] [gn:sucd] |
| CONTIG484 | 24726711_f2_80 | 3231 | 8893 | 1686 | 562 | 2440 | 1.6(10)-253 | Escherichia coli | b0732 | [pn:ybgb] [gn:ybgg] |
| CONTIG484 | 6347132_f3_100 | 3232 | 8894 | 834 | 278 | 1208 | 5.7(10)-123 | Escherichia coli | b0710 | [pn:hypothetical protein] [gn:ybgj] |
| CONTIG484 | 29331261_f3_109 | 3233 | 8895 | 399 | 133 | 470 | 9.3(10)-45 | Escherichia coli | b0722 | [pn:succinate dehydrogenase 13 kd hydrophobic protein] [gn:sucd] |
| CONTIG484 | 5190968_f3_114 | 3234 | 8896 | 2817 | 939 | 4678 | 0 | Escherichia coli | b0726 | [pn:2-oxoglutarate dehydrogenase e1 component] [gn:suca] |
| CONTIG484 | 25490691_f3_116 | 3235 | 8897 | 1194 | 398 | 1622 | 7.9(10)-167 | Escherichia coli | b0728 | [pn:succinyl-coa synthetase beta chain] [gn:succ] |
| CONTIG484 | 433468_f3_119 | 3236 | 8898 | 1929 | 643 | 2228 | 4.7(10)-231 | Escherichia coli | b0731 | [pn:heat-responsive regulatory protein] [gn:hrsa] |
| CONTIG484 | 26458125_c1_148 | 3237 | 8899 | 1695 | 565 | 2180 | 5.7(10)-226 | Escherichia coli | b0698 | [pn:potassium-transporting atpase, a chain] [gn:kdpa] |
| CONTIG484 | 11931712_c1_149 | 3238 | 8900 | 2067 | 689 | 2744 | 1.0(10)-285 | Escherichia coli | b0697 | [pn:potassium-transporting atpase, b chain] [gn:kdpb] |
| CONTIG484 | 1992963_f1_1 | 3239 | 8901 | 588 | 196 | 632 | 6.4(10)-62 | Escherichia coli | b0696 | [pn:potassium-transporting atpase, c chain] [gn:kdpc] |
| CONTIG484 | 25988452_c1_150 | 3240 | 8902 | 2688 | 896 | 3570 | 0 | Escherichia coli | b0695 | [pn:sensor protein kdpd] [gn:kdpd] |
| CONTIG484 | 1423512_c1_151 | 3241 | 8903 | 195 | 65 | 90 | 0.00017 | Haemophilus influenzae | HI0592 | [pn:hypothetical protein] |
| CONTIG484 | 5289012_c1_152 | 3242 | 8904 | 2214 | 738 | 3359 | 0 | Escherichia coli | b0693 | [pn:ornithine decarboxylase, inducible] [gn:spef] |
| CONTIG484 | 24422650_c2_163 | 3243 | 8905 | 750 | 250 | 904 | 9.5(10)-91 | Escherichia coli | b0730 | [pn:fatty acyl responsive regulator] [gn:farr] |
| CONTIG484 | 10413587_c2_177 | 3244 | 8906 | 1221 | 407 | 1940 | 1.6(10)-200 | Escherichia coli | b0720 | [pn:glta] [gn:glta] |
| CONTIG484 | 36207127_c3_243 | 3245 | 8907 | 693 | 231 | 871 | 3.0(10)-87 | Escherichia coli | b0694 | [pn:kdp operon transcriptional regulatory protein kdpe] [gn:kdpe] |
| CONTIG484 | 14663091_c3_246 | 3246 | 8908 | 1389 | 463 | 1945 | 4.7(10)-201 | Escherichia coli | b0692 | [pn:putrescine-ornithine antiporter] [gn:pote] |
| CONTIG485 | 1992963_f1_1 | 3247 | 8909 | 531 | 177 | 215 | 9.8(10)-18 | Saccharomyces cerevisiae | S62019 | hypothetical protein ydr540c - yeast (saccharomyces cerevisiae) |
| CONTIG485 | 26599012_f1_2 | 3248 | 8910 | 600 | 200 | 293 | 5.2(10)-26 | Thiobacillus ferrooxidans | U66426 | or:thiobacillus ferrooxidans pn:transposase le:73 re:1284 transposase homolog (insertion element isae1) - alcaligenes eutrophus |
| CONTIG485 | 25681417_f1_3 | 3249 | 8911 | 315 | 105 | 117 | 1.8(10)-6 | Ralstonia eutropha | A47041 | |
| CONTIG485 | 5985443_f2_60 | 3250 | 8912 | 807 | 269 | 1184 | 2.0(10)-120 | Escherichia coli | P15026 | istb protein (insertion sequence is21). |
| CONTIG485 | 14238143_f3_100 | 3251 | 8913 | 1200 | 400 | 1910 | 2.3(10)-197 | Escherichia coli | P15025 | ista protein (insertion sequence is21) |
| CONTIG485 | 14657086_f3_101 | 3252 | 8914 | 333 | 111 | 132 | 4.2(10)-8 | Bordetella parapertussis | Q06126 | transposase for insertion sequence element is1001 |
| CONTIG485 | 25491665_c1_154 | 3253 | 8915 | 597 | 199 | 587 | 3.7(10)-57 | Escherichia coli | b4059 | [pn:single-strand dna-binding protein] [gn:ssb] |
| CONTIG485 | 15027217_c1_162 | 3254 | 8916 | 2112 | 704 | 107 | 0.01099 | Oenococcus oeni | S42039 | hypothetical protein 2 - leuconostoc oenos |
| CONTIG485 | 22933541_c2_190 | 3255 | 8917 | 2025 | 675 | 1098 | 2.6(10)-111 | Haemophilus influenzae | HI0444 | [PN:topoisomerase iii] [gn:topb] |
| CONTIG485 | 34412908_c2_198 | 3256 | 8918 | 579 | 193 | 345 | 1.6(10)-31 | Salmonella typhimurium | AF000360 | [PN:hypothetical protein] [DE:Salmonella typhimurium IncN plasmid pKM101 IS26 (IS46) element TnpA (tnpA) gene, |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG485 | 34415760_c2_216 | 3257 | 8919 | 1482 | 494 | 99 | 0.17999 | Escherichia coli | b1372 | [pn:hypothetical protein] complete cds.] [LE:1033] [RE:1674] [DI:complement] |
| CONTIG485 | 1258591_c3_230 | 3258 | 8920 | 294 | 98 | 100 | 1.5(10)-5 | Synechocystis sp. | S77531 | [PN:hypothetical protein] [OR:Synechocystis sp.] [SR:PCC 6803,, PCC 6803] [SR:PCC 6803,] |
| CONTIG485 | 13167787_c3_248 | 3259 | 8921 | 1518 | 506 | 97 | 0.42999 | Saccharomyces cerevisiae | YHR023W | [pn:type ii myosin heavy chain] [gn:myo1] |
| CONTIG485 | 32714125_c3_266 | 3260 | 8922 | 327 | 109 | 208 | 5.4(10)-17 | Escherichia coli | b1183 | [pn:umud protein] [gn:umud] |
| CONTIG485 | 5112518_f1_1 | 3261 | 8923 | 1428 | 476 | 1982 | 5.5(10)-205 | Escherichia coli | b4240 | [pn:phosphotransferase system trehalose permease] [gn:treb] |
| CONTIG485 | 9781900_f1_2 | 3262 | 8924 | 1695 | 565 | 2480 | 9.4(10)-258 | Escherichia coli | b4239 | [pn:trehalose-6-phosphate hydrolase] [gn:trec] |
| CONTIG485 | 7204593_f1_4 | 3263 | 8925 | 483 | 161 | 778 | 2.1(10)-77 | Escherichia coli | b4237 | [pn:anaerobic ribonucleoside-triphosphate reductase activating pr] [gn:nrdg] |
| CONTIG486 | 897326_f1_24 | 3264 | 8926 | 588 | 196 | 785 | 3.8(10)-78 | Escherichia coli | b4234 | [pn:x] [gn:yjga] |
| CONTIG486 | 4947281_f1_36 | 3265 | 8927 | 468 | 156 | 318 | 1.2(10)-28 | Escherichia coli | b4223 | [pn:ile repressor protein] [gn:yifa] |
| CONTIG486 | 441043_f1_51 | 3266 | 8928 | 567 | 189 | 681 | 4.0(10)-67 | Escherichia coli | b4216 | [pn:f18] [gn:ytf] |
| CONTIG486 | 3219057_f1_54 | 3267 | 8929 | 2073 | 691 | 2954 | 0 | Escherichia coli | b4213 | [pn:2"",3""-cyclic-nucleotide 2""-phosphodiesterase] [gn:cpdb] |
| CONTIG486 | 5133512_f2_59 | 3268 | 8930 | 2151 | 717 | 3486 | 0 | Escherichia coli | b4238 | [pn:anaerobic ribonucleoside-triphosphate reductase] [gn:nrdd] |
| CONTIG486 | 15080013_f2_78 | 3269 | 8931 | 1050 | 350 | 1627 | 2.2(10)-167 | Escherichia coli | b4232 | [pn:fructose-1,6-bisphosphatease] [gn:fbp] |
| CONTIG486 | 36536467_f2_87 | 3270 | 8932 | 630 | 210 | 899 | 3.2(10)-90 | Escherichia coli | b4226 | [pn:pyrophosphate phospho] [gn:ppa] |
| CONTIG486 | 32210956_f2_102 | 3271 | 8933 | 672 | 224 | 910 | 2.2(10)-91 | Escherichia coli | b4219 | [pn:peptide methionine sulfoxide reductase] [gn:msra] |
| CONTIG486 | 24228382_f3_156 | 3272 | 8934 | 1341 | 447 | 1948 | 2.2(10)-201 | Escherichia coli | b4218 | [pn:hypothetical 49.8 kd protein in cysq-msra intergenic region] |
| CONTIG486 | 26460400_c1_163 | 3273 | 8935 | 225 | 75 | 335 | 1.8(10)-30 | Escherichia coli | b4217 | [pn:hypothetical 9.6 kd protein in cysq-msra intergenic region] [gn:ytfk] |
| CONTIG486 | 275252_c1_167 | 3274 | 8936 | 2940 | 980 | 4140 | 0 | Escherichia coli | b4221 | [pn:hypothetical 136.8 kd protein in msra-chpb intergenic region] [gn:ytfn] |
| CONTIG486 | 25439541_c1_168 | 3275 | 8937 | 834 | 278 | 1142 | 5.7(10)-116 | Escherichia coli | b4221 | [pn:hypothetical 136.8 kd protein in msra-chpb intergenic region] [gn:ytfn] |
| CONTIG486 | 32507077_c1_174 | 3276 | 8938 | 1053 | 351 | 1069 | 3.1(10)-108 | Escherichia coli | b4230 | [pn:hypothetical 35.7 kd protein in ppa-fbp intergenic region] [gn:ytfl] |
| CONTIG486 | 2050705_c1_192 | 3277 | 8939 | 1209 | 403 | 332 | 3.8(10)-30 | Bacillus subtilis | ykgB | [pn:hypothetical protein] |
| CONTIG486 | 14165878_c2_209 | 3278 | 8940 | 774 | 258 | 1110 | 1.3(10)-112 | Escherichia coli | b4214 | [pn:cysq protein] [gn:cysq] |
| CONTIG486 | 35162813_c2_216 | 3279 | 8941 | 1860 | 620 | 2678 | 9.8(10)-279 | Escherichia coli | b4220 | [pn:hypothetical 64.8 kd protein in msra-chpbi intergenic region] [gn:ytfm] |
| CONTIG486 | 11027152_c2_222 | 3280 | 8942 | 1089 | 363 | 1366 | 1.1(10)-139 | Escherichia coli | b4231 | [pn:hypothetical 34.0 kd protein in ppa-fbp intergenic region] [gn:yiff] |
| CONTIG486 | 2775841_c2_223 | 3281 | 8943 | 1623 | 541 | 863 | 2.1(10)-86 | Escherichia coli | b1886 | [pn:methyl-accepting chemotaxis protein ii] [gn:tar] |
| CONTIG486 | 4556516_c2_226 | 3282 | 8944 | 1377 | 459 | 2270 | 1.7(10)-235 | Escherichia coli | b4233 | [pn:hypothetical 48.5 kd protein in fbp-pmba intergenic region] |
| CONTIG486 | 17057035_c2_235 | 3283 | 8945 | 1176 | 392 | 102 | 0.019 | Escherichia coli | b0512 | [pn:hypothetical protein] [gn:ybbx] |
| CONTIG486 | 25973588_c2_239 | 3284 | 8946 | 1923 | 641 | 567 | 4.9(10)-55 | Bacillus subtilis | licR | [pn:transcriptional regulator] [gn:celr] |
| CONTIG486 | 4818753_c3_259 | 3285 | 8947 | 354 | 118 | 554 | 1.2(10)-53 | Escherichia coli | b4222 | [pn:hypothetical 12.9 kd protein in msra-chpbi intergenic region] [gn:ytfp] |
| CONTIG486 | 26054762_c3_261 | 3286 | 8948 | 1104 | 368 | 1511 | 4.5(10)-155 | Escherichia coli | b4227 | [pn:o318] [gn:ytfg] |
| CONTIG486 | 31719406_c3_262 | 3287 | 8949 | 1614 | 538 | 1694 | 1.8(10)-174 | Escherichia coli | b4228 | [pn:hypothetical abc transporter in ppa-fbp intergenic region] [gn:ytfj] |
| CONTIG486 | 3401562_c3_268 | 3288 | 8950 | 1434 | 478 | 2089 | 2.6(10)-216 | Escherichia coli | b4235 | [pn:pmba protein] [gn:pmba] |
| CONTIG486 | 23697183_c3_269 | 3289 | 8951 | 390 | 130 | 376 | 8.5(10)-35 | Escherichia coli | b4236 | [pn:cytochrome b562] [gn:cybc] |
| CONTIG486 | 36520331_c3_274 | 3290 | 8952 | 1140 | 380 | 140 | 1.3(10)-6 | Haemophilus influenzae | HI0708 | [pn:l-seryl-trna] [gn:sela] |
| CONTIG487 | 4689187_f1_1 | 3291 | 8953 | 789 | 263 | 1065 | 8.3(10)-108 | Escherichia coli | b3364 | [pn:hypothetical 43.2 kd protein in ppia-nirb intergenic region] |
| CONTIG487 | 3562632_f1_4 | 3292 | 8954 | 360 | 120 | 481 | 6.4(10)-46 | Escherichia coli | b3366 | [pn:nadph small subunit] [gn:nird] |
| CONTIG487 | 6439205_f1_31 | 3293 | 8955 | 756 | 252 | 1041 | 2.8(10)-105 | Escherichia coli | b3399 | [pn:hypothetical 27.1 kd protein in mrca-pcka intergenic region] [gn:yrfg] |
| CONTIG487 | 26612631_f1_44 | 3294 | 8956 | 249 | 83 | 335 | 1.8(10)-30 | Escherichia coli | b3408 | [pn:ferrous iron transport protein a] [gn:feoa] |
| CONTIG487 | 35816686_f1_45 | 3295 | 8957 | 2349 | 783 | 3358 | 0 | Escherichia coli | b3409 | [pn:ferrous iron transport protein b] [gn:feob] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG487 | 4039033_f1_47 | 3296 | 8958 | 585 | 195 | 962 | 6.7(10)-97 | Escherichia coli | b3414 | [pn:hypothetical 21.0 kd protein in bioh-gntt intergenic region] |
| CONTIG487 | 30331875_f2_49 | 3297 | 8959 | 747 | 249 | 647 | 1.6(10)-63 | Escherichia coli | b3364 | [pn:hypothetical 43.2 kd protein in ppia-nirb intergenic region] |
| CONTIG487 | 25517283_f2_50 | 3298 | 8960 | 2469 | 823 | 3923 | 0 | Escherichia coli | b3365 | [pn:nadh-nitrate oxidoreductase apoprotein] [gn:nirb] |
| CONTIG487 | 22696061_f2_53 | 3299 | 8961 | 183 | 61 | 155 | 2.2(10)-11 | Escherichia coli | b3369 | [pn:hypothetical 5.8 kd protein in cysg-trps intergenic region] [gn:yhfl] |
| CONTIG487 | 15652152_f2_70 | 3300 | 8962 | 2625 | 875 | 3985 | 0 | Escherichia coli | b3396 | [pn:mrca] |
| CONTIG487 | 2926075_f2_88 | 3301 | 8963 | 351 | 117 | 359 | 5.4(10)-33 | Escherichia coli | b3410 | [pn:hypothetical 8.7 kd protein in fcob-bioh intergenic region] [gn:yhgg] |
| CONTIG487 | 6301518_f3_102 | 3302 | 8964 | 1383 | 461 | 2088 | 3.2(10)-216 | Escherichia coli | b3368 | [pn:siroheme synthase] [gn:cysg] |
| CONTIG487 | 3419138_f3_122 | 3303 | 8965 | 2151 | 717 | 2807 | 2.1(10)-292 | Escherichia coli | b3398 | [pn:hypothetical 79.5 kd protein in mrca-pcka intergenic region] [gn:yrff] |
| CONTIG487 | 10573437_f3_123 | 3304 | 8966 | 477 | 159 | 545 | 1.1(10)-52 | Escherichia coli | b3400 | [pn:hypothetical 15.5 kd protein in mrca-pcka intergenic region] [gn:yrfh] |
| CONTIG487 | 15725656_f3_124 | 3305 | 8967 | 903 | 301 | 1313 | 4.4(10)-134 | Escherichia coli | b3401 | [pn:hypothetical 32.8 kd protein in mrca-pcka intergenic region] [gn:yrfi] |
| CONTIG487 | 24785136_f3_129 | 3306 | 8968 | 1677 | 559 | 2513 | 3.0(10)-261 | Escherichia coli | b3403 | [pn:phosphoenolpyruvate carboxykinase] [gn:pcka] |
| CONTIG487 | 14491316_f3_132 | 3307 | 8969 | 801 | 267 | 154 | 3.1(10)-11 | Rhizobium sp. | S28675 | hypothetical protein 5 - rhizobium sp. (strain ic3342) |
| CONTIG487 | 32158437_f3_133 | 3308 | 8970 | 654 | 218 | 776 | 3.5(10)-77 | Escherichia coli | b3406 | [pn:transcription elongation factor greb] [gn:greb] |
| CONTIG487 | 16292280_f3_134 | 3309 | 8971 | 2418 | 806 | 3440 | 0 | Escherichia coli | b3407 | [pn:hypothetical 81.4 kd protein in greb-feoa intergenic region] [gn:yhgf] |
| CONTIG487 | 7207652_f2_140 | 3310 | 8972 | 855 | 285 | 770 | 1.5(10)-76 | Escherichia coli | b3413 | [pn:hypothetical 27.7 kd protein in bioh-gntt intergenic region] |
| CONTIG487 | 6454662_f3_143 | 3311 | 8973 | 1200 | 400 | 1635 | 3.2(10)-168 | Escherichia coli | b3415 | [pn:high-affinity gluconate transporter] [gn:gntt] |
| CONTIG487 | 32697167_c1_153 | 3312 | 8974 | 1350 | 450 | 1961 | 9.4(10)-203 | Escherichia coli | b3404 | [pn:osmolarity sensor protein envz] [gn:envz] |
| CONTIG487 | 1097206_c1_170 | 3313 | 8975 | 486 | 162 | 189 | 2.6(10)-14 | Escherichia coli | b3391 | [pn:protein transport protein hofq precursor] [gn:hofq] |
| CONTIG487 | 9767138_c1_172 | 3314 | 8976 | 642 | 214 | 940 | 1.5(10)-94 | Escherichia coli | b3390 | [pn:shikimic acid kinase i] [gn:arok] |
| CONTIG487 | 3149293_c1_173 | 3315 | 8977 | 1104 | 368 | 1535 | 1.3(10)-157 | Escherichia coli | b3389 | [pn:3-dehydroquinate synthase] [gn:arob] |
| CONTIG487 | 30366667_c1_176 | 3316 | 8978 | 873 | 291 | 1187 | 9.8(10)-121 | Escherichia coli | b3387 | [pn:dna adenine methylase] [gn:dam] |
| CONTIG487 | 23829557_c1_177 | 3317 | 8979 | 699 | 233 | 1124 | 4.5(10)-114 | Escherichia coli | b3386 | [pn:dod protein] [gn:rpe] |
| CONTIG487 | 31886465_c1_180 | 3318 | 8980 | 252 | 84 | 90 | 0.00119 | Plasmid R751 | L13688 | orplasmid r751 gn:kfra le:2408 re:3466 di:direct sr:plasmid r751 dna |
| CONTIG487 | 15040951_c2_196 | 3319 | 8981 | 786 | 262 | 1084 | 8.0(10)-110 | Escherichia coli | b3412 | [pn:bioh] [gn:bioh] |
| CONTIG487 | 5864427_c2_205 | 3320 | 8982 | 834 | 278 | 1212 | 2.2(10)-123 | Escherichia coli | b3405 | [pn:ompr] [gn:ompr] |
| CONTIG487 | 14073292_c2_219 | 3321 | 8983 | 591 | 197 | 885 | 9.9(10)-89 | Escherichia coli | b3397 | [pn:hypothetical 21.2 kd protein in mrca-pcka intergenic region] [gn:yrfe] |
| CONTIG487 | 2207675_c2_223 | 3322 | 8984 | 534 | 178 | 172 | 3.5(10)-13 | Escherichia coli | b3394 | [pn:hypothetical 20.8 kd protein in hofq-mrca intergenic region] [gn:yrfc] |
| CONTIG487 | 4197331_c2_224 | 3323 | 8985 | 456 | 152 | 197 | 7.9(10)-16 | Escherichia coli | b3393 | [pn:hypothetical 16.8 kd protein in hofq-mrca intergenic region] [gn:yrfb] |
| CONTIG487 | 32557191_c2_226 | 3324 | 8986 | 315 | 105 | 94 | 0.00022 | Escherichia coli | b3390 | [pn:shikimic acid kinase i] [gn:arok] |
| CONTIG487 | 23650278_c2_230 | 3325 | 8987 | 765 | 255 | 1045 | 1.1(10)-105 | Escherichia coli | b3385 | [pn:hypothetical 27.4 kd protein in trps-dod intergenic region] [gn:gph] |
| CONTIG487 | 24736537_c3_243 | 3326 | 8988 | 501 | 167 | 118 | 1.8(10)-7 | Escherichia coli | D90866 | or:escherichia coli pn:d-serine dehydratase transcriptional activator gn:dsdc le:10864 re:11133 di:complement sr:escherichia coli gn:dsdc (strain:k12) dna, clone_lib:kohara lambda minise nt:similar to [pir accession number a28674]; |
| CONTIG487 | 24431563_c3_258 | 3327 | 8989 | 1761 | 587 | 950 | 1.3(10)-95 | Escherichia coli | b3402 | [pn:hypothetical 64.6 kd protein in mrca-pcka intergenic region] [gn:yhge] |
| CONTIG487 | 134667_c3_269 | 3328 | 8990 | 777 | 259 | 535 | 1.2(10)-51 | Escherichia coli | b3395 | [pn:hypothetical 30.0 kd protein in hofq-mrca intergenic region] [gn:yrfd] |
| CONTIG487 | 11720828_c3_270 | 3329 | 8991 | 468 | 156 | 295 | 3.2(10)-26 | Escherichia coli | b3392 | [pn:hypothetical 16.9 kd protein in hofq-mrca intergenic region] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG487 | 35441390_c3_271 | 3330 | 8992 | 1149 | 383 | 1180 | 5.4(10)-120 | Escherichia coli | b3391 | [gn:yrfa] [pn:protein transport protein hofq precursor] [gn:hofq] |
| CONTIG487 | 986077_c3_272 | 3331 | 8993 | 1290 | 430 | 902 | 1.1(10)-105 | Escherichia coli | b3388 | [pn:damx protein] [gn:damx] |
| CONTIG487 | 23556552_c3_273 | 3332 | 8994 | 1008 | 336 | 1646 | 2.2(10)-169 | Escherichia coli | b3384 | [pn:tryptophanyl-trna synthetase] [gn:trps] |
| CONTIG488 | 26458418_f1_32 | 3333 | 8995 | 1638 | 546 | 171 | 7.2(10)-10 | Escherichia coli | b0591 | [pn:hypothetical membrane protein p43] [gn:ybda] |
| CONTIG488 | 5960056_f1_33 | 3334 | 8996 | 846 | 282 | 963 | 5.2(10)-97 | Pseudomonas fluorescens | U12537 | or:pseudomonas fluorescens pn:esterase ie:248 re:1066 di:direct [de:neisseria gonorrhoeae strain wr302 tex gene, partial cds, 5-methylcytosine methyltransferase (demh), n6-methyl/adeninemethyltransferase (damh) and restriction endonuclease (de")] [pn:restriction endonuclease] [gn:derh] |
| CONTIG488 | 25448950_f1_48 | 3335 | 8997 | 1017 | 339 | 119 | 0.00014 | Neisseria gonorrhoeae | AF001598 | or:pseudomonas alcaligenes pn:putative transposase subunit gn:orf2 ie:1104 re:2426 di:direct |
| CONTIG488 | 31343942_f2_70 | 3336 | 8998 | 858 | 286 | 92 | 0.094 | Pseudomonas alcaligenes | U84154 | [pn:mcrc protein] [gn:mcrc] |
| CONTIG488 | 26457290_f2_74 | 3337 | 8999 | 1179 | 393 | 168 | 5.0(10)-10 | Escherichia coli | b4345 | [pn:transcriptional regulator] |
| CONTIG488 | 16023540_f2_78 | 3338 | 9000 | 1035 | 345 | 334 | 2.3(10)-30 | Bacillus subtilis | degA | [de:pseudomonas sp. dna for styrene catabolism genes.] |
| CONTIG488 | 4476702_f3_93 | 3339 | 9001 | 618 | 206 | 456 | 2.7(10)-43 | Pseudomonas sp. | AJ000330 | [pn:styrene response regulator] [gn:styr] |
| CONTIG488 | 2086630_f3_108 | 3340 | 9002 | 1884 | 628 | 393 | 3.2(10)-36 | Bacillus subtilis | ytcJ | [pn:hypothetical protein] |
| CONTIG488 | 21596925_f3_115 | 3341 | 9003 | 2028 | 676 | 549 | 4.0(10)-53 | Escherichia coli | b4346 | [pn:5-methylcytosine-specific restriction enzyme b] [gn:mcrb] |
| CONTIG488 | 3909818_f3_122 | 3342 | 9004 | 1014 | 338 | 825 | 2.2(10)-82 | Clostridium longisporum | Q46127 | tryptophanyl-trna synthetase (ec 6.1.1.2) (tryptophan-trna ligase) (trprs). |
| CONTIG488 | 35214849_c1_125 | 3343 | 9005 | 370 | 123 | 498 | 1.0(10)-47 | Enterobacter agglomerans | B38965 | hypothetical protein b (insertion sequence is1222)-enterobacter agglomerans |
| CONTIG488 | 23930317_c1_134 | 3344 | 9006 | 414 | 138 | 101 | 0.00019 | Pseudomonas aeruginosa | Z54213 | or:pseudomonas aeruginosa pn:alginate lyase gn:algy ie:1820 re:3874 di:direct |
| CONTIG488 | 1192705_c1_160 | 3345 | 9007 | 1155 | 385 | 1353 | 2.5(10)-138 | Escherichia coli | b1128 | [pn:hypothetical protein in pept-phoq intergenic region] [gn:yefl] |
| CONTIG488 | 34647887_c2_169 | 3346 | 9008 | 516 | 172 | 186 | 1.2(10)-14 | Vibrio cholerae | S81006 | or:vibrio cholerae pn:hcp gn:hcp ie:690 re:1208 di:direct sr:vibrio cholerae o17 nt 28 kda secreted hydrophilic protein; this sequence |
| CONTIG488 | 6725052_c2_174 | 3347 | 9009 | 1113 | 371 | 602 | 9.5(10)-59 | Mycobacterium tuberculosis | Z95150 | unknown,, mtcy164.07, mtcy164.07. unknown, len |
| CONTIG488 | 16300816_c2_175 | 3348 | 9010 | 1434 | 478 | 425 | 5.5(10)-40 | Bacillus subtilis | yjmB | [pn:hypothetical protein] |
| CONTIG488 | 25892702_c2_189 | 3349 | 9011 | 468 | 156 | 151 | 5.9(10)-11 | Haemophilus influenzae | H0884 | [pn:aerobic respiration control protein arca] [gn:arca] |
| CONTIG488 | 5338193_c2_190 | 3350 | 9012 | 5595 | 1865 | 235 | 1.0(10)-15 | Bacillus subtilis | yloP | [pn:hypothetical protein] |
| CONTIG488 | 16586458_c2_192 | 3351 | 9013 | 630 | 210 | 406 | 5.7(10)-38 | Bacillus subtilis | clpP | [pn:class iii heat-shock protein] [gn:yvdn] |
| CONTIG488 | 884575_c2_194 | 3352 | 9014 | 1017 | 339 | 307 | 1.7(10)-27 | Bordetella pertussis | AF018255 | [de:bordetella pertussis alcaligin siderophore system regulator (alcr) gene, complete cds.] [pn:alcr] [gn:alcr] [alt:member of arac family, regulator of alcaligin] |
| CONTIG488 | 5908451_c3_195 | 3353 | 9015 | 279 | 93 | 327 | 1.3(10)-29 | Escherichia coli | b4308 | [pn:hypothetical 38.0 kd protein in feci-fimb intergenic region] [gn:yjhr] |
| CONTIG488 | 4071963_c3_197 | 3354 | 9016 | 477 | 159 | 95 | 0.00013 | Escherichia coli | b4347 | [pn:hypothetical 14.6 kd protein in mcrb-hsds intergenic region] [gn:yjiw] |
| CONTIG488 | 15814391_c3_203 | 3355 | 9017 | 612 | 204 | 734 | 9.9(10)-73 | Escherichia coli | A60635 | glutathione transferase (ec 2.5.1.18), fosfomycin-modifying-escherichia coli plasmid psu961 transposon tn2921 this enzyme inactivates the antibiotic phosphomycin by opening the epoxide ring and creating an adduct with glutathione. |
| CONTIG488 | 10271881_c3_220 | 3356 | 9018 | 711 | 237 | 259 | 2.1(10)-22 | Escherichia coli | b0897 | [pn:hypothetical 23.1 kd protein in dmsc 3'"" region] [gn:ycac] |
| CONTIG488 | 2037813_c3_233 | 3357 | 9019 | 2112 | 704 | 1451 | 1.0(10)-148 | Erwinia amylovora | AJ223062 | [de:erwinia amylovora foxr gene.] [pn:ferrioxamine receptor] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG489 | 7120253_f1_1 | 3358 | 9020 | 1143 | 381 | 1780 | 1.3(10)-183 | Escherichia coli | b2097 | [gn:foxr] [pn:hypothetical protein] |
| CONTIG489 | 17065668_f1_38 | 3359 | 9021 | 618 | 206 | 936 | 3.8(10)-94 | Escherichia coli | b2065 | [pn:deoxycytidine triphosphate deaminase] [gn:dcd] |
| CONTIG489 | 22299168_f1_45 | 3360 | 9022 | 2235 | 745 | 2883 | 1.8(10)-300 | Escherichia coli | b2060 | [pn:hypothetical protein] |
| CONTIG489 | 36407341_f1_47 | 3361 | 9023 | 510 | 170 | 780 | 1.3(10)-77 | Escherichia coli | b2058 | [pn:putative acetyl transferase] [gn:wcab] |
| CONTIG489 | 14163325_f1_49 | 3362 | 9024 | 1116 | 372 | 1176 | 1.3(10)-119 | Escherichia coli | b2056 | [pn:hypothetical protein] [gn:wcad] |
| CONTIG489 | 24650305_f2_74 | 3363 | 9025 | 1140 | 380 | 1771 | 1.3(10)-182 | Escherichia coli | b2062 | [pn:hypothetical protein] [gn:wza] |
| CONTIG489 | 1213533_f2_75 | 3364 | 9026 | 450 | 150 | 606 | 3.6(10)-59 | Escherichia coli | b2061 | [pn:hypothetical protein] [gn:wzb] |
| CONTIG489 | 4101718_f2_79 | 3365 | 9027 | 852 | 284 | 1378 | 5.5(10)-141 | Escherichia coli | b2059 | [pn:hypothetical protein] [gn:wcaa] |
| CONTIG489 | 4782830_f3_108 | 3366 | 9028 | 1020 | 340 | 1061 | 2.2(10)-107 | Escherichia coli | b2068 | [pn:dna-3-methyladenine glycosidase ii] [gn:alka] |
| CONTIG489 | 21900836_f3_113 | 3367 | 9029 | 534 | 178 | 95 | 0.01799 | Methanobacterium thermoautotrophicum | MTH954 | [pn:atp synthase, subunit b] |
| CONTIG489 | 6533041_f3_116 | 3368 | 9030 | 693 | 231 | 1071 | 1.8(10)-108 | Escherichia coli | b2066 | [pn:uridine kinase] [gn:udk] |
| CONTIG489 | 2972817_f3_117 | 3369 | 9031 | 1881 | 627 | 2079 | 2.8(10)-215 | Escherichia coli | b2064 | [pn:yegal] [gn:asma] |
| CONTIG489 | 29504766_f3_127 | 3370 | 9032 | 1308 | 436 | 1789 | 1.6(10)-184 | Escherichia coli | b2057 | [pn:hypothetical protein] [gn:wcac] |
| CONTIG489 | 24395411_c1_168 | 3371 | 9033 | 1449 | 483 | 1938 | 2.6(10)-200 | Escherichia coli | b2078 | [pn:sensor protein baes] [gn:baes] |
| CONTIG489 | 13906637_c2_191 | 3372 | 9034 | 3417 | 1139 | 4069 | 0 | Escherichia coli | b2067 | [pn:hypothetical 123.9 kd protein in udk-alka intergenic region] [gn:yege] |
| CONTIG489 | 31844831_c2_194 | 3373 | 9035 | 3186 | 1062 | 3946 | 0 | Escherichia coli | b2075 | [pn:hypothetical protein] |
| CONTIG489 | 10953_c2_195 | 3374 | 9036 | 3078 | 1026 | 4028 | 0 | Escherichia coli | b2076 | [pn:hypothetical protein] |
| CONTIG489 | 2550952_c2_196 | 3375 | 9037 | 1416 | 472 | 1529 | 5.5(10)-157 | Escherichia coli | b2077 | [pn:hypothetical protein] [gn:yegb] |
| CONTIG489 | 650700_c2_197 | 3376 | 9038 | 357 | 119 | 91 | 0.00013 | Daucus carota | U47097 | or:daucus carota pn:glycine-rich protein le:<1 re:336 di:direct sr:carrot strain=danver half-long |
| CONTIG489 | 33628506_c2_202 | 3377 | 9039 | 1386 | 462 | 2084 | 8.6(10)-216 | Escherichia coli | b2081 | [pn:hypothetical protein] [gn:yegq] |
| CONTIG489 | 26535955_c3_216 | 3378 | 9040 | 1629 | 543 | 2101 | 1.3(10)-217 | Escherichia coli | b2063 | [pn:hypothetical protein] [gn:yegi] |
| CONTIG489 | 1082040_c3_228 | 3379 | 9041 | 1452 | 484 | 1977 | 1.8(10)-204 | Escherichia coli | b2069 | [pn:yegd] |
| CONTIG489 | 14486438_c3_230 | 3380 | 9042 | 1215 | 405 | 1533 | 2.1(10)-157 | Escherichia coli | b2074 | [pn:hypothetical protein] |
| CONTIG489 | 33473136_c3_236 | 3381 | 9043 | 768 | 256 | 1094 | 7.0(10)-111 | Escherichia coli | b2079 | [pn:transcriptional regulatory protein baer] [gn:baer] |
| CONTIG489 | 36523426_c3_241 | 3382 | 9044 | 921 | 307 | 1081 | 1.7(10)-109 | Escherichia coli | b2086 | [pn:hypothetical protein] [gn:yegs] |
| CONTIG49 | 31437686_c1_1 | 3383 | 9045 | 285 | 95 | 91 | 0.00083 | Escherichia coli | D90807 | or:escherichia coli pn:fusaric acid resistance protein fuse. le:18869 re:19858 di:direct sr:escherichia coli (strain:k12) dna, clone_lib:kohara lambda minise nt:orf_id:o316#23, similar to [swissprot accession |
| CONTIG490 | 32464583_f1_1 | 3384 | 9046 | 1392 | 464 | 1788 | 2.0(10)-184 | Escherichia coli | b3035 | [pn:tolc] [gn:tolc] |
| CONTIG490 | 35644442_f1_2 | 3385 | 9047 | 204 | 68 | 160 | 6.5(10)-12 | Escherichia coli | b3036 | [pn:hypothetical 9.9 kd protein in tolc-ribb/htrp intergenic region] |
| CONTIG490 | 3379790_f1_3 | 3386 | 9048 | 1200 | 400 | 1939 | 2.0(10)-200 | Escherichia coli | b3038 | [pn:hypothetical 45.0 kd protein in tolc-ribb/htrp intergenic region] [gn:ygic] |
| CONTIG490 | 23632140_f1_6 | 3387 | 9049 | 2532 | 844 | 2377 | 7.7(10)-247 | Escherichia coli | b0718 | [pn:hypothetical protein] |
| CONTIG490 | 4331563_f1_7 | 3388 | 9050 | 771 | 257 | 698 | 6.4(10)-69 | Escherichia coli | b0717 | [pn:hypothetical protein] |
| CONTIG490 | 10672833_f1_31 | 3389 | 9051 | 600 | 200 | 350 | 4.9(10)-32 | Bacillus subtilis | ureA | [pn:urease] |
| CONTIG490 | 22917040_f1_40 | 3390 | 9052 | 255 | 85 | 357 | 8.8(10)-33 | Escherichia coli | b3065 | [pn:30s ribosomal subunit protein s21] [gn:rpsu] |
| CONTIG490 | 4103953_f1_42 | 3391 | 9053 | 1980 | 660 | 2670 | 6.9(10)-278 | Escherichia coli | b3067 | [pn:rna polymerase sigma-70 factor] [gn:rpod] |
| CONTIG490 | 554651_f1_44 | 3392 | 9054 | 1203 | 401 | 93 | 0.34999 | Escherichia coli | b2592 | [pn:clpb protein] [gn:clpb] |
| CONTIG490 | 24707030_f2_54 | 3393 | 9055 | 783 | 261 | 1044 | 1.3(10)-105 | Escherichia coli | b3037 | [pn:hypothetical 24.9 kd protein in tolc-ribb/htrp intergenic region] [gn:ygib] |
| CONTIG490 | 14932812_f2_64 | 3394 | 9056 | 375 | 125 | 290 | 1.1(10)-25 | Escherichia coli | b0716 | [pn:hypothetical protein] |
| CONTIG490 | 32304812_f2_79 | 3395 | 9057 | 1578 | 526 | 207 | 7.4(10)-14 | Bacillus subtilis | yfiG | [pn:hypothetical protein] |
| CONTIG490 | 35430415_f2_80 | 3396 | 9058 | 846 | 282 | 931 | 1.3(10)-93 | Klebsiella aerogenes | Q09063 | urease operon ured protein. |
| CONTIG490 | 823905_f2_81 | 3397 | 9059 | 399 | 133 | 317 | 1.5(10)-28 | Haemophilus influenzae | HI0540 | [pn:urease beta subunit] [gn:ureb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG490 | 30718912_f2_87 | 3398 | 9060 | 726 | 242 | 817 | 1.6(10)-81 | Klebsiella aerogenes | P18318 | urease accessory protein ureF. |
| CONTIG490 | 4097318_f2_88 | 3399 | 9061 | 627 | 209 | 691 | 3.6(10)-68 | Helicobacter pylori | HP0068 | [pn:urease accessory protein] [gn:ureg] |
| CONTIG490 | 9892668_f2_91 | 3400 | 9062 | 1812 | 604 | 2662 | 4.9(10)-277 | Escherichia coli | b3066 | [pn:dna primase] [gn:dnag] |
| CONTIG490 | 4492818_f2_94 | 3401 | 9063 | 504 | 168 | 526 | 1.1(10)-50 | Escherichia coli | b3071 | [pn:hypothetical protein] |
| CONTIG490 | 4539193_f3_102 | 3402 | 9064 | 783 | 261 | 1124 | 4.5(10)-114 | Escherichia coli | b3040 | [pn:hypothetical 26.5 kd protein in tolc-ribb/hrtp intergenic region] [gn:ybgd] |
| CONTIG490 | 24235787_f3_103 | 3403 | 9065 | 681 | 227 | 376 | 8.5(10)-35 | Escherichia coli | b0719 | [pn:hypothetical fimbrial-like protein in glta 3'''' region] [gn:ybgd] |
| CONTIG490 | 36051013_f3_104 | 3404 | 9066 | 741 | 247 | 739 | 2.8(10)-73 | Escherichia coli | b0716 | [pn:hypothetical protein] |
| CONTIG490 | 4797911_f3_107 | 3405 | 9067 | 342 | 114 | 424 | 7.0(10)-40 | Escherichia coli | b3042 | [pn:hypothetical protein] |
| CONTIG490 | 5086400_f3_121 | 3406 | 9068 | 702 | 234 | 852 | 3.1(10)-85 | Escherichia coli | b3055 | [pn:hypothetical protein in glnc-cca intergenic region] [gn:ygim] |
| CONTIG490 | 10159776_f3_122 | 3407 | 9069 | 1302 | 434 | 1840 | 6.2(10)-190 | Escherichia coli | b3056 | [pn:trna nucleotidyltransferase] [gn:cca] |
| CONTIG490 | 11882677_f3_124 | 3408 | 9070 | 735 | 245 | 921 | 1.5(10)-92 | Escherichia coli | b3059 | [pn:hypothetical 22.2 kd protein in baca-ttda intergenic region] |
| CONTIG490 | 2525287_f3_129 | 3409 | 9071 | 1707 | 569 | 1859 | 6.0(10)-192 | Bacillus subtilis | ureC | [pn:urease] |
| CONTIG490 | 5119193_f3_130 | 3410 | 9072 | 474 | 158 | 405 | 7.2(10)-38 | Klebsiella aerogenes | P18317 | urease accessory protein ureE. |
| CONTIG490 | 23471885_f3_144 | 3411 | 9073 | 888 | 296 | 103 | 0.012 | Rhodobacter sphaeroides | AJ000977 | [derhodobacter sphaeroides dna for second chemotaxis operon and flanking genes] [pn:transducer-like protein, tlpc] [gn:tlpc] [nt:tlpc shows weak homology to tlpa (formerly orf1) of] |
| CONTIG490 | 21692187_c1_148 | 3412 | 9074 | 1644 | 548 | 525 | 1.3(10)-50 | Escherichia coli | b4355 | [pn:methyl-accepting chemotaxis protein l] [gn:tsr] |
| CONTIG490 | 10553811_c1_150 | 3413 | 9075 | 825 | 275 | 991 | 5.7(10)-100 | Escherichia coli | b3070 | [pn:hypothetical protein] |
| CONTIG490 | 33867181_c1_172 | 3414 | 9076 | 390 | 130 | 555 | 9.1(10)-54 | Escherichia coli | b3058 | [pn:hypothetical 13.6 kd protein in baca-ttda intergenic region] |
| CONTIG490 | 4114702_c1_173 | 3415 | 9077 | 822 | 274 | 1144 | 3.5(10)-116 | Escherichia coli | b3057 | [pn:bacitracin resistance protein] [gn:baca] |
| CONTIG490 | 10069692_c2_196 | 3416 | 9078 | 1512 | 504 | 1862 | 2.8(10)-192 | Escherichia coli | b3072 | [pn:aerotaxis receptor protein] [gn:aer] |
| CONTIG490 | 26227307_c2_199 | 3417 | 9079 | 519 | 173 | 678 | 8.5(10)-67 | Escherichia coli | b3068 | [pn:hypothetical protein] |
| CONTIG490 | 24400916_c2_223 | 3418 | 9080 | 1323 | 441 | 1573 | 1.2(10)-161 | Escherichia coli | b3054 | [pn:hypothetical 48.4 kd protein in glne-cca intergenic region] [gn:ygif] |
| CONTIG490 | 36120650_c2_224 | 3419 | 9081 | 2877 | 959 | 3854 | 0 | Escherichia coli | b3053 | [pn:adenyl-transferase] [gn:glne] |
| CONTIG490 | 24276662_c3_255 | 3420 | 9082 | 1032 | 344 | 1552 | 2.1(10)-159 | Escherichia coli | b3064 | [pn:hypothetical 36.0 kd protein in ttdb-rpsu intergenic region] |
| CONTIG490 | 26578152_c3_282 | 3421 | 9083 | 1449 | 483 | 2299 | 1.3(10)-238 | Escherichia coli | b3052 | [pn:hypothetical protein] |
| CONTIG490 | 13671893_c3_284 | 3422 | 9084 | 666 | 222 | 995 | 2.2(10)-100 | Escherichia coli | b3041 | [pn:3,4-dihydroxy-2-butanone 4-phosphate synthase] [gn:ribb] |
| CONTIG490 | 4470033_c3_291 | 3423 | 9085 | 825 | 275 | 1230 | 2.7(10)-125 | Escherichia coli | b3039 | [pn:hypothetical 29.9 kd protein in tolc-ribb intergenic region] [gn:ygid] |
| CONTIG491 | 2223507_f1_1 | 3424 | 9086 | 906 | 302 | 170 | 5.7(10)-11 | Bacillus subtilis | ydeE | [pn:hypothetical protein] |
| CONTIG491 | 2056402_f1_9 | 3425 | 9087 | 1386 | 462 | 951 | 1.0(10)-95 | Synechocystis sp. | S76228 | [PN:hypothetical protein] [OR:Synechocystis sp.] [SR:PCC 6803, PCC 6803.] |
| CONTIG491 | 25682967_f1_13 | 3426 | 9088 | 1092 | 364 | 322 | 1.8(10)-58 | Synechocystis sp. | S77535 | [PN:hypothetical protein] [OR:Synechocystis sp.] [SR:PCC 6803, PCC 6803.] |
| CONTIG491 | 3072818_f1_22 | 3427 | 9089 | 681 | 227 | 729 | 3.2(10)-72 | Escherichia coli | b1529 | [pn:hypothetical protein in marr 5'''' region] [gn:ydeb] |
| CONTIG491 | 1432191_f1_23 | 3428 | 9090 | 849 | 283 | 292 | 6.7(10)-26 | Synechococcus PCC7942 | U59236 | or:synechococcus pcc7942 pn:unknown le:4337 re:>4953 di:direct nt:orf205 |
| CONTIG491 | 13158461_f1_25 | 3429 | 9091 | 1428 | 476 | 1645 | 2.8(10)-169 | Escherichia coli | b1525 | [pn:hypothetical protein] [gn:yneh] |
| CONTIG491 | 24120381_f1_26 | 3430 | 9092 | 948 | 316 | 1338 | 9.8(10)-137 | Escherichia coli | b1524 | [pn:hypothetical protein] [gn:yneh] |
| CONTIG491 | 11069415_f1_27 | 3431 | 9093 | 987 | 329 | 225 | 1.7(10)-18 | Escherichia coli | b0385 | [pn:hypothetical 41.5 kd protein in psif-proc intergenic region] [gn:yaic] |
| CONTIG491 | 4379092_f1_28 | 3432 | 9094 | 1464 | 488 | 2225 | 9.9(10)-231 | Escherichia coli | b1521 | [pn:altronate oxidoreductase] [gn:uxab] |
| CONTIG491 | 32117968_f1_29 | 3433 | 9095 | 963 | 321 | 1268 | 2.6(10)-129 | Escherichia coli | b1520 | [pn:hypothetical protein] [gn:cpxa] |
| CONTIG491 | 3049702_f1_32 | 3434 | 9096 | 1296 | 432 | 236 | 1.0(10)-17 | Escherichia coli | b3911 | [pn:cpxa] [gn:cpxa] |
| CONTIG491 | 29816950_f1_33 | 3435 | 9097 | 1326 | 442 | 210 | 1.1(10)-16 | Bacillus subtilis | ykuV | [pn:hypothetical protein] |
| CONTIG491 | 4180191_f2_41 | 3436 | 9098 | 1974 | 658 | 3043 | 0 | Escherichia coli | b1435 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG491 | 4305318_f2_44 | 3437 | 9099 | 420 | 140 | 106 | 7.7(10)-6 | Mycobacterium tuberculosis | AL022002 | [de:mycobacterium tuberculosis sequence v047] [pn:hypothetical protein mtv047.09c] [gn:mtv047.09c] [nt:mtv047.09c, |
| CONTIG491 | 15023916_f2_45 | 3438 | 9100 | 1128 | 376 | 926 | 4.5(10)-93 | Bacillus subtilis | yxjG | [pn:hypothetical protein] [gn:n15nr] |
| CONTIG491 | 16510187_f2_48 | 3439 | 9101 | 1614 | 538 | 412 | 1.3(10)-38 | Methylophilus methylotrophus | Y14964 | [de:methylophilus methylotrophus fmdd, fmde genes and partial fmdf gene,] [pn:putative transport protein] [gn:fmde] |
| CONTIG491 | 12145260_f2_52 | 3440 | 9102 | 681 | 227 | 723 | 1.3(10)-71 | Escherichia coli | b1973 | [pn:hypothetical protein] |
| CONTIG491 | 14554838_f2_60 | 3441 | 9103 | 825 | 275 | 155 | 3.7(10)-9 | Escherichia coli | b1464 | [pn:hypothetical 32.3 kd protein in rhse-narv intergenic region] [gn:ydde] |
| CONTIG491 | 21721965_f2_64 | 3442 | 9104 | 1653 | 551 | 485 | 2.3(10)-46 | Escherichia coli | b1886 | [pn:methyl-accepting chemotaxis protein ii] [gn:tar] |
| CONTIG491 | 4817693_f2_68 | 3443 | 9105 | 537 | 179 | 195 | 1.3(10)-15 | Pseudomonas syringae | P16966 | acetyltransferase (ec 2.3.1.—) (tabtoxin resistance protein) |
| CONTIG491 | 22479765_f2_72 | 3444 | 9106 | 453 | 151 | 262 | 1.0(10)-22 | Acinetobacter calcoaceticus | AF009672 | [PN:unknown] [DE:Acinetobacter calcoaceticus ADP1 vanillate demethylase region, vanillate demethylase (vanB) and vanillate demethylase (vanA) genes, complete cds.] [NT:putative acetyl transferase; ORF2] [LE:535] [RE:1002] [DI:complement |
| CONTIG491 | 30118883_f2_75 | 3445 | 9107 | 792 | 264 | 503 | 3.0(10)-48 | Escherichia coli | b3405 | [pn:ompr] [gn:ompr] |
| CONTIG491 | 4429568_f2_80 | 3446 | 9108 | 1302 | 434 | 232 | 4.5(10)-17 | Erwinia carotovora | JC1219 | polygalacturonase (ec 3.2.1.15) precursor - erwinia carotovora - this enzyme plays an important role in plant tissue maceration. |
| CONTIG491 | 5972143_f3_84 | 3447 | 9109 | 585 | 195 | 600 | 1.6(10)-58 | Escherichia coli | b1434 | [pn:hypothetical protein] |
| CONTIG491 | 34198965_f3_90 | 3448 | 9110 | 459 | 153 | 94 | 0.035 | Caenorhabditis elegans | Z81518 | [de:caenorhabditis elegans cosmid f28d9, complete sequence.] [pn:f28d9.a] [nt:protein predicted using gene finder; preliminary] |
| CONTIG491 | 992843_f3_96 | 3449 | 9111 | 810 | 270 | 319 | 9.4(10)-29 | Escherichia coli | b3455 | [pn:high-affinity branched-chain amino acid transport atp-binding protein livg] [gn:livg] |
| CONTIG491 | 5370443_f3_97 | 3450 | 9112 | 594 | 198 | 299 | 1.2(10)-26 | Escherichia coli | b3454 | [pn:high-affinity branched-chain amino acid transport atp-binding] [gn:livf] |
| CONTIG491 | 23984767_f3_102 | 3451 | 9113 | 936 | 312 | 1014 | 2.1(10)-102 | Escherichia coli | b1533 | [pn:hypothetical 28.7 kd protein in marb-dcp intergenic region] [gn:yded] |
| CONTIG491 | 29558277_f3_111 | 3452 | 9114 | 513 | 171 | 506 | 1.3(10)-48 | Escherichia coli | b1523 | [pn:hypothetical protein] |
| CONTIG491 | 31677037_f3_115 | 3453 | 9115 | 1074 | 358 | 153 | 1.1(10)-8 | Bacillus subtilis | yfhM | [pn:hypothetical protein] |
| CONTIG491 | 13697152_f3_121 | 3454 | 9116 | 762 | 254 | 291 | 8.6(10)-26 | Bacillus subtilis | fruR | [pn:transcriptional regulator] |
| CONTIG491 | 25484625_cl_125 | 3455 | 9117 | 669 | 223 | 496 | 1.6(10)-47 | Escherichia coli | b2467 | [pn:hypothetical 21.7 kd protein in tktb-narq intergenic region] [gn:yffh] |
| CONTIG491 | 22438307_cl_126 | 3456 | 9118 | 783 | 261 | 953 | 6.0(10)-96 | Escherichia coli | b1519 | [pn:hypothetical protein] |
| CONTIG491 | 24737775_cl_148 | 3457 | 9119 | 615 | 205 | 96 | 0.035 | Microbacterium ammoniaphilum | X79027 | or:microbacterium ammoniaphilum pn:unknown le:3382 re:>4972 di:complement |
| CONTIG491 | 12600660_cl_150 | 3458 | 9120 | 912 | 304 | 1155 | 2.3(10)-117 | Escherichia coli | b1526 | [pn:hypothetical protein] [gn:ynej] |
| CONTIG491 | 21593758_cl_156 | 3459 | 9121 | 429 | 143 | 633 | 5.0(10)-62 | Escherichia coli | b1531 | [pn:multiple antibiotic resistance protein] [gn:mara] |
| CONTIG491 | 12986452_cl_173 | 3460 | 9122 | 1011 | 337 | 290 | 1.1(10)-25 | Azorhizobium caulinodans | S52856 | arac-like protein - azorhizobium caulinodans |
| CONTIG491 | 33603452_cl_176 | 3461 | 9123 | 237 | 79 | 292 | 6.7(10)-26 | Escherichia coli | b1436 | [pn:hypothetical protein] |
| CONTIG491 | 12140785_cl_180 | 3462 | 9124 | 1206 | 402 | 1035 | 1.3(10)-104 | Escherichia coli | b1433 | [pn:hypothetical protein] |
| CONTIG491 | 31442539_c2_184 | 3463 | 9125 | 476 | 158 | 264 | 6.2(10)-23 | Escherichia coli | b3558 | [pn:insertion element is150 hypothetical 33.3 kd protein] [gn:yi5b] |
| CONTIG491 | 24785687_c2_197 | 3464 | 9126 | 600 | 200 | 113 | 2.5(10)-5 | Bacillus subtilis | ydaF | [pn:hypothetical protein] |
| CONTIG491 | 10884683_c2_216 | 3465 | 9127 | 480 | 160 | 592 | 1.1(10)-57 | Escherichia coli | b1530 | [pn:multiple antibiotic resistance protein] [gn:marr] |
| CONTIG491 | 23626905_c2_219 | 3466 | 9128 | 1266 | 422 | 917 | 4.0(10)-92 | Escherichia coli | b1534 | [pn:hypothetical protein in marb-dcp intergenic region] [gn:ydcf] |
| CONTIG491 | 35679180_c3_250 | 3467 | 9129 | 801 | 267 | 154 | 2.8(10)-11 | Rhizobium sp. | S28675 | hypothetical protein 5 - rhizobium sp. (strain ic3342) |
| CONTIG491 | 5265668_c3_274 | 3468 | 9130 | 1248 | 416 | 1474 | 3.7(10)-151 | Escherichia coli | b1528 | [pn:hypothetical protein in marr 5"" region] [gn:ydea] |
| CONTIG491 | 25897288_c3_276 | 3469 | 9131 | 234 | 78 | 142 | 5.2(10)-10 | Escherichia coli | b1532 | [pn:multiple antibiotic resistance protein marb] [gn:marb] |
| CONTIG491 | 6364437_c3_301 | 3470 | 9132 | 489 | 163 | 148 | 1.0(10)-9 | Escherichia coli | b1433 | [pn:hypothetical protein] |
| CONTIG492 | 16601011_f1_9 | 3471 | 9133 | 369 | 123 | 357 | 8.8(10)-33 | Escherichia coli | b1273 | [pn:hypothetical 9.4 kd protein in sohb-topa intergenic region] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG492 | 25554807_f3_16 | 3472 | 9134 | 1584 | 528 | 2099 | 2.2(10)-217 | Escherichia coli | b1264 | [pn:anthranilate synthase component I] [gn:trpc] |
| CONTIG492 | 31832017_f3_17 | 3473 | 9135 | 1272 | 424 | 1623 | 6.2(10)-167 | Haemophilus influenzae | HI1431 | [pn:tryptophan synthase, beta chain] [gn:trpb] |
| CONTIG492 | 29687656_f1_23 | 3474 | 9136 | 1050 | 350 | 926 | 4.5(10)-93 | Escherichia coli | b1255 | [pn:hypothetical protein in tonb-trpa intergenic region] [gn:ycic] |
| CONTIG492 | 2032531_f1_25 | 3475 | 9137 | 465 | 155 | 485 | 2.3(10)-46 | Haemophilus influenzae | HI0827 | [pnp14 protein] |
| CONTIG492 | 46905_f1_43 | 3476 | 9138 | 2745 | 915 | 3902 | 0 | Escherichia coli | b1241 | [pn:alcohol/acetaldehyde dehydrogenase] [gn:adhe] |
| CONTIG492 | 25589537_f2_62 | 3477 | 9139 | 642 | 214 | 696 | 1.1(10)-68 | Escherichia coli | b1270 | [pn:i alanin adenosyltransferase] [gn:btur] |
| CONTIG492 | 2646037_f2_72 | 3478 | 9140 | 252 | 84 | 396 | 6.5(10)-37 | Escherichia coli | b1930 | [pn:hypothetical 8.6 kd protein in amya-flie intergenic region] |
| CONTIG492 | 23706650_f2_74 | 3479 | 9141 | 564 | 188 | 386 | 7.4(10)-36 | Haemophilus influenzae | HI0826 | [pn:sp] |
| CONTIG492 | 22853333_f2_76 | 3480 | 9142 | 2052 | 684 | 1755 | 6.2(10)-181 | Escherichia coli | b0584 | [pn:ferrienterobactin receptor precursor] [gn:fepa] |
| CONTIG492 | 21720266_f2_80 | 3481 | 9143 | 333 | 111 | 449 | 1.6(10)-42 | Escherichia coli | b1251 | [pn:hypothetical protein in kch-tonb intergenic region] [gn:ycii] |
| CONTIG492 | 23246652_f2_84 | 3482 | 9144 | 1512 | 504 | 2392 | 2.0(10)-248 | Escherichia coli | U24201 | or:escherichia coli pn:cardiolipin synthase gn:cls Ie:5896 re:7356 di:direct |
| CONTIG492 | 4350461_f2_85 | 3483 | 9145 | 342 | 114 | 555 | 9.1(10)-54 | Escherichia coli | b1248 | [pn:hypothetical protein] |
| CONTIG492 | 26282780_f3_101 | 3484 | 9146 | 654 | 218 | 960 | 1.1(10)-96 | Escherichia coli | b1277 | [pn:gtp cyclohydrolase ii] [gn:riba] |
| CONTIG492 | 6363568_f3_113 | 3485 | 9147 | 771 | 257 | 1039 | 4.7(10)-105 | Escherichia coli | b1271 | [pn:hypothetical oxidoreductase in btur-solb intergenic region] |
| CONTIG492 | 35807292_f3_119 | 3486 | 9148 | 1653 | 551 | 2248 | 3.6(10)-233 | Escherichia coli | b1263 | [pn:anthranilate synthase component ii] [gn:trpd] |
| CONTIG492 | 1502502_f3_120 | 3487 | 9149 | 1362 | 454 | 1894 | 1.2(10)-195 | Escherichia coli | b1262 | [pn:indole-3-glycerol phosphate synthase] [gn:trpc] |
| CONTIG492 | 2117811_f3_121 | 3488 | 9150 | 861 | 287 | 693 | 2.2(10)-68 | Escherichia coli | HI1432 | [pn:tryptophan synthase alpha subunit] [gn:trpa] |
| CONTIG492 | 1448253_f3_122 | 3489 | 9151 | 1227 | 409 | 1588 | 3.1(10)-163 | Haemophilus influenzae | b1929 | [pn:hypothetical 44.4 kd protein in amya-flie intergenic region] [gn:yede] |
| CONTIG492 | 1298500_f3_124 | 3490 | 9152 | 435 | 145 | 435 | 4.7(10)-41 | Escherichia coli | b0288 | [pn:hypothetical protein] |
| CONTIG492 | 9819786_c1_153 | 3491 | 9153 | 351 | 117 | 330 | 6.4(10)-30 | Escherichia coli | b1242 | [pn:hypothetical protein in adhe-oppa intergenic region] [gn:yche] |
| CONTIG492 | 36022511_c1_156 | 3492 | 9154 | 954 | 318 | 1349 | 6.7(10)-138 | Escherichia coli | b1244 | [pn:oligopeptide transport system permease protein oppb] [gn:oppb] |
| CONTIG492 | 16198576_c1_157 | 3493 | 9155 | 921 | 307 | 1170 | 6.2(10)-119 | Escherichia coli | b1245 | [pn:oligopeptide transport system permease protein] [gn:oppc] |
| CONTIG492 | 6720317_c1_200 | 3494 | 9156 | 813 | 271 | 924 | 7.2(10)-93 | Escherichia coli | b1278 | [pn:phosphatidylglycerophosphatase b] [gn:pgpb] |
| CONTIG492 | 3909503_c2_206 | 3495 | 9157 | 471 | 157 | 562 | 1.7(10)-54 | Escherichia coli | b1242 | [pn:hypothetical 44.4 kd protein in adhe-oppa intergenic region] [gn:yehc] |
| CONTIG492 | 36219783_c2_208 | 3496 | 9158 | 1023 | 341 | 1588 | 3.1(10)-163 | Escherichia coli | b1247 | [pn:oligopeptide transport atp-binding protein oppf] [gn:oppf] |
| CONTIG492 | 495140_c2_209 | 3497 | 9159 | 864 | 288 | 175 | 5.5(10)-12 | Bacillus subtilis | yugO | [pn:hypothetical protein] |
| CONTIG492 | 880092_c2_212 | 3498 | 9160 | 648 | 216 | 104 | 1.1(10)-5 | Plasmid ColE1 | J01566 | or:plasmid cole1 le:3943 re:4362 di:complement sr:plasmid colc1 (clone:pew2762 and pmm1.) dna nt:entry exclusion protein 2 (exc2) |
| CONTIG492 | 23679576_c2_215 | 3499 | 9161 | 876 | 292 | 391 | 4.4(10)-63 | Escherichia coli | b1252 | [pn:tonb protein] [gn:tonb] |
| CONTIG492 | 25973287_c2_221 | 3500 | 9162 | 654 | 218 | 860 | 4.4(10)-86 | Escherichia coli | b1256 | [pn:hypothetical 22.9 kd protein in tonb-trpa intergenic region] |
| CONTIG492 | 34277692_c2_240 | 3501 | 9163 | 633 | 211 | 1025 | 1.3(10)-103 | Escherichia coli | b1267 | [pn:hypothetical 24.5 kd protein in trpl-btur intergenic region] [gn:ycio] |
| CONTIG492 | 26620277_c2_244 | 3502 | 9164 | 1062 | 354 | 1170 | 6.2(10)-119 | Escherichia coli | b1272 | [pn:possible protease] [gn:solb] |
| CONTIG492 | 12694152_c2_247 | 3503 | 9165 | 2841 | 947 | 4175 | 0 | Escherichia coli | b1276 | [pn:aconitate hydratase 1] [gn:acna] |
| CONTIG492 | 3911432_c2_250 | 3504 | 9166 | 348 | 116 | 342 | 3.3(10)-31 | Escherichia coli | b1279 | [pn:hypothetical protein] |
| CONTIG492 | 3157830_c2_251 | 3505 | 9167 | 1089 | 363 | 1473 | 4.7(10)-151 | Escherichia coli | b1280 | [pn:hypothetical protein in pyrf 5''' region] [gn:ycim] |
| CONTIG492 | 24273561_c3_254 | 3506 | 9168 | 1749 | 583 | 2422 | 1.3(10)-251 | Escherichia coli | b1243 | [pn:periplasmic oligopeptide-binding protein precursor] [gn:oppa] |
| CONTIG492 | 12750790_c3_257 | 3507 | 9169 | 1050 | 350 | 1607 | 3.1(10)-165 | Escherichia coli | b1246 | [pn:oligopeptide transport atp-binding protein oppd] [gn:oppd] |
| CONTIG492 | 15634788_c3_263 | 3508 | 9170 | 639 | 213 | 750 | 2.0(10)-74 | Escherichia coli | b1798 | [pn:hypothetical protein] |
| CONTIG492 | 167000_c3_286 | 3509 | 9171 | 951 | 317 | 1262 | 1.1(10)-128 | Escherichia coli | b1266 | [pn:hypothetical protein] |
| CONTIG492 | 4770943_c3_287 | 3510 | 9172 | 885 | 295 | 1355 | 1.5(10)-138 | Escherichia coli | b1269 | [pn:hypothetical 32.7 kd protein in trpl-btur intergenic region] [gn:ycig] |
| CONTIG493 | 24667178_c3_291 | 3511 | 9173 | 2610 | 870 | 4117 | 0 | Escherichia coli | b1274 | [pn:dna topoisomerase i, omega protein] [gn:topa] |
| CONTIG493 | 11180402_c3_292 | 3512 | 9174 | 990 | 330 | 1557 | 6.0(10)-160 | Escherichia coli | b1275 | [pn:cys regulon transcriptional activator] [gn:cysb] |
| CONTIG493 | 26306510_f1_4 | 3513 | 9175 | 192 | 64 | 213 | 1.6(10)-17 | Escherichia coli | b1259 | [pn:hypothetical protein in tonb-trpa intergenic region] [gn:ycil] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG493 | 2642630_f1_5 | 3514 | 9176 | 567 | 189 | 444 | 5.2(10)-42 | Escherichia coli | U25418 | or:escherichia coli gn:ycif le:4030 re:4530 di:direct [pn:putative trehalose synthase] |
| CONTIG493 | 1445785_f1_11 | 3515 | 9177 | 1653 | 551 | 870 | 3.7(10)-87 | Streptomyces coelicolor | AJ001206 | [de:streptomyces coelicolor a3(2), glycogen metabolism clusterii.] |
| CONTIG493 | 554561_f1_16 | 3516 | 9178 | 435 | 145 | 415 | 6.2(10)-39 | Escherichia coli | b1536 | [pn:hypothetical 14.1 kd protein in marb-dcp intergenic region] |
| CONTIG493 | 2284032_f1_22 | 3517 | 9179 | 573 | 191 | 629 | 1.3(10)-61 | Escherichia coli | b2889 | [pn:hypothetical protein] |
| CONTIG493 | 1617401_f1_32 | 3518 | 9180 | 534 | 178 | 848 | 8.1(10)-85 | Escherichia coli | b2895 | [pn:flavodoxin ii] [gn:fldb] |
| CONTIG493 | 11957058_f1_42 | 3519 | 9181 | 633 | 211 | 551 | 2.3(10)-53 | Salmonella typhimurium | U75949 | [de:salmonella typhimurium curved dna-binding protein (cbpa) gene and agp (agp) gene, partial cds; operon 1 containing suppressor for copper-sensitivity a (scsa) gene."] [pn:suppressor for copper-sensitivity c] [gn:scsc] |
| CONTIG493 | 4882917_f2_53 | 3520 | 9182 | 903 | 301 | 345 | 1.6(10)-31 | Bacillus subtilis | yijC | [pn:hypothetical protein] |
| CONTIG493 | 22940910_f2_55 | 3521 | 9183 | 1077 | 359 | 910 | 2.2(10)-91 | Pseudomonas aeruginosa | Y10528 | [PN:cyanide insensitive terminal oxidase] [GN:cioB] [LE:1746] [RE:2753] [DE:P. aeruginosa cioA and cioB genes.] [DI:direct] |
| CONTIG493 | 20111291_f2_62 | 3522 | 9184 | 930 | 310 | 784 | 5.0(10)-78 | Bacillus subtilis | yhxD | [pn:hypothetical protein] |
| CONTIG493 | 4797186_f2_93 | 3523 | 9185 | 1527 | 509 | 2399 | 3.6(10)-249 | Escherichia coli | b2901 | [pn:6-phospho-beta-glucosidase bgla] [gn:bgla] |
| CONTIG493 | 7300052_f2_97 | 3524 | 9186 | 606 | 202 | 322 | 4.5(10)-29 | Haemophilus influenzae | HI1115 | [pn:thioredoxin] |
| CONTIG493 | 16854160_f3_101 | 3525 | 9187 | 921 | 307 | 1189 | 6.0(10)-121 | Escherichia coli | b2845 | [pn:hypothetical protein] |
| CONTIG493 | 23626681_f3_103 | 3526 | 9188 | 534 | 178 | 769 | 1.8(10)-76 | Escherichia coli | U25423 | or:escherichia coli gn:ycic le:4576 re:5082 di:direct |
| CONTIG493 | 16814418_f3_105 | 3527 | 9189 | 1452 | 484 | 1752 | 1.3(10)-180 | Pseudomonas aeruginosa | Y10528 | [PN:cyanide insensitive terminal oxidase] [GN:cioA] [DE:P. aeruginosa cioA and cioB genes.] [LE:276] [RE:1742] [DI:direct] |
| CONTIG493 | 26734683_f3_126 | 3528 | 9190 | 999 | 333 | 1451 | 1.0(10)-148 | Escherichia coli | b2898 | [pn:hypothetical protein] [gn:ygfz] |
| CONTIG493 | 16525765_f3_129 | 3529 | 9191 | 762 | 254 | 181 | 7.5(10)-14 | Bacillus subtilis | yfiA | [pn:hypothetical protein] |
| CONTIG493 | 17000052_f3_131 | 3530 | 9192 | 375 | 125 | 243 | 1.1(10)-20 | Salmonella typhimurium | U75949 | [de:salmonella typhimurium curved dna-binding protein (cbpa) gene and agp (agp) gene, partial cds; operon 1 containing suppressor for copper-sensitivity a (scsa) gene."] [pn:suppressor for copper-sensitivity a] [gn:scsa] |
| CONTIG493 | 13681500_f3_132 | 3531 | 9193 | 2013 | 671 | 1246 | 6.9(10)-173 | Salmonella typhimurium | U75949 | [de:salmonella typhimurium curved dna-binding protein (cbpa) gene and agp (agp) gene, partial cds; operon 1 containing suppressor for copper-sensitivity a (scsa) gene,"] [pn:suppressor for copper-sensitivity b] [gn:scsb] |
| CONTIG493 | 16148542_c1_140 | 3532 | 9194 | 783 | 261 | 1016 | 1.3(10)-102 | Escherichia coli | b2902 | [pn:hypothetical oxidoreductase] [gn:ygfF] |
| CONTIG493 | 5860055_c1_148 | 3533 | 9195 | 687 | 229 | 885 | 9.9(10)-89 | Escherichia coli | b2899 | [pn:hypothetical protein] |
| CONTIG493 | 3260282_c1_154 | 3534 | 9196 | 873 | 291 | 1007 | 1.2(10)-101 | Escherichia coli | b2893 | [pn:disulfide interchange protein, precursor] [gn:dsbc] |
| CONTIG493 | 910312_c1_156 | 3535 | 9197 | 1077 | 359 | 1581 | 1.7(10)-162 | Escherichia coli | b2891 | [pn:peptide chain release factor 2] [gn:prfb] |
| CONTIG493 | 4488443_c1_157 | 3536 | 9198 | 1527 | 509 | 2300 | 1.1(10)-238 | Escherichia coli | b2890 | [pn:lysyl trna synthetase] [gn:lyss] |
| CONTIG493 | 6813751_c1_164 | 3537 | 9199 | 636 | 212 | 392 | 1.7(10)-36 | Escherichia coli | b0957 | [pn:outer membrane protein a] [gn:ompa] |
| CONTIG493 | 10320330_c1_169 | 3538 | 9200 | 1035 | 345 | 280 | 2.3(10)-24 | Bacillus subtilis | yxnA | [pn:hypothetical protein] |
| CONTIG493 | 16971016_c1_180 | 3539 | 9201 | 297 | 99 | 343 | 2.7(10)-31 | Escherichia coli | b4126 | [pn:hypothetical 8.6 kd protein in dcub-lysu intergenic region] |
| CONTIG493 | 22464665_c2_198 | 3540 | 9202 | 282 | 94 | 431 | 1.3(10)-40 | Escherichia coli | b2897 | [pn:hypothetical protein] [gn:ygfy] |
| CONTIG493 | 21519790_c2_203 | 3541 | 9203 | 771 | 257 | 914 | 8.3(10)-92 | Escherichia coli | b2865 | [pn:hypothetical 23.1 kd protein in dmsc 3'''' region] [gn:ygac] |
| CONTIG493 | 2369591_c2_206 | 3542 | 9204 | 702 | 234 | 354 | 1.8(10)-32 | Escherichia coli | b0897 | [pn:hypothetical protein] |
| CONTIG493 | 4103838_c2_217 | 3543 | 9205 | 456 | 152 | 142 | 5.2(10)-10 | Bacillus subtilis | ydfR | [pn:hypothetical protein] |
| CONTIG493 | 2659781_c2_226 | 3544 | 9206 | 279 | 93 | 408 | 3.5(10)-38 | Escherichia coli | b4127 | [pn:hypothetical 10.5 kd protein in dcub-lysu intergenic region] |
| CONTIG493 | 30365655_c3_228 | 3545 | 9207 | 2958 | 986 | 4326 | 0 | Escherichia coli | b2903 | [pn:glycine dehydrogenase] [gn:gcvp] |
| CONTIG493 | 35726525_c3_244 | 3546 | 9208 | 432 | 144 | 478 | 1.3(10)-45 | Escherichia coli | b2896 | [pn:hypothetical protein] |
| CONTIG493 | 29507090_c3_245 | 3547 | 9209 | 927 | 309 | 1341 | 4.7(10)-137 | Escherichia coli | b2894 | [pn:site-specific integrase/recombinase, with xerc] [gn:xerd] |
| CONTIG493 | 6500302_c3_247 | 3548 | 9210 | 1743 | 581 | 2600 | 1.8(10)-270 | Escherichia coli | b2892 | [pn:single-stranded dna-specific exonuclease] [gn:recj] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG493 | 23476500_c3_252 | 3549 | 9211 | 1260 | 420 | 197 | 7.5(10)-15 | Escherichia coli | b2344 | [pn:long-chain fatty acid transport protein precursor] [gn:fadl] |
| CONTIG493 | 36141327_c3_253 | 3550 | 9212 | 648 | 216 | 209 | 4.2(10)-17 | Escherichia coli | b0375 | [pn:hypothetical protein] [gn:yaiv] |
| CONTIG493 | 12110131_c3_254 | 3551 | 9213 | 2034 | 678 | 1566 | 6.7(10)-161 | Escherichia coli | b4083 | [pn:hypothetical 73.7 kd protein in fdhf-phnp intergenic region] |
| CONTIG493 | 807137_c3_257 | 3552 | 9214 | 585 | 195 | 426 | 4.2(10)-40 | Escherichia coli | b1537 | [pn:hypothetical 18.3 kd protein in marb-dcp intergenic region] |
| CONTIG494 | 1486206_f1_2 | 3553 | 9215 | 1092 | 364 | 1449 | 1.7(10)-148 | Escherichia coli | b0888 | [pn:thioredoxin reductase] [gn:trxb] |
| CONTIG494 | 14484500_f1_3 | 3554 | 9216 | 1797 | 599 | 2423 | 1.0(10)-251 | Escherichia coli | b0887 | [pn:transport atp-binding protein cydd] [gn:cydd] |
| CONTIG494 | 34376252_f1_26 | 3555 | 9217 | 819 | 273 | 679 | 6.7(10)-67 | Escherichia coli | b0875 | [pn:aquaporin z] [gn:aqpz] |
| CONTIG494 | 32659515_f1_27 | 3556 | 9218 | 942 | 314 | 1044 | 1.3(10)-105 | Escherichia coli | b0874 | [pn:hypothetical protein] |
| CONTIG494 | 115887_f1_28 | 3557 | 9219 | 1677 | 559 | 2665 | 2.2(10)-277 | Escherichia coli | b0873 | [pn:hypothetical protein] |
| CONTIG494 | 15745303_f1_65 | 3558 | 9220 | 744 | 248 | 1094 | 7.0(10)-111 | Escherichia coli | b0864 | [pn:arginine transport atp-binding protein artp] [gn:artp] |
| CONTIG494 | 2682815_f1_66 | 3559 | 9221 | 750 | 250 | 1117 | 2.6(10)-113 | Escherichia coli | b0863 | [pn:arginine-binding periplasmic protein 1 precursor] [gn:arti] |
| CONTIG494 | 33714207_f1_68 | 3560 | 9222 | 684 | 228 | 975 | 2.8(10)-98 | Escherichia coli | b0861 | [pn:arginine transport system permease protein artm] [gn:artm] |
| CONTIG494 | 26363577_f2_79 | 3561 | 9223 | 219 | 73 | 362 | 2.6(10)-33 | Escherichia coli | b0884 | [pn:initiation factor if-1] [gn:infa] |
| CONTIG494 | 14160432_f2_84 | 3562 | 9224 | 288 | 96 | 364 | 1.6(10)-33 | Escherichia coli | b0880 | [pn:cold shock-like protein cspd] [gn:cspd] |
| CONTIG494 | 4376252_f2_89 | 3563 | 9225 | 990 | 330 | 743 | 1.1(10)-73 | Escherichia coli | b0877 | [pn:hypothetical protein] |
| CONTIG494 | 4415901_f2_95 | 3564 | 9226 | 972 | 324 | 1441 | 1.2(10)-147 | Escherichia coli | b0872 | [pn:hypothetical protein] |
| CONTIG494 | 4423318_f2_99 | 3565 | 9227 | 1011 | 337 | 1468 | 1.6(10)-150 | Escherichia coli | b0870 | [pn:hypothetical protein] [gn:ybju] |
| CONTIG494 | 14642176_f2_102 | 3566 | 9228 | 1110 | 370 | 1597 | 3.5(10)-164 | Escherichia coli | b0868 | [pn:hypothetical protein] |
| CONTIG494 | 12994811_f2_135 | 3567 | 9229 | 696 | 232 | 1090 | 1.8(10)-110 | Escherichia coli | b0863 | [pn:arginine transport system permease protein artq] [gn:artq] |
| CONTIG494 | 2995933_f3_140 | 3568 | 9230 | 1776 | 592 | 2045 | 1.2(10)-211 | Escherichia coli | b0886 | [pn:transport atp-binding protein cydc] [gn:cydc] |
| CONTIG494 | 5865882_f3_141 | 3569 | 9231 | 750 | 250 | 1032 | 2.6(10)-104 | Escherichia coli | b0885 | [pn:leucyl/phenylalanyl-trna–protein transferase] [gn:aat] |
| CONTIG494 | 15117842_f3_159 | 3570 | 9232 | 1734 | 578 | 2699 | 5.9(10)-281 | Escherichia coli | b0871 | [pn:cytochrome] [gn:poxb] |
| CONTIG494 | 33875912_f3_161 | 3571 | 9233 | 1476 | 492 | 2080 | 2.2(10)-215 | Escherichia coli | b0869 | [pn:hypothetical protein] |
| CONTIG494 | 36597081_f3_183 | 3572 | 9234 | 1818 | 606 | 393 | 3.7(10)-36 | Escherichia coli | b3323 | [pn:putative general secretion pathway protein b] [gn:yhed] |
| CONTIG494 | 23631550_f3_186 | 3573 | 9235 | 540 | 180 | 729 | 3.2(10)-72 | Escherichia coli | b0865 | [pn:hypothetical protein] [gn:yaiv] |
| CONTIG494 | 1315827_c1_199 | 3574 | 9236 | 675 | 225 | 177 | 1.0(10)-13 | Escherichia coli | b0375 | [pn:hypothetical protein] |
| CONTIG494 | 15761437_c1_206 | 3575 | 9237 | 1293 | 431 | 847 | 1.0(10)-84 | Escherichia coli | b3327 | [pn:putative general secretion pathway protein f] [gn:hoff] |
| CONTIG494 | 134652_c1_207 | 3576 | 9238 | 453 | 151 | 474 | 3.5(10)-45 | Escherichia coli | b3328 | [pn:putative general secretion pathway protein g precursor] [gn:hofg] |
| CONTIG494 | 16838437_c1_208 | 3577 | 9239 | 387 | 129 | 144 | 3.2(10)-10 | Escherichia coli | b3330 | [pn:putative general secretion pathway protein i precursor] [gn:yheh] |
| CONTIG494 | 32632827_c1_212 | 3578 | 9240 | 486 | 162 | 102 | 0.00013 | Escherichia coli | b3334 | [pn:putative general secretion pathway protein m] [gn:pshm] |
| CONTIG494 | 26735627_c1_213 | 3579 | 9241 | 2721 | 907 | 2118 | 7.2(10)-248 | Aeromonas caviae | U09139 | or:aeromonas caviae pn:chitinase protein precursor le:154 re:2751 di:direct |
| CONTIG494 | 30664092_c1_230 | 3580 | 9242 | 1689 | 563 | 2468 | 1.8(10)-256 | Escherichia coli | b0876 | [pn:hypothetical protein] |
| CONTIG494 | 16975466_c1_248 | 3581 | 9243 | 210 | 70 | 172 | 3.5(10)-13 | Escherichia coli | b0889 | [pn:leucine-responsive regulatory protein] [gn:lrp] |
| CONTIG494 | 32055135_c2_255 | 3582 | 9244 | 909 | 303 | 1016 | 1.3(10)-102 | Escherichia coli | b0867 | [pn:hypothetical protein] |
| CONTIG494 | 1447187_c2_263 | 3583 | 9245 | 777 | 259 | 155 | 1.5(10)-9 | Escherichia coli | b3324 | [pn:putative general secretion pathway protein c] [gn:yhee] |
| CONTIG494 | 32694192_c2_265 | 3584 | 9246 | 1500 | 500 | 1407 | 4.7(10)-144 | Escherichia coli | b3326 | [pn:type ii traffic] [gn:yhcg] |
| CONTIG494 | 36222885_c2_268 | 3585 | 9247 | 1116 | 372 | 285 | 3.7(10)-25 | Escherichia coli | b3332 | [pn:putative general secretion pathway protein k] [gn:yhej] |
| CONTIG494 | 24641037_c2_269 | 3586 | 9248 | 1140 | 380 | 307 | 1.7(10)-27 | Escherichia coli | b3333 | [pn:putative general secretion pathway protein l] [gn:yhek] |
| CONTIG494 | 24726625_c2_276 | 3587 | 9249 | 1845 | 615 | 299 | 6.2(10)-26 | Oryza sativa | L37289 | or:oryza sativa pn:chitinase ec:3.2.1.14 le:43 re:1044 di:direct sr:oryza sativa (strain ir36) seedling etiolated leaf cdna to mrna |
| CONTIG494 | 21767817_c2_299 | 3588 | 9250 | 1980 | 660 | 2714 | 1.5(10)-282 | Escherichia coli | b0879 | [pn:hypothetical protein] |
| CONTIG494 | 26449052_c3_323 | 3589 | 9251 | 339 | 113 | 493 | 3.3(10)-47 | Escherichia coli | b0866 | [pn:hypothetical protein] |
| CONTIG494 | 24015932_c3_328 | 3590 | 9252 | 1944 | 648 | 1216 | 8.3(10)-124 | Escherichia coli | b3325 | [pn:putative general secretion pathway protein d precursor] [gn:hofd] |
| CONTIG494 | 4899063_c3_332 | 3591 | 9253 | 498 | 166 | 158 | 1.1(10)-11 | Escherichia coli | b3329 | [pn:putative general secretion pathway protein h precursor] [gn:hofh] |
| CONTIG494 | 35678963_c3_334 | 3592 | 9254 | 708 | 236 | 142 | 5.2(10)-10 | Escherichia coli | b3331 | [pn:putative general secretion pathway protein j precursor] [gn:yhei] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG494 | 32594556_c3_336 | 3593 | 9255 | 849 | 283 | 366 | 9.8(10)-34 | Escherichia coli | b2972 | [pn:hypothetical protein] |
| CONTIG494 | 21672156_c3_337 | 3594 | 9256 | 537 | 179 | 208 | 5.4(10)-17 | Escherichia coli | b2854 | [pn:hypothetical protein] |
| CONTIG494 | 294181_c3_353 | 3595 | 9257 | 1140 | 380 | 1393 | 1.5(10)-142 | Escherichia coli | b0878 | [pn:hypothetical protein] |
| CONTIG494 | 32507211_c3_355 | 3596 | 9258 | 393 | 131 | 528 | 6.7(10)-51 | Escherichia coli | b0881 | [pn:hypothetical protein] [gn:ylja] |
| CONTIG494 | 975293_c3_356 | 3597 | 9259 | 2304 | 768 | 3480 | 0 | Escherichia coli | b0882 | [pn:atp-dependent clp protease atp-binding subunit clpa] [gn:clpa] |
| CONTIG494 | 11724086_f1_17 | 3598 | 9260 | 618 | 206 | 772 | 9.3(10)-77 | Escherichia coli | b3465 | [pn:hypothetical 21.7 kd protein in ftsy-nika intergenic region] |
| CONTIG494 | 2097655_f1_25 | 3599 | 9261 | 681 | 227 | 999 | 8.1(10)-101 | Escherichia coli | b3471 | [pn:hypothetical 25.3 kd protein in ftsy-nika intergenic region] |
| CONTIG494 | 13095332_f1_26 | 3600 | 9262 | 600 | 200 | 874 | 1.3(10)-87 | Escherichia coli | b3472 | [pn:hypothetical protein] |
| CONTIG494 | 32300666_f1_27 | 3601 | 9263 | 1113 | 371 | 1421 | 1.6(10)-145 | Escherichia coli | b3474 | [pn:hypothetical 38.5 kd protein in ftsy-nika intergenic region] [gn:yiht] |
| CONTIG495 | 5195317_f1_32 | 3602 | 9264 | 1356 | 452 | 120 | 0.0032 | Bacillus subtilis | srfAB | [pn:surfactin synthetase] [gn:comL] |
| CONTIG495 | 22369816_f1_34 | 3603 | 9265 | 1728 | 576 | 173 | 2.6(10)-12 | Methanobacterium thermoautotrophicum | MTH136 | [pn:dolichyl-phosphate mannose synthase] |
| CONTIG495 | 14869217_f1_35 | 3604 | 9266 | 426 | 142 | 119 | 1.5(10)-7 | Bacillus subtilis | yneP | [pn:hypothetical protein] |
| CONTIG495 | 16912907_f1_38 | 3605 | 9267 | 1251 | 417 | 354 | 1.8(10)-32 | Escherichia coli | b1095 | [pn:3-oxoacyl-acyl-carrier-protein synthase ii] [gn:fabF] |
| CONTIG495 | 10626391_f1_39 | 3606 | 9268 | 330 | 110 | 96 | 0.00289 | Homo sapiens | AF004884 | [PN:neuronal calcium channel alpha 1A subunit] [SR:human] [DE:Homo sapiens neuronal calcium channel alpha 1A subunit isoform A-1mRNA, complete cds.] [LE:237] [RE:7769] [DI:direct] |
| CONTIG495 | 15808466_f1_40 | 3607 | 9269 | 1242 | 414 | 624 | 4.5(10)-61 | Bacillus subtilis | yjaY | [pn:hypothetical protein] |
| CONTIG495 | 14229752_f2_48 | 3608 | 9270 | 432 | 144 | 498 | 1.0(10)-47 | Escherichia coli | b3459 | [pn:hypothetical 14.5 kd protein in livk-livj intergenic region] [gn:yhhk] |
| CONTIG495 | 24619625_f2_58 | 3609 | 9271 | 408 | 136 | 341 | 4.4(10)-31 | Escherichia coli | b3466 | [pn:hypothetical 10.3 kd protein in ftsy-nika intergenic region] [gn:yhhl] |
| CONTIG495 | 10644062_f2_60 | 3610 | 9272 | 753 | 251 | 833 | 3.2(10)-83 | Escherichia coli | b3468 | [pn:hypothetical protein] |
| CONTIG495 | 1626817_f2_71 | 3611 | 9273 | 921 | 307 | 122 | 1.3(10)-5 | Helicobacter pylori | HP1348 | [pn:1-acyl-glycerol-3-phosphate acyltransferase] [gn:yhhn] |
| CONTIG495 | 11064191_f2_72 | 3612 | 9274 | 330 | 110 | 94 | 6.5(10)-5 | Helicobacter pylori | HP0559 | [pn:acyl carrier protein] [gn:acpP] |
| CONTIG495 | 3134705_f2_82 | 3613 | 9275 | 813 | 271 | 400 | 2.3(10)-37 | Bacillus subtilis | fabG | [pn:3-oxoacyl-acyl-carrier protein reductase] [gn:yhhO] |
| CONTIG495 | 4884707_f2_86 | 3614 | 9276 | 798 | 266 | 552 | 1.8(10)-53 | Bacillus subtilis | yvaG | [pn:hypothetical protein] |
| CONTIG495 | 2071916_f3_103 | 3615 | 9277 | 2244 | 748 | 2482 | 5.7(10)-258 | Leucothrix mucor | P80920 | hypothetical 35.5 kd protein in transposon tn4556. |
| CONTIG495 | 447686_f3_113 | 3616 | 9278 | 291 | 97 | 92 | 0.00011 | Streptomyces fradiae | P20186 | or:brucella abortus pn:fabz gn:fabz ec:4.2.1.— ie:6377 re:6844 di:direct sr:brucella abortus strain=s2308 nt:similar to swiss-prot accession number p21774 |
| CONTIG495 | 1301416_f3_120 | 3617 | 9279 | 384 | 128 | 95 | 0.00034 | Brucella abortus | U51683 | |
| CONTIG495 | 11924157_f3_129 | 3618 | 9280 | 543 | 181 | 107 | 2.6(10)-5 | | | |
| CONTIG495 | 6540832_f3_133 | 3619 | 9281 | 609 | 203 | 705 | 1.2(10)-69 | Escherichia coli | b3475 | [pn:hypothetical 21.8 kd protein in ftsy-nika intergenic region] |
| CONTIG495 | 30104052_f3_135 | 3620 | 9282 | 927 | 309 | 225 | 8.5(10)-19 | Escherichia coli | b0504 | [pn:hypothetical protein] [gn:ybbs] |
| CONTIG495 | 1307918_c1_142 | 3621 | 9283 | 318 | 106 | 229 | 2.2(10)-18 | Rhizobium sp. | P50360 | hypothetical 29.3 kd protein in region 2 of sym plasmid (no1265). |
| CONTIG495 | 20984450_c1_143 | 3622 | 9284 | 468 | 156 | 432 | 9.9(10)-41 | Escherichia coli | S70162 | |
| CONTIG495 | 29329043_c1_187 | 3623 | 9285 | 699 | 233 | 1086 | 4.9(10)-110 | Escherichia coli | b3463 | [pn:cell division atp-binding protein ftse] [gn:ftsc] |
| CONTIG495 | 29713291_c1_190 | 3624 | 9286 | 1344 | 448 | 1578 | 3.6(10)-162 | Escherichia coli | b1302 | [pn:gaba-aminotransferase] [gn:goaG] |
| CONTIG495 | 4957587_c1_192 | 3625 | 9287 | 336 | 112 | 387 | 5.7(10)-36 | Escherichia coli | b3458 | [pn:leucine-specific binding protein precursor] [gn:livk] |
| CONTIG495 | 10282891_c2_194 | 3626 | 9288 | 1098 | 366 | 1388 | 4.9(10)-142 | Plasmid R478 | L38824 | or:plasmid r478 gn:terc ie:2277 re:3317 di:direct sr:plasmid r478 dna nt:putative |
| CONTIG495 | 5189842_c2_202 | 3627 | 9289 | 546 | 182 | 478 | 1.3(10)-45 | Bacillus subtilis | padC | [pn:ferulate decarboxylase] [gn:yveh] |
| CONTIG495 | 14504207_c2_216 | 3628 | 9290 | 246 | 82 | 90 | 0.00017 | Haemophilus influenzae | HI1355 | [pn:hypothetical protein] |
| CONTIG495 | 24271091_c2_227 | 3629 | 9291 | 285 | 95 | 391 | 2.2(10)-36 | Escherichia coli | b3470 | [pn:hypothetical 9.1 kd protein in ftsy-nika intergenic region] |
| CONTIG495 | 21568791_c2_228 | 3630 | 9292 | 1002 | 334 | 395 | 8.3(10)-37 | Escherichia coli | b3579 | [pn:hypothetical 36.0 kd protein in avta-selb intergenic region] [gn:yiaO] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG495 | 32086658_c2_229 | 3631 | 9293 | 522 | 174 | 114 | 5.0(10)-7 | Haemophilus influenzae | HI1030 | [pn:sp] |
| CONTIG495 | 16833955_c2_240 | 3632 | 9294 | 1467 | 489 | 1423 | 1.3(10)-152 | Escherichia coli | b3464 | [pn:cell division protein ftsy] [gn:ftsy] |
| CONTIG495 | 4587833_c2_241 | 3633 | 9295 | 1083 | 361 | 1361 | 3.6(10)-139 | Escherichia coli | b3462 | [pn:cell division protein ftsx] [gn:ftsx] |
| CONTIG495 | 15837807_c3_277 | 3634 | 9296 | 1290 | 430 | 548 | 5.0(10)-53 | Haemophilus influenzae | HI1029 | [pn:sp] |
| CONTIG495 | 9767340_c3_283 | 3635 | 9297 | 369 | 123 | 211 | 2.6(10)-17 | Escherichia coli | b3467 | [pn:hypothetical 13.5 kd protein in ftsy-nika intergenic region] [gn:yihm] |
| CONTIG495 | 26363452_c3_287 | 3636 | 9298 | 858 | 286 | 1211 | 2.7(10)-123 | Escherichia coli | b3461 | [pn:rna polymerase sigma-32 subunit] [gn:rpoh] |
| CONTIG495 | 3257762_c3_291 | 3637 | 9299 | 1164 | 388 | 1772 | 1.0(10)-182 | Escherichia coli | b3460 | [pn:leu/ile/val-binding protein precursor] [gn:livj] |
| CONTIG495 | 4304068_fl_8 | 3638 | 9300 | 2394 | 798 | 680 | 5.2(10)-67 | Porphyromonas gingivalis | P49008 | beta-hexosaminidase precursor (ec 3.2.1.52) (n-acetyl-beta-glucosaminidase) (beta-glcnacase) (beta-n-acetylhexosaminidase) (beta-nahase). |
| CONTIG496 | 29589130_fl_21 | 3639 | 9301 | 468 | 156 | 670 | 6.0(10)-66 | Escherichia coli | b4252 | [pn:hypothetical 17.3 kd protein in pyrI-argI intergenic region] [gn:yjgk] |
| CONTIG496 | 24353408_fl_32 | 3640 | 9302 | 429 | 143 | 358 | 6.9(10)-33 | Escherichia coli | b4255 | [pn:hypothetical 15.6 kd protein in argI-valS intergenic region] [gn:yjgd] |
| CONTIG496 | 30369653_fl_49 | 3641 | 9303 | 3330 | 1110 | 1018 | 7.9(10)-103 | Escherichia coli | b4308 | [pn:hypothetical 38.0 kd protein in fecI-fimB intergenic region] [gn:yjhr] |
| CONTIG496 | 23609515_fl_50 | 3642 | 9304 | 294 | 98 | 419 | 2.3(10)-39 | Enterobacter agglomerans | A38965 | hypothetical protein a (insertion sequence is1222)-enterobacter agglomerans |
| CONTIG496 | 3381711_f2_55 | 3643 | 9305 | 2775 | 925 | 3895 | 0 | Escherichia coli | b4242 | [pn:mg2+ transport atpase, p-type 1] [gn:mgta] |
| CONTIG496 | 25522918_f2_76 | 3644 | 9306 | 2025 | 675 | 3216 | 0 | Escherichia coli | b0269 | [pn:hypothetical 69.4 kd protein in perr-argF intergenic region] [gn:yagf] |
| CONTIG496 | 30332633_f2_81 | 3645 | 9307 | 1725 | 575 | 2884 | 1.5(10)-300 | Escherichia coli | b0271 | [pn:hypothetical protein] [gn:yagh] |
| CONTIG496 | 3448032_f2_86 | 3646 | 9308 | 936 | 312 | 1124 | 4.5(10)-114 | Salmonella typhimurium | Q08015 | trna-(ms[2]io[6]a)-hydroxylase (ec 1.—.—.—). |
| CONTIG496 | 3984643_f3_102 | 3647 | 9309 | 489 | 163 | 183 | 2.3(10)-14 | Vibrio cholerae | S81006 | or:vibrio cholerae pn:hcp gn:hcp le:690 re:1208 di:direct sr:vibrio cholerae o17 nt:28 kda secreted hydrophilic protein; this sequence |
| CONTIG496 | 954637_f3_104 | 3648 | 9310 | 222 | 74 | 100 | 1.5(10)-5 | Escherichia coli | D21157 | [PN:unknown] [SR:Escherichia coli (sub_strain W3110, strain K-12) (library:librar] [DE:E. coli gene for unknown product, partial cds.] [NT:the coding frame was determined by the Lac fusion] [LE:57] [RE:192] [DI:direct] |
| CONTIG496 | 4470443_f3_123 | 3649 | 9311 | 918 | 306 | 1207 | 7.4(10)-123 | Escherichia coli | b0268 | [pn:hypothetical 33.3 kd protein in perr-argF intergenic region] |
| CONTIG496 | 2849025_f3_126 | 3650 | 9312 | 1413 | 471 | 2155 | 2.6(10)-223 | Escherichia coli | b0270 | [pn:hypothetical 50.6 kd protein in perr-argF intergenic region] |
| CONTIG496 | 9896067_f3_151 | 3651 | 9313 | 186 | 62 | 196 | 1.0(10)-15 | Enterobacter agglomerans | B38965 | hypothetical protein b (insertion sequence is1222)-enterobacter agglomerans |
| CONTIG496 | 26370678_c1_160 | 3652 | 9314 | 1488 | 496 | 2397 | 5.9(10)-249 | Escherichia coli | I41293 | ecoe type i restriction modification enzyme m subunit-escherichia coli |
| CONTIG496 | 29863508_c1_183 | 3653 | 9315 | 951 | 317 | 739 | 2.8(10)-73 | Haemophilus influenzae | HI0595 | [pn:carbamate kinase] [gn:arcc] |
| CONTIG496 | 11214091_c1_185 | 3654 | 9316 | 1551 | 517 | 756 | 4.0(10)-83 | Haemophilus influenzae | HI0594 | [pn:hypothetical protein] |
| CONTIG496 | 33603340_c1_195 | 3655 | 9317 | 300 | 100 | 94 | 6.5(10)-5 | Saccharomyces cerevisiae | X85757 | or:saccharomyces cerevisiae pn:unknown gn:internal orf g1669 le:6964 re:7365 di:direct sr:baker's yeast |
| CONTIG496 | 6251280_c2_204 | 3656 | 9318 | 2466 | 822 | 3981 | 0 | Escherichia coli | I41292 | ecoe type i restriction-modification enzyme r subunit-escherichia coli |
| CONTIG496 | 2599015_c2_216 | 3657 | 9319 | 915 | 305 | 1072 | 1.5(10)-108 | Escherichia coli | b0272 | [pn:hypothetical transcriptional regulator in perr-argF intergenic region] [gn:yagj] |
| CONTIG496 | 31328187_c2_226 | 3658 | 9320 | 1014 | 338 | 759 | 2.2(10)-75 | Escherichia coli | U70214 | or:escherichia coli le:112561 re:113301 di:complement nt:similar to e. coli yjhh |
| CONTIG496 | 21954407_c2_234 | 3659 | 9321 | 993 | 331 | 1409 | 2.8(10)-144 | Escherichia coli | b4245 | [pn:aspartate carbomoyltransferase catalytic subunit] [gn:pyrb] |
| CONTIG496 | 14964218_c2_235 | 3660 | 9322 | 474 | 158 | 679 | 6.7(10)-67 | Escherichia coli | b4244 | [pn:aspartate carbomoyltransferase regulatory subunit] [gn:pyri] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG496 | 32547931_c3_258 | 3661 | 9323 | 1794 | 598 | 1274 | 5.9(10)-130 | Citrobacter freundii | X17591 | or:citrobacter freundii pn:hsds polypeptide, part of cfra family gn:hsds le:234 re:1970 di:direct |
| CONTIG496 | 30657775_c3_266 | 3662 | 9324 | 1038 | 346 | 1701 | 3.2(10)-175 | Escherichia coli | b0273 | [pn:ornithine carbamoyltransferase chain f] [gn:argf] |
| CONTIG496 | 24347205_c3_275 | 3663 | 9325 | 213 | 71 | 117 | 6.2(10)-7 | Escherichia coli | U70214 | or:escherichia coli le:112561 re:113301 di:complement nt:similar to e. coli yjhh |
| CONTIG496 | 4469557_c3_276 | 3664 | 9326 | 1275 | 425 | 912 | 1.3(10)-91 | Pseudomonas aeruginosa | P13981 | arginine deiminase (ec 3.5.3.6). |
| CONTIG496 | 24406311_c3_279 | 3665 | 9327 | 1026 | 342 | 1230 | 2.7(10)-125 | Escherichia coli | b4254 | [pn:ornithine carbamoyltransferase] [gn:argi] |
| CONTIG496 | 10329756_c3_283 | 3666 | 9328 | 708 | 236 | 206 | 8.8(10)-17 | Escherichia coli | b3237 | [pn:arginine repressor] [gn:argr] |
| CONTIG496 | 9955041_c3_285 | 3667 | 9329 | 408 | 136 | 642 | 5.5(10)-63 | Escherichia coli | b4243 | [pn:13.5 kd protein in mgta-pyri intergenic region] [gn:yjgf] |
| CONTIG496 | 10179702_c3_286 | 3668 | 9330 | 1449 | 483 | 377 | 6.7(10)-35 | Streptomyces olivaceoviridis | S55000 | alpha-chitin binding protein precursor - streptomyces olivaceoviridis (strain |
| CONTIG496 | 31406300_c3_297 | 3669 | 9331 | 978 | 326 | 1381 | 2.7(10)-141 | Escherichia coli | b4241 | [pn:trehalose operon repressor] [gn:trer] |
| CONTIG497 | 26736576_f1_1 | 3670 | 9332 | 1272 | 424 | 1955 | 4.0(10)-202 | Escherichia coli | b2551 | [pn:serine hydroxymethyltransferase] [gn:glya] |
| CONTIG497 | 25969791_f1_2 | 3671 | 9333 | 1206 | 402 | 1637 | 2.0(10)-168 | Escherichia coli | b2536 | [pn:hypothetical protein] [gn:yfhs] |
| CONTIG497 | 4181268_f1_15 | 3672 | 9334 | 333 | 111 | 452 | 7.5(10)-43 | Escherichia coli | b2528 | [pn:hypothetical protein in hsca 5"" region] [gn:yfhf] |
| CONTIG497 | 34235307_f1_17 | 3673 | 9335 | 1896 | 632 | 2657 | 1.7(10)-276 | Escherichia coli | b2526 | [pn:heat shock protein hsca] [gn:hsca] |
| CONTIG497 | 12397806_f1_27 | 3674 | 9336 | 4983 | 1661 | 6480 | 0 | Escherichia coli | b2520 | [pn:hypothetical protein] |
| CONTIG497 | 11953427_f1_43 | 3675 | 9337 | 535 | 179 | 637 | 1.8(10)-62 | Escherichia coli | b2512 | [pn:hypothetical protein] |
| CONTIG497 | 16226057_f2_47 | 3676 | 9338 | 1008 | 336 | 406 | 5.7(10)-38 | Haemophilus influenzae | HI1248 | [pn:hypothetical protein] |
| CONTIG497 | 12219836_f2_50 | 3677 | 9339 | 537 | 179 | 789 | 1.5(10)-78 | Escherichia coli | b2527 | [pn:hypothetical 20.1 kd protein in hsca 5"" region] [gn:yfhe] |
| CONTIG497 | 11988587_f2_52 | 3678 | 9340 | 363 | 121 | 539 | 4.5(10)-52 | Escherichia coli | b2525 | [pn:ferredoxin, 2fe-2s] [gn:fdx] |
| CONTIG497 | 31650080_f2_70 | 3679 | 9341 | 2343 | 781 | 3091 | 0 | Escherichia coli | b2519 | [pn:hypothetical protein] [gn:pbpc] |
| CONTIG497 | 21759667_f2_72 | 3680 | 9342 | 633 | 211 | 585 | 6.0(10)-57 | Escherichia coli | b0895 | [pn:anaerobic dimethyl sulfoxide reductase chain b] [gn:dmsb] |
| CONTIG497 | 15751633_f2_74 | 3681 | 9343 | 912 | 304 | 126 | 1.5(10)-7 | Methanobacterium thermoautotrophicum | MTH1241 | [pn:polyferredoxin] |
| CONTIG497 | 4805165_f2_76 | 3682 | 9344 | 1170 | 390 | 1691 | 3.7(10)-174 | Escherichia coli | b2515 | [pn:gcpe protein] [gn:gcpe] |
| CONTIG497 | 879700_f2_77 | 3683 | 9345 | 1323 | 441 | 2088 | 3.2(10)-216 | Escherichia coli | b2514 | [pn:histidyl-trna synthetase] [gn:hiss] |
| CONTIG497 | 22479766_f3_82 | 3684 | 9346 | 651 | 217 | 356 | 1.1(10)-32 | Haemophilus influenzae | HI1249 | [pn:hypothetical protein precursor] |
| CONTIG497 | 31464586_f3_85 | 3685 | 9347 | 807 | 269 | 1032 | 2.6(10)-104 | Escherichia coli | b2532 | [pn:hypothetical protein] |
| CONTIG497 | 3009663_f3_86 | 3686 | 9348 | 495 | 165 | 640 | 9.0(10)-63 | Escherichia coli | b2531 | [pn:hypothetical protein] |
| CONTIG497 | 4956303_f3_87 | 3687 | 9349 | 1320 | 440 | 2020 | 5.2(10)-209 | Escherichia coli | b2530 | [pn:hypothetical protein] |
| CONTIG497 | 23616080_f3_88 | 3688 | 9350 | 411 | 137 | 642 | 5.5(10)-63 | Escherichia coli | b2529 | [pn:hypothetical protein] |
| CONTIG497 | 5275331_f3_92 | 3689 | 9351 | 264 | 88 | 346 | 1.3(10)-31 | Escherichia coli | b2524 | [pn:hypothetical 7.7 kd protein in fdx 3"" region] [gn:yfhj] |
| CONTIG497 | 34022075_f3_93 | 3690 | 9352 | 1308 | 436 | 1833 | 3.3(10)-189 | Escherichia coli | b2523 | [pn:hypothetical protein in fdx 3"" region] [gn:yfhi] |
| CONTIG497 | 9961781_f3_94 | 3691 | 9353 | 804 | 268 | 1144 | 2.6(10)-116 | Escherichia coli | b2522 | [pn:sseb protein] [gn:sseb] |
| CONTIG497 | 34491287_f3_104 | 3692 | 9354 | 2418 | 806 | 1485 | 2.6(10)-152 | Escherichia coli | b1588 | [pn:sseb protein] [gn:sseb] |
| CONTIG497 | 4557805_f3_106 | 3693 | 9355 | 819 | 273 | 133 | 7.0(10)-7 | Escherichia coli | b1590 | [pn:hypothetical protein] |
| CONTIG497 | 3259683_f3_108 | 3694 | 9356 | 516 | 172 | 696 | 1.1(10)-68 | Escherichia coli | b2518 | [pn:nucleoside diphosphate kinase] [gn:ndk] |
| CONTIG497 | 30267625_f3_109 | 3695 | 9357 | 1311 | 437 | 1854 | 2.0(10)-191 | Escherichia coli | b2517 | [pn:hypothetical 43.1 kd protein in ndk-gcpe intergenic region] |
| CONTIG497 | 13869066_f3_110 | 3696 | 9358 | 1011 | 337 | 1100 | 1.6(10)-111 | Escherichia coli | b2516 | [pn:hypothetical 36.2 kd protein in ndk-gcpe intergenic region] |
| CONTIG497 | 16839666_f3_113 | 3697 | 9359 | 678 | 226 | 695 | 1.3(10)-68 | Escherichia coli | b2513 | [pn:hypothetical protein] |
| CONTIG497 | 24424167_c1_147 | 3698 | 9360 | 951 | 317 | 1162 | 4.4(10)-118 | Escherichia coli | b2521 | [pn:putative thiosulfate sulfurtransferase] |
| CONTIG497 | 31879212_c1_163 | 3699 | 9361 | 1353 | 451 | 1344 | 2.2(10)-137 | Escherichia coli | b2535 | [pn:stationary phase inducible protein csie] [gn:csie] |
| CONTIG497 | 10052078_c2_204 | 3700 | 9362 | 1572 | 524 | 691 | 3.6(10)-68 | Escherichia coli | b1621 | [pn:pts system, maltose and glucose-specific ii abc component [gn:malx] |
| CONTIG497 | 24245462_c2_205 | 3701 | 9363 | 1380 | 460 | 1013 | 2.7(10)-102 | Bacillus subtilis | glvA | [pn:6-phospho-alpha-glucosidase] [gn:glvg] |
| CONTIG497 | 5180338_c2_223 | 3702 | 9364 | 813 | 271 | 1258 | 2.8(10)-128 | Escherichia coli | b2533 | [pn:extragenic suppressor protein suhb] [gn:suhb] |
| CONTIG497 | 13705037_c2_229 | 3703 | 9365 | 468 | 156 | 583 | 9.9(10)-57 | Escherichia coli | b2543 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG497 | 4896032_c3_266 | 3704 | 9366 | 783 | 261 | 137 | 3.0(10)-7 | Bacillus subtilis | ybbH | [pn:hypothetical protein] |
| CONTIG498 | 5947212_f1_1 | 3705 | 9367 | 447 | 149 | 651 | 6.2(10)-64 | Escherichia coli | b1778 | [pn:hypothetical protein] [gn:ycaa] |
| CONTIG498 | 16228431_f1_6 | 3706 | 9368 | 555 | 185 | 729 | 3.2(10)-72 | Escherichia coli | b1765 | [pn:hypothetical 20.1 kd protein in seld-sppa intergenic region] |
| CONTIG498 | 6336575_f1_8 | 3707 | 9369 | 1926 | 642 | 2996 | 0 | Escherichia coli | b1763 | [pn:dna topoisomerase iii] [gn:topb] |
| CONTIG498 | 24740925_f1_14 | 3708 | 9370 | 636 | 212 | 479 | 1.0(10)-45 | Escherichia coli | b1753 | [pn:hypothetical protein] |
| CONTIG498 | 19535307_f1_22 | 3709 | 9371 | 1251 | 417 | 1800 | 1.1(10)-185 | Escherichia coli | b1748 | [pn:hypothetical protein] [gn:cstc] |
| CONTIG498 | 34039076_f1_34 | 3710 | 9372 | 516 | 172 | 491 | 5.5(10)-47 | Escherichia coli | b1743 | [pn:hypothetical protein] [gn:spy] |
| CONTIG498 | 34567181_f1_39 | 3711 | 9373 | 339 | 113 | 454 | 4.5(10)-43 | Escherichia coli | b1738 | [pn:pts system, cellobiose-specific iib component] [gn:cela] |
| CONTIG498 | 36516660_f1_43 | 3712 | 9374 | 1374 | 458 | 2120 | 1.3(10)-219 | Escherichia coli | b1734 | [pn:phospho-beta-glucosidase b] [gn:celf] |
| CONTIG498 | 14492058_f1_56 | 3713 | 9375 | 570 | 190 | 609 | 1.7(10)-59 | Escherichia coli | b1726 | [pn:hypothetical protein] |
| CONTIG498 | 32539012_f1_60 | 3714 | 9376 | 936 | 312 | 1221 | 2.3(10)-124 | Escherichia coli | b1722 | [pn:hypothetical protein] |
| CONTIG498 | 4876318_f1_62 | 3715 | 9377 | 1938 | 646 | 3261 | 0 | Escherichia coli | b1719 | [pn:threonyl-trna synthetase] [gn:thrs] |
| CONTIG498 | 36125268_f1_63 | 3716 | 9378 | 321 | 107 | 373 | 1.8(10)-34 | Escherichia coli | b1718 | [pn:initiation factor if-3] [gn:infc] |
| CONTIG498 | 33594575_f2_80 | 3717 | 9379 | 705 | 235 | 788 | 6.2(10)-78 | Escherichia coli | b1758 | [pn:hypothetical protein] |
| CONTIG498 | 33789193_f2_88 | 3718 | 9380 | 1500 | 500 | 2058 | 4.9(10)-213 | Escherichia coli | b1746 | [pn:hypothetical protein] |
| CONTIG498 | 32320932_f2_96 | 3719 | 9381 | 360 | 120 | 548 | 5.0(10)-53 | Escherichia coli | b1739 | [pn:osmotically inducible protein e precursor] [gn:osme] |
| CONTIG498 | 5289837_f3_111 | 3720 | 9382 | 291 | 97 | 398 | 4.0(10)-37 | Escherichia coli | b1777 | [pn:hypothetical protein] |
| CONTIG498 | 11057961_f3_120 | 3721 | 9383 | 1056 | 352 | 1608 | 2.3(10)-165 | Escherichia coli | b1764 | [pn:selenophosphate synthase] [gn:seld] |
| CONTIG498 | 892316_f3_124 | 3722 | 9384 | 342 | 114 | 335 | 1.8(10)-30 | Escherichia coli | b1760 | [pn:hypothetical protein] |
| CONTIG498 | 3252266_f3_141 | 3723 | 9385 | 1140 | 380 | 1521 | 4.0(10)-156 | Escherichia coli | b1747 | [pn:hypothetical protein] |
| CONTIG498 | 29980152_f3_144 | 3724 | 9386 | 1359 | 453 | 1724 | 1.2(10)-177 | Escherichia coli | b1745 | [pn:hypothetical protein] [gn:ydjs] |
| CONTIG498 | 4504818_f3_145 | 3725 | 9387 | 975 | 325 | 977 | 1.8(10)-98 | Escherichia coli | b1744 | [pn:hypothetical protein] |
| CONTIG498 | 17052038_f3_146 | 3726 | 9388 | 708 | 236 | 644 | 3.3(10)-63 | Escherichia coli | b1742 | [pn:hypothetical protein] [gn:ydjs] |
| CONTIG498 | 11720093_f3_151 | 3727 | 9389 | 1371 | 457 | 1873 | 2.0(10)-193 | Escherichia coli | b1737 | [pn:pts system, cellobiose-specific iic component] [gn:celb] or:escherichia coli pn:pts enzyme iii cel gn:celc le:1 re:351 di:direct sr:escherichia coli (individual_isolate fn23/human/sweden, strain cco nt:putative |
| CONTIG498 | 26181562_f3_152 | 3728 | 9390 | 351 | 117 | 467 | 1.8(10)-44 | Escherichia coli | M93573 | |
| CONTIG498 | 33651711_f3_153 | 3729 | 9391 | 834 | 278 | 1136 | 2.5(10)-115 | Escherichia coli | b1735 | [pn:cel operon repressor] [gn:celd] |
| CONTIG498 | 14657188_f3_155 | 3730 | 9392 | 786 | 262 | 949 | 1.6(10)-95 | Escherichia coli | b1733 | [pn:ydjc] |
| CONTIG498 | 125063_f3_159 | 3731 | 9393 | 267 | 89 | 359 | 5.4(10)-33 | Escherichia coli | b1731 | [pn:hypothetical protein] |
| CONTIG498 | 33869002_c1_181 | 3732 | 9394 | 294 | 98 | 295 | 3.2(10)-26 | Escherichia coli | b1724 | [pn:hypothetical protein] |
| CONTIG498 | 22536630_c1_182 | 3733 | 9395 | 888 | 296 | 1320 | 7.9(10)-135 | Escherichia coli | b1725 | [pn:hypothetical protein] |
| CONTIG498 | 270402_c1_186 | 3734 | 9396 | 615 | 205 | 968 | 1.6(10)-97 | Escherichia coli | b1728 | [pn:hypothetical protein] |
| CONTIG498 | 26734393_c1_190 | 3735 | 9397 | 2283 | 761 | 3404 | 0 | Escherichia coli | b1732 | [pn:catalase hpii] [gn:kate] |
| CONTIG498 | 35647706_c1_197 | 3736 | 9398 | 951 | 317 | 1117 | 2.6(10)-113 | Escherichia coli | b1741 | [pn:hypothetical protein] |
| CONTIG498 | 32109831_c1_203 | 3737 | 9399 | 483 | 161 | 95 | 0.001 | Azospirillum brasilense | X70360 | or:azospirillum brasilense gn:carr le:59 re:580 di:direct nt:orf2 |
| CONTIG498 | 16688291_c1_210 | 3738 | 9400 | 1545 | 515 | 635 | 2.0(10)-106 | Escherichia coli | b1755 | [pn:hypothetical protein] |
| CONTIG498 | 1961575_c1_212 | 3739 | 9401 | 1404 | 468 | 1916 | 5.5(10)-198 | Escherichia coli | b1757 | [pn:hypothetical protein] |
| CONTIG498 | 24728175_c1_216 | 3740 | 9402 | 429 | 143 | 435 | 4.7(10)-41 | Escherichia coli | b1759 | [pn:hypothetical protein] |
| CONTIG498 | 29890942_c2_244 | 3741 | 9403 | 924 | 308 | 1015 | 1.7(10)-102 | Escherichia coli | b2842 | [pn:2-deoxy-d-gluconate 3-dehydrogenase] [gn:kdud] |
| CONTIG498 | 14730277_c2_245 | 3742 | 9404 | 1407 | 469 | 1752 | 1.3(10)-180 | Escherichia coli | b1729 | [pn:hypothetical protein] |
| CONTIG498 | 16614825_c2_276 | 3743 | 9405 | 882 | 294 | 1322 | 4.7(10)-135 | Escherichia coli | b1749 | [pn:exodeoxyribonuclease iii] [gn:xtha] |
| CONTIG498 | 24663132_c2_277 | 3744 | 9406 | 690 | 230 | 173 | 2.7(10)-13 | Escherichia coli | b1750 | [pn:hypothetical protein] |
| CONTIG498 | 32453418_c2_278 | 3745 | 9407 | 1176 | 392 | 1434 | 6.5(10)-147 | Escherichia coli | b1754 | [pn:nadp-specific glutamate dehydrogenase] [gn:gdha] |
| CONTIG498 | 3922338_c2_288 | 3746 | 9408 | 1359 | 453 | 2125 | 3.8(10)-220 | Escherichia coli | b1761 | [pn:1-asparaginase i] [gn:ansa] |
| CONTIG498 | 13100905_c2_297 | 3747 | 9409 | 1128 | 376 | 1636 | 2.6(10)-168 | Escherichia coli | b1767 | [pn:hypothetical 23,4 kd protein in ansa 3"" region] [gn:ydjb] |
| CONTIG498 | 4392318_c2_298 | 3748 | 9410 | 651 | 217 | 969 | 1.2(10)-97 | Bacillus circulans | P20533 | chitinase a1 precursor (ec 3.2.1.14). |
| CONTIG498 | 22738257_c2_299 | 3749 | 9411 | 1365 | 455 | 403 | 5.4(10)-37 | Escherichia coli | b1768 | [pn:hypothetical protein] |
| CONTIG498 | 4354837_c3_304 | 3750 | 9412 | 945 | 315 | 1266 | 4.2(10)-129 | Escherichia coli | b1723 | [pn:6-phosphofructokinase isozyme] [gn:pfkb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG498 | 5907943_c3_307 | 3751 | 9413 | 684 | 228 | 980 | 8.4(10)-99 | Escherichia coli | b1727 | [pn:hypothetical protein] |
| CONTIG498 | 24266652_c3_320 | 3752 | 9414 | 936 | 312 | 1257 | 3.7(10)-128 | Escherichia coli | b1740 | [pn:nh3-dependent nad synthetase] [gn:nade] |
| CONTIG498 | 12230453_c3_336 | 3753 | 9415 | 1143 | 381 | 568 | 3.7(10)-55 | Escherichia coli | b1756 | [pn:hypothetical protein] |
| CONTIG498 | 2860216_c3_340 | 3754 | 9416 | 261 | 87 | 91 | 0.00093 | Pseudomonas aeruginosa | M32077 | or:pseudomonas aeruginosa le:2079 re:3137 di:direct nt:alginate regulatory protein p; (put.); putative srp. aeruginosa (strain pao, isolate pa02003) dna, from patien |
| CONTIG498 | 4461068_c3_346 | 3755 | 9417 | 1866 | 622 | 2525 | 1.6(10)-262 | Escherichia coli | b1766 | [pn:protease iv] [gn:sppa] |
| CONTIG499 | 22150281_f1_23 | 3756 | 9418 | 1575 | 525 | 2423 | 1.0(10)-251 | Escherichia coli | b0074 | [pn:2-isopropylmalate synthase] [gn:leua] |
| CONTIG499 | 26750286_f1_37 | 3757 | 9419 | 1521 | 507 | 2481 | 7.4(10)-258 | Escherichia coli | b0062 | [pn:1-arabinose isomerase] [gn:araa] |
| CONTIG499 | 14570792_f1_42 | 3758 | 9420 | 2919 | 973 | 4561 | 0 | Escherichia coli | b0059 | [pn:probable atp-dependent helicase hepa] [gn:hepa] |
| CONTIG499 | 24089208_f1_43 | 3759 | 9421 | 499 | 167 | 724 | 1.1(10)-71 | Escherichia coli | b0058 | [pn:hypothetical 24.9 kd protein in sura-hepa intergenic region] [gn:yabo] |
| CONTIG499 | 4736717_f2_82 | 3760 | 9422 | 1413 | 471 | 2250 | 2.2(10)-233 | Escherichia coli | b0072 | [pn:3-isopropylmalate dehydratase] [gn:leuc] |
| CONTIG499 | 32538577_f2_90 | 3761 | 9423 | 1611 | 537 | 2192 | 3.1(10)-227 | Escherichia coli | b0067 | [pn:hypothetical 59.6 kd protein in arac-tbpa intergenic region] [gn:yabk] |
| CONTIG499 | 22445442_f3_131 | 3762 | 9424 | 1116 | 372 | 1535 | 1.3(10)-157 | Escherichia coli | b0073 | [pn:3-isopropylmalate dehydrogenase] [gn:leub] |
| CONTIG499 | 15057762_f3_132 | 3763 | 9425 | 621 | 207 | 946 | 3.3(10)-95 | Escherichia coli | b0071 | [pn:3-isopropylmalate dehydratase] [gn:leud] |
| CONTIG499 | 33640625_f3_134 | 3764 | 9426 | 1680 | 560 | 2374 | 1.6(10)-246 | Escherichia coli | b0069 | [pn:hypothetical 63.9 kd protein in tbpa-leud intergenic region] [gn:yabn] |
| CONTIG499 | 34245791_f3_135 | 3765 | 9427 | 1047 | 349 | 1413 | 1.1(10)-144 | Escherichia coli | b0068 | [pn:thiamine-binding periplasmic protein precursor] [gn:tbpa] |
| CONTIG499 | 29941042_f3_138 | 3766 | 9428 | 921 | 307 | 828 | 1.1(10)-82 | Escherichia coli | b0066 | [pn:hypothetical abc transporter in arac-tbpa intergenic region] [gn:yabj] |
| CONTIG499 | 10937566_f3_141 | 3767 | 9429 | 1770 | 590 | 2439 | 2.1(10)-253 | Escherichia coli | b0063 | [pn:1-ribulokinase] [gn:arab] |
| CONTIG499 | 15755192_f3_145 | 3768 | 9430 | 828 | 276 | 1193 | 2.2(10)-121 | Escherichia coli | b0061 | [pn:1-ribulose-5-phosphate 4-epimerase] [gn:arad] |
| CONTIG499 | 11765657_f3_146 | 3769 | 9431 | 2514 | 838 | 3674 | 0 | Escherichia coli | b0060 | [pn:dna polymerase ii] [gn:polb] |
| CONTIG499 | 3211058_c1_165 | 3770 | 9432 | 804 | 268 | 920 | 1.8(10)-92 | Escherichia coli | b0065 | [pn:hypothetical 26.3 kd protein in arac-tbpa intergenic region] [gn:yabp] |
| CONTIG499 | 33722680_c1_171 | 3771 | 9433 | 1263 | 421 | 1669 | 8.1(10)-172 | Escherichia coli | b0070 | [pn:hypothetical 42.7 kd protein in tbpa-leud intergenic region] [gn:yabm] |
| CONTIG499 | 34632808_c1_183 | 3772 | 9434 | 513 | 171 | 758 | 2.7(10)-75 | Escherichia coli | b0078 | [pn:acetolactate synthase isozyme iii small subunit] [gn:ilvh] |
| CONTIG499 | 15752150_c1_187 | 3773 | 9435 | 399 | 133 | 519 | 6.0(10)-50 | Escherichia coli | b0083 | [pn:cell division protein ftsl] [gn:ftsl] |
| CONTIG499 | 32539093_c1_188 | 3774 | 9436 | 1782 | 594 | 2669 | 8.8(10)-278 | Escherichia coli | b0084 | [pn:penicillin-binding protein 3 precursor] [gn:ftsi] |
| CONTIG499 | 26256317_c1_191 | 3775 | 9437 | 1437 | 479 | 1871 | 3.2(10)-193 | Escherichia coli | b0086 | [pn:udp-n-acetylmuramoyl-l-alanine] [gn:murf] |
| CONTIG499 | 12265765_c1_192 | 3776 | 9438 | 1278 | 426 | 1637 | 2.0(10)-168 | Escherichia coli | b0089 | [pn:cell division protein ftsw] [gn:ftsw] |
| CONTIG499 | 832575_c1_197 | 3777 | 9439 | 564 | 188 | 674 | 2.2(10)-66 | Escherichia coli | b0093 | [pn:cell division protein ftsq] [gn:ftsq] |
| CONTIG499 | 6527_c2_236 | 3778 | 9440 | 1011 | 337 | 1318 | 1.3(10)-134 | Escherichia coli | b0076 | [pn:leuo] |
| CONTIG499 | 4492650_c2_237 | 3779 | 9441 | 987 | 329 | 1500 | 6.7(10)-154 | Escherichia coli | b0082 | [pn:hypothetical 34.9 kd protein in frur-ftsl intergenic region] [gn:yabc] |
| CONTIG499 | 16987800_c2_240 | 3780 | 9442 | 1509 | 503 | 2125 | 3.8(10)-220 | Escherichia coli | b0085 | [pn:meso-diaminopimelate-adding enzyme] [gn:mure] |
| CONTIG499 | 3398507_c2_244 | 3781 | 9443 | 1416 | 472 | 1859 | 6.0(10)-192 | Escherichia coli | b0088 | [pn:udp-n-acetylmuramoyl-1-alanine] [gn:murd] |
| CONTIG499 | 13869067_c2_247 | 3782 | 9444 | 1479 | 493 | 2196 | 1.2(10)-227 | Escherichia coli | b0091 | [pn:udp-n-acetylmuramate] [gn:murc] |
| CONTIG499 | 1172057_c3_266 | 3783 | 9445 | 1023 | 341 | 1299 | 1.3(10)-132 | Escherichia coli | b0064 | [pn:arabinose operon regulatory protein] [gn:arac] |
| CONTIG499 | 14485081_c2_287 | 3784 | 9446 | 1755 | 585 | 2612 | 9.6(10)-272 | Escherichia coli | b0077 | [pn:acetolactate synthase isozyme iii large subunit] [gn:ilvi] |
| CONTIG499 | 5897968_c3_288 | 3785 | 9447 | 1014 | 338 | 1684 | 2.1(10)-173 | Escherichia coli | b0080 | [pn:fructose repressor] [gn:frur] |
| CONTIG499 | 36016382_c3_290 | 3786 | 9448 | 513 | 171 | 705 | 1.2(10)-69 | Escherichia coli | b0081 | [pn:hypothetical 17.4 kd protein in frur-ftsl intergenic region] [gn:yabb] |
| CONTIG499 | 35333290_c3_295 | 3787 | 9449 | 1128 | 376 | 1620 | 1.3(10)-166 | Escherichia coli | b0087 | [pn:phospho-n-acetylmuramoyl-pentapeptide-transferase] [gn:mray] |
| CONTIG499 | 35244787_c3_298 | 3788 | 9450 | 1107 | 369 | 1655 | 2.5(10)-170 | Escherichia coli | b0090 | [pn:udp-n-acetylglucosamine] [gn:murg] |
| CONTIG499 | 2927042_c3_299 | 3789 | 9451 | 948 | 316 | 1322 | 4.7(10)-135 | Escherichia coli | b0092 | [pn:d-alanine] [gn:ddlb] |
| CONTIG5 | 14265875_c3_6 | 3790 | 9452 | 465 | 155 | 225 | 9.3(10)-25 | Escherichia coli | b0368 | [pn:hypothetical protein] [gn:taud] |
| CONTIG50 | 31847506_f2_1 | 3791 | 9453 | 729 | 243 | 1149 | 1.0(10)-116 | Escherichia coli | b0096 | [pn:udp-3-o-3-hydroxymyristoyl n-acetylglucosamine deacetylase] [gn:lpxc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG500 | 1646136_f1_8 | 3792 | 9454 | 846 | 282 | 1294 | 4.5(10)-132 | Escherichia coli | b3697 | [pn:hypothetical 29.7 kd protein in ibpa-gyrb intergenic region] |
| CONTIG500 | 31299317_f1_10 | 3793 | 9455 | 978 | 326 | 1268 | 2.6(10)-129 | Escherichia coli | b3693 | [pn:hypothetical 31.4 kd protein in ibpa-gyrb intergenic region] |
| CONTIG500 | 2638082_f1_11 | 3794 | 9456 | 336 | 112 | 92 | 0.0015 | Escherichia coli | b3692 | [pn:hypothetical 64.0 kd protein in ibpa-gyrb intergenic region] |
| CONTIG500 | 14316958_f1_12 | 3795 | 9457 | 1203 | 401 | 1929 | 2.2(10)-199 | Escherichia coli | b3692 | [pn:hypothetical 64.0 kd protein in ibpa-gyrb intergenic region] |
| CONTIG500 | 1265891_f1_13 | 3796 | 9458 | 1398 | 466 | 2061 | 2.3(10)-213 | Escherichia coli | b3691 | [pn:hypothetical 48.8 kd protein in ibpa-gyrb intergenic region] |
| CONTIG500 | 5328280_f1_14 | 3797 | 9459 | 1281 | 427 | 1771 | 1.3(10)-182 | Escherichia coli | b3689 | [pn:hypothetical 46.4 kd protein in ibpa-gyrb intergenic region] |
| CONTIG500 | 2471288_f1_16 | 3798 | 9460 | 465 | 155 | 614 | 5.0(10)-60 | Escherichia coli | b3686 | [pn:hslj] [gn:ibpb] |
| CONTIG500 | 36455080_f1_17 | 3799 | 9461 | 1851 | 617 | 2260 | 1.8(10)-234 | Escherichia coli | b3685 | [pn:hypothetical 58.9 kd protein in ibpb 3'''' region] [gn:yide] |
| CONTIG500 | 2254062_f1_20 | 3800 | 9462 | 1674 | 558 | 1724 | 1.2(10)-177 | Escherichia coli | b3683 | [pn:pts system arbutin-like iic component] [gn:glvc] |
| CONTIG500 | 9847285_f1_24 | 3801 | 9463 | 711 | 237 | 160 | 6.5(10)-12 | Escherichia coli | D90866 | or:escherichia coli pn:d-serine dehydratase transcriptional activator gn:dsdc le:11564 re:11818 di:complement sr:escherichia coli (strain k:12) dna, clone_lib:kohara lambda minise nt:similar to [pir accession number a28674]; |
| CONTIG500 | 979582_f1_26 | 3802 | 9464 | 954 | 318 | 1262 | 1.1(10)-128 | Escherichia coli | b2364 | [pn:d-serine deaminase activator] [gn:dsdc] |
| CONTIG500 | 2428532_f1_27 | 3803 | 9465 | 1116 | 372 | 93 | 0.098 | Clostridium sp. | P23340 | endoglucanase c307 precursor (ec 3.2.1.4) (endo-1,4-beta-glucanase) (cellulase) |
| CONTIG500 | 4554818_f1_45 | 3804 | 9466 | 462 | 154 | 598 | 2.5(10)-58 | Escherichia coli | b3663 | [pn:hypothetical 18.2 kd protein in nlpa-uhpt intergenic region] |
| CONTIG500 | 2994757_f1_47 | 3805 | 9467 | 1233 | 411 | 1251 | 1.6(10)-127 | Escherichia coli | b3662 | [pn:hypothetical 43.6 kd protein in nlpa 3'''' region] [gn:yicm] |
| CONTIG500 | 4551942_f2_55 | 3806 | 9468 | 1125 | 375 | 1762 | 1.1(10)-181 | Escherichia coli | b3700 | [pn:protein] [gn:rrec] |
| CONTIG500 | 24417336_f2_60 | 3807 | 9469 | 1038 | 346 | 333 | 3.1(10)-30 | Bacillus subtilis | yogA | [pn:hypothetical protein] |
| CONTIG500 | 33750965_f2_61 | 3808 | 9470 | 717 | 239 | 556 | 7.2(10)-54 | Escherichia coli | b3695 | [pn:hypothetical transcriptional regulator in ibpa-gyrb intergenic region] [gn:yidw] |
| CONTIG500 | 3210443_f2_63 | 3809 | 9471 | 630 | 210 | 669 | 7.5(10)-66 | Escherichia coli | b3692 | [pn:hypothetical 64.0 kd protein in ivbl-ibpb intergenic region] |
| CONTIG500 | 1580617_f2_73 | 3810 | 9472 | 378 | 126 | 371 | 2.8(10)-34 | Escherichia coli | b3676 | [pn:hypothetical 12.8 kd protein in ivbl-ibpb intergenic region] |
| CONTIG500 | 6362807_f2_79 | 3811 | 9473 | 459 | 153 | 97 | 3.1(10)-5 | Escherichia coli | D90866 | or:escherichia coli pn:d-serine dehydratase transcriptional activator gn:dsdc le:10864 re:11133 di:complement sr:escherichia coli (strain k:12) dna, clone_lib:kohara lambda minise nt:similar to [pir accession number a28674]; |
| CONTIG500 | 4898593_f2_86 | 3812 | 9474 | 429 | 143 | 390 | 2.7(10)-36 | Escherichia coli | b3082 | [pn:hypothetical 15.0 kd protein in ebgc-exut intergenic region] [gn:ygin] |
| CONTIG500 | 32541507_f2_87 | 3813 | 9475 | 1731 | 577 | 2464 | 4.7(10)-256 | Escherichia coli | b3671 | [pn:acetohydroxy acid synthase i, small subunit] [gn:ilvb] |
| CONTIG500 | 2479098_f2_88 | 3814 | 9476 | 291 | 97 | 435 | 4.7(10)-41 | Escherichia coli | b3670 | [pn:acetohydroxy acid synthase i, small subunit] [gn:ilvn] |
| CONTIG500 | 4822086_f2_90 | 3815 | 9477 | 1515 | 505 | 1640 | 9.6(10)-169 | Escherichia coli | b3668 | [pn:sensor protein uhpb] [gn:uhpb] |
| CONTIG500 | 2943034_f2_96 | 3816 | 9478 | 1017 | 339 | 167 | 2.0(10)-10 | Helicobacter pylori | yfhM | [pn:hypothetical protein] |
| CONTIG500 | 22462782_f2_99 | 3817 | 9479 | 531 | 177 | 94 | 9.5(10)-5 | Escherichia coli | HP0641 | [pn:h] |
| CONTIG500 | 14316406_f3_105 | 3818 | 9480 | 1110 | 370 | 1669 | 8.1(10)-172 | Escherichia coli | b3701 | [pn:dna polymerase iii beta-subunit] [gn:dnan] |
| CONTIG500 | 26432887_f3_106 | 3819 | 9481 | 2430 | 810 | 3700 | 0 | Escherichia coli | b3699 | [pn:dna gyrase, subunit b] [gn:gyrb] |
| CONTIG500 | 22870125_f3_120 | 3820 | 9482 | 429 | 143 | 607 | 2.7(10)-59 | Escherichia coli | b3687 | [pn:hslj] [gn:ibpa] |
| CONTIG500 | 34156516_f3_129 | 3821 | 9483 | 1479 | 493 | 1696 | 1.1(10)-174 | Bacillus subtilis | glvA | [pn:6-phospho-alpha-glucosidase] [gn:glvg] |
| CONTIG500 | 30707515_f3_130 | 3822 | 9484 | 363 | 121 | 287 | 2.2(10)-25 | Escherichia coli | b3675 | [pn:hypothetical 13.8 kd protein in ivbl-ibpb intergenic region] |
| CONTIG500 | 15085840_f3_141 | 3823 | 9485 | 342 | 114 | 349 | 6.2(10)-32 | Bacillus subtilis | b3083 | [pn:hypothetical 12.1 kd protein in cbgc-exut intergenic region] [gn:ygin] |
| CONTIG500 | 14930291_f3_143 | 3824 | 9486 | 768 | 256 | 932 | 1.0(10)-93 | Escherichia coli | b3669 | [pn:transcriptional regulatory protein uhpa] [gn:uhpa] |
| CONTIG500 | 4333318_f3_145 | 3825 | 9487 | 1320 | 440 | 1875 | 1.2(10)-193 | Escherichia coli | b3667 | [pn:regulatory protein uhpc] [gn:uhpc] |
| CONTIG500 | 12582291_f3_146 | 3826 | 9488 | 1524 | 508 | 2073 | 1.3(10)-214 | Escherichia coli | b3666 | [pn:hexosephosphate transport protein] [gn:uhpt] |
| CONTIG500 | 5116067_c1_160 | 3827 | 9489 | 315 | 105 | 223 | 1.3(10)-18 | Bacillus subtilis | licA | [pn:phosphotransferase system] [gn:celc] |
| CONTIG500 | 24226552_c1_161 | 3828 | 9490 | 1407 | 469 | 190 | 3.7(10)-12 | Escherichia coli | b4036 | [pn:phage lambda receptor protein] [gn:lamb] |
| CONTIG500 | 24101517_c1_162 | 3829 | 9491 | 1050 | 350 | 1083 | 1.0(10)-109 | Escherichia coli | b3660 | [pn:hypothetical 33.1 kd protein in nlpa 5'''' region] [gn:yicl] |
| CONTIG500 | 432811_c1_168 | 3830 | 9492 | 912 | 304 | 426 | 4.2(10)-40 | Pseudomonas putida | P10183 | transcriptional activator protein nahr. |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG500 | 10837763_c1_190 | 3831 | 9493 | 1341 | 447 | 1507 | 1.2(10)-154 | *Escherichia coli* | b2365 | [pn:dsdx permease] [gn:dsdx] |
| CONTIG500 | 34557265_c1_199 | 3832 | 9494 | 756 | 252 | 928 | 2.7(10)-93 | *Escherichia coli* | b3684 | [pn:hypothetical transcriptional regulator in ilvo-ibpb intergenic region] [gn:yidp] |
| CONTIG500 | 17004052_c1_215 | 3833 | 9495 | 342 | 114 | 99 | 5.5(10)-5 | *Escherichia coli* | U27192 | or:*escherichia coli* pn:modd gn:modd le:5360 re:6055 di:direct |
| CONTIG500 | 25878136_c2_226 | 3834 | 9496 | 1368 | 456 | 1543 | 1.8(10)-158 | *Bacillus subtilis* | ydhP | [pn:hypothetical protein] [gn:yidq] |
| CONTIG500 | 23940636_c2_255 | 3835 | 9497 | 855 | 285 | 100 | 0.00839 | *Haemophilus influenzae* | HI1538 | [pn:lic-1 operon protein] [gn:licb] |
| CONTIG500 | 34415953_c2_277 | 3836 | 9498 | 336 | 112 | 448 | 2.0(10)-42 | *Escherichia coli* | b3688 | [pn:o135] [gn:yidq] |
| CONTIG500 | 10626535_c2_291 | 3837 | 9499 | 948 | 316 | 407 | 4.4(10)-38 | *Escherichia coli* | b0208 | [pn:hypothetical transcriptional regulator in rmh-dnir intergenic region] [gn:yafc] |
| CONTIG500 | 33729167_c2_292 | 3838 | 9500 | 1446 | 482 | 291 | 4.5(10)-28 | *Haloferax* sp. | P21562 | hypothetical 80.2 kd protein in the 5' region of gyra and gyrb (orf4). |
| CONTIG500 | 31273568_c2_293 | 3839 | 9501 | 1059 | 353 | 349 | 5.0(10)-31 | *Haloferax* sp. | P21562 | hypothetical 80.2 kd protein in the 5' region of gyra and gyrb (orf4). |
| CONTIG500 | 13677158_c3_326 | 3840 | 9502 | 291 | 97 | 136 | 2.2(10)-9 | *Escherichia coli* | U70214 | or:*escherichia coli* le:84358 re:84669 di:complement nt:hypothetical |
| CONTIG500 | 1984555_c3_330 | 3841 | 9503 | 1230 | 410 | 1118 | 2.0(10)-113 | *Escherichia coli* | b3673 | [pn:multidrug resistance protein d] [gn:emrd] |
| CONTIG500 | 4859538_c3_336 | 3842 | 9504 | 1389 | 463 | 1854 | 2.0(10)-191 | *Escherichia coli* | b2366 | [pn:d-serine dehydratase] [gn:dsda] |
| CONTIG500 | 34093886_f1_3 | 3843 | 9505 | 1983 | 661 | 3188 | 0 | *Escherichia coli* | b4069 | [pn:acetyl-coa synthease] [gn:acs] |
| CONTIG500 | 10039711_f1_4 | 3844 | 9506 | 1680 | 560 | 2193 | 2.3(10)-227 | *Escherichia coli* | b4067 | [pn:hypothetical 59.2 kd protein in soxr-acs intergenic region] [gn:yjcj] |
| CONTIG501 | 26306592_f1_52 | 3845 | 9507 | 1203 | 401 | 1883 | 1.7(10)-194 | *Escherichia coli* | b4034 | [pn:periplasmic maltose-binding protein] [gn:male] |
| CONTIG501 | 17074051_f1_56 | 3846 | 9508 | 909 | 303 | 1253 | 9.9(10)-128 | *Escherichia coli* | b4032 | [pn:maltose transport inner membrane protein] [gn:malg] |
| CONTIG501 | 21501708_f1_63 | 3847 | 9509 | 282 | 94 | 99 | 0.0006 | *Streptomyces ambofaciens* | Z46913 | or:*streptomyces ambofaciens* pn:polyketide synthase le:<1 re:>3596 di:direct nt:putative |
| CONTIG501 | 14554662_f2_71 | 3848 | 9510 | 348 | 116 | 366 | 9.8(10)-34 | *Escherichia coli* | b4068 | [pn:hypothetical 11.7 kd protein in soxr-acs intergenic region] [gn:yjch] |
| CONTIG501 | 4977000_f2_75 | 3849 | 9511 | 897 | 299 | 540 | 3.6(10)-52 | *Bacillus subtilis* | ywbl | [pn:hypothetical protein] [gn:ipa-24d] |
| CONTIG501 | 3409812_f2_83 | 3850 | 9512 | 240 | 80 | 204 | 1.3(10)-16 | *Escherichia coli* | b4062 | [pn:regulatory protein soxs] [gn:soxs] |
| CONTIG501 | 898566_f2_89 | 3851 | 9513 | 333 | 111 | 356 | 1.1(10)-32 | *Escherichia coli* | b4060 | [pn:hypothetical 13.0 kd protein in ssb-soxs intergenic region] [gn:yjcb] |
| CONTIG501 | 5267327_f2_91 | 3852 | 9514 | 2823 | 941 | 4604 | 0 | *Escherichia coli* | b4058 | [pn:excision nuclease] [gn:uvra] |
| CONTIG501 | 26421891_f2_94 | 3853 | 9515 | 303 | 101 | 175 | 1.7(10)-13 | *Escherichia coli* | Z26592 | or:*escherichia coli* pn:dna binding protein sp:p36558 le:1086 re:1376 di:direct |
| CONTIG501 | 2552281_f2_100 | 3854 | 9516 | 1110 | 370 | 1519 | 6.5(10)-156 | *Escherichia coli* | b4051 | [pn:quinone oxidoreductase] [gn:qor] |
| CONTIG501 | 14569216_f2_109 | 3855 | 9517 | 2502 | 834 | 3793 | 0 | *Escherichia coli* | b4041 | [pn:glycerol-3-phosphate acyltransferase] [gn:plsb] |
| CONTIG501 | 12307842_f2_120 | 3856 | 9518 | 1557 | 519 | 2116 | 3.5(10)-219 | *Escherichia coli* | b4033 | [pn:maltose transport inner membrane protein] [gn:malf] |
| CONTIG501 | 1614918_f3_151 | 3857 | 9519 | 552 | 184 | 150 | 5.9(10)-10 | *Pseudomonas aeruginosa* | U50396 | or:*pseudomonas aeruginosa* pn:wbpn gn:wbpn le:22302 re:23693 di:direct |
| CONTIG501 | 1580438_f3_152 | 3858 | 9520 | 522 | 174 | 248 | 1.2(10)-20 | *Pseudomonas aeruginosa* | U50396 | or:*pseudomonas aeruginosa* pn:wbpn gn:wbpn le:22302 re:23693 di:direct |
| CONTIG501 | 276642_f3_161 | 3859 | 9521 | 552 | 184 | 849 | 6.4(10)-85 | *Escherichia coli* | b4046 | [pn:hypothetical 21.7 kd protein in dinf-qor intergenic region] [gn:yjbk] |
| CONTIG501 | 35242955_c1_184 | 3860 | 9522 | 216 | 72 | 93 | 0.00259 | *Saccharomyces cerevisiae* | YJR151C | [pn:similarity to mucin proteins, yk1224c, sta1p] [gn:j2223] |
| CONTIG501 | 11883290_c1_189 | 3861 | 9523 | 2139 | 713 | 3366 | 0 | *Escherichia coli* | b4029 | [pn:hypothetical 78.5 kd protein in pgi-xyle intergenic region] [gn:yjbh] |
| CONTIG501 | 14113277_c1_190 | 3862 | 9524 | 468 | 156 | 475 | 2.7(10)-45 | *Escherichia coli* | b4030 | [pn:hypothetical 15.6 kd protein in pgi-xyle intergenic region] [gn:yjba] |
| CONTIG501 | 5868877_c1_202 | 3863 | 9525 | 570 | 190 | 756 | 4.5(10)-75 | *Escherichia coli* | b4039 | [pn:chorismate lyase] [gn:ubic] |
| CONTIG501 | 24821088_c1_203 | 3864 | 9526 | 882 | 294 | 1175 | 1.8(10)-119 | *Escherichia coli* | b4040 | [pn:4-hydroxybenzoate-octaprenyl transferase] [gn:rubia] |
| CONTIG501 | 16087_c1_206 | 3865 | 9527 | 381 | 127 | 416 | 4.9(10)-39 | *Escherichia coli* | b4042 | [pn:diacylglycerol kinase] [gn:dgka] |
| CONTIG501 | 22298201_c1_207 | 3866 | 9528 | 633 | 211 | 949 | 1.6(10)-95 | *Escherichia coli* | b4043 | [pn:lexa] [gn:lexa] |
| CONTIG501 | 33753275_c1_208 | 3867 | 9529 | 1380 | 460 | 1701 | 3.2(10)-175 | *Escherichia coli* | b4044 | [pn:dna-damage-inducible protein f] [gn:dinf] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG501 | 442037_c1_212 | 3868 | 9530 | 1005 | 335 | 1606 | 3.8(10)-165 | Escherichia coli | b4049 | [pn:hypothetical 38.4 kd protein in dinf-qor intergenic region] [gn:ybn] |
| CONTIG501 | 4859693_c1_216 | 3869 | 9531 | 1089 | 363 | 1628 | 1.8(10)-167 | Escherichia coli | b4053 | [pn:alanine racemase] [gn:alr] |
| CONTIG501 | 12579812_c1_221 | 3870 | 9532 | 447 | 149 | 631 | 8.0(10)-62 | Escherichia coli | b4056 | [pn:hypothetical 15.7 kd protein in tyrb-uvra intergenic region] |
| CONTIG501 | 11958316_c1_225 | 3871 | 9533 | 225 | 75 | 98 | 2.5(10)-5 | Escherichia coli | J01721 | or:escherichia coli, le:124 re:300 di:complement sr:escherichia coli, pdr1996 plasmid dna nt:single-stranded dna-binding protein (ssb) |
| CONTIG501 | 3908567_c1_231 | 3872 | 9534 | 468 | 156 | 749 | 2.5(10)-74 | Escherichia coli | b4063 | [pn:soxr protein] [gn:soxr] |
| CONTIG501 | 32453126_c1_236 | 3873 | 9535 | 1794 | 598 | 2089 | 2.6(10)-216 | Escherichia coli | b4065 | [pn:hypothetical 60.5 kd protein in soxr-acs intergenic region] [gn:yce] |
| CONTIG501 | 17036340_c1_240 | 3874 | 9536 | 756 | 252 | 257 | 3.5(10)-22 | Bacillus subtilis | ywbG | [pn:hypothetical protein] [gn:ipa-22r] |
| CONTIG501 | 24035252_c1_248 | 3875 | 9537 | 1260 | 420 | 1530 | 4.4(10)-157 | Escherichia coli | b4077 | [pn:glutamate-aspartate carrier] [gn:gltp] |
| CONTIG501 | 3634956_c2_251 | 3876 | 9538 | 840 | 280 | 805 | 3.0(10)-80 | Escherichia coli | b4028 | [pn:hypothetical 26.3 kd protein in pgi-xyle intergenic region] [gn:ybg] |
| CONTIG501 | 2384712_c2_273 | 3877 | 9539 | 369 | 123 | 350 | 4.9(10)-32 | Escherichia coli | b4050 | [pn:hypothetical 17.4 kd protein in dinf-qor intergenic region] [gn:ybo] |
| CONTIG501 | 22477280_c2_278 | 3878 | 9540 | 1209 | 403 | 1795 | 3.7(10)-185 | Escherichia coli | b4054 | [pn:tyrosine aminotransferase] [gn:tyrb] |
| CONTIG501 | 9932188_c2_284 | 3879 | 9541 | 549 | 183 | 531 | 3.2(10)-51 | Escherichia coli | b4059 | [pn:single-strand dna-binding protein] [gn:ssb] |
| CONTIG501 | 2236375_c2_285 | 3880 | 9542 | 1476 | 492 | 220 | 5.0(10)-15 | Escherichia coli | b1285 | [pn:hypothetical protein] [gn:ycir] |
| CONTIG501 | 1581_c2_288 | 3881 | 9543 | 738 | 246 | 305 | 2.8(10)-27 | Saccharomyces cerevisiae | P40582 | hypothetical 26.8 kd protein in hyr1 3' region |
| CONTIG501 | 3528716_c2_289 | 3882 | 9544 | 1419 | 473 | 1796 | 2.8(10)-185 | Escherichia coli | b4064 | [pn:hypothetical 45.7 kd protein in soxr-acs intergenic region] [gn:ycd] |
| CONTIG501 | 13958261_c3_305 | 3883 | 9545 | 1893 | 631 | 2763 | 9.6(10)-288 | Escherichia coli | b4025 | [pn:glucose-6-phosphate isomerase] [gn:pgi] |
| CONTIG501 | 35551431_c3_307 | 3884 | 9546 | 681 | 227 | 961 | 8.6(10)-97 | Escherichia coli | b4027 | [pn:hypothetical 25.0 kd lipoprotein in pgi-xyle intergenic region] [gn:ipa-23r] |
| CONTIG501 | 24824066_c3_316 | 3885 | 9547 | 1125 | 375 | 1774 | 6.0(10)-183 | Escherichia coli | b4035 | [pn:cytoplamsic membrane protein for maltose uptake] [gn:malk] |
| CONTIG501 | 956308_c3_317 | 3886 | 9548 | 1353 | 451 | 1872 | 2.5(10)-193 | Escherichia coli | b4036 | [pn:phage lambda receptor protein] [gn:lamb] |
| CONTIG501 | 32547893_c3_318 | 3887 | 9549 | 996 | 332 | 1128 | 1.8(10)-114 | Escherichia coli | b4037 | [pn:maltose operon periplasmic protein] [gn:malm] |
| CONTIG501 | 14276661_c3_329 | 3888 | 9550 | 225 | 75 | 355 | 1.3(10)-32 | Escherichia coli | b4045 | [pn:hypothetical protein] [gn:yjbj] |
| CONTIG501 | 12315630_c3_336 | 3889 | 9551 | 1452 | 484 | 2320 | 8.5(10)-241 | Escherichia coli | b4052 | [pn:replicative dna helicase] [gn:dnab]/ |
| CONTIG501 | 20516561_c3_341 | 3890 | 9552 | 738 | 246 | 973 | 4.7(10)-98 | Escherichia coli | b4055 | [pn:hypothetical 26.1 kd protein in tyrb-uvra intergenic region] [gn:yjbr] |
| CONTIG501 | 24079387_c3_343 | 3891 | 9553 | 384 | 128 | 515 | 1.6(10)-49 | Escherichia coli | b4057 | [pn:hypothetical 13.4 kd protein in tyrb-uvra intergenic region] |
| CONTIG501 | 31895161_c3_349 | 3892 | 9554 | 588 | 196 | 155 | 6.9(10)-10 | Micrococcus luteus | JQ0406 | hypothetical protein 1246 (uvra region) - micrococcus luteus (fragment) |
| CONTIG501 | 32212775_c3_354 | 3893 | 9555 | 1650 | 550 | 1657 | 1.5(10)-170 | Escherichia coli | b4061 | [pn:hypothetical 60.8 kd protein in ssb-soxs intergenic region] [gn:ycc] |
| CONTIG501 | 6719025_c3_363 | 3894 | 9556 | 477 | 159 | 145 | 2.6(10)-10 | Bacillus subtilis | ywbH | [pn:hypothetical protein] [gn:ipa-23r] |
| CONTIG501 | 4093891_f1_14 | 3895 | 9557 | 1533 | 511 | 1600 | 1.7(10)-164 | Escherichia coli | b0621 | [pn:hypothetical protein] [gn:dcuc] |
| CONTIG502 | 19792580_f1_16 | 3896 | 9558 | 354 | 118 | 372 | 2.2(10)-34 | Escherichia coli | b2387 | [pn:hypothetical protein] |
| CONTIG502 | 11897505_f1_17 | 3897 | 9559 | 1275 | 425 | 1432 | 1.1(10)-146 | Escherichia coli | b2386 | [pn:hypothetical protein] |
| CONTIG502 | 15908192_f1_18 | 3898 | 9560 | 1122 | 374 | 1339 | 7.7(10)-137 | Escherichia coli | b2384 | [pn:hypothetical protein] |
| CONTIG502 | 5941376_f1_32 | 3899 | 9561 | 984 | 328 | 780 | 1.3(10)-77 | Escherichia coli | b0603 | [pn:hypothetical protein] |
| CONTIG502 | 14882962_f1_38 | 3900 | 9562 | 621 | 207 | 306 | 2.2(10)-27 | Bacillus subtilis | ykrY | [pn:hypothetical protein] |
| CONTIG502 | 6040765_f1_44 | 3901 | 9563 | 1311 | 437 | 763 | 8.3(10)-76 | Bacillus subtilis | ykrT | [pn:hypothetical protein] |
| CONTIG502 | 24243791_f1_53 | 3902 | 9564 | 1113 | 371 | 1416 | 5.2(10)-145 | Escherichia coli | b0599 | [pn:hypothetical protein in csta 3″″ region] [gn:ybdh] |
| CONTIG502 | 32286450_f1_54 | 3903 | 9565 | 801 | 267 | 419 | 2.3(10)-39 | Escherichia coli | b4249 | [pn:hypothetical 24.6 kd protein in pyrI-argI intergenic region] [gn:yjgI] |
| CONTIG502 | 4971937_f1_55 | 3904 | 9566 | 372 | 124 | 101 | 1.2(10)-5 | Methanococcus jannaschii | MJ1103 | [pn:conserved hypothetical protein] |
| CONTIG502 | 34178885_f2_75 | 3905 | 9567 | 891 | 297 | 1078 | 3.5(10)-109 | Escherichia coli | b0611 | [pn:ribonuclease i precursor] [gn:rna] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG502 | 12370750_f2_77 | 3906 | 9568 | 447 | 149 | 441 | 1.1(10)-41 | Escherichia coli | b2385 | [pn:hypothetical protein] |
| CONTIG502 | 26250966_f2_80 | 3907 | 9569 | 2457 | 819 | 2860 | 5.0(10)-298 | Escherichia coli | b2383 | [pn:hypothetical protein] |
| CONTIG502 | 6923316_f2_82 | 3908 | 9570 | 426 | 142 | 501 | 4.7(10)-48 | Escherichia coli | b0610 | [pn:regulator of nucleoside diphosphate kinase] [gn:rnk] |
| CONTIG502 | 16490807_f2_92 | 3909 | 9571 | 684 | 228 | 758 | 2.7(10)-75 | Escherichia coli | b0601 | [pn:hypothetical protein] |
| CONTIG502 | 3301088_f2_103 | 3910 | 9572 | 582 | 194 | 121 | 3.7(10)-6 | Hordeum vulgare | S35221 | globulin beg1 precursor - barley |
| CONTIG502 | 1464811_f3_146 | 3911 | 9573 | 831 | 277 | 798 | 1.6(10)-79 | Escherichia coli | b2385 | [pn:hypothetical protein] |
| CONTIG502 | 21932056_f3_149 | 3912 | 9574 | 444 | 148 | 642 | 2.1(10)-63 | Escherichia coli | b0607 | [pn:hypothetical protein] [gn:ybdq] |
| CONTIG502 | 4095150_f3_151 | 3913 | 9575 | 261 | 87 | 124 | 2.1(10)-13 | Burkholderia cepacia | Q02940 | beta-lactamase precursor (ec 3.5.2.6) (penicillinase). |
| CONTIG502 | 15820827_f3_156 | 3914 | 9576 | 1281 | 427 | 1792 | 7.5(10)-185 | Escherichia coli | b0602 | [pn:hypothetical protein] |
| CONTIG502 | 11036262_c1_190 | 3915 | 9577 | 723 | 241 | 943 | 7.0(10)-95 | Klebsiella oxytoca | A49101 | enolase-phosphatase e-1 - klebsiella oxytoca |
| CONTIG502 | 14479186_c1_199 | 3916 | 9578 | 528 | 176 | 591 | 1.3(10)-57 | Escherichia coli | b0597 | [pn:hypothetical 15.0 kd protein in enta-csta intergenic region] [gn:ybdb] |
| CONTIG502 | 24415937_c1_200 | 3917 | 9579 | 1644 | 548 | 803 | 4.7(10)-80 | Bacillus subtilis | rbsA | [pn:ribose abc transporter] |
| CONTIG502 | 22297528_c1_202 | 3918 | 9580 | 1068 | 356 | 114 | 0.00046 | Escherichia coli | b2548 | [pn:hypothetical protein] |
| CONTIG502 | 5320781_c1_211 | 3919 | 9581 | 1083 | 361 | 555 | 9.1(10)-54 | Methanococcus jannaschii | MI0454 | [pn:translation initiation factor eif-2b, subunit alpha] |
| CONTIG502 | 24109377_c1_216 | 3920 | 9582 | 621 | 207 | 970 | 9.6(10)-98 | Escherichia coli | b0605 | [pn:alkyl hydroperoxide reductase c22 protein] [gn:ahpc] |
| CONTIG502 | 29970066_c1_233 | 3921 | 9583 | 732 | 244 | 277 | 2.6(10)-24 | Bacillus subtilis | ywrF | [pn:hypothetical protein] |
| CONTIG502 | 16975677_c1_236 | 3922 | 9584 | 1596 | 532 | 630 | 1.0(10)-61 | Escherichia coli | b0574 | [pn:hypothetical protein] [gn:ylcd] |
| CONTIG502 | 1462624_c2_237 | 3923 | 9585 | 996 | 332 | 832 | 4.0(10)-83 | Escherichia coli | b0622 | [pn:hypothetical protein in cspe 5'''' region] [gn:ybeg] |
| CONTIG502 | 4319068_c2_238 | 3924 | 9586 | 1310 | 436 | 1591 | 1.5(10)-163 | Escherichia coli | b0593 | [pn:isochorismate synthase entc] [gn:entc] |
| CONTIG502 | 15830125_c2_239 | 3925 | 9587 | 1620 | 540 | 2268 | 2.7(10)-235 | Escherichia coli | b0594 | [pn:2,3-dihydroxybenzoate-amp ligase] [gn:ente] |
| CONTIG502 | 6135002_c2_263 | 3926 | 9588 | 822 | 274 | 978 | 1.3(10)-98 | Escherichia coli | b0596 | [pn:2,3-dihydro-2,3-dihydroxybenzoate dehydrogenase] [gn:entb] |
| CONTIG502 | 26343841_c2_274 | 3927 | 9589 | 1098 | 366 | 999 | 8.1(10)-101 | Escherichia coli | b2382 | [pn:hypothetical protein] |
| CONTIG502 | 21768943_c2_278 | 3928 | 9590 | 1305 | 435 | 125 | 5.5(10)-5 | Alcaligenes sp. | JC4698 | divalent cation resistant determinant protein c - alcaligene sp. this protein is a cation/proton antiporter protein, which determines the resistancy for cadmium, zinc, cobalt. |
| CONTIG502 | 29786537_c3_285 | 3929 | 9591 | 2124 | 708 | 2082 | 1.3(10)-215 | Escherichia coli | b0595 | [pn:hypothetical protein in phep 5'''' region] [gn:ybde] |
| CONTIG502 | 5972011_c3_288 | 3930 | 9592 | 1035 | 345 | 1312 | 5.5(10)-134 | Escherichia coli | b2548 | [pn:isochorismatase] [gn:entb] |
| CONTIG502 | 14629386_c3_289 | 3931 | 9593 | 2139 | 713 | 2899 | 3.7(10)-302 | Escherichia coli | b0598 | [pn:hypothetical protein in phep 5'''' region] [gn:csta] |
| CONTIG502 | 13786067_c3_295 | 3932 | 9594 | 312 | 104 | 270 | 1.5(10)-23 | Bacillus subtilis | b4353 | [pn:hypothetical 7.7 kd protein in mnr-tsr intergenic region] [gn:yjix] |
| CONTIG502 | 32610082_c3_305 | 3933 | 9595 | 1035 | 345 | 317 | 1.5(10)-28 | Escherichia coli | rbsC | [pn:ribose abc transporter] |
| CONTIG502 | 22661668_c3_310 | 3934 | 9596 | 1242 | 414 | 1693 | 2.3(10)-174 | Escherichia coli | b0600 | [pn:hypothetical protein] |
| CONTIG502 | 22363758_c3_312 | 3935 | 9597 | 1605 | 535 | 2447 | 3.0(10)-254 | Escherichia coli | b0606 | [pn:alkyl hydroperoxide reductase f52a protein] [gn:ahpf] |
| CONTIG502 | 33722793_c3_313 | 3936 | 9598 | 1266 | 422 | 1759 | 2.3(10)-181 | Escherichia coli | b0608 | [pn:hypothetical protein] |
| CONTIG502 | 203525_c3_328 | 3937 | 9599 | 234 | 78 | 128 | 1.6(10)-8 | Escherichia coli | b0609 | [pn:hypothetical protein] |
| CONTIG502 | 35673516_c3_332 | 3938 | 9600 | 336 | 112 | 96 | 4.0(10)-5 | Escherichia coli | b0573 | [pn:hypothetical protein in phep 5'''' region] [gn:ybde] |
| CONTIG502 | 3069387_f1_6 | 3939 | 9601 | 1188 | 396 | 1204 | 1.5(10)-122 | Escherichia coli | b0575 | [pn:hypothetical protein in sfsa-nrcb intergenic region] [gn:yadp] |
| CONTIG503 | 33994165_f1_7 | 3940 | 9602 | 1002 | 334 | 732 | 1.6(10)-72 | Escherichia coli | b0147 | [pn:dosage-dependent dnak suppressor protein] [gn:dksa] |
| CONTIG503 | 21403_f1_14 | 3941 | 9603 | 477 | 159 | 689 | 5.7(10)-68 | Escherichia coli | b0145 | [pn:pantoate] [gn:panc] |
| CONTIG503 | 87812_f1_15 | 3942 | 9604 | 903 | 301 | 1134 | 4.0(10)-115 | Escherichia coli | b0133 | [pn:hypothetical protein] |
| CONTIG503 | 12944680_f1_16 | 3943 | 9605 | 615 | 205 | 140 | 8.6(10)-10 | Escherichia coli | b0141 | [pn:hypothetical fimbrial-like protein in ecpd-folk intergenic region] [gn:yadn] |
| CONTIG503 | 32035766_f1_18 | 3944 | 9606 | 627 | 209 | 183 | 2.3(10)-14 | Escherichia coli | b0138 | [pn:hypothetical 20.3 kd protein in panb-htre intergenic region] [gn:yadm] |
| CONTIG503 | 22380131_f1_45 | 3945 | 9607 | 1122 | 374 | 197 | 7.5(10)-16 | Escherichia coli | b0135 | [pn:hypothetical fimbrial-like protein in panb-htre intergenic region] [gn:yadc] |
| CONTIG503 | 35282686_f1_50 | 3946 | 9608 | 1803 | 601 | 1054 | 1.2(10)-106 | Escherichia coli | b3657 | [pn:hypothetical 51.0 kd protein in gltx-sclc intergenic region] [gn:yicj] |
| CONTIG503 | | 3947 | 9609 | 987 | 329 | 1201 | 3.2(10)-122 | Escherichia coli | b0109 | [pn:nicotinate-nucleotide pyrophosphorylase] [gn:nadc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG503 | 24692676_f1_53 | 3948 | 9610 | 1224 | 408 | 1007 | 1.2(10)-101 | Escherichia coli | b0106 | [pn:protein transport protein hofc] [gn:hofc] |
| CONTIG503 | 10835150_f1_55 | 3949 | 9611 | 639 | 213 | 684 | 2.0(10)-67 | Escherichia coli | b0103 | [pn:hypothetical 22.5 kd protein in mutt-guac intergenic region] [gn:yace] |
| CONTIG503 | 1302361_f2_62 | 3950 | 9612 | 585 | 195 | 114 | 7.2(10)-5 | Homo sapiens | Q15428 | [GN:SAP62] [SR:HUMAN] [DE:SPLICEOSOME ASSOCIATED PROTEIN 62 (SAP62) (SF3A66)] [SP:Q15428] |
| CONTIG503 | 5097193_f2_67 | 3951 | 9613 | 714 | 238 | 956 | 3.0(10)-96 | Escherichia coli | b0146 | [pn:sugar fermentation stimulation protein] [gn:sfsa] |
| CONTIG503 | 4582717_f2_71 | 3952 | 9614 | 489 | 163 | 620 | 1.2(10)-60 | Escherichia coli | b0142 | [pn:2-amino-4-hydroxy-6-hydroxymethyldihydropteridine pyrophosphokinase] |
| CONTIG503 | 34166637_f2_72 | 3953 | 9615 | 831 | 277 | 1237 | 4.9(10)-126 | Escherichia coli | b0134 | [pn:3-methyl-2-oxobutanoate hydroxymethyltransferase] [gn:panb] |
| CONTIG503 | 6444212_f2_74 | 3954 | 9616 | 393 | 131 | 506 | 1.3(10)-48 | Escherichia coli | b0131 | [pn:aspartate 1-decarboxylase] [gn:pand] |
| CONTIG503 | 23713380_f2_76 | 3955 | 9617 | 840 | 280 | 568 | 3.7(10)-55 | Escherichia coli | b0140 | [pn:chaperone protein eepd precursor] [gn:eepd] |
| CONTIG503 | 806542_f2_77 | 3956 | 9618 | 2598 | 866 | 1852 | 3.2(10)-191 | Escherichia coli | b0139 | [pn:outer membrane usher protein hltre precursor] [gn:hltre] |
| CONTIG503 | 21754165_f2_79 | 3957 | 9619 | 651 | 217 | 159 | 8.4(10)-12 | Escherichia coli | b0136 | [pn:hypothetical 21.1 kd protein in panb-hltre intergenic region] [gn:yadk] |
| CONTIG503 | 14462840_f2_91 | 3958 | 9620 | 897 | 299 | 1402 | 1.6(10)-143 | Escherichia coli | b0120 | [pn:spermidine synthase] [gn:spcc] |
| CONTIG503 | 3320325_f2_92 | 3959 | 9621 | 795 | 265 | 1327 | 1.3(10)-135 | Escherichia coli | b0120 | [pn:s-adenosylmethionine decarboxylase proenzyme] [gn:sped] |
| CONTIG503 | 14241436_f2_112 | 3960 | 9622 | 1392 | 464 | 1968 | 1.7(10)-203 | Escherichia coli | b0112 | [pn:aromatic amino acid transport protein arop] [gn:arop] |
| CONTIG503 | 33625332_f2_113 | 3961 | 9623 | 999 | 333 | 90 | 0.37 | Selenomonas ruminantium | AF040720 | [de:selenomonas ruminantium xylosidase/arabinosidase (xsa) gene, complete cds] [gn:xylosidase/arabinosidase] [gn:xsa] |
| CONTIG503 | 24645887_f2_121 | 3962 | 9624 | 213 | 71 | 95 | 0.00259 | Turnip yellow mosaic virus | AF035403 | [deturnip yellow mosaic blue lake isolate, complete genome.] [gn:replicase protein] |
| CONTIG503 | 2230418_f2_138 | 3963 | 9625 | 924 | 308 | 1271 | 1.2(10)-129 | Escherichia coli | b0144 | [pn:hypothetical 29.3 kd protein in pcnb-dksa intergenic region] [gn:yadb] |
| CONTIG503 | 129175_f3_139 | 3964 | 9626 | 1440 | 480 | 1951 | 1.1(10)-201 | Escherichia coli | b0143 | [pn:poly] [gn:pcnb] |
| CONTIG503 | 32048127_f3_147 | 3965 | 9627 | 606 | 202 | 268 | 2.3(10)-23 | Escherichia coli | b0137 | [pn:hypothetical 21.0 kd protein in panb-hltre intergenic region] [gn:mutt] |
| CONTIG503 | 13695127_f3_151 | 3966 | 9628 | 768 | 256 | 1029 | 5.4(10)-104 | Escherichia coli | b0126 | [pn:hypothetical protein in hpt-pand intergenic region] [gn:yadf] |
| CONTIG503 | 23475311_f3_153 | 3967 | 9629 | 2424 | 808 | 3386 | 0 | Escherichia coli | b0124 | [pn:glucose dehydrogenase] [gn:gcd] |
| CONTIG503 | 32248952_f3_158 | 3968 | 9630 | 636 | 212 | 625 | 3.5(10)-61 | Escherichia coli | b0122 | [pn:hypothetical protein in spee-gcd intergenic region] [gn:yacc] |
| CONTIG503 | 22916285_f3_162 | 3969 | 9631 | 1554 | 518 | 807 | 1.8(10)-80 | Escherichia coli | b0117 | [pn:hypothetical protein in lpda-sped intergenic region] [gn:yach] |
| CONTIG503 | 4507318_f3_179 | 3970 | 9632 | 447 | 149 | 499 | 7.9(10)-48 | Escherichia coli | b0108 | [pn:prepilin peptidase dependent protein d precursor] [gn:ppdd] |
| CONTIG503 | 15089211_f3_180 | 3971 | 9633 | 1392 | 464 | 1500 | 6.7(10)-154 | Escherichia coli | b0107 | [pn:protein transport protein hofb] [gn:hofb] |
| CONTIG503 | 33708341_f3_185 | 3972 | 9634 | 837 | 279 | 1007 | 1.2(10)-101 | Escherichia coli | b0102 | [pn:hypothetical protein in mutt-guac intergenic region] [gn:yacf] |
| CONTIG503 | 5181693_f3_186 | 3973 | 9635 | 204 | 68 | 312 | 5.2(10)-28 | Escherichia coli | b0101 | [pn:yacg] |
| CONTIG503 | 10052077_c1_190 | 3974 | 9636 | 2739 | 913 | 4104 | 0 | Escherichia coli | b0098 | [pn:preprotein translocase seca subunit] [gn:seca] |
| CONTIG503 | 24017063_c1_191 | 3975 | 9637 | 450 | 150 | 538 | 5.7(10)-52 | Escherichia coli | b0099 | [pn:mutator mutt protein] [gn:mutt] |
| CONTIG503 | 34661891_c1_195 | 3976 | 9638 | 1098 | 366 | 1681 | 4.4(10)-173 | Escherichia coli | b0104 | [pn:gmp reductase] [gn:guac] |
| CONTIG503 | 1004802_c1_201 | 3977 | 9639 | 579 | 193 | 839 | 7.4(10)-84 | Escherichia coli | b0110 | [pn:ampd protein] [gn:ampd] |
| CONTIG503 | 12367317_c1_221 | 3978 | 9640 | 2643 | 881 | 4131 | 0 | Escherichia coli | b0118 | [pn:aconitate hydratase 2] [gn:acnb] |
| CONTIG503 | 7032637_c1_228 | 3979 | 9641 | 555 | 185 | 872 | 2.3(10)-87 | Escherichia coli | b0125 | [pn:hypoxanthine phosphoribosyltransferase] [gn:hpt] |
| CONTIG503 | 4304573_c1_229 | 3980 | 9642 | 936 | 312 | 1453 | 6.4(10)-149 | Escherichia coli | b0127 | [pn:hypothetical abc transporter in hpt-pand intergenic region] [gn:yadi] |
| CONTIG503 | 2594632_c1_230 | 3981 | 9643 | 468 | 156 | 560 | 2.7(10)-54 | Escherichia coli | b0129 | [pn:hypothetical protein in hpt-pand intergenic region] [gn:yadi] |
| CONTIG503 | 837557_c1_231 | 3982 | 9644 | 1311 | 437 | 1647 | 1.8(10)-169 | Escherichia coli | b0130 | [pn:hypothetical 46.3 kd protein in hpt-pand intergenic region precursor] [gn:yade] |
| CONTIG503 | 34661686_c1_248 | 3983 | 9645 | 519 | 173 | 131 | 7.7(10)-9 | Haemophilus influenzae | L20805 | or:haemophilus influenzae le:<1 re:172 di:direct nt:truncated sequence, 32.6% identity and 67% |
| CONTIG503 | 35244781_c2_277 | 3984 | 9646 | 1929 | 643 | 2436 | 4.2(10)-253 | Escherichia coli | b0115 | [pn:e2 of pyruvate dehydrogenase] [gn:acef] |
| CONTIG503 | 1697021S_c2_286 | 3985 | 9647 | 483 | 161 | 594 | 6.7(10)-58 | Escherichia coli | b0119 | [pn:hypothetical protein in lpda-sped intergenic region] [gn:yacl] |
| CONTIG503 | 81953_c2_315 | 3986 | 9648 | 2430 | 810 | 3244 | 0 | Escherichia coli | b0148 | [pn:atp-dependent helicase hrpb] [gn:hrpb] |
| CONTIG503 | 34644452_c2_316 | 3987 | 9649 | 1956 | 652 | 2530 | 9.8(10)-275 | Escherichia coli | b0149 | [pn:peptidoglycan synthetase] [gn:mrcb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG503 | 22742711_c3_322 | 3988 | 9650 | 522 | 174 | 116 | 2.0(10)-6 | Pseudomonas aeruginosa | P24564 | hypothetical 19.5 kd protein in pilt region (orf6). [pn:ampe protein] [gn:ampe] |
| CONTIG503 | 4486068_c3_325 | 3989 | 9651 | 864 | 288 | 1164 | 2.7(10)-118 | Escherichia coli | b0111 | [pn:pyruvate dehydrogenase complex repressor] [gn:pdhr] |
| CONTIG503 | 24355151_c3_332 | 3990 | 9652 | 795 | 265 | 1105 | 4.7(10)-112 | Escherichia coli | b0113 | [pn:pyruvate dehydrogenase e1 component] [gn:acee] |
| CONTIG503 | 13870927_c3_333 | 3991 | 9653 | 2679 | 893 | 4352 | 0 | Escherichia coli | b0114 | [pn:dihydrolipoamide dehydrogenase] [gn:pda] |
| CONTIG503 | 5112963_c3_334 | 3992 | 9654 | 1434 | 478 | 2284 | 5.5(10)-237 | Escherichia coli | b0116 | [pn:dihydrolipoamide dehydrogenase] [gn:lpda] |
| CONTIG503 | 16145137_c3_343 | 3993 | 9655 | 447 | 149 | 199 | 4.9(10)-16 | Xanthomonas campestris | P22264 | hypothetical protein in clp 5' region (orf1) (fragment). |
| CONTIG503 | 22393826_c3_345 | 3994 | 9656 | 1764 | 588 | 1537 | 3.2(10)-210 | Escherichia coli | b0123 | [pn:hypothetical protein in spee-gcd intergenic region precursor] [gn:yack] |
| CONTIG503 | 12692811_c3_351 | 3995 | 9657 | 834 | 278 | 1000 | 6.4(10)-101 | Escherichia coli | b0128 | [pn:hypothetical 28.5 kd protein in hpt-pand intergenic region] |
| CONTIG503 | 24645388_f1_1 | 3996 | 9658 | 237 | 79 | 377 | 6.7(10)-35 | Escherichia coli | b2741 | [pn:rna polymerase sigma subunit rpos] [gn:rpos] |
| CONTIG503 | 5086577_f1_5 | 3997 | 9659 | 603 | 201 | 543 | 1.7(10)-52 | Bacillus subtilis | yclB | [pn:hypothetical protein] |
| CONTIG503 | 24652343_f1_12 | 3998 | 9660 | 357 | 119 | 524 | 1.8(10)-50 | Escherichia coli | b2732 | [pn:hypothetical 13.9 kd protein in fhla-muts intergenic region] [gn:ygba] |
| CONTIG504 | 32041625_f1_31 | 3999 | 9661 | 624 | 208 | 474 | 3.5(10)-45 | Escherichia coli | b2725 | [pn:formate hydrogenlyase regulatory protein] [gn:hyca] |
| CONTIG504 | 26074191_f1_32 | 4000 | 9662 | 1827 | 609 | 1828 | 1.2(10)-188 | Escherichia coli | b2723 | [pn:formate hydrogenlyase subunit 3] [gn:hyce] |
| CONTIG504 | 1032706_f1_38 | 4001 | 9663 | 807 | 269 | 1176 | 1.3(10)-119 | Escherichia coli | b2719 | [pn:formate hydrogenlyase subunit 7] [gn:hycg] |
| CONTIG504 | 6407943_f1_39 | 4002 | 9664 | 465 | 155 | 687 | 9.4(10)-68 | Escherichia coli | b2717 | [pn:hydrogenase 3 maturation protease] [gn:hyci] |
| CONTIG504 | 26618750_f1_65 | 4003 | 9665 | 1111 | 371 | 1295 | 3.5(10)-132 | Escherichia coli | b2701 | [pn:membrane-bound lytic transglycosylase b precursor] [gn:mltb] |
| CONTIG504 | 10166031_f1_71 | 4004 | 9666 | 1521 | 507 | 1636 | 2.6(10)-168 | Bacillus subtilis | yclC | [pn:hypothetical protein] |
| CONTIG504 | 22393826_f2_76 | 4005 | 9667 | 495 | 165 | 288 | 1.8(10)-25 | Escherichia coli | b2848 | [pn:hypothetical protein] |
| CONTIG504 | 26272556_f2_96 | 4006 | 9668 | 630 | 210 | 749 | 2.5(10)-74 | Escherichia coli | b2724 | [pn:formate hydrogenlyase subunit 2] [gn:hycb] |
| CONTIG504 | 21491325_f2_97 | 4007 | 9669 | 948 | 316 | 1094 | 7.0(10)-111 | Escherichia coli | b2722 | [pn:formate hydrogenlyase subunit 4] [gn:hycd] |
| CONTIG504 | 6917175_f2_98 | 4008 | 9670 | 1725 | 575 | 2877 | 8.0(10)-300 | Escherichia coli | b2721 | [pn:formate hydrogenlyase subunit 5] [gn:hyce] |
| CONTIG504 | 4425968_f2_99 | 4009 | 9671 | 552 | 184 | 905 | 7.5(10)-91 | Escherichia coli | b2720 | [pn:formate hydrogenlyase subunit 6] [gn:hycf] |
| CONTIG504 | 12525131_f2_108 | 4010 | 9672 | 2373 | 791 | 2325 | 2.5(10)-241 | Escherichia coli | b2712 | [pn:formate hydrogenlyase maturation protein hypf] [gn:hypf] |
| CONTIG504 | 16304657_f2_113 | 4011 | 9673 | 1071 | 357 | 205 | 1.3(10)-16 | Escherichia coli | U03846 | or:escherichia coli le:<1 re:183 di:direct nt:putative orf>60aa |
| CONTIG504 | 33709461_f3_124 | 4012 | 9674 | 906 | 302 | 320 | 7.2(10)-29 | Haemophilus influenzae | HI1364 | [pn:hypothetical protein] |
| CONTIG504 | 2993026_f3_126 | 4013 | 9675 | 258 | 86 | 189 | 5.5(10)-15 | Bacillus subtilis | yclD | [pn:hypothetical protein] |
| CONTIG504 | 14855436_f3_130 | 4014 | 9676 | 900 | 300 | 563 | 1.3(10)-54 | Escherichia coli | b2847 | [pn:hypothetical protein] |
| CONTIG504 | 11885418_f3_160 | 4015 | 9677 | 423 | 141 | 592 | 1.1(10)-57 | Escherichia coli | b2718 | [pn:formate hydrogenlyase maturation protein hypb] [gn:hypb] |
| CONTIG504 | 32444642_f3_166 | 4016 | 9678 | 1053 | 351 | 1336 | 1.6(10)-136 | Escherichia coli | b2714 | [pn:asc operon repressor protein] [gn:ascg] |
| CONTIG504 | 32501052_f3_167 | 4017 | 9679 | 582 | 194 | 850 | 5.0(10)-85 | Escherichia coli | b2713 | [pn:4fe-4s iron-sulfur protein] [gn:hydn] |
| CONTIG504 | 32660958_f3_170 | 4018 | 9680 | 1239 | 413 | 570 | 2.3(10)-55 | Ralstonia eutropha | P23516 | high-affinity nickel transport protein. |
| CONTIG504 | 4863165_f3_175 | 4019 | 9681 | 1599 | 533 | 2152 | 5.4(10)-223 | Escherichia coli | b2709 | [pn:hypothetical sigma-54-dependent transcriptional regulator in gutq-hypf intergenic region] [gn:ygaa] |
| CONTIG504 | 1050718_c1_191 | 4020 | 9682 | 849 | 283 | 1166 | 1.6(10)-118 | Escherichia coli | b2705 | [pn:sorbitol-6-phosphate 2-dehydrogenase] [gn:srld] |
| CONTIG504 | 4349193_c1_221 | 4021 | 9683 | 360 | 120 | 407 | 4.4(10)-38 | Escherichia coli | b2726 | [pn:hypa protein] [gn:hypa] |
| CONTIG504 | 33447142_c1_222 | 4022 | 9684 | 867 | 289 | 1153 | 3.8(10)-117 | Escherichia coli | b2727 | [pn:hydrogenase isoenzymes formation protein hypb] [gn:hypb] |
| CONTIG504 | 16252_1_226 | 4023 | 9685 | 2109 | 703 | 2883 | 1.8(10)-300 | Escherichia coli | b2731 | [pn:transcriptional activator of the formate hydrogenlyase system] [gn:fhla] |
| CONTIG504 | 13672291_c1_235 | 4024 | 9686 | 330 | 110 | 92 | 0.00011 | Escherichia coli | b4347 | [pn:hypothetical 14.6 kd protein in mcrb-hsds intergenic region] [gn:yjiw] |
| CONTIG504 | 11992307_c2_247 | 4025 | 9687 | 990 | 330 | 1231 | 2.1(10)-125 | Escherichia coli | b2703 | [gn:srla_2] |
| CONTIG504 | 15728588_c2_248 | 4026 | 9688 | 375 | 125 | 475 | 2.7(10)-45 | Escherichia coli | b2704 | [pn:pts system, glucitol/sorbitol-specific iia component] [gn:srlb] |
| CONTIG504 | 2591481_c2_249 | 4027 | 9689 | 372 | 124 | 385 | 9.5(10)-36 | Escherichia coli | b2706 | [pn:gutm] [gn:gutm] |
| CONTIG504 | 25627000_c2_250 | 4028 | 9690 | 837 | 279 | 1202 | 2.5(10)-122 | Escherichia coli | b2707 | [pn:srlr] [gn:srlr] |
| CONTIG504 | 35739757_c2_258 | 4029 | 9691 | 1152 | 384 | 1525 | 1.5(10)-156 | Escherichia coli | b2711 | [pn:hypothetical protein in hyda 3''" region] [gn:ygbd] |
| CONTIG504 | 31894511_c2_262 | 4030 | 9692 | 342 | 114 | 103 | 6.5(10)-5 | Plasmid pSB24.2 | M32513 | or:plasmid psb24.2 pn:neomycin resistance protein le:1443 re:2756 di:direct srplasmid psb24.2 dna |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG504 | 14259667_c2_293 | 4031 | 9693 | 1014 | 338 | 1359 | 5.7(10)-139 | Escherichia coli | b2730 | [pn:hydrogenase isoenzymes formation protein hypc] [gn:hypc] |
| CONTIG504 | 4572178_c2_298 | 4032 | 9694 | 765 | 255 | 409 | 2.7(10)-38 | Escherichia coli | b4287 | [pn:ironiii dicitrate transport atp-binding protein fece] [gn:fece] |
| CONTIG504 | 5195253_c2_299 | 4033 | 9695 | 1230 | 410 | 263 | 1.3(10)-22 | Escherichia coli | b1065 | [pn:hypothetical protein] |
| CONTIG504 | 22548313_c2_302 | 4034 | 9696 | 2583 | 861 | 3763 | 0 | Escherichia coli | b2733 | [pn:dna mismatch repair protein] [gn:muts] |
| CONTIG504 | 7156875_c2_303 | 4035 | 9697 | 264 | 88 | 99 | 0.00013 | Salmonella typhi | Q56132 | [pn:rna polymerase sigma factor rpos (sigma-38)] |
| CONTIG504 | 24335932_c3_316 | 4036 | 9698 | 594 | 198 | 697 | 8.1(10)-69 | Escherichia coli | b2702 | [pn:pts system, glucitol/sorbitol-specific iibc component] [gn:srla_1] |
| CONTIG504 | 24495456_c3_320 | 4037 | 9699 | 978 | 326 | 1287 | 2.5(10)-131 | Escherichia coli | b2708 | [pn:gutq] [gn:gutq] |
| CONTIG504 | 15682878_c3_324 | 4038 | 9700 | 1461 | 487 | 2252 | 1.3(10)-233 | Escherichia coli | b2710 | [pn:hypothetical protein] |
| CONTIG504 | 117301062_c3_333 | 4039 | 9701 | 1497 | 499 | 1768 | 2.7(10)-182 | Escherichia coli | b2715 | [pn:phosphotransferase enzyme iiabc-asc] |
| CONTIG504 | 26054757_c3_334 | 4040 | 9702 | 1443 | 481 | 2295 | 3.7(10)-238 | Escherichia coli | b2716 | [pn:6-phospho-beta-glucosidase] [gn:ascb] |
| CONTIG504 | 22753805_c3_344 | 4041 | 9703 | 243 | 81 | 95 | 0.00033 | Homo sapiens | U31468 | [de:home sapiens homeobox protein (gbx2) gene, complete cds.] [pn:homeobox protein] [gn:gbx2] |
| CONTIG504 | 35282013_c3_346 | 4042 | 9704 | 342 | 114 | 409 | 2.7(10)-38 | Escherichia coli | b2728 | [pn:hydrogenase isoenzymes formation protein hypc] [gn:hypc] |
| CONTIG504 | 19790911_c3_347 | 4043 | 9705 | 1125 | 375 | 1709 | 4.7(10)-176 | Escherichia coli | b2729 | [pn:hydrogenase isoenzymes formation protein hypd] [gn:hypd] |
| CONTIG504 | 24664891_c3_352 | 4044 | 9706 | 1005 | 335 | 106 | 2.3(10)-8 | Bacillus subtilis | yvrC | [pn:ferrichrome abc transporter] |
| CONTIG504 | 29869067_c3_353 | 4045 | 9707 | 747 | 249 | 268 | 2.3(10)-23 | Bacillus subtilis | fhuB | [pn:hypothetical protein] |
| CONTIG504 | 167342_c3_369 | 4046 | 9708 | 435 | 145 | 128 | 1.6(10)-8 | Escherichia coli | yybA | [pn:hypothetical protein] |
| CONTIG504 | 14181462_c3_372 | 4047 | 9709 | 1416 | 472 | 220 | 1.7(10)-15 | Escherichia coli | b2367 | [pn:multidrug resistance protein y] [gn:emry] |
| CONTIG504 | 3208137_f1_23 | 4048 | 9710 | 1215 | 405 | 1418 | 3.2(10)-145 | Escherichia coli | b3124 | [pn:hypothetical 42.1 kd protein in mpb-soha intergenic region] [gn:yhad] |
| CONTIG505 | 4082005_f1_33 | 4049 | 9711 | 1437 | 479 | 1983 | 4.4(10)-205 | Escherichia coli | b3110 | [pn:hypothetical 46.6 kd protein in exur-tdcc intergenic region] [gn:yhao] |
| CONTIG505 | 34007882_f1_48 | 4050 | 9712 | 1515 | 505 | 2290 | 1.3(10)-237 | Escherichia coli | b3091 | [pn:altronate hydrolase] [gn:uxaa] |
| CONTIG505 | 282138_f1_57 | 4051 | 9713 | 1395 | 465 | 1887 | 6.5(10)-195 | Escherichia coli | b3084 | [pn:hypothetical 43.4 kd protein in ebgc-exut intergenic region] [gn:ygjo] |
| CONTIG505 | 13144378_f1_66 | 4052 | 9714 | 938 | 313 | 602 | 9.5(10)-59 | Escherichia coli | b1514 | [pn:hypothetical protein] |
| CONTIG505 | 23712803_f2_76 | 4053 | 9715 | 774 | 258 | 1052 | 2.0(10)-106 | Escherichia coli | b3126 | [pn:hypothetical 27.4 kd protein in mpb-soha intergenic region] [gn:yhaf] |
| CONTIG505 | 34381931_f2_77 | 4054 | 9716 | 912 | 304 | 1312 | 5.5(10)-134 | Escherichia coli | b3125 | [pn:hypothetical 31.0 kd protein in mpb-soha intergenic region] [gn:yhae] |
| CONTIG505 | 4104583_f2_80 | 4055 | 9717 | 933 | 311 | 1248 | 3.3(10)-127 | Escherichia coli | b3118 | [pn:bc operon transcriptional activator] [gn:agar] |
| CONTIG505 | 24630001_f2_81 | 4056 | 9718 | 1029 | 343 | 1249 | 2.6(10)-127 | Escherichia coli | b3117 | [pn:catabolic threonine dehydratase] [gn:tdcb] |
| CONTIG505 | 24416526_f2_99 | 4057 | 9719 | 1509 | 503 | 2319 | 1.1(10)-240 | Escherichia coli | b3092 | [pn:uronate isomerase] [gn:uxac] |
| CONTIG505 | 35728280_f2_119 | 4058 | 9720 | 1575 | 525 | 1521 | 4.0(10)-156 | Escherichia coli | b1513 | [pn:hypothetical protein] |
| CONTIG505 | 4157378_f2_135 | 4059 | 9721 | 813 | 271 | 1216 | 8.3(10)-124 | Escherichia coli | b3131 | [pn:putative aga operon transcriptional repressor] [gn:agar] |
| CONTIG505 | 24103376_f3_140 | 4060 | 9722 | 1335 | 445 | 1803 | 5.2(10)-186 | Escherichia coli | b3116 | [pn:threonine-serine permease] [gn:tdcc] |
| CONTIG505 | 21617157_f3_141 | 4061 | 9723 | 1239 | 413 | 1388 | 4.9(10)-142 | Escherichia coli | b3115 | [pn:hypothetical protein in exur-tdcc intergenic region] [gn:yhaa] |
| CONTIG505 | 2151667_f3_142 | 4062 | 9724 | 2307 | 769 | 3452 | 0 | Escherichia coli | b3114 | [pn:probable formate acetyltransferase 3] [gn:yhas] |
| CONTIG505 | 16048967_f3_144 | 4063 | 9725 | 1398 | 466 | 720 | 3.0(10)-71 | Escherichia coli | b3108 | [pn:hypothetical 19.4 kd protein in exur-tdcc intergenic region] [gn:yham] |
| CONTIG505 | 32313842_f3_147 | 4064 | 9726 | 972 | 324 | 1419 | 2.6(10)-145 | Escherichia coli | b3105 | [pn:hypothetical transcriptional regulator in exur-tdcc intergenic region] [gn:yhaj] |
| CONTIG505 | 24117711_c1_190 | 4065 | 9727 | 1611 | 537 | 2058 | 4.9(10)-213 | Escherichia coli | b1511 | [pn:hypothetical protein] [gn:ydev] |
| CONTIG505 | 5109457_c1_194 | 4066 | 9728 | 1005 | 335 | 1405 | 7.7(10)-144 | Escherichia coli | b3087 | [pn:ygjr] |
| CONTIG505 | 14337766_c1_195 | 4067 | 9729 | 1245 | 415 | 1456 | 3.1(10)-149 | Escherichia coli | b3089 | [pn:hypothetical 43.5 kd protein in ebgc-exut intergenic region] [gn:ygju] |
| CONTIG505 | 6375378_c1_200 | 4068 | 9730 | 1347 | 449 | 1783 | 6.7(10)-184 | Escherichia coli | b3093 | [pn:hexuronate transporter] [gn:exut] |
| CONTIG505 | 14261275_c1_204 | 4069 | 9731 | 414 | 138 | 430 | 1.6(10)-40 | Escherichia coli | b3097 | [pn:hypothetical 14.5 kd protein in exur-tdcc intergenic region] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG505 | 26056653_c1_206 | 4070 | 9732 | 300 | 100 | 428 | 2.6(10)-40 | Escherichia coli | b3100 | [pn:hypothetical protein] |
| CONTIG505 | 23886067_c1_211 | 4071 | 9733 | 717 | 239 | 1030 | 4.2(10)-104 | Escherichia coli | b3106 | [pn:hypothetical 25.9 kd protein in exur-tdcc intergenic region] [gn:yhak] |
| CONTIG505 | 25915932_c1_227 | 4072 | 9734 | 1575 | 525 | 2421 | 1.7(10)-251 | Escherichia coli | b3128 | [pn:hypothetical 56.4 kd protein in mpb-soha intergenic region] [gn:yhag] |
| CONTIG505 | 12616452_c1_229 | 4073 | 9735 | 1326 | 442 | 1876 | 9.5(10)-194 | Escherichia coli | b3132 | [pn:putative tagatose 6-phosphate kinase agaz] [gn:agaz] |
| CONTIG505 | 29925955_c1_230 | 4074 | 9736 | 942 | 314 | 1003 | 3.1(10)-101 | Vibrio furnissii | U65015 | or:vibrio furnissii pn:pts permease for mannose subunit iibman gn:manz le:1604 re:2485 di:direct nt:manz [pn:hypothetical protein] |
| CONTIG505 | 10937880_c2_243 | 4075 | 9737 | 1050 | 350 | 996 | 1.7(10)-100 | Escherichia coli | b1512 | [pn:hypothetical protein] |
| CONTIG505 | 12753401_c2_245 | 4076 | 9738 | 2064 | 688 | 2834 | 2.8(10)-295 | Escherichia coli | b3081 | [pn:probable nadh-dependent flavin oxidoreductase] [gn:ygjl] |
| CONTIG505 | 2238537_c2_259 | 4077 | 9739 | 519 | 173 | 403 | 1.2(10)-37 | Escherichia coli | b3096 | [pn:hypothetical 14.2 kd protein in exur-tdcc intergenic region] |
| CONTIG505 | 35759530_c2_260 | 4078 | 9740 | 471 | 157 | 282 | 7.7(10)-25 | Escherichia coli | b3099 | [pn:hypothetical 15.1 kd protein in exur-tdcc intergenic region] |
| CONTIG505 | 2424140_c2_261 | 4079 | 9741 | 414 | 138 | 486 | 1.8(10)-46 | Escherichia coli | b3101 | [pn:hypothetical 17.2 kd protein in exur-tdcc intergenic region] [gn:ygjf] |
| CONTIG505 | 13833558_c2_262 | 4080 | 9742 | 1059 | 353 | 1589 | 2.5(10)-163 | Escherichia coli | b3102 | [pn:hypothetical 37.4 kd protein in exur-tdcc intergenic region] |
| CONTIG505 | 2443297_c2_289 | 4081 | 9743 | 489 | 163 | 764 | 6.5(10)-76 | Escherichia coli | b3133 | [pn:pts system, n-acetylgalactosamine-specific iib component 2] [gn:agav] |
| CONTIG505 | 3239382_c2_293 | 4082 | 9744 | 1176 | 392 | 704 | 1.5(10)-69 | Escherichia coli | b3135 | [pn:putative n-acetylgalactosamine-6-phosphate deacetylase] [gn:agaa] |
| CONTIG505 | 22369003_c2_294 | 4083 | 9745 | 1146 | 382 | 1610 | 1.5(10)-165 | Escherichia coli | b3136 | [pn:protein] [gn:agas] |
| CONTIG505 | 3395463_c2_295 | 4084 | 9746 | 885 | 295 | 1348 | 8.5(10)-138 | Escherichia coli | b3137 | [pn:tagatose-bisphosphate aldolase] [gn:yqja] |
| CONTIG505 | 2395842_c2_296 | 4085 | 9747 | 546 | 182 | 377 | 6.7(10)-35 | Escherichia coli | b1621 | [pn:pts system, maltose and glucose-specific ii abc component] [gn:malx] |
| CONTIG505 | 1270053_c3_309 | 4086 | 9748 | 537 | 179 | 770 | 1.5(10)-76 | Escherichia coli | b3085 | [pn:hypothetical 20.9 kd protein in ebgc-exut intergenic region] [gn:ygjp] |
| CONTIG505 | 1171956_c3_311 | 4087 | 9749 | 999 | 333 | 1142 | 5.7(10)-116 | Escherichia coli | b3088 | [pn:hypothetical 35.8 kd protein in ebgc-exut intergenic region] |
| CONTIG505 | 31284686_c3_322 | 4088 | 9750 | 810 | 270 | 1229 | 3.5(10)-125 | Escherichia coli | b3094 | [pn:cxu regulon regulator] [gn:exur] |
| CONTIG505 | 23577_c3_324 | 4089 | 9751 | 663 | 221 | 883 | 1.6(10)-88 | Escherichia coli | b3095 | [pn:hypothetical protein] [gn:yqja] |
| CONTIG505 | 21570341_c3_326 | 4090 | 9752 | 330 | 110 | 345 | 1.6(10)-31 | Escherichia coli | b3098 | [pn:hypothetical 11.1 kd protein in exur-tdcc intergenic region] |
| CONTIG505 | 34562826_c3_329 | 4091 | 9753 | 387 | 129 | 444 | 5.2(10)-42 | Escherichia coli | b3103 | [pn:hypothetical 14.3 kd protein in exur-tdcc intergenic region] [gn:yhah] |
| CONTIG505 | 26667717_c3_358 | 4092 | 9754 | 864 | 288 | 578 | 3.3(10)-56 | Vibrio furnissii | U65015 | or:vibrio furnissii pn:pts permease for mannose subunit iipman gn:many le:838 re:1614 di:direct nt:many; pel; iidman |
| CONTIG505 | 2822002_c3_360 | 4093 | 9755 | 471 | 157 | 363 | 2.0(10)-33 | Vibrio furnissii | U65015 | or:vibrio furnissii pn:pts permease for mannose subunit iiiman n gn:manw le:2543 re:2983 di:direct nt:manw; iiaman |
| CONTIG506 | 33726666_f1_2 | 4094 | 9756 | 1842 | 614 | 3110 | 0 | Escherichia coli | b2286 | [pn:chain d] [gn:nadh dehydrogenase i chain c] |
| CONTIG506 | 36225631_f1_5 | 4095 | 9757 | 996 | 332 | 1393 | 1.5(10)-142 | Escherichia coli | b2282 | [pn:nadh dehydrogenase i chain h] [gn:nuoh] |
| CONTIG506 | 31697625_f1_6 | 4096 | 9758 | 693 | 231 | 589 | 2.2(10)-57 | Escherichia coli | b2280 | [pn:nadh dehydrogenase i chain j] [gn:nuoj] |
| CONTIG506 | 7242961_f1_22 | 4097 | 9759 | 1311 | 437 | 1167 | 9.3(10)-118 | Escherichia coli | b2265 | [pn:isochorismate synthase] [gn:menf] |
| CONTIG506 | 26302091_f1_23 | 4098 | 9760 | 822 | 274 | 904 | 9.5(10)-91 | Escherichia coli | b2263 | [pn:yfbb] |
| CONTIG506 | 25502283_f1_27 | 4099 | 9761 | 1617 | 539 | 1589 | 2.5(10)-163 | Escherichia coli | b2260 | [pn:o-succinylbenzoic acid–coa ligase] [gn:mene] |
| CONTIG506 | 24477163_f1_31 | 4100 | 9762 | 513 | 171 | 130 | 3.1(10)-8 | Agrobacterium vitis | U32375 | or:agrobacterium vitis pn:unknown le:10379 re:11221 di:complement sr:plasmid ptrab3 |
| CONTIG506 | 2532787_f1_34 | 4101 | 9763 | 729 | 243 | 843 | 2.7(10)-84 | Salmonella typhimurium | P22104 | transcriptional regulatory protein tctd. |
| CONTIG506 | 2284584_f1_36 | 4102 | 9764 | 366 | 122 | 327 | 1.3(10)-29 | Salmonella typhi | AF029846 | [de:salmonella typhi tctd and tcte genes, complete cds.] [pn:tcte] [gn:tcte] |
| CONTIG506 | 822702_f1_37 | 4103 | 9765 | 672 | 224 | 710 | 3.5(10)-70 | Escherichia coli | b2250 | [pn:hypothetical protein] |
| CONTIG506 | 26676087_f1_45 | 4104 | 9766 | 1371 | 457 | 1962 | 7.2(10)-203 | Escherichia coli | b2240 | [pn:glycerol-3-phosphatase transporter] [gn:glpt] |
| CONTIG506 | 4181558_f2_57 | 4105 | 9767 | 444 | 148 | 700 | 4.0(10)-69 | Escherichia coli | b2288 | [pn:nadh dehydrogenase i chain a] [gn:nuoa] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG506 | 24117711_f2_58 | 4106 | 9768 | 690 | 230 | 1142 | 5.7(10)-116 | *Escherichia coli* | b2287 | [pn:nadh dehydrogenase i chain b] [gn:nuob] |
| CONTIG506 | 16688506_f2_61 | 4107 | 9769 | 1356 | 452 | 2268 | 2.7(10)-235 | *Escherichia coli* | b2284 | [pn:nadh dehydrogenase i chain f] [gn:nuof] |
| CONTIG506 | 9822541_f2_62 | 4108 | 9770 | 2760 | 920 | 4322 | 0 | *Escherichia coli* | b2283 | [gn:nuog] |
| CONTIG506 | 5322878_f2_66 | 4109 | 9771 | 1851 | 617 | 2758 | 3.2(10)-287 | *Escherichia coli* | b2278 | [pn:nadh dehydrogenase i chain l] [gn:nuol] |
| CONTIG506 | 1207277_f2_67 | 4110 | 9772 | 1536 | 512 | 2262 | 1.2(10)-234 | *Escherichia coli* | b2277 | [pn:nadh dehydrogenase i chain m] [gn:nuom] |
| CONTIG506 | 14879150_f2_68 | 4111 | 9773 | 1464 | 488 | 1829 | 9.0(10)-189 | *Escherichia coli* | b2276 | [pn:nadh dehydrogenase i chain n] [gn:nuon] |
| CONTIG506 | 29900800_f2_72 | 4112 | 9774 | 339 | 113 | 279 | 1.6(10)-24 | *Escherichia coli* | b2266 | [pn:hypothetical protein] [gn:elab] |
| CONTIG506 | 13859718_f2_74 | 4113 | 9775 | 1767 | 589 | 2446 | 3.7(10)-254 | *Escherichia coli* | b2264 | [pn:2-succinyl-6-hydroxy-2,4-cyclohexadiene-1-carboxylate synthase] [gn:mend] |
| CONTIG506 | 15801416_f2_76 | 4114 | 9776 | 1068 | 356 | 1342 | 3.7(10)-137 | *Escherichia coli* | b2261 | [pn:o-succinylbenzoate-coa synthase] [gn:menc] |
| CONTIG506 | 16929206_f2_89 | 4115 | 9777 | 1122 | 374 | 1024 | 1.8(10)-103 | *Salmonella typhi* | AF029846 | [de:*Salmonella typhi* tctd and tcte genes, complete cds.] [pn:tcte] [gn:tcte] |
| CONTIG506 | 30275056_f2_91 | 4116 | 9778 | 1221 | 407 | 1644 | 3.7(10)-169 | *Escherichia coli* | b2249 | [pn:hypothetical protein] |
| CONTIG506 | 2552202_f2_109 | 4117 | 9779 | 2637 | 879 | 3740 | 0 | *Escherichia coli* | b2231 | [pn:dna gyrase subunit a] [gn:gyra] |
| CONTIG506 | 32680156_f2_110 | 4118 | 9780 | 2871 | 957 | 3706 | 0 | *Escherichia coli* | b2218 | [pn:sensor protein rcsc] [gn:rcsc] |
| CONTIG506 | 29305135_f3_117 | 4119 | 9781 | 537 | 179 | 844 | 2.2(10)-84 | *Escherichia coli* | b2285 | [pn:nadh dehydrogenase i chain e] [gn:nuoe] |
| CONTIG506 | 16605040_f3_122 | 4120 | 9782 | 423 | 141 | 374 | 1.3(10)-34 | *Escherichia coli* | D90859 | or:*escherichia coli* pn:nadh dehydrogenase i chain g (ec 1.6.5.3) gn:nuog [e:9026 re:9565 di:complement sr:*escherichia coli* (strain:k12) dna, clone_lib:kohara lambda minise nt:similar to [swissprot accession number |
| CONTIG506 | 6049181_f3_126 | 4121 | 9783 | 651 | 217 | 897 | 5.2(10)-90 | *Escherichia coli* | b2281 | [pn:nadh dehydrogenase i chain j] [gn:nuoj] |
| CONTIG506 | 26014441_f3_128 | 4122 | 9784 | 336 | 112 | 319 | 9.4(10)-29 | *Escherichia coli* | b2279 | [pn:nadh dehydrogenase i chain k] [gn:nuok] |
| CONTIG506 | 5129635_f3_134 | 4123 | 9785 | 498 | 166 | 630 | 1.0(10)-61 | *Escherichia coli* | b2267 | [pn:hypothetical protein] [gn:elaa] |
| CONTIG506 | 14459708_f3_136 | 4124 | 9786 | 207 | 69 | 144 | 3.2(10)-10 | *Escherichia coli* | D90857 | or:*escherichia coli* pn:mend protein gn:mend le:10698 re:10907 di:complement sr:*escherichia coli* (strain:k12) dna, clone_lib:kohara lambda minise nt:similar to [pir accession number a33860] |
| CONTIG506 | 11067041_f3_137 | 4125 | 9787 | 969 | 323 | 1438 | 2.5(10)-147 | *Escherichia coli* | b2262 | [pn:naphthoate synthase] [gn:menb] |
| CONTIG506 | 3375126_f3_158 | 4126 | 9788 | 1191 | 397 | 1545 | 1.1(10)-158 | *Escherichia coli* | b2239 | [pn:glycerophosphoryl diester phosphodiesterase periplasmic precursor] [gn:glpq] |
| CONTIG506 | 24494150_c1_169 | 4127 | 9789 | 741 | 247 | 1051 | 2.5(10)-106 | *Escherichia coli* | b2217 | [pn:regulator of capsule synthesis b component] [gn:rcsb] |
| CONTIG506 | 2060418_c1_178 | 4128 | 9790 | 2328 | 776 | 3678 | 0 | *Escherichia coli* | b2234 | [pn:ribonucleoside-diphosphate reductase 1 alpha chain] [gn:nrda] or:*escherichia coli* gn:nrdb le:3505 re:5835 di:direct sr:*escherichia coli* k-12 dna, clone pps2 nt:ribonucleoside diphosphate reductase b1 subunit |
| CONTIG506 | 14156906_c1_179 | 4129 | 9791 | 1221 | 407 | 1844 | 2.2(10)-190 | *Escherichia coli* | b2235 | [pn:ribonucleoside-diphosphate reductase 1 beta chain] [gn:nrdb] |
| CONTIG506 | 22869676_c1_197 | 4130 | 9792 | 1530 | 510 | 766 | 4.0(10)-76 | *Agrobacterium vitis* | U32375 | [PN:unknown] [SR:plasmid pTrAB3] [DE:*Agrobacterium vitis* plasmid pTrAB3 tartrate utilization generegion, including LysR-like regulator (ttuC and ttuC"), membrane protein (ttuB), tartrate dehydrogenase (ttuC and ttuC"), enzyme degrading primary ta |
| CONTIG506 | 33464808_c1_211 | 4131 | 9793 | 1050 | 350 | 1143 | 4.5(10)-116 | *Escherichia coli* | b2268 | [pn:hypothetical protein] [gn:elac] |
| CONTIG506 | 16600443_c2_242 | 4132 | 9794 | 744 | 248 | 1177 | 1.1(10)-119 | *Escherichia coli* | b2232 | [pn:3-demethylubiquinone-9,3-methyltransferase] [gn:ubig] |
| CONTIG506 | 14469587_c2_244 | 4133 | 9795 | 201 | 67 | 96 | 0.000076 | *Escherichia coli* | KO2672 | or:*escherichia coli* gn:nrdb le:3505 re:5835 di:direct sr:*escherichia coli* k-12 dna, clone pps2 nt:ribonucleoside diphosphate reductase b1 subunit |
| CONTIG506 | 34470790_c2_245 | 4134 | 9796 | 288 | 96 | 183 | 3.7(10)-13 | *Escherichia coli* | KO2672 | or:*escherichia coli* gn:nrdb k-12 dna, clone pps2 nt:ribonucleoside diphosphate reductase b1 subunit |
| CONTIG506 | 24412702_c2_250 | 4135 | 9797 | 1659 | 553 | 2303 | 5.4(10)-239 | *Escherichia coli* | b2241 | [pn:anaerobic glycerol-3-phosphate dehydrogenase subunit a] [gn:glpa] |
| CONTIG506 | 32031937_c2_252 | 4136 | 9798 | 1320 | 440 | 1716 | 8.5(10)-177 | *Escherichia coli* | b2243 | [pn:anaerobic glycerol-3-phosphate dehydrogenase subunit c] [gn:glpc] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG506 | 4566712_c2_274 | 4137 | 9799 | 1032 | 344 | 334 | 2.3(10)-30 | Helicobacter pylori | HP0393 | [pn:chemotaxis protein chev] [gn:chev] |
| CONTIG506 | 29956660_c3_303 | 4138 | 9800 | 546 | 182 | 755 | 5.9(10)-75 | Escherichia coli | b2216 | [pn:probable sensor protein yojn] [gn:yojn] |
| CONTIG506 | 7267876_c3_313 | 4139 | 9801 | 1053 | 351 | 223 | 2.6(10)-16 | Mycobacterium smegmatis | X84077 | or:mycobacterium smegmatis gn:orf617 le:3075 re:4925 di:complement nt:val start codon |
| CONTIG506 | 22067707_c3_314 | 4140 | 9802 | 1095 | 365 | 108 | 0.00619 | Mycobacterium smegmatis | X84077 | or:mycobacterium smegmatis gn:orf617 le:3075 re:4925 di:complement nt:val start codon |
| CONTIG506 | 31820142_c3_321 | 4141 | 9803 | 291 | 97 | 383 | 1.5(10)-35 | Escherichia coli | b2236 | [pn:hypothetical 9.3 kd protein in nrdb 5''' region] [gn:yfae] |
| CONTIG506 | 35286582_c3_328 | 4142 | 9804 | 1329 | 443 | 1061 | 2.2(10)-107 | Escherichia coli | b2242 | [pn:anaerobic glycerol-3-phosphate dehydrogenase subunit b] [gn:glpb] |
| CONTIG507 | 24415957_c3_336 | 4143 | 9805 | 984 | 328 | 232 | 1.6(10)-19 | Bacillus subtilis | yfIP | [pn:hypothetical protein] |
| CONTIG507 | 26738791_c1_3 | 4144 | 9806 | 768 | 256 | 146 | 6.4(10)-9 | Haemophilus influenzae | HI0575 | [pn:gb] |
| CONTIG507 | 4693763_f1_5 | 4145 | 9807 | 348 | 116 | 180 | 5.0(10)-14 | Bacillus subtilis | yvaE | [pn:hypothetical protein] |
| CONTIG507 | 913562_f1_6 | 4146 | 9808 | 2463 | 821 | 835 | 2.0(10)-83 | Escherichia coli | b3951 | [pn:formate acetyltransferase 2] [gn:pfld] |
| CONTIG507 | 4584643_f1_7 | 4147 | 9809 | 234 | 78 | 208 | 5.4(10)-17 | Escherichia coli | b2833 | [pn:hypothetical protein] |
| CONTIG507 | 7320391_f1_11 | 4148 | 9810 | 1149 | 383 | 428 | 2.6(10)-40 | Escherichia coli | b1486 | [pn:hypothetical protein] |
| CONTIG507 | 16916450_f1_12 | 4149 | 9811 | 966 | 322 | 489 | 9.0(10)-47 | Haemophilus influenzae | HI1185 | [pn:dipeptide transport atp-binding protein] [gn:dppd] |
| CONTIG507 | 25391038_f1_18 | 4150 | 9812 | 894 | 298 | 949 | 1.6(10)-95 | Klebsiella terrigena | P52666 | bud operon transcriptional regulator. |
| CONTIG507 | 33724033_f1_25 | 4151 | 9813 | 495 | 165 | 95 | 0.0061 | Saccharomyces cerevisiae | YDL037C | [pn:strong similarity to glucan 1,4-alpha-glucosidase] |
| CONTIG507 | 24416090_f2_71 | 4152 | 9814 | 807 | 269 | 183 | 7.0(10)-13 | Escherichia coli | b1464 | [pn:hypothetical 32.3 kd protein in rhse-narv intergenic region] [gn:ydde] |
| CONTIG507 | 30745308_f2_78 | 4153 | 9815 | 975 | 325 | 437 | 2.8(10)-41 | Escherichia coli | b0824 | [pn:hypothetical protein] |
| CONTIG507 | 24001537_f2_81 | 4154 | 9816 | 1602 | 534 | 436 | 3.7(10)-41 | Escherichia coli | b1487 | [pn:hypothetical protein] |
| CONTIG507 | 7300265_f2_87 | 4155 | 9817 | 864 | 288 | 477 | 1.7(10)-45 | Bacillus subtilis | ykfD | [pn:hypothetical protein] |
| CONTIG507 | 33806966_f2_96 | 4156 | 9818 | 273 | 91 | 270 | 1.5(10)-23 | Escherichia coli | b0581 | [pn:hypothetical protein] [gn:ybdk] |
| CONTIG507 | 11209657_f2_97 | 4157 | 9819 | 537 | 179 | 233 | 1.2(10)-19 | Vibrio cholerae | S81006 | or:vibrio cholerae pn:hcp gn:hcp le:690 re:1208 di:direct sr:vibrio cholerae o17 nt:28 kda secreted hydrophilic protein; this sequence |
| CONTIG507 | 16884636_f2_117 | 4158 | 9820 | 753 | 251 | 129 | 1.8(10)-8 | Saccharomyces cerevisiae | X85757 | or:saccharomyces cerevisiae pn:unknown gn:internal orf g1669 le:6964 re:7365 di:direct sr:baker's yeast |
| CONTIG507 | 1300636_f2_126 | 4159 | 9821 | 663 | 221 | 106 | 0.00051 | Haemophilus influenzae | HI0955 | [pn:protein homolog] [gn:ttk] |
| CONTIG507 | 6923416_f2_130 | 4160 | 9822 | 1452 | 484 | 301 | 5.0(10)-25 | Bacillus subtilis | mmr | [pn:methylenomycin a resistance protein] |
| CONTIG507 | 414926_f3_151 | 4161 | 9823 | 429 | 143 | 146 | 2.0(10)-10 | Escherichia coli | b0543 | [pn:hypothetical protein] [gn:emre] |
| CONTIG507 | 12754381_f3_159 | 4162 | 9824 | 879 | 293 | 495 | 2.1(10)-47 | Escherichia coli | b1485 | [pn:hypothetical protein] |
| CONTIG507 | 26679086_f3_180 | 4163 | 9825 | 1140 | 380 | 1556 | 7.7(10)-160 | Escherichia coli | b0581 | [pn:hypothetical protein] [gn:ybdk] |
| CONTIG507 | 23479076_f3_190 | 4164 | 9826 | 267 | 89 | 178 | 8.1(10)-14 | Escherichia coli | b0580 | [pn:hypothetical protein] [gn:ybdj] |
| CONTIG507 | 26063750_f3_193 | 4165 | 9827 | 2181 | 727 | 1814 | 3.5(10)-187 | Erwinia chrysanthemi | Q47162 | ferrichrysobactin receptor precursor. |
| CONTIG507 | 10007212_f3_195 | 4166 | 9828 | 579 | 193 | 397 | 5.0(10)-37 | Escherichia coli | b0579 | [pn:hypothetical protein in nfsb 5''' region] [gn:ybdf] |
| CONTIG507 | 10206325_f3_196 | 4167 | 9829 | 774 | 258 | 1084 | 8.0(10)-110 | Enterobacter cloacae | Q01234 | oxygen-insensitive nad(p)h nitroreductase (ec 1.—.—.). |
| CONTIG507 | 4723752_f3_199 | 4168 | 9830 | 1302 | 434 | 1644 | 3.7(10)-169 | Escherichia coli | b0577 | [pn:hypothetical protein in phep-entd intergenic region] [gn:ybdg] |
| CONTIG507 | 1197041_f3_212 | 4169 | 9831 | 786 | 262 | 125 | 3.2(10)-5 | Escherichia coli | b0457 | [pn:hypothetical protein] [gn:ylab] |
| CONTIG507 | 34065925_c1_214 | 4170 | 9832 | 297 | 99 | 265 | 4.9(10)-23 | Escherichia coli | b0329 | [pn:hypothetical protein] [gn:yaho] |
| CONTIG507 | 16148586_c1_217 | 4171 | 9833 | 1986 | 662 | 96 | 0.0038 | Pseudomonas putida | S64724 | uxpb protein - pseudomonas putida (fragment) |
| CONTIG507 | 26369168_c1_218 | 4172 | 9834 | 1392 | 464 | 1906 | 6.2(10)-197 | Escherichia coli | b0576 | [pn:phenylalanine-specific permease] [gn:phep] |
| CONTIG507 | 109705_c1_220 | 4173 | 9835 | 1296 | 432 | 669 | 7.5(10)-66 | Escherichia coli | b2098 | [pn:hypothetical protein] |
| CONTIG507 | 36225641_c1_221 | 4174 | 9836 | 1041 | 347 | 155 | 7.9(10)-9 | Bacillus subtilis | yxdc | [pn:hypothetical protein] [gn:yxdc] |
| CONTIG507 | 14582660_c1_234 | 4175 | 9837 | 420 | 140 | 499 | 7.9(10)-48 | Klebsiella pneumoniae | iolE | transcriptional activator rama. |
| CONTIG507 | 13867217_c1_241 | 4176 | 9838 | 2721 | 907 | 1360 | 4.5(10)-139 | Bacillus subtilis | Q48413 | [pn:hypothetical protein] |
| CONTIG507 | 14570343_c1_242 | 4177 | 9839 | 1092 | 364 | 480 | 8.0(10)-46 | Escherichia coli | yloB | [pn:hypothetical protein] |
| CONTIG507 | 4332318_c1_243 | 4178 | 9840 | 3165 | 1055 | 807 | 1.8(10)-80 | Escherichia coli | b0462 | [pn:acriflavin resistance protein b] [gn:acrb] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG507 | 7083293_c1_247 | 4179 | 9841 | 306 | 102 | 185 | 1.5(10)-14 | Mycobacterium tuberculosis | Q50648 | hypothetical 26.2 kd protein cy227.28c. |
| CONTIG507 | 25474036_c1_248 | 4180 | 9842 | 723 | 241 | 906 | 5.9(10)-91 | Haemophilus influenzae | HI0882 | [pn:hypothetical protein] |
| CONTIG507 | 24620302_c1_252 | 4181 | 9843 | 804 | 268 | 1353 | 2.5(10)-138 | Enterobacter aerogenes | P05361 | alpha-acetolactate decarboxylase (ec 4.1.1.5). |
| CONTIG507 | 25516656_c1_256 | 4182 | 9844 | 834 | 278 | 1194 | 1.8(10)-121 | Klebsiella pneumoniae | D86412 | or:*klebsiella pneumoniae* pn:meso-2,3-butanediol dehydrogenase (d-acetoin gn:budc le:319 re:1089 di:direct sr:*klebsiella pneumoniae* (strain:iam 1063) dna |
| CONTIG507 | 12994562_c2_290 | 4183 | 9845 | 258 | 86 | 93 | 0.0015 | Bacteriophage I3 | S26427 | structural protein, 70k - phage i3 |
| CONTIG507 | 5212842_c2_298 | 4184 | 9846 | 1245 | 415 | 237 | 9.0(10)-18 | Bacillus subtilis | yfiI | [pn:hypothetical protein] |
| CONTIG507 | 33485627_c2_299 | 4185 | 9847 | 1020 | 340 | 427 | 3.3(10)-40 | Escherichia coli | b3753 | [pn:rbs repressor] [gn:rbsr] |
| CONTIG507 | 33786037_c2_305 | 4186 | 9848 | 309 | 103 | 110 | 1.3(10)-6 | Mycobacterium tuberculosis | Z84498 | or:*mycobacterium tuberculosis* pn:unknown gn:mtcy0919.08c le:3775 re:4224 di:complement nt:mtcy0919.08c, unknown, len:149 aa |
| CONTIG507 | 973760_c2_314 | 4187 | 9849 | 1632 | 544 | 252 | 2.2(10)-19 | Escherichia coli | b0585 | [pn:enterochelin esterase] [gn:fes] |
| CONTIG507 | 25478406_c2_320 | 4188 | 9850 | 894 | 298 | 660 | 6.9(10)-65 | Mycobacterium tuberculosis | Q50648 | hypothetical 26.2 kd protein cy227.28c. |
| CONTIG507 | 12347825_c2_327 | 4189 | 9851 | 1779 | 593 | 1407 | 4.7(10)-144 | Bacillus subtilis | alsS | [pn:alpha-acetolactate synthase] |
| CONTIG507 | 12992781_c2_328 | 4190 | 9852 | 240 | 80 | 120 | 2.7(10)-7 | Klebsiella terrigena | Q04520 | acetoin (diacetyl) reductase (ec 1.1.1.5) (acetoin dehydrogenase) (ar). |
| CONTIG507 | 2035278_c2_335 | 4191 | 9853 | 765 | 255 | 437 | 2.8(10)-41 | Saccharomyces cerevisiae | P40586 | hypothetical 27.4 kd protein in hyr1 3' region. |
| CONTIG507 | 3940838_c3_348 | 4192 | 9854 | 2193 | 731 | 1970 | 1.0(10)-203 | Yersinia enterocolitica | Q05202 | ferrichrome receptor fcua precursor. |
| CONTIG507 | 14510461_c3_392 | 4193 | 9855 | 489 | 163 | 102 | 9.3(10)-6 | Staphylococcus aureus | AF003592 | [PN:CspB] [GN:cspB] [DE:*Staphylococcus aureus* CspB (cspB) gene, complete cds] [NT:similar to major cold-shock protein] [LE:439] [RE:639] [DI:direct] |
| CONTIG508 | 33992790_f1_9 | 4194 | 9856 | 930 | 310 | 1402 | 1.6(10)-143 | Escherichia coli | b2916 | [pn:chromosome initiation inhibitor] [gn:icia] |
| CONTIG508 | 16285416_f1_24 | 4195 | 9857 | 237 | 79 | 105 | 4.5(10)-6 | Azospirillum brasilense | X70360 | or:*azospirillum brasilense* gn:carr le:59 re:580 di:direct nt:orf2 |
| CONTIG508 | 31770765_f1_36 | 4196 | 9858 | 369 | 123 | 93 | 0.003 | human herpesvirus 2 | Z86099 | or:human herpesvirus 2 gn:rs1 re:128076 re:132032 di:complement |
| CONTIG508 | 36438950_f1_52 | 4197 | 9859 | 765 | 255 | 1142 | 5.7(10)-116 | Escherichia coli | b2945 | [pn:endonuclease i] [gn:enda] |
| CONTIG508 | 994036_f1_53 | 4198 | 9860 | 750 | 250 | 948 | 2.1(10)-95 | Escherichia coli | b2946 | [pn:hypothetical protein in enda-gshb intergenic region] [gn:mltc] |
| CONTIG508 | 24807956_f1_54 | 4199 | 9861 | 960 | 320 | 1498 | 1.1(10)-153 | Escherichia coli | b2947 | [pn:glutathione synthetase] [gn:gshb] |
| CONTIG508 | 3566142_f1_57 | 4200 | 9862 | 318 | 106 | 138 | 1.3(10)-9 | Pseudomonas aeruginosa | P24564 | hypothetical 19.5 kd protein in pilt region (orf6). |
| CONTIG508 | 15751010_f1_60 | 4201 | 9863 | 327 | 109 | 416 | 4.9(10)-39 | Escherichia coli | b2953 | [pn:hypothetical protein] [gn:yggu] |
| CONTIG508 | 24790907_f1_61 | 4202 | 9864 | 597 | 199 | 910 | 2.2(10)-91 | Escherichia coli | b2954 | [pn:hypothetical protein] [gn:yggv] |
| CONTIG508 | 29976593_f1_63 | 4203 | 9865 | 387 | 129 | 292 | 6.7(10)-26 | Escherichia coli | b1289 | [pn:hypothetical 14.0 kd protein in envm-sapf intergenic region] [gn:ycjd] |
| CONTIG508 | 10755300_f1_66 | 4204 | 9866 | 1071 | 357 | 1684 | 2.1(10)-173 | Escherichia coli | b2961 | [pn:a/g-specific adenine glycosylase] [gn:muty] |
| CONTIG508 | 10003757_f1_67 | 4205 | 9867 | 1260 | 420 | 1648 | 1.3(10)-169 | Escherichia coli | b2963 | [pn:yggz] [gn:mltc] |
| CONTIG508 | 20353462_f1_81 | 4206 | 9868 | 1683 | 561 | 835 | 2.0(10)-83 | Escherichia coli | b0619 | [pn:hypothetical protein] [gn:cita] |
| CONTIG508 | 1040963_f2_96 | 4207 | 9869 | 639 | 213 | 126 | 3.5(10)-8 | Saccharomyces cerevisiae | P25614 | very hypothetical 22.8 kd protein in pgk1 region. |
| CONTIG508 | 3925052_f2_102 | 4208 | 9870 | 846 | 282 | 1050 | 3.2(10)-106 | Escherichia coli | b2936 | [pn:hypothetical 31.8 kd protein in tkta-speb intergenic region] [gn:yggi] |
| CONTIG508 | 13675250_f2_123 | 4209 | 9871 | 1314 | 438 | 157 | 1.3(10)-8 | Escherichia coli | b4356 | [pn:hypothetical 49.4 kd protein in tsr-mdob intergenic region] |
| CONTIG508 | 16151390_f2_124 | 4210 | 9872 | 696 | 232 | 726 | 7.0(10)-72 | Escherichia coli | M32363 | or:*escherichia coli* le:271 re:1287 di:complement sr:*escherichia coli* (strain k-12) (clone: plc[2-5,5-8,5-14].) dna nt:orf1; putative |
| CONTIG508 | 14493937_f2_127 | 4211 | 9873 | 1425 | 475 | 2144 | 3.7(10)-222 | Escherichia coli | b2943 | [pn:galactose-proton symport] [gn:galp] |
| CONTIG508 | 22078760_f2_132 | 4212 | 9874 | 453 | 151 | 659 | 8.8(10)-65 | Escherichia coli | b2949 | [pn:hypothetical protein] [gn:yqgf] |
| CONTIG508 | 6775790_f2_133 | 4213 | 9875 | 420 | 140 | 118 | 1.7(10)-6 | Volvox carteri | S22697 | extensin - *volvox carteri* (fragment) |
| CONTIG508 | 31344632_f2_134 | 4214 | 9876 | 717 | 239 | 855 | 1.5(10)-85 | Escherichia coli | b2951 | [pn:hypothetical protein] [gn:yggs] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG508 | 34395318_f2_135 | 4215 | 9877 | 585 | 195 | 797 | 2.1(10)-79 | Escherichia coli | b2952 | [pn:hypothetical protein] [gn:yggt] |
| CONTIG508 | 29845662_f2_136 | 4216 | 9878 | 1173 | 391 | 1799 | 1.3(10)-185 | Escherichia coli | b2955 | [pn:hypothetical protein] [gn:yggw] |
| CONTIG508 | 2911266_f2_143 | 4217 | 9879 | 1344 | 448 | 1883 | 1.7(10)-194 | Escherichia coli | b2964 | [pn:nucleoside permease nupg] [gn:nupg] |
| CONTIG508 | 4039075_f2_156 | 4218 | 9880 | 828 | 276 | 415 | 6.2(10)-39 | Escherichia coli | b0620 | [nt:transcriptional regulator citr] [gn:citb] |
| CONTIG508 | 489515_f3_159 | 4219 | 9881 | 396 | 132 | 486 | 1.8(10)-46 | Escherichia coli | b2910 | [pn:hypothetical 12.7 kd protein in pepp-ssr intergenic region] [gn:ygfe] |
| CONTIG508 | 25985662_f3_160 | 4220 | 9882 | 693 | 231 | 748 | 3.2(10)-74 | Escherichia coli | b2912 | [pn:hypothetical 21.1 kd protein in ssr-sera intergenic region] [gn:ygfa] |
| CONTIG508 | 13073275_f3_184 | 4221 | 9883 | 1041 | 347 | 159 | 2.5(10)-11 | Azospirillum brasilense | X70360 | or:azospirillum brasilense gn:carr le:<1 re:588 di:direct |
| CONTIG508 | 24353412_f3_204 | 4222 | 9884 | 1158 | 386 | 1813 | 4.5(10)-187 | Escherichia coli | b2942 | [pn:s-adenosylmethionine synthetase] [gn:metk] |
| CONTIG508 | 14957708_f3_206 | 4223 | 9885 | 570 | 190 | 796 | 1.7(10)-79 | Escherichia coli | b2944 | [pn:hypothetical 19.3 kd protein in galp-enda intergenic region] |
| CONTIG508 | 35820762_f3_209 | 4224 | 9886 | 708 | 236 | 894 | 1.1(10)-89 | Escherichia coli | b2948 | [pn:hypothetical protein] |
| CONTIG508 | 14583376_f3_218 | 4225 | 9887 | 381 | 127 | 436 | 3.7(10)-41 | Escherichia coli | b2962 | [pn:hypothetical protein] [gn:yggx] |
| CONTIG508 | 4879557_cl_240 | 4226 | 9888 | 1389 | 463 | 960 | 1.1(10)-96 | Bacillus subtilis | yxkJ | [pn:hypothetical protein] |
| CONTIG508 | 4567918_cl_240 | 4227 | 9889 | 1032 | 344 | 728 | 4.2(10)-72 | Escherichia coli | b0618 | [pn:hypothetical protein] |
| CONTIG508 | 21661682_cl_243 | 4228 | 9890 | 903 | 301 | 935 | 5.0(10)-94 | Escherichia coli | b0616 | [pn:hypothetical protein] [gn:cite] |
| CONTIG508 | 22520128_cl_247 | 4229 | 9891 | 621 | 207 | 285 | 3.7(10)-25 | Escherichia coli | b2960 | [pn:hypothetical 27.3 kd protein in muty 5'''' region] [gn:yggh] |
| CONTIG508 | 4730001_cl_259 | 4230 | 9892 | 771 | 257 | 1178 | 8.8(10)-120 | Escherichia coli | b2938 | [pn:biosynthetic arginine decarboxylase] [gn:spea] |
| CONTIG508 | 1382785_cl_281 | 4231 | 9893 | 1998 | 666 | 3068 | 0 | Acinetobacter calcoaceticus | AF009672 | [PN:unknown] [DE:Acinetobacter calcoaceticus ADP1 vanillate demethylase region, vanillate demethylase (vanB) and vanillate demethylase (vanA) genes, complete cds.] [NT:putative ferredoxin; ORF9] [LE:12779] [RE:13084] [DI:direct] |
| CONTIG508 | 24015955_cl_284 | 4232 | 9894 | 438 | 146 | 324 | 2.7(10)-29 | Acinetobacter calcoaceticus | AF009672 | [PN:unknown] [DE:Acinetobacter calcoaceticus ADP1 vanillate demethylase region, vanillate demethylase (vanB) and vanillate demethylase (vanA) genes, complete cds.] [NT:similar to vanillate demethylase (vanA subunit)x] [LE:13411] [RE:143 |
| CONTIG508 | 16261457_cl_285 | 4233 | 9895 | 1116 | 372 | 1157 | 1.5(10)-117 | Acinetobacter calcoaceticus | AF009672 | [pn:hypothetical protein] |
| CONTIG508 | 25500413_cl_293 | 4234 | 9896 | 552 | 184 | 90 | 0.01799 | Bacillus subtilis | ykrZ | [pn:hypothetical protein] |
| CONTIG508 | 5114843_cl_294 | 4235 | 9897 | 780 | 260 | 120 | 2.3(10)-5 | Bacillus subtilis | yvaM | [pn:hypothetical protein] |
| CONTIG508 | 34491313_cl_307 | 4236 | 9898 | 1185 | 395 | 1788 | 2.0(10)-184 | Escherichia coli | b2926 | [pn:phosphoglycerate kinase] [gn:pgk] |
| CONTIG508 | 2914202_cl_309 | 4237 | 9899 | 855 | 285 | 1025 | 1.3(10)-103 | Escherichia coli | b2924 | [pn:hypothetical 30.9 kd protein in sbm-fba intergenic region] [gn:yggb] |
| CONTIG508 | 14462658_cl_312 | 4238 | 9900 | 783 | 261 | 780 | 1.3(10)-77 | Escherichia coli | b2922 | [pn:hypothetical 26.6 kd protein in sbm-fba intergenic region] [gn:ygge] |
| CONTIG508 | 4165941_cl_318 | 4239 | 9901 | 384 | 128 | 548 | 5.0(10)-53 | Escherichia coli | b2909 | [pn:hypothetical 21.5 kd protein in pepp-ssr intergenic region] [gn:ygfb] |
| CONTIG508 | 15128755_c2_328 | 4240 | 9902 | 600 | 200 | 194 | 1.6(10)-15 | Haemophilus influenzae | HI0024 | [nt:acyl lyase subunit] [gn:citd] |
| CONTIG508 | 22917825_c2_330 | 4241 | 9903 | 1668 | 556 | 1715 | 1.1(10)-176 | Escherichia coli | b0615 | [pn:hypothetical protein] [gn:citf] |
| CONTIG508 | 35275330_c2_332 | 4242 | 9904 | 807 | 269 | 449 | 1.6(10)-42 | Escherichia coli | b0613 | [pn:hypothetical protein] [gn:citg] |
| CONTIG508 | 6072130_c2_342 | 4243 | 9905 | 984 | 328 | 1234 | 1.0(10)-125 | Escherichia coli | b2950 | [pn:hypothetical 9.5 kd protein in spea-metk intergenic region] [gn:yggd] |
| CONTIG508 | 36113775_c2_351 | 4244 | 9906 | 243 | 81 | 161 | 5.2(10)-12 | Escherichia coli | b2941 | [pn:hypothetical 9.5 kd protein in spea-metk intergenic region] [gn:yggd] |
| CONTIG508 | 3261557_c2_352 | 4245 | 9907 | 219 | 73 | 125 | 3.3(10)-8 | Escherichia coli | b2939 | [pn:hypothetical 5.4 kd protein in spea-metk intergenic region] [gn:yggb] |
| CONTIG508 | 16195806_c2_367 | 4246 | 9908 | 1227 | 409 | 467 | 1.8(10)-44 | Escherichia coli | b2542 | [pn:hypothetical protein] |
| CONTIG508 | 11750417_c2_372 | 4247 | 9909 | 987 | 329 | 248 | 3.1(10)-21 | Escherichia coli | b1619 | [pn:7-alpha-hydroxysteroid dehydrogenase] [gn:hdha] |
| CONTIG508 | 4332693_c2_373 | 4248 | 9910 | 780 | 260 | 297 | 2.0(10)-26 | Methanobacterium thermoautotrophicum | MTH973 | [pn:conserved protein] |
| CONTIG508 | 5197318_c2_374 | 4249 | 9911 | 1479 | 493 | 931 | 1.3(10)-93 | Saccharomyces cerevisiae | YER073W | [pn:aldehyde dehydrogenase] [gn:ald3] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG508 | 13756568_c2_377 | 4250 | 9912 | 2184 | 728 | 3323 | 0 | Escherichia coli | b2935 | [pn:transketolase] [gn:tkta] |
| CONTIG508 | 876260_c2_381 | 4251 | 9913 | 708 | 236 | 1009 | 7.0(10)-102 | Escherichia coli | b2923 | [pn:hypothetical protein in ibm-fba intergenic region] [gn:ygga] |
| CONTIG508 | 34394790_c2_384 | 4252 | 9914 | 696 | 232 | 1048 | 5.2(10)-106 | Escherichia coli | b2914 | [pn:ribose 5-phosphate isomerase] [gn:rpia] |
| CONTIG508 | 7226077_c2_385 | 4253 | 9915 | 1233 | 411 | 1936 | 4.2(10)-200 | Escherichia coli | b2913 | [pn:d-3-phosphoglycerate dehydrogenase] [gn:sera] |
| CONTIG508 | 32713250_c3_388 | 4254 | 9916 | 1122 | 374 | 1722 | 2.0(10)-177 | Escherichia coli | b2965 | [pn:ornithine decarboxylase, constitutive] [gn:spec] |
| CONTIG508 | 2128266_c3_394 | 4255 | 9917 | 924 | 308 | 396 | 6.5(10)-37 | Bacillus subtilis | yisK | [pn:hypothetical protein] |
| CONTIG508 | 13135432_c3_411 | 4256 | 9918 | 387 | 129 | 571 | 1.8(10)-55 | Escherichia coli | b2959 | [pn:hypothetical protein in muty 5'''' region] [gn:yggl] |
| CONTIG508 | 35745292_c3_412 | 4257 | 9919 | 771 | 257 | 942 | 9.0(10)-95 | Escherichia coli | b2958 | [pn:hypothetical protein in ansb 5'''' region] [gn:yggn] |
| CONTIG508 | 597140_c3_430 | 4258 | 9920 | 948 | 316 | 1550 | 3.2(10)-159 | Escherichia coli | b2937 | [pn:agmatinase] [gn:speb] |
| CONTIG508 | 36096667_c3_435 | 4259 | 9921 | 771 | 257 | 300 | 9.6(10)-27 | Bacillus subtilis | fabG | [pn:3-oxoacyl-acyl-carrier protein reductase] [gn:ylpf] |
| CONTIG508 | 5214643_c3_436 | 4260 | 9922 | 801 | 267 | 326 | 1.7(10)-29 | Escherichia coli | b0272 | [pn:hypothetical transcriptional regulator in perr-argf intergenic region] [gn:yagi] |
| CONTIG508 | 17048951_c3_437 | 4261 | 9923 | 978 | 326 | 177 | 1.8(10)-11 | Ralstonia eutropha | P17296 | metapyrocatchase 2 (ec 1.13.11.2) (cato2ase) (catechol 2,3-dioxygenase ii). |
| CONTIG509 | 6351031_c3_440 | 4262 | 9924 | 1278 | 426 | 247 | 1.1(10)-18 | Escherichia coli | b4356 | [pn:hypothetical 49.4 kd protein in tsr-mdob intergenic region] [gn:mtlr] |
| CONTIG509 | 26056558_c3_445 | 4263 | 9925 | 1644 | 548 | 374 | 2.2(10)-34 | Escherichia coli | b3671 | [pn:acetohydroxy acid synthase i, small subunit] [gn:ilvb] |
| CONTIG509 | 34645626_c3_447 | 4264 | 9926 | 1035 | 345 | 1663 | 3.6(10)-171 | Escherichia coli | b2927 | [pn:d-erythrose 4-phosphate dehydrogenase] [gn:epd] |
| CONTIG509 | 22147313_c3_448 | 4265 | 9927 | 1179 | 393 | 1761 | 1.5(10)-181 | Escherichia coli | b2925 | [pn:fructose 1,6-bisphosphate aldolase] [gn:fba] |
| CONTIG509 | 10335127_f1_3 | 4266 | 9928 | 1932 | 644 | 2853 | 2.7(10)-297 | Escherichia coli | b3846 | [pn:large] |
| CONTIG509 | 15702_f1_18 | 4267 | 9929 | 1044 | 348 | 1362 | 2.7(10)-139 | Escherichia coli | b3566 | [pn:xylf] [gn:xylf] |
| CONTIG509 | 16536530_f1_19 | 4268 | 9930 | 1614 | 538 | 2319 | 1.1(10)-240 | Escherichia coli | b3567 | [pn:d-xylose transport atp-binding protein xylg] [gn:xylg] |
| CONTIG509 | 14156906_f1_32 | 4269 | 9931 | 1584 | 528 | 1928 | 2.8(10)-199 | Escherichia coli | b3580 | [pn:cryptic 1-xylulose kinase] [gn:lyx] |
| CONTIG509 | 15822667_f1_35 | 4270 | 9932 | 723 | 241 | 1080 | 2.1(10)-109 | Escherichia coli | b3583 | [pn:hypothetical 25.6 kd protein in avta-selb intergenic region] [gn:yial] |
| CONTIG509 | 22166282_f1_49 | 4271 | 9933 | 1953 | 651 | 2652 | 5.5(10)-276 | Escherichia coli | b3599 | [pn:mannitol-specific enzyme ii of phosphotransferase system] [gn:mtla] |
| CONTIG509 | 15656306_f2_56 | 4272 | 9934 | 1776 | 592 | 2236 | 6.7(10)-232 | Escherichia coli | b3603 | [pn:l-lactate permease] [gn:lldp] |
| CONTIG509 | 17058340_f2_68 | 4273 | 9935 | 525 | 175 | 595 | 5.2(10)-58 | Escherichia coli | b3846 | [pn:large] |
| CONTIG509 | 4800443_f2_69 | 4274 | 9936 | 1173 | 391 | 1796 | 2.8(10)-185 | Escherichia coli | b3845 | [pn:small] [gn:fada] |
| CONTIG509 | 19582686_f2_76 | 4275 | 9937 | 1140 | 380 | 1383 | 1.7(10)-141 | Escherichia coli | b3561 | [pn:hypothetical 37.6 kd protein in glyq-xylb intergenic region] |
| CONTIG509 | 16213568_f2_82 | 4276 | 9938 | 1194 | 398 | 1570 | 2.5(10)-161 | Escherichia coli | b3568 | [pn:xylose transport permease protein xylh] [gh:xylh] |
| CONTIG509 | 25400283_f2_83 | 4277 | 9939 | 1182 | 394 | 1762 | 1.1(10)-181 | Escherichia coli | b3569 | [pn:xylose operon regulatory protein] [gn:xylr] |
| CONTIG509 | 14069843_f2_87 | 4278 | 9940 | 1398 | 466 | 1914 | 9.0(10)-198 | Escherichia coli | b3572 | [pn:valine-pyruvate aminotransferase] [gn:avta] |
| CONTIG509 | 34645312_f2_91 | 4279 | 9941 | 1017 | 339 | 1599 | 2.2(10)-164 | Escherichia coli | b3575 | [pn:hypothetical protein] [gn:yiak] |
| CONTIG509 | 178442_f2_93 | 4280 | 9942 | 1359 | 453 | 464 | 4.0(10)-44 | Escherichia coli | b2246 | [pn:hypothetical protein] |
| CONTIG509 | 36066655_f2_97 | 4281 | 9943 | 921 | 307 | 1257 | 3.7(10)-128 | Escherichia coli | b3582 | [pn:hypothetical 33.7 kd protein in avta-selb intergenic region] [gn:yiar] |
| CONTIG509 | 251562_f2_100 | 4282 | 9944 | 1428 | 476 | 752 | 1.2(10)-74 | Escherichia coli | b3657 | [pn:hypothetical 51.0 kd protein in glts-selc intergenic region] [gn:yicj] |
| CONTIG509 | 35783391_f2_112 | 4283 | 9945 | 630 | 210 | 795 | 3.3(10)-79 | Escherichia coli | b3601 | [pn:mannitol operon repressor] [gn:mtlr] |
| CONTIG509 | 36503135_f2_123 | 4284 | 9946 | 951 | 317 | 1316 | 2.1(10)-134 | Escherichia coli | b3605 | [pn:lctd] [gn:lldd] |
| CONTIG509 | 188326_f3_148 | 4285 | 9947 | 2154 | 718 | 2820 | 8.8(10)-294 | Escherichia coli | b3571 | [pn:alpha-amylase] [gn:mals] |
| CONTIG509 | 7317883_f3_150 | 4286 | 9948 | 315 | 105 | 103 | 7.2(10)-6 | Escherichia coli | P37670 | hypothetical 11.9 kd protein in avta-selb intergenic region (o103). |
| CONTIG509 | 21932205_f3_152 | 4287 | 9949 | 663 | 221 | 673 | 2.8(10)-66 | Escherichia coli | b3576 | [pn:hypothetical 17.5 kd protein in avta-selb intergenic region] [gn:yiaj] |
| CONTIG509 | 12755693_f3_155 | 4288 | 9950 | 666 | 222 | 949 | 1.6(10)-95 | Escherichia coli | b3581 | [pn:hypothetical 23.4 kd protein in avta-selb intergenic region] [gn:yiaq] |
| CONTIG509 | 911390_f3_161 | 4289 | 9951 | 2007 | 669 | 172 | 9.0(10)-10 | Bacteroides ovatus | U15179 | or:bacteroides ovatus le:<1 re:1311 di:direct nt orf1 |
| CONTIG509 | 29767327_f3_162 | 4290 | 9952 | 492 | 164 | 207 | 6.9(10)-17 | Azospirillum brasilense | X70360 | or:azospirillum brasilense gn:carr le:59 re:580 di:direct nt:orf2 |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG509 | 24020078_f3_163 | 4291 | 9953 | 1032 | 344 | 228 | 8.5(10)-19 | Haemophilus influenzae | HI0182 | [pn:hypothetical protein] |
| CONTIG509 | 7147186_f3_174 | 4292 | 9954 | 1257 | 419 | 1561 | 2.2(10)-160 | Escherichia coli | b3600 | [pn:mannitol-1-phosphate dehydrogenase] [gn:mtld] |
| CONTIG509 | 260937_f3_176 | 4293 | 9955 | 441 | 147 | 496 | 1.6(10)-47 | Escherichia coli | b3602 | [pn:hypothetical 13.7 kd protein in mtlr-lctp intergenic region] [gn:yibl] |
| CONTIG509 | 25495182_f3_186 | 4294 | 9956 | 849 | 283 | 1100 | 1.6(10)-111 | Escherichia coli | b3604 | [pn:lctr] [gn:lldr] |
| CONTIG509 | 3160052_c1_222 | 4295 | 9957 | 825 | 275 | 139 | 2.2(10)-7 | Escherichia coli | b3906 | [pn:1-rhamnose operon transcriptional activator] [gn:rhar] |
| CONTIG509 | 4692912_c1_237 | 4296 | 9958 | 267 | 89 | 96 | 0.00011 | Escherichia coli | A27279 | valine-pyruvate transaminase (ec 2.6.1.66) - escherichia coli |
| CONTIG509 | 2081888_c1_242 | 4297 | 9959 | 891 | 297 | 1215 | 1.1(10)-123 | Escherichia coli | b3570 | [pn:hypothetical protein] [gn:bax] |
| CONTIG509 | 16220188_c1_265 | 4298 | 9960 | 645 | 215 | 828 | 1.1(10)-82 | Escherichia coli | b3848 | [pn:hypothetical 21.9 kd protein in pepq-trkh intergenic region] |
| CONTIG509 | 30116455_c1_267 | 4299 | 9961 | 663 | 221 | 662 | 4.2(10)-65 | Escherichia coli | b3850 | [pn:hypothetical protein] [gn:hcmg] |
| CONTIG509 | 36538375_c2_275 | 4300 | 9962 | 606 | 202 | 184 | 5.1(10)-14 | Escherichia coli | b0534 | [pn:hypothetical fimbrial-like protein in fimz 5'''' region] [gn:ybcg] |
| CONTIG509 | 21723250_c2_276 | 4301 | 9963 | 705 | 235 | 409 | 2.7(10)-38 | Escherichia coli | b3143 | [pn:hypothetical 25.7 kd fimbrial chaperone in agaI-mtr intergeni] [gn:yraj] |
| CONTIG509 | 2931558_c2_286 | 4302 | 9964 | 612 | 204 | 834 | 2.5(10)-83 | Escherichia coli | b3592 | [pn:hypothetical protein] [gn:yibf] |
| CONTIG509 | 9822892_c2_288 | 4303 | 9965 | 1866 | 622 | 2493 | 4.0(10)-259 | Escherichia coli | b3590 | [pn:selb] |
| CONTIG509 | 2939513_c2_307 | 4304 | 9966 | 879 | 293 | 1274 | 5.9(10)-130 | Escherichia coli | b3574 | [pn:hypothetical transcriptional regulator in avta-selb intergenic region] [gn:yiaj] |
| CONTIG509 | 22072201_c2_308 | 4305 | 9967 | 459 | 153 | 517 | 9.8(10)-50 | Escherichia coli | b3573 | [pn:hypothetical 17.5 kd protein in avta-selb intergenic region] |
| CONTIG509 | 913427_c3_325 | 4306 | 9968 | 1518 | 506 | 1955 | 4.0(10)-202 | Escherichia coli | b3564 | [pn:xylulose kinase] [gn:xylb] |
| CONTIG509 | 20817037_c3_326 | 4307 | 9969 | 939 | 313 | 1494 | 2.8(10)-153 | Escherichia coli | b3560 | [pn:glycine-trna synthetase, alpha subunit] [gn:glyq] |
| CONTIG509 | 4432338_c2_327 | 4308 | 9970 | 2079 | 693 | 3204 | 0 | Escherichia coli | b3559 | [pn:glycine-trna synthetase, beta subunit] [gn:glys] |
| CONTIG509 | 23886001_c2_333 | 4309 | 9971 | 1362 | 454 | 2160 | 7.7(10)-224 | Escherichia coli | b3847 | [pn:xaa-pro dipeptidase] [gn:pepq] |
| CONTIG509 | 3377258_c3_345 | 4310 | 9972 | 2544 | 848 | 1465 | 3.3(10)-150 | Escherichia coli | b3144 | [pn:hypothetical outer membrane usher protein in agaI-mtr intergenic region] [gn:yraj] |
| CONTIG509 | 4329717_c3_346 | 4311 | 9973 | 1104 | 368 | 144 | 1.5(10)-9 | Escherichia coli | b4318 | [pn:fimf protein precursor] [gn:fimf] |
| CONTIG509 | 32292527_c3_353 | 4312 | 9974 | 1644 | 548 | 1778 | 2.2(10)-183 | Escherichia coli | b3591 | [pn:1-seryl-trna] [gn:sela] |
| CONTIG509 | 4744642_c3_357 | 4313 | 9975 | 1641 | 547 | 2423 | 1.0(10)-251 | Escherichia coli | b3588 | [pn:aldehyde dehydrogenase b] [gn:aldb] |
| CONTIG509 | 24744803_c3_379 | 4314 | 9976 | 267 | 89 | 120 | 2.2(10)-7 | Escherichia coli | A27279 | valine-pyruvate transaminase (ec 2.6.1.66) - escherichia coli |
| CONTIG509 | 650966_c3_380 | 4315 | 9977 | 369 | 123 | 182 | 3.1(10)-14 | Escherichia coli | A27279 | valine-pyruvate transaminase (ec 2.6.1.66) - escherichia coli |
| CONTIG509 | 4739012_c3_392 | 4316 | 9978 | 1410 | 470 | 2209 | 4.9(10)-229 | Escherichia coli | b3565 | [pn:d-xylose isomerase] [gn:xyla] |
| CONTIG509 | 26750802_c3_408 | 4317 | 9979 | 1473 | 491 | 1941 | 1.2(10)-200 | Escherichia coli | b3849 | [pn:trkh] |
| CONTIG51 | 4892893_c1_3 | 4318 | 9980 | 297 | 99 | 239 | 2.7(10)-20 | Escherichia coli | b1825 | [pn:hypothetical protein] |
| CONTIG510 | 22735807_f1_2 | 4319 | 9981 | 516 | 172 | 424 | 7.0(10)-40 | Escherichia coli | b3929 | [pn:menaquinone biosynthesis protein meng] [gn:meng] |
| CONTIG510 | 22634682_f1_25 | 4320 | 9982 | 702 | 234 | 977 | 1.8(10)-98 | Escherichia coli | b3912 | [pn:transcriptional regulatory protein] [gn:cpxr] |
| CONTIG510 | 16015963_f1_28 | 4321 | 9983 | 1020 | 340 | 270 | 1.5(10)-23 | Escherichia coli | M85158 | or:escherichia coli gn:soda le;<1 re:225 di:direct sr:escherichia coli (strain k-12) (library: lambda from kohara et al |
| CONTIG510 | 23835200_f1_29 | 4322 | 9984 | 1149 | 383 | 1420 | 2.0(10)-145 | Escherichia coli | b3907 | [pn:rhamnose permease] [gn:rhat] |
| CONTIG510 | 7212781_f1_59 | 4323 | 9985 | 591 | 197 | 914 | 8.3(10)-92 | Escherichia coli | b3894 | [pn:formate dehydrogenase-o, major subunit] [gn:fdog] |
| CONTIG510 | 14555411_f1_60 | 4324 | 9986 | 2463 | 821 | 3796 | 0 | Escherichia coli | b3894 | [pn:formate dehydrogenase-o, major subunit] [gn:fdog] |
| CONTIG510 | 2992841_f1_61 | 4325 | 9987 | 915 | 305 | 1496 | 1.8(10)-153 | Escherichia coli | b3893 | [pn:formate dehydrogenase-o, iron-sulfur subunit] [gn:fdoh] |
| CONTIG510 | 5197193_f1_72 | 4326 | 9988 | 879 | 293 | 1225 | 9.1(10)-125 | Escherichia coli | b3881 | [pn:hypothetical 32 kd protein in glna-fdhe intergenic region] |
| CONTIG510 | 55413_f1_75 | 4327 | 9989 | 2037 | 679 | 3041 | 0 | Escherichia coli | b3878 | [pn:hypothetical 77.2 kd protein in glna-fdhe intergenic region] |
| CONTIG510 | 16119418_f1_76 | 4328 | 9990 | 1425 | 475 | 2125 | 3.8(10)-220 | Escherichia coli | b3877 | [pn:hypothetical 51.7 kd protein in glna-fdhe intergenic region] |
| CONTIG510 | 33862917_f1_80 | 4329 | 9991 | 783 | 261 | 840 | 5.7(10)-84 | Escherichia coli | b3875 | [pn:hypothetical protein] |
| CONTIG510 | 19782067_f1_85 | 4330 | 9992 | 1455 | 485 | 2353 | 2.7(10)-244 | Escherichia coli | b3870 | [pn:glutamine synthetase] [gn:glna] |
| CONTIG510 | 14875927_f2_92 | 4331 | 9993 | 927 | 309 | 1244 | 8.9(10)-127 | Escherichia coli | b3930 | [pn:menaquinone biosynthesis protein mcna] [gn:mcna] |
| CONTIG510 | 412557_f2_95 | 4332 | 9994 | 873 | 291 | 1060 | 2.7(10)-107 | Escherichia coli | b3927 | [pn:glycerol uptake facilitator protein] [gn:glpf] |
| CONTIG510 | 35707880_f2_96 | 4333 | 9995 | 1530 | 510 | 2456 | 3.2(10)-255 | Escherichia coli | b3926 | [pn:glycerol kinase] [gn:glpk] |
| CONTIG510 | 20910700_f2_97 | 4334 | 9996 | 1026 | 342 | 1516 | 1.3(10)-155 | Escherichia coli | b3925 | [pn:glpx protein] [gn:glpx] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG510 | 14664712_f2_98 | 4335 | 9997 | 774 | 258 | 1179 | 6.9(10)-120 | Escherichia coli | b3924 | [pn:ferredoxin—nadp reductase] [gn:fpr] |
| CONTIG510 | 32422943_f2_118 | 4336 | 9998 | 1272 | 424 | 1966 | 2.7(10)-203 | Escherichia coli | b3903 | [pn:1-rhamnose isomerase] [gn:rhaa] |
| CONTIG510 | 12975937_f2_119 | 4337 | 9999 | 927 | 309 | 1331 | 5.4(10)-136 | Escherichia coli | b3902 | [pn:rhamnulose-1-phosphate aldolase] [gn:rhad] |
| CONTIG510 | 35444752_f2_125 | 4338 | 10000 | 1272 | 424 | 391 | 2.2(10)-36 | Bacillus subtilis | rbsC | [pn:ribose abc transporter] |
| CONTIG510 | 16666393_f2_127 | 4339 | 10001 | 342 | 114 | 507 | 1.1(10)-48 | Escherichia coli | b3901 | [pn:hypothetical 12.3 kd protein in rhad 3'" region] [gn:yiii] |
| CONTIG510 | 31283452_f2_146 | 4340 | 10002 | 930 | 310 | 1369 | 5.0(10)-140 | Escherichia coli | b3891 | [pn:fdhe protein] [gn:fdhe] |
| CONTIG510 | 892542_f2_147 | 4341 | 10003 | 954 | 318 | 329 | 8.1(10)-30 | Escherichia coli | b0476 | [pn:hypothetical protein in hemh-gsk intergenic region] [gn:ybac] |
| CONTIG510 | 36214211_f2_151 | 4342 | 10004 | 903 | 301 | 1165 | 2.1(10)-118 | Escherichia coli | b3882 | [pn:hypothetical 31.2 kd protein in glna-fdhe intergenic region] |
| CONTIG510 | 4416318_f2_158 | 4343 | 10005 | 1434 | 478 | 1907 | 4.9(10)-197 | Escherichia coli | b3876 | [pn:hypothetical protein] |
| CONTIG510 | 7225312_f2_163 | 4344 | 10006 | 1431 | 477 | 2103 | 8.4(10)-218 | Escherichia coli | b3868 | [pn:glnl] [gn:glnl] |
| CONTIG510 | 2166605_f3_165 | 4345 | 10007 | 303 | 101 | 413 | 1.1(10)-38 | Escherichia coli | b3931 | [pn:heat shock protein hslu] [gn:hslu] |
| CONTIG510 | 17085216_f3_174 | 4346 | 10008 | 615 | 205 | 666 | 1.6(10)-65 | Escherichia coli | b3920 | [pn:hypothetical 21.8 kd protein in tpia 3''' region precursor] [gn:tpia] |
| CONTIG510 | 4964458_f3_175 | 4347 | 10009 | 783 | 261 | 1130 | 1.1(10)-114 | Escherichia coli | b3919 | [pn:triosephosphate isomerase] [gn:tpia] |
| CONTIG510 | 10637644_f3_188 | 4348 | 10010 | 1434 | 478 | 1806 | 2.5(10)-186 | Escherichia coli | b3911 | [pn:cpxa] [gn:cpxa] |
| CONTIG510 | 33796877_f3_194 | 4349 | 10011 | 1707 | 569 | 2017 | 1.1(10)-208 | Escherichia coli | b3904 | [pn:rhamnulokinase] [gn:rhab] |
| CONTIG510 | 23939402_f3_198 | 4350 | 10012 | 1083 | 361 | 491 | 5.5(10)-47 | Escherichia coli | b1516 | [pn:hypothetical protein] |
| CONTIG510 | 34632782_f3_199 | 4351 | 10013 | 1521 | 507 | 1076 | 5.7(10)-109 | Escherichia coli | b3749 | [pn:high affinity ribose transport] [gn:rbsa] |
| CONTIG510 | 10422077_f3_200 | 4352 | 10014 | 1005 | 335 | 414 | 8.0(10)-39 | Escherichia coli | b3750 | [pn:high affinity ribose transport] [gn:rbsc] |
| CONTIG510 | 4964675_f3_202 | 4353 | 10015 | 1164 | 388 | 850 | 5.0(10)-85 | Escherichia coli | b3589 | [pn:hypothetical 40.2 kd protein in avta-selb intergenic region] [gn:yiay] |
| CONTIG510 | 24642887_f3_211 | 4354 | 10016 | 666 | 222 | 172 | 3.5(10)-13 | Streptomyces coelicolor | AL020958 | [de:streptomyces coelicolor cosmid 4h8.] [pn:hypothetical protein sc4h8.02] [gn:sc4h8.02] [nt:sc4h8.02, possible membrane |
| CONTIG510 | 32304817_f3_221 | 4355 | 10017 | 657 | 219 | 999 | 8.1(10)-101 | Escherichia coli | b3892 | [pn:formate dehydrogenase, cytochrome b556] [gn:fdoi] |
| CONTIG510 | 12978333_c1_273 | 4356 | 10018 | 1287 | 429 | 1880 | 3.6(10)-194 | Escherichia coli | b3880 | [pn:hypothetical 48 kd protein in glna-fdhe intergenic region] |
| CONTIG510 | 15829202_c1_289 | 4357 | 10019 | 1050 | 350 | 1609 | 1.8(10)-165 | Escherichia coli | b3869 | [pn:glnl] [gn:glnl] |
| CONTIG510 | 7166507_c1_252 | 4358 | 10020 | 1485 | 495 | 2205 | 1.3(10)-228 | Escherichia coli | b3867 | [pn:oxygen-independent coproporphyrinogen iii oxidase] [gn:hemn] |
| CONTIG510 | 3620141_c1_256 | 4359 | 10021 | 969 | 323 | 311 | 1.3(10)-27 | Transposon mini-Tn3Cm | M84113 | or:transposon mini-tn3cm le:30 re:1508 di:complement sr:transposon mini-tn3cm dna; neisseria gonorrhoeae (strain ms11) dna nt:orf1 |
| CONTIG510 | 31847192_c1_257 | 4360 | 10022 | 570 | 190 | 257 | 1.5(10)-21 | Transposon mini-Tn3Cm | M84113 | or:transposon mini-tn3cm le:30 re:1508 di:complement sr:transposon mini-tn3cm dna; neisseria gonorrhoeae (strain ms11) dna nt:orf1 |
| CONTIG510 | 1966051_c1_271 | 4361 | 10023 | 654 | 218 | 813 | 4.2(10)-81 | Escherichia coli | b3885 | [pn:hypothetical 23.5 kd protein in glna-fdhe intergenic region] |
| CONTIG510 | 12978333_c1_273 | 4362 | 10024 | 1092 | 364 | 1480 | 8.8(10)-152 | Escherichia coli | b3888 | [pn:hypothetical 37.1 kd protein in glna-fdhe intergenic region] |
| CONTIG510 | 15829202_c1_289 | 4363 | 10025 | 1401 | 467 | 1892 | 1.8(10)-195 | Enterobacter cloacae | AB000622 | or:enterobacter cloacae pn:mely gn:mely le:481 re:1758 di:direct sr:enterobacter cloacae |
| CONTIG510 | 3963265_c1_303 | 4364 | 10026 | 879 | 293 | 1050 | 3.2(10)-106 | Escherichia coli | b3906 | [pn:1-rhamnose operon transcriptional activator] [gn:rhar] |
| CONTIG510 | 31884586_c1_305 | 4365 | 10027 | 654 | 218 | 1074 | 9.1(10)-109 | Escherichia coli | b3908 | [pn:manganese superoxide dismutase] [gn:soda] |
| CONTIG510 | 1026_c1_306 | 4366 | 10028 | 705 | 235 | 966 | 2.6(10)-97 | Escherichia coli | b3910 | [pn:hypothetical 26.6 kd protein in kdgt-cpxa intergenic region] [gn:yiim] |
| CONTIG510 | 5910626_c1_308 | 4367 | 10029 | 603 | 201 | 491 | 5.5(10)-47 | Escherichia coli | b3914 | [pn:hypothetical 14.4 kd protein in cpxa-pfka intergenic region] |
| CONTIG510 | 4579541_c1_309 | 4368 | 10030 | 909 | 303 | 1289 | 1.5(10)-131 | Escherichia coli | b3915 | [pn:hypothetical 32.9 kd protein in cpxa-pfka intergenic region] |
| CONTIG510 | 14119712_c2_326 | 4369 | 10031 | 282 | 94 | 198 | 6.2(10)-16 | Escherichia coli | b3866 | [pn:hypothetical 19.1 kd protein in pola-hemn intergenic region] |
| CONTIG510 | 25671932_c2_346 | 4370 | 10032 | 948 | 316 | 1040 | 3.7(10)-105 | Escherichia coli | b3883 | [pn:hypothetical 31.9 kd protein in glna-fdhe intergenic region] |
| CONTIG510 | 34100937_c2_351 | 4371 | 10033 | 462 | 154 | 698 | 6.4(10)-69 | Escherichia coli | b3887 | [pn:hypothetical 15.9 kd protein in glna-fdhe intergenic region] |
| CONTIG510 | 16688843_c2_366 | 4372 | 10034 | 1062 | 354 | 1031 | 3.2(10)-104 | Escherichia coli | A35160 | repressor protein rafr - escherichia coli |
| CONTIG510 | 24426430_c2_367 | 4373 | 10035 | 2229 | 743 | 2766 | 4.7(10)-288 | Escherichia coli | P16551 | alpha-galactosidase (ec 3.2.1.22) (melibiase). |
| CONTIG510 | 4410252_c2_395 | 4374 | 10036 | 1095 | 365 | 1462 | 7.0(10)-150 | Escherichia coli | b3916 | [pn:6-phosphofructokinase] [gn:pfka] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG510 | 33260055_c2_396 | 4375 | 10037 | 1050 | 350 | 1469 | 1.3(10)-150 | Escherichia coli | b3917 | [pn:periplasmic sulphate binding protein] [gn:sbp] |
| CONTIG510 | 31894063_c2_397 | 4376 | 10038 | 819 | 273 | 941 | 1.1(10)-94 | Escherichia coli | b3918 | [pn:cdp-diglyceride hydrolase] [gn:cdh] |
| CONTIG510 | 5914043_c3_418 | 4377 | 10039 | 1833 | 611 | 2757 | 4.2(10)-287 | Escherichia coli | b3871 | [pn:65.4 kd gtp-binding protein in glna-fdhe intergenic region] [gn:yihw] |
| CONTIG510 | 34163512_c3_431 | 4378 | 10040 | 912 | 304 | 1066 | 6.5(10)-108 | Escherichia coli | b3884 | [pn:hypothetical transcriptional regulator in glna-fdhe intergenic region] [gn:yihw] |
| CONTIG510 | 20969180_c3_432 | 4379 | 10041 | 951 | 317 | 997 | 1.3(10)-100 | Escherichia coli | b3886 | [pn:hypothetical 32.8 kd protein in glna-fdhe intergenic region] [gn:yihw] |
| CONTIG510 | 30100280_c3_448 | 4380 | 10042 | 912 | 304 | 1110 | 1.3(10)-112 | Escherichia coli | b3895 | [pn:fdhc protein] [gn:fdhd] |
| CONTIG510 | 818893_c3_449 | 4381 | 10043 | 279 | 93 | 97 | 3.1(10)-5 | Escherichia coli | b0802 | [pn:hypothetical 8.6 kd protein in ding/rarb 3"" region] [gn:ybij] |
| CONTIG510 | 14704431_c3_452 | 4382 | 10044 | 642 | 214 | 168 | 9.4(10)-13 | Escherichia coli | b1434 | [pn:hypothetical protein] |
| CONTIG510 | 10156438_c3_483 | 4383 | 10045 | 864 | 288 | 1052 | 2.0(10)-106 | Escherichia coli | b3905 | [pn:1-rhamnose operon regulatory protein rhas] [gn:rhas] |
| CONTIG510 | 22281562_c3_494 | 4384 | 10046 | 1326 | 442 | 204 | 9.0(10)-14 | Methanobacterium thermoautotrophicum | MTH788 | [pn:sodium/dicarboxylate or sulfate cotransporter] |
| CONTIG510 | 20570300_c3_498 | 4385 | 10047 | 501 | 167 | 546 | 8.3(10)-53 | Escherichia coli | b3921 | [pn:hypothetical 16.5 kd protein in tpia-fpr intergenic region] [gn:yiir] |
| CONTIG510 | 519167_c3_509 | 4386 | 10048 | 273 | 91 | 362 | 2.6(10)-33 | Escherichia coli | b3928 | [pn:hypothetical 9.6 kd protein in glpf-hslu intergenic region] [gn:yiiu] |
| CONTIG511 | 31835915_f1_2 | 4387 | 10049 | 3219 | 1073 | 2383 | 1.8(10)-247 | Burkholderia cepacia | U97042 | ceob,, ceob, similar to cytoplasmic membrane protein of the rnd |
| CONTIG511 | 17070152_f1_9 | 4388 | 10050 | 855 | 285 | 159 | 4.7(10)-10 | Escherichia coli | b1782 | [pn:hypothetical protein] |
| CONTIG511 | 29320338_f1_13 | 4389 | 10051 | 903 | 301 | 316 | 1.8(10)-28 | Escherichia coli | b2409 | [pn:hypothetical protein] |
| CONTIG511 | 2677253_f1_30 | 4390 | 10052 | 1308 | 436 | 1961 | 9.4(10)-203 | Escherichia coli | b2497 | [pn:uracil permease] [gn:uraa] |
| CONTIG511 | 31647632_f1_31 | 4391 | 10053 | 744 | 248 | 1118 | 2.0(10)-113 | Escherichia coli | b2496 | [pn:phosphoribosylaminoimidazole-succinocarboxamide synthase] [gn:purc] |
| CONTIG511 | 4335802_f1_48 | 4392 | 10054 | 744 | 248 | 1185 | 1.6(10)-120 | Escherichia coli | b2476 | [pn:hypothetical protein] |
| CONTIG511 | 1229775_f1_49 | 4393 | 10055 | 882 | 294 | 1223 | 1.5(10)-124 | Escherichia coli | b2475 | [pn:hypothetical protein] |
| CONTIG511 | 900837_f1_52 | 4394 | 10056 | 804 | 268 | 1024 | 1.8(10)-103 | Escherichia coli | b2473 | [pn:hypothetical protein] [gn:ypfh] |
| CONTIG511 | 3159432_f1_64 | 4395 | 10057 | 2058 | 686 | 2749 | 2.8(10)-286 | Escherichia coli | b2468 | [pn:hypothetical 71.8 kd protein in tktb-narq intergenic region] [gn:yffg] |
| CONTIG511 | 25648456_f1_72 | 4396 | 10058 | 2304 | 768 | 3460 | 0 | Escherichia coli | b2463 | [pn:hypothetical protein] |
| CONTIG511 | 23954386_f1_74 | 4397 | 10059 | 525 | 175 | 707 | 7.2(10)-70 | Escherichia coli | b2434 | [pn:hypothetical protein] |
| CONTIG511 | 4772706_f1_77 | 4398 | 10060 | 948 | 316 | 1451 | 1.0(10)-148 | Escherichia coli | b2431 | [pn:sulfate transport system permease protein cyst] [gn:cysu] |
| CONTIG511 | 1563467_f1_79 | 4399 | 10061 | 837 | 279 | 1110 | 1.3(10)-112 | Escherichia coli | b2424 | [pn:sulfate transport system permease protein cysa] [gn:cysa] |
| CONTIG511 | 2487842_f1_80 | 4400 | 10062 | 1131 | 377 | 1677 | 1.2(10)-172 | Escherichia coli | b2422 | [pn:sulfate transport atp-binding protein cysa] [gn:cysa] |
| CONTIG511 | 792317_f1_81 | 4401 | 10063 | 873 | 291 | 986 | 2.0(10)-99 | Escherichia coli | b2418 | [pn:hypothetical protein] [gn:pdxk] |
| CONTIG511 | 1003595_f1_83 | 4402 | 10064 | 282 | 94 | 92 | 0.00169 | Homo sapiens | U78554 | [PN:mucin] [GN:MUC5B] [SR:human] [DE:homo sapiens mucin (MUC5B) gene, 3 exons, partial cds.] [LE:U78552:<1:U78553:266:U78553:733] [RE:526:447:904] [DI:direct Join] |
| CONTIG511 | 4866582_f2_85 | 4403 | 10065 | 1275 | 425 | 437 | 2.8(10)-41 | Escherichia coli | b0463 | [pn:acriflavin resistance protein a precursor] [gn:acra] |
| CONTIG511 | 4551528_f2_96 | 4404 | 10066 | 2379 | 793 | 2181 | 4.5(10)-226 | Escherichia coli | b2503 | [pn:hypothetical protein] |
| CONTIG511 | 36025316_f2_102 | 4405 | 10067 | 1434 | 478 | 1667 | 1.3(10)-171 | Escherichia coli | b2901 | [pn:6-phospho-beta-glucosidase bgla] [gn:bgla] |
| CONTIG511 | 22355137_f2_111 | 4406 | 10068 | 891 | 297 | 153 | 6.7(10)-9 | Shewanella sp. SCRC-2738 | U73935 | [de:shewanella sp. scrc-2738 etcosapentaenoic acid (epa) synthesis genecluster, complete sequence] [pn:unknown] [nt:orf4] |
| CONTIG511 | 10000668_f2_120 | 4407 | 10069 | 906 | 302 | 1390 | 3.0(10)-142 | Escherichia coli | b2478 | [pn:dihydrodipicolinate synthase] [gn:dapa] |
| CONTIG511 | 261305_f2_139 | 4408 | 10070 | 291 | 97 | 117 | 3.5(10)-6 | Escherichia coli | L34011 | or:escherichia coli pn:fe-s center and glutamate synthase (gltd) gn:acg53.0 le:239 re:2197 di:direct sr:escherichia coli (individual_isolate mc4100, strain k-12) (library |
| CONTIG511 | 864182_f2_140 | 4409 | 10071 | 621 | 207 | 795 | 3.3(10)-79 | Escherichia coli | b2467 | [pn:hypothetical 21.7 kd protein in tktb-narq intergenic region] [gn:yffh] |
| CONTIG511 | 24651580_f2_152 | 4410 | 10072 | 456 | 152 | 531 | 3.2(10)-51 | Escherichia coli | b2433 | [pn:hypothetical protein] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG511 | 114787_f2_153 | 4411 | 10073 | 639 | 213 | 700 | 4.0(10)-69 | Escherichia coli | b2432 | [pn:hypothetical protein] |
| CONTIG511 | 4817593_f2_155 | 4412 | 10074 | 1023 | 341 | 1482 | 5.4(10)-152 | Escherichia coli | b2425 | [pn:thiosulfate-binding protein precursor] [gn:cysP] |
| CONTIG511 | 6289053_f2_160 | 4413 | 10075 | 921 | 307 | 1385 | 1.0(10)-141 | Escherichia coli | b2421 | [pn:cysteine synthase b] [gn:cysM] |
| CONTIG511 | 6025325_f3_197 | 4414 | 10076 | 723 | 241 | 1036 | 9.8(10)-105 | Escherichia coli | b2498 | [pn:uracil phosphoribosyltransferase] [gn:upp] |
| CONTIG511 | 14070177_f3_210 | 4415 | 10077 | 1113 | 371 | 1299 | 1.3(10)-132 | Escherichia coli | b2493 | [pn:hypothetical protein] [gn:perm] |
| CONTIG511 | 5079818_f3_212 | 4416 | 10078 | 1044 | 348 | 1537 | 8.0(10)-158 | Escherichia coli | b2477 | [pn:lipoprotein-34 precursor] [gn:nlpB] |
| CONTIG511 | 22906410_f3_214 | 4417 | 10079 | 1968 | 656 | 2029 | 8.0(10)-210 | Escherichia coli | b2474 | [pn:hypothetical protein] [gn:ypfI] |
| CONTIG511 | 5173152_f3_229 | 4418 | 10080 | 1134 | 378 | 1351 | 4.0(10)-138 | Escherichia coli | b2466 | [pn:hypothetical protein] |
| CONTIG511 | 24344411_f3_243 | 4419 | 10081 | 918 | 306 | 1325 | 2.2(10)-135 | Escherichia coli | P16702 | sulfate transport system permease protein cysW. |
| CONTIG511 | 30603817_c1_249 | 4420 | 10082 | 456 | 152 | 719 | 3.7(10)-71 | Escherichia coli | b2416 | [pn:phosphoenolpyruvate-protein phosphotransferase] [gn:ptsI] |
| CONTIG511 | 2598452_c1_280 | 4421 | 10083 | 387 | 129 | 115 | 3.8(10)-7 | Escherichia coli | P37670 | [pn:hypothetical 11.9 kd protein in avtA-selb intergenic region (o103). |
| CONTIG511 | 36130181_c1_297 | 4422 | 10084 | 591 | 197 | 853 | 2.3(10)-85 | Escherichia coli | b2479 | [pn:gcvr] |
| CONTIG511 | 16540667_c1_302 | 4423 | 10085 | 462 | 154 | 488 | 1.2(10)-46 | Escherichia coli | b2495 | [pn:hypothetical protein] |
| CONTIG511 | 4492202_c1_313 | 4424 | 10086 | 696 | 232 | 935 | 5.0(10)-94 | Escherichia coli | b2500 | [pn:phosphoribosylglycinamidine myltransferase] [gn:purm] |
| CONTIG511 | 10268093_c1_324 | 4425 | 10087 | 537 | 179 | 104 | 3.2(10)-5 | Bacillus subtilis | yhdE | [pn:hypothetical protein] |
| CONTIG511 | 4339088_c2_334 | 4426 | 10088 | 519 | 173 | 577 | 4.2(10)-56 | Haemophilus influenzae | HI1711 | [pn:glucose phosphotransferase enzyme iii-glc] [gn:crr] |
| CONTIG511 | 16289055_c2_349 | 4427 | 10089 | 927 | 309 | 1468 | 1.6(10)-150 | Escherichia coli | b2436 | [pn:coproporphyrinogen iii oxidase] [gn:hemF] |
| CONTIG511 | 156276_c2_355 | 4428 | 10090 | 975 | 325 | 1380 | 3.5(10)-141 | Escherichia coli | b2464 | [pn:hypothetical protein] [gn:tala] |
| CONTIG511 | 34176402_c2_371 | 4429 | 10091 | 384 | 128 | 480 | 8.0(10)-46 | Escherichia coli | b2471 | [pn:hypothetical 13.6 kd protein in dape 5"" region] [gn:yffb] |
| CONTIG511 | 30165880_c2_372 | 4430 | 10092 | 1131 | 377 | 1862 | 2.8(10)-192 | Escherichia coli | b2472 | [pn:succinyl-diaminopimelate desuccinylase] [gn:dape] |
| CONTIG511 | 29900316_c2_373 | 4431 | 10093 | 201 | 67 | 192 | 2.7(10)-15 | Escherichia coli | D90875 | or.escherichia coli (strain:kl2) dna, clone_lib:kohara lambda minise nt:similar to [pir accession number d42959] |
| CONTIG511 | 5109818_c2_392 | 4432 | 10094 | 1428 | 476 | 614 | 5.0(10)-60 | Haemophilus influenzae | HI1705 | [pn:aminopeptidase a/i] [gn:pepa] |
| CONTIG511 | 23947283_c2_399 | 4433 | 10095 | 1041 | 347 | 1603 | 8.0(10)-165 | Escherichia coli | b2499 | [pn:phosphoribosylformylglycinamidine cyclo-ligase] [gn:purm] |
| CONTIG511 | 3636008_c2_402 | 4434 | 10096 | 2067 | 689 | 3137 | 0 | Escherichia coli | b2501 | [pn:polyphosphate kinase] [gn:ppk] |
| CONTIG511 | 4790881_c2_403 | 4435 | 10097 | 1542 | 514 | 2265 | 5.7(10)-235 | Escherichia coli | b2502 | [pn:exopolyphosphatase] [gn:ppx] |
| CONTIG511 | 12360706_c2_408 | 4436 | 10098 | 225 | 75 | 189 | 5.5(10)-15 | Escherichia coli | b2504 | [pn:hypothetical protein] |
| CONTIG511 | 26600312_c2_410 | 4437 | 10099 | 1236 | 412 | 91 | 0.28 | Escherichia coli | b0045 | [pn:hypothetical metabolite transport protein in carb-kefc intergenic region] [gn:yaau] |
| CONTIG511 | 31752035_c2_413 | 4438 | 10100 | 1407 | 469 | 296 | 1.5(10)-24 | Escherichia coli | b2078 | [pn:sensor protein baes] [gn:baes] |
| CONTIG511 | 14120812_c2_423 | 4439 | 10101 | 321 | 107 | 237 | 4.5(10)-20 | Escherichia coli | b1531 | [pn:multiple antibiotic resistance protein] [gn:mara] |
| CONTIG511 | 12323286_c3_437 | 4440 | 10102 | 909 | 303 | 1262 | 1.1(10)-128 | Escherichia coli | b2435 | [pn:probable n-acetylmuramoyl-1-alanine amidase] [gn:amia] |
| CONTIG511 | 31728382_c3_444 | 4441 | 10103 | 1992 | 664 | 3150 | 0 | Escherichia coli | b2465 | [pn:transketolase 2] [gn:tktb] |
| CONTIG511 | 23488453_c3_449 | 4442 | 10104 | 1695 | 565 | 1836 | 1.7(10)-189 | Escherichia coli | b2469 | [pn:nitrate/nitrite sensor protein] [gn:narq] |
| CONTIG511 | 24351016_c3_450 | 4443 | 10105 | 3141 | 1047 | 4723 | 0 | Escherichia coli | b2470 | [pn:acriflavin resistance protein d] [gn:acrd] |
| CONTIG511 | 12306553_c3_464 | 4444 | 10106 | 474 | 158 | 808 | 1.3(10)-80 | Escherichia coli | b2480 | [pn:bacterioferritin comigratory protein] [gn:bcp] |
| CONTIG511 | 24397576_c3_467 | 4445 | 10107 | 1632 | 544 | 2010 | 6.0(10)-208 | Escherichia coli | b2494 | [pn:hypothetical protein] |
| CONTIG511 | 12578456_c3_471 | 4446 | 10108 | 1407 | 469 | 846 | 2.3(10)-84 | Bacillus subtilis | ywbA | [pn:hypothetical protein] [gn:ipa-16d] |
| CONTIG511 | 36572167_c3_472 | 4447 | 10109 | 960 | 320 | 287 | 2.2(10)-25 | Escherichia coli | b0828 | [pn:hypothetical protein in moea-grxa intergenic region] [gn:ybik] |
| CONTIG511 | 2035_c3_492 | 4448 | 10110 | 729 | 243 | 375 | 1.1(10)-34 | Haemophilus influenzae | HI1708 | [pn:transcriptional regulatory protein] |
| CONTIG512 | 32516252_f1_1 | 4449 | 10111 | 999 | 333 | 1465 | 3.3(10)-150 | Escherichia coli | b2615 | [pn:hypothetical 32.6 kd protein in grpc-recn intergenic region] |
| CONTIG512 | 2431957_f1_15 | 4450 | 10112 | 1290 | 430 | 146 | 1.3(10)-7 | Bacillus subtilis | yxlH | [pn:hypothetical protein] |
| CONTIG512 | 11722677_f1_16 | 4451 | 10113 | 1383 | 461 | 656 | 1.8(10)-64 | Methanobacterium thermoautotrophicum | MTH225 | [pn:histidinol dehydrogenase] |
| CONTIG512 | 3244033_f1_17 | 4452 | 10114 | 768 | 256 | 302 | 5.9(10)-27 | Escherichia coli | b2842 | [pn:2-deoxy-d-gluconate 3-dehydrogenase] [gn:kdud] |
| CONTIG512 | 4884682_f1_37 | 4453 | 10115 | 921 | 307 | 431 | 1.3(10)-40 | Escherichia coli | b0900 | [pn:hypothetical protein] [gn:ycan] |
| CONTIG512 | 4567957_f1_45 | 4454 | 10116 | 309 | 103 | 101 | 0.00017 | Nicotiana tabacum | P13983 | extensin precursor (cell wall hydroxyproline-rich glycoprotein). |
| CONTIG512 | 13022331_f1_51 | 4455 | 10117 | 237 | 79 | 99 | 1.8(10)-5 | Drosophila melanogaster | X13625 | or.drosophila melanogaster sp.:p13008 le:58 re:398 di:direct |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG512 | 4507693_f1_54 | 4456 | 10118 | 1413 | 471 | 166 | 2.5(10)-9 | Escherichia coli | b3035 | sr:fruit fly nt:put. ribosomal protein [pn:tolc] [gn:tolc] |
| CONTIG512 | 2432967_f1_56 | 4457 | 10119 | 342 | 114 | 102 | 2.2(10)-5 | Orf virus | C34768 | orf2 protein - orf virus (strain nz2) |
| CONTIG512 | 6382182_f1_58 | 4458 | 10120 | 1251 | 417 | 293 | 1.3(10)-25 | Bordetella pertussis | P11091 | cyad protein |
| CONTIG512 | 1042883_f2_94 | 4459 | 10121 | 1782 | 594 | 2335 | 2.2(10)-242 | Escherichia coli | b2616 | [pn:recn] [gn:recn] |
| CONTIG512 | 2984158_f2_95 | 4460 | 10122 | 378 | 126 | 244 | 8.3(10)-21 | Haemophilus influenzae | HI0838 | [pn:hypothetical protein] |
| CONTIG512 | 16145763_f2_114 | 4461 | 10123 | 834 | 278 | 302 | 5.9(10)-27 | Escherichia coli | b2245 | [pn:hypothetical protein] |
| CONTIG512 | 24847006_f2_122 | 4462 | 10124 | 1950 | 650 | 265 | 2.0(10)-27 | Escherichia coli | b3533 | [pn:hypothetical 101.6 kd protein in dcta-dppf intergenic region] |
| CONTIG512 | 32451778_f2_127 | 4463 | 10125 | 2727 | 909 | 520 | 2.6(10)-63 | Escherichia coli | b2786 | [pn:sensor protein bara] [gn:bara] |
| CONTIG512 | 15822183_f2_131 | 4464 | 10126 | 468 | 156 | 108 | 6.0(10)-5 | Helicobacter pylori | HP0357 | [pn:short chain alcohol dehydrogenase] |
| CONTIG512 | 22738922_f2_156 | 4465 | 10127 | 387 | 129 | 225 | 8.5(10)-19 | Haemophilus influenzae | HI1250 | [pn:hypothetical protein] |
| CONTIG512 | 12925816_f2_164 | 4466 | 10128 | 276 | 92 | 100 | 0.00033 | Caenorhabditis elegans | Z81518 | [de:caenorhabditis elegans cosmid f28d9, complete sequence.] [pn:f28d9.a] [nt:protein predicted using genefinder; preliminary] |
| CONTIG512 | 16103408_f2_166 | 4467 | 10129 | 924 | 308 | 385 | 9.5(10)-36 | Escherichia coli | b0254 | [pn:peroxide resistance protein perr] [gn:perr] |
| CONTIG512 | 10025462_f2_170 | 4468 | 10130 | 891 | 297 | 95 | 0.016 | Plasmodium falciparum | M13987 | or:plasmodium falciparum (strain 7g8) pn:histidine-rich protein le:<23 re:679 di:direct sr:p. falciparum pn:histidine-rich protein clone pfhrp-iii |
| CONTIG512 | 33723390_f3_178 | 4469 | 10131 | 984 | 328 | 1370 | 4.0(10)-140 | Escherichia coli | b0316 | [pn:hypothetical protein] [gn:yahb] |
| CONTIG512 | 13713887_f3_187 | 4470 | 10132 | 513 | 171 | 768 | 2.5(10)-76 | Escherichia coli | b2620 | [pn:small protein b] [gn:smpb] |
| CONTIG512 | 14164827_f3_188 | 4471 | 10133 | 588 | 196 | 395 | 8.3(10)-37 | Escherichia coli | b2622 | [pn:slpa integrase] [gn:inta] |
| CONTIG512 | 26589591_f3_201 | 4472 | 10134 | 774 | 258 | 92 | 0.04499 | Escherichia coli | b3412 | [pn:bioh] [pn:bioh] |
| CONTIG512 | 6298291_f3_209 | 4473 | 10135 | 306 | 102 | 90 | 0.00059 | Aedes densovirus | C40784 | hypothetical protein 2 - aedes densovirus (strain gkv 002002) |
| CONTIG512 | 4453208_f3_218 | 4474 | 10136 | 2277 | 759 | 110 | 0.0028 | Escherichia coli | b1617 | [pn:beta-d-glucuronidase] [gn:uida] |
| CONTIG512 | 9772307_f3_224 | 4475 | 10137 | 11517 | 3839 | 681 | 9.8(10)-77 | Acinetobacter calcoaceticus | AF011339 | [PN:unknown] [DE:Acinetobacter calcoaceticus unknown protein gene, partial cds] [LE:<1] [RE:2753] [DI:direct] |
| CONTIG512 | 22057062_f3_228 | 4476 | 10138 | 2226 | 742 | 451 | 2.1(10)-42 | Bacillus subtilis | yknV | [pn:hypothetical protein] |
| CONTIG512 | 13864182_f3_231 | 4477 | 10139 | 447 | 149 | 408 | 3.5(10)-38 | Escherichia coli | b0483 | [pn:hypothetical protein] |
| CONTIG512 | 23516311_f3_238 | 4478 | 10140 | 681 | 227 | 431 | 1.3(10)-40 | Synechocystis sp. | S77469 | [PN:hypothetical protein] [OR:Synechocystis sp.] [SR:PCC 6803.. PCC 6803] [SR:PCC 6803,] |
| CONTIG512 | 4723443_f3_266 | 4479 | 10141 | 528 | 176 | 448 | 2.0(10)-42 | Escherichia coli | b2668 | [pn:hypothetical protein] [gn:ygap] |
| CONTIG512 | 13726077_c1_269 | 4480 | 10142 | 240 | 80 | 170 | 5.7(10)-13 | Escherichia coli | b2666 | [pn:hypothetical protein] [gn:yahg] |
| CONTIG512 | 32207625_c1_270 | 4481 | 10143 | 1773 | 591 | 2214 | 1.5(10)-229 | Escherichia coli | b0321 | [pn:hypothetical protein] [gn:yahg] |
| CONTIG512 | 5986592_c1_278 | 4482 | 10144 | 1011 | 337 | 1145 | 2.7(10)-116 | Rhizobium sp. | P55573 | hypothetical transketolase family protein y4mn, |
| CONTIG512 | 32079650_c1_294 | 4483 | 10145 | 252 | 84 | 142 | 5.2(10)-10 | Escherichia coli | U73857 | or:escherichia coli le:5101 re:5604 di:direct nt:hypothetical protein |
| CONTIG512 | 4494082_c1_319 | 4484 | 10146 | 342 | 114 | 116 | 3.0(10)-7 | Bacillus subtilis | spoIIAA | [pn:anti-sigma factor] |
| CONTIG512 | 12948567_c1_332 | 4485 | 10147 | 291 | 97 | 391 | 2.2(10)-36 | Escherichia coli | I41306 | hypothetical protein (argf-lacz region) - escherichia coli |
| CONTIG512 | 10187_c1_337 | 4486 | 10148 | 411 | 137 | 133 | 4.7(10)-9 | Escherichia coli | D90888 | or:escherichia coli gn:yfjc le:13589 re:13900 di:complement sr:escherichia coli (strain:k12) dna, clone_lib:kohara lambda miniset nt:similar to [swissprot accession number p37907] |
| CONTIG512 | 34662787_c2_339 | 4487 | 10149 | 624 | 208 | 703 | 1.8(10)-69 | Escherichia coli | b0318 | [pn:hypothetical protein] [gn:yahd] |
| CONTIG512 | 11187791_c2_340 | 4488 | 10150 | 1650 | 550 | 2082 | 1.3(10)-215 | Escherichia coli | b0320 | [pn:hypothetical protein] [gn:yahf] |
| CONTIG512 | 24785843_c2_347 | 4489 | 10151 | 990 | 330 | 1312 | 5.5(10)-134 | Escherichia coli | b0323 | [pn:hypothetical protein] [gn:yahi] |
| CONTIG512 | 31337753_c2_352 | 4490 | 10152 | 1335 | 445 | 444 | 5.2(10)-42 | Escherichia coli | b3127 | [pn:hypothetical 49.0 kd protein in mpb-soha intergenic region] [gn:yhau] |
| CONTIG512 | 30267840_c2_353 | 4491 | 10153 | 762 | 254 | 407 | 4.4(10)-38 | Escherichia coli | b1093 | [pn:3-oxoacyl-acyl-carrier protein reductase] [gn:fabg] |
| CONTIG512 | 14954818_c2_354 | 4492 | 10154 | 858 | 286 | 891 | 2.2(10)-89 | Rhizobium sp. | P55574 | hypothetical transketolase family protein y4mo, |
| CONTIG512 | 15712817_c2_359 | 4493 | 10155 | 1185 | 395 | 432 | 9.9(10)-41 | Bacillus subtilis | ydfD | [pn:hypothetical protein] |
| CONTIG512 | 1377152_c2_415 | 4494 | 10156 | 435 | 145 | 91 | 0.00309 | Bacillus subtilis | rsbW | [pn:switch protein/serine kinase and anti-sigma factor] |
| CONTIG512 | 14082025_c2_428 | 4495 | 10157 | 1200 | 400 | 93 | 0.20999 | Methanococcus jannaschii | MJ0156 | [pn:acetyl-coa decarbonylase/synthase, subunit beta] |
| CONTIG512 | 21678202_c2_429 | 4496 | 10158 | 1296 | 432 | 720 | 3.0(10)-71 | Escherichia coli | b2020 | [pn:histidinol dehydrogenase] [gn:hisd] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG512 | 31725412_c2_430 | 4497 | 10159 | 1365 | 455 | 284 | 3.3(10)-23 | Methanobacterium thermoautotrophicum | MTH1496 | [pn:amidase] |
| CONTIG512 | 787577__c2_435 | 4498 | 10160 | 477 | 159 | 701 | 3.1(10)-69 | Escherichia coli | b2619 | [pn:hypothetical protein [gn:yfjg] |
| CONTIG512 | 35625788_c3_438 | 4499 | 10161 | 381 | 127 | 231 | 2.0(10)-19 | Escherichia coli | b2669 | [pn:dna-binding protein stpa] [gn:stpa] |
| CONTIG512 | 5989812_c3_448 | 4500 | 10162 | 1632 | 544 | 509 | 6.9(10)-49 | Synechocystis sp. | S76103 | [PN:hypothetical protein] [OR:Synechocystis sp.] [SR:PCC 6803], PCC 6803] [SR:PCC 6803,] |
| CONTIG512 | 31350680_c3_451 | 4501 | 10163 | 1458 | 486 | 2018 | 8.5(10)-209 | Escherichia coli | b0324 | [pn:hypothetical protein] [gn:yahj] |
| CONTIG512 | 26818956_c3_457 | 4502 | 10164 | 861 | 287 | 358 | 6.9(10)-33 | Haemophilus influenzae | HI0912 | [pn:gp] |
| CONTIG512 | 31307931_c3_460 | 4503 | 10165 | 903 | 301 | 397 | 5.0(10)-37 | Escherichia coli | b3243 | [pn:hypothetical protein] [gn:yhcs] |
| CONTIG512 | 24632632_c3_495 | 4504 | 10166 | 744 | 248 | 632 | 6.4(10)-62 | Synechocystis sp. | S76993 | [PN:hypothetical protein] [OR:Synechocystis sp.] [SR:PCC 6803] [SR:PCC 6803,] |
| CONTIG512 | 34275752_c3_515 | 4505 | 10167 | 1269 | 423 | 210 | 1.3(10)-16 | Haemophilus influenzae | HI0884 | [pn:aerobic respiration control protein arca] [gn:arca] |
| CONTIG512 | 29383255_c3_527 | 4506 | 10168 | 1209 | 403 | 340 | 5.5(10)-31 | Escherichia coli | b2714 | [pn:asc operon repressor protein] [gn:ascg] |
| CONTIG512 | 30347307_c3_535 | 4507 | 10169 | 984 | 328 | 437 | 2.8(10)-41 | Escherichia coli | b3558 | [pn:insertion element is150 hypothetical 33.3 kd protein] [gn:yi5b] |
| CONTIG512 | 32660955_c3_540 | 4508 | 10170 | 372 | 124 | 409 | 2.7(10)-38 | Escherichia coli | b2618 | [pn:hypothetical protein] |
| CONTIG512 | 23629567_f1_1 | 4509 | 10171 | 2427 | 809 | 1447 | 2.7(10)-148 | Escherichia coli | b0124 | [pn:glucose dehydrogenase] [gn:gcd] |
| CONTIG513 | 7282800_f1_18 | 4510 | 10172 | 378 | 126 | 509 | 6.9(10)-49 | Escherichia coli | b1599 | [pn:hypothetical protein] [gn:ynfl] |
| CONTIG513 | 24406285_f1_26 | 4511 | 10173 | 918 | 306 | 1150 | 8.1(10)-117 | Escherichia coli | b1595 | [pn:hypothetical protein] [gn:ynfl] |
| CONTIG513 | 4891293_f1_40 | 4512 | 10174 | 687 | 229 | 758 | 2.7(10)-75 | Proteus mirabilis | P07641 | chloramphenicol acetyltransferase (ec 2.3.1.28). |
| CONTIG513 | 25584832_f1_50 | 4513 | 10175 | 723 | 241 | 868 | 6.2(10)-87 | Escherichia coli | b1585 | [pn:hypothetical protein] [gn:ynfc] |
| CONTIG513 | 33876063_f1_52 | 4514 | 10176 | 1116 | 372 | 1366 | 1.1(10)-139 | Escherichia coli | b1580 | [pn:starvation sensing protein rspb] [gn:rspb] |
| CONTIG513 | 7119082_f1_59 | 4515 | 10177 | 2037 | 679 | 2392 | 2.0(10)-248 | Escherichia coli | b1538 | [pn:dipeptidyl carboxypeptidase ii] [gn:dcp] |
| CONTIG513 | 23611652_f1_61 | 4516 | 10178 | 825 | 275 | 322 | 4.5(10)-29 | Escherichia coli | b1790 | [pn:hypothetical protein] |
| CONTIG513 | 24259677_f1_62 | 4517 | 10179 | 495 | 165 | 293 | 5.2(10)-26 | Bacillus subtilis | ybbK | [pn:hypothetical protein] |
| CONTIG513 | 1048177_f1_70 | 4518 | 10180 | 309 | 103 | 138 | 1.3(10)-9 | Escherichia coli | b3238 | [pn:hypothetical protein] [gn:yhen] |
| CONTIG513 | 30286561_f1_76 | 4519 | 10181 | 1590 | 530 | 2218 | 5.5(10)-230 | Escherichia coli | b1385 | [pn:hypothetical protein] [gn:feab] |
| CONTIG513 | 24490626_f1_85 | 4520 | 10182 | 999 | 333 | 1487 | 1.6(10)-152 | Escherichia coli | b1388 | [pn:hypothetical protein] |
| CONTIG513 | 14539213_f1_86 | 4521 | 10183 | 300 | 100 | 495 | 2.1(10)-47 | Escherichia coli | b1389 | [pn:hypothetical protein] |
| CONTIG513 | 4713467_f1_91 | 4522 | 10184 | 798 | 266 | 1016 | 1.3(10)-102 | Escherichia coli | b1394 | [pn:hypothetical protein] |
| CONTIG513 | 12276640_f1_96 | 4523 | 10185 | 1332 | 444 | 2185 | 1.7(10)-226 | Escherichia coli | b1398 | [pn:hypothetical protein] |
| CONTIG513 | 26737775_f1_97 | 4524 | 10186 | 963 | 321 | 1260 | 1.8(10)-128 | Escherichia coli | b1399 | [pn:hypothetical protein] |
| CONTIG513 | 4198568_f1_98 | 4525 | 10187 | 615 | 205 | 951 | 1.0(10)-95 | Escherichia coli | b1400 | [pn:hypothetical protein] |
| CONTIG513 | 23489792_f1_104 | 4526 | 10188 | 1548 | 516 | 654 | 3.0(10)-64 | Mycobacterium tuberculosis | AL021932 | [de:mycobacterium tuberculosis sequence v037] [nt:mtv037.13c] [pn:putative dehydrogenase] [gn:mtv037.13c] [en] |
| CONTIG513 | 14878332_f2_105 | 4527 | 10189 | 1227 | 409 | 495 | 2.1(10)-47 | Escherichia coli | b1661 | [pn:cyclopropane-fatty-acyl-phospholipid synthase] [gn:cfa] |
| CONTIG513 | 42312_f2_115 | 4528 | 10190 | 3942 | 1314 | 6025 | 0 | Escherichia coli | b1413 | [pn:atp-dependent helicase hrpa] [gn:hrpa] |
| CONTIG513 | 126541_f2_141 | 4529 | 10191 | 1062 | 354 | 154 | 1.3(10)-8 | Bacillus subtilis | ywcH | [pn:protein] [gn:ipa-44d] |
| CONTIG513 | 885766_f2_153 | 4530 | 10192 | 1290 | 430 | 1818 | 1.3(10)-187 | Escherichia coli | b1594 | [pn:protein] [gn:mlc] |
| CONTIG513 | 23462778_f2_154 | 4531 | 10193 | 699 | 233 | 1033 | 2.0(10)-104 | Escherichia coli | b1593 | [pn:hypothetical protein] |
| CONTIG513 | 21579652_f2_178 | 4532 | 10194 | 351 | 117 | 528 | 6.7(10)-51 | Escherichia coli | b1582 | [pn:hypothetical protein] |
| CONTIG513 | 4535002_f2_179 | 4533 | 10195 | 1254 | 418 | 2087 | 4.2(10)-216 | Escherichia coli | b1581 | [pn:starvation sensing protein rspa] [gn:rspa] |
| CONTIG513 | 24735213_f2_180 | 4534 | 10196 | 1437 | 479 | 1821 | 6.4(10)-188 | Escherichia coli | b1543 | [pn:hypothetical protein] |
| CONTIG513 | 4769191_f2_181 | 4535 | 10197 | 1476 | 492 | 2005 | 2.0(10)-207 | Escherichia coli | b1542 | [pn:hypothetical protein] [gn:ydfi] |
| CONTIG513 | 11754183_f2_195 | 4536 | 10198 | 2148 | 716 | 1055 | 9.5(10)-107 | Escherichia coli | b0124 | [pn:glucose dehydrogenase] [gn:gcd] |
| CONTIG513 | 4804068_f2_202 | 4537 | 10199 | 201 | 67 | 208 | 5.4(10)-17 | Escherichia coli | b1382 | [pn:hypothetical protein] |
| CONTIG513 | 13808563_f2_213 | 4538 | 10200 | 594 | 198 | 765 | 5.0(10)-76 | Escherichia coli | b1391 | [pn:hypothetical protein] |
| CONTIG513 | 26851665_f2_216 | 4539 | 10201 | 783 | 261 | 774 | 5.7(10)-77 | Escherichia coli | b1393 | [pn:hypothetical protein] [gn:ydbs] |
| CONTIG513 | 32629805_f2_217 | 4540 | 10202 | 1581 | 527 | 1940 | 1.6(10)-200 | Escherichia coli | b1395 | [pn:hypothetical protein] [gn:ydbu] |
| CONTIG513 | 12710012_f2_218 | 4541 | 10203 | 1290 | 430 | 1760 | 1.8(10)-181 | Escherichia coli | b1397 | [pn:hypothetical protein] |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG513 | 4767043_f2_225 | 4542 | 10204 | 1986 | 662 | 1596 | 4.5(10)-164 | Escherichia coli | b4083 | [pn:hypothetical 73.7 kd protein in fdhf-plmp intergenic region] |
| CONTIG513 | 15676040_f2_227 | 4543 | 10205 | 948 | 316 | 203 | 1.8(10)-16 | Bacillus subtilis | dltE | [pn:hypothetical protein] [gn:ipa-1r] |
| CONTIG513 | 32506457_f2_229 | 4544 | 10206 | 753 | 251 | 231 | 2.0(10)-19 | Mycobacterium tuberculosis | AL021932 | [de:mycobacterium tuberculosis sequence v037.] [pn:hypothetical protein mtv037.12c] [gn:mtv037.12c, |
| CONTIG513 | 26884505_f2_233 | 4545 | 10207 | 963 | 321 | 176 | 3.2(10)-13 | Haemophilus influenzae | H11399 | [pn:hypothetical protein] |
| CONTIG513 | 14879707_f2_238 | 4546 | 10208 | 546 | 182 | 632 | 6.4(10)-62 | Escherichia coli | b0354 | [pn:hypothetical protein in alda 5″″ region] [gn:ydcf] |
| CONTIG513 | 34194791_f2_255 | 4547 | 10209 | 846 | 282 | 868 | 6.2(10)-87 | Escherichia coli | b1414 | [pn:hypothetical protein MTCY180.06] [GN:MTCY180.06] |
| CONTIG513 | 22744037_f3_272 | 4548 | 10210 | 984 | 328 | 182 | 4.7(10)-12 | Mycobacterium tuberculosis | Z97193 | [PN:hypothetical protein MTCY180.06] [GN:MTCY180.06] [DE:Mycobacterium tuberculosis cosmid Y180.] [NT:MTCY180.06, possible oxidoreductase, Len:334.] [LE:6203] [RE:7207] [DI:direct] |
| CONTIG513 | 38275_f3_277 | 4549 | 10211 | 432 | 144 | 477 | 1.7(10)-45 | Escherichia coli | b1600 | [pn:hypothetical protein] |
| CONTIG513 | 859452_f3_299 | 4550 | 10212 | 456 | 152 | 142 | 1.7(10)-9 | Escherichia coli | b1328 | [pn:hypothetical protein] [gn:ycjz] |
| CONTIG513 | 35581281_f3_320 | 4551 | 10213 | 459 | 153 | 383 | 1.5(10)-35 | Escherichia coli | b0607 | [pn:hypothetical protein] [gn:ybdq] |
| CONTIG513 | 5272338_f3_339 | 4552 | 10214 | 183 | 61 | 168 | 9.4(10)-13 | Escherichia coli | b1550 | [pn:hypothetical protein] |
| CONTIG513 | 24644576_f3_344 | 4553 | 10215 | 2646 | 882 | 3438 | 0 | Escherichia coli | b1381 | [pn:hypothetical protein] [gn:ydbh] |
| CONTIG513 | 16535137_f3_345 | 4554 | 10216 | 348 | 116 | 299 | 1.2(10)-26 | Escherichia coli | b1383 | [pn:hypothetical protein] |
| CONTIG513 | 16657590_f3_365 | 4555 | 10217 | 774 | 258 | 997 | 1.3(10)-100 | Escherichia coli | b1390 | [pn:hypothetical protein] |
| CONTIG513 | 16269758_f3_366 | 4556 | 10218 | 1200 | 400 | 1585 | 6.5(10)-163 | Escherichia coli | b1392 | [pn:hypothetical protein] |
| CONTIG513 | 3461416_f3_371 | 4557 | 10219 | 513 | 171 | 569 | 3.0(10)-55 | Escherichia coli | b1396 | [pn:hypothetical protein] |
| CONTIG513 | 22117188_f3_387 | 4558 | 10220 | 978 | 326 | 437 | 2.8(10)-41 | Haemophilus influenzae | H11364 | [pn:hypothetical protein] |
| CONTIG513 | 22870175_f3_406 | 4559 | 10221 | 483 | 161 | 597 | 3.2(10)-58 | Escherichia coli | b1415 | [pn:lactaldehyde dehydrogenase a] [gn:alda] |
| CONTIG513 | 22069212_f3_408 | 4560 | 10222 | 1668 | 556 | 134 | 1.3(10)-5 | Bacillus subtilis | yhcA | [pn:hypothetical protein] |
| CONTIG513 | 6539783_c1_410 | 4561 | 10223 | 1452 | 484 | 420 | 1.8(10)-39 | Escherichia coli | b0572 | [pn:hypothetical protein] [gn:ylcb] |
| CONTIG513 | 20214775_c1_439 | 4562 | 10224 | 696 | 232 | 116 | 4.2(10)-5 | Escherichia coli | b0375 | [pn:hypothetical protein] [gn:yaiv] |
| CONTIG513 | 23870400_c1_454 | 4563 | 10225 | 2091 | 697 | 2967 | 0 | Escherichia coli | b1387 | [pn:hypothetical protein] [gn:rmaoc] |
| CONTIG513 | 13944091_c1_480 | 4564 | 10226 | 231 | 77 | 247 | 4.0(10)-21 | Escherichia coli | b1541 | [pn:hypothetical protein] |
| CONTIG513 | 12911066_c1_491 | 4565 | 10227 | 939 | 313 | 138 | 3.1(10)-9 | Homo sapiens | Q09327 | beta-1,4-mannosyl-glycoprotein beta-1,4-n-acetylglucosaminyl-transferase (ec 2.4.1.144) (n-glycosyl-oligosaccharide-glycoprotein n-acetylglucosaminyltransferase iii) (n-acetylglucosaminyltransferase iii) (gnt-iii) (glcnac-t iii) |
| CONTIG513 | 15786281_c1_492 | 4566 | 10228 | 348 | 116 | 323 | 3.5(10)-29 | Escherichia coli | b1586 | [pn:hypothetical protein] |
| CONTIG513 | 30361281_c1_495 | 4567 | 10229 | 270 | 90 | 221 | 3.5(10)-17 | Escherichia coli | b1587 | [pn:hypothetical protein] |
| CONTIG513 | 22925083_c1_502 | 4568 | 10230 | 783 | 261 | 97 | 0.006 | Sinorhizobium meliloti | AF031940 | [de:sinorhizobium meliloti alcohol dehydrogenase (adha) gene, complete cds.] [pn:hypothetical protein] [nt:orf1] |
| CONTIG513 | 15679061_c1_504 | 4569 | 10231 | 672 | 224 | 291 | 8.6(10)-26 | Bacillus subtilis | opuCB | [pn:glycine betaine/carnitine/choline abc transporter] [gn:ybd] |
| CONTIG513 | 25961525_c1_512 | 4570 | 10232 | 1503 | 501 | 823 | 3.7(10)-82 | Bacillus subtilis | ypwA | [pn:hypothetical protein] |
| CONTIG513 | 11722677_c1_521 | 4571 | 10233 | 1461 | 487 | 1881 | 2.7(10)-194 | Escherichia coli | b1184 | [pn:umuc protein] [gn:umuc] |
| CONTIG513 | 892531_c1_523 | 4572 | 10234 | 996 | 332 | 1546 | 8.9(10)-159 | Klebsiella pneumoniae | P27504 | coenzyme pqq synthesis protein b. |
| CONTIG513 | 914591_c2_541 | 4573 | 10235 | 1209 | 403 | 338 | 9.0(10)-31 | Escherichia coli | b2685 | [pn:multidrg resistance protein a] [gn:emra] |
| CONTIG513 | 641967_c2_549 | 4574 | 10236 | 858 | 286 | 422 | 1.1(10)-39 | Escherichia coli | b0058 | [pn:hypothetical 24.9 kd protein in sura-hepa intergenic region] [gn:yabo] |
| CONTIG513 | 1969212_c2_550 | 4575 | 10237 | 1041 | 347 | 321 | 5.5(10)-28 | Escherichia coli | b3829 | [pn:5-methyltetrahydropteroyltriglutamate-homocysteine methyltransferase] [gn:mete] |
| CONTIG513 | 32667541_c2_582 | 4576 | 10238 | 2502 | 834 | 3407 | 0 | Escherichia coli | b1386 | [pn:copper amine oxidase precursor] [gn:tyna] |
| CONTIG513 | 14063411_c2_583 | 4577 | 10239 | 2037 | 679 | 1604 | 6.2(10)-165 | Escherichia coli | b4083 | [pn:hypothetical 73.7 kd protein in fdhf-plmp intergenic region] |
| CONTIG513 | 10338967_c2_584 | 4578 | 10240 | 1158 | 386 | 268 | 1.3(10)-21 | Escherichia coli | b1025 | [pn:hypothetical protein] [gn:ycdt] |
| CONTIG513 | 3324025_c2_586 | 4579 | 10241 | 438 | 146 | 173 | 2.7(10)-13 | Azospirillum brasilense | X70360 | or:azospirillum brasilense gn:carr 1e:59 re:580 di:direct nt:orf2 |
| CONTIG513 | 30257702_c2_588 | 4580 | 10242 | 951 | 317 | 982 | 5.2(10)-99 | Escherichia coli | b1384 | [pn:hypothetical protein] [gn:fear] |

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG513 | 23908516_c2_595 | 4581 | 10243 | 1020 | 340 | 1498 | 1.1(10)-153 | Escherichia coli | b1380 | [pn:d-lactate dehydrogenase] [gn:ldha] |
| CONTIG513 | 915887_c2_596 | 4582 | 10244 | 840 | 280 | 1066 | 6.5(10)-108 | Pseudomonas pyrrocinia | JN0828 | chloroperoxidase (ec 1.11.1.—) precursor - *pseudomonas pyrrocinia* this enzyme catalyzes the formation of carbon-halogen bonds in the presence of hydrogen peroxide, halide ions, and a suitable organic substrate. this enzyme is involved in the production o |
| CONTIG513 | 9823576_c2_606 | 4583 | 10245 | 696 | 232 | 1021 | 3.7(10)-103 | Escherichia coli | b1931 | [pn:yedg] [gn:yedk] |
| CONTIG513 | 36070465_c2_609 | 4584 | 10246 | 852 | 284 | 113 | 0.00017 | Methanobacterium thermoautotrophicum | MTH882 | [pn:conserved protein] |
| CONTIG513 | 3250786_c2_620 | 4585 | 10247 | 609 | 203 | 870 | 3.7(10)-87 | Escherichia coli | b1584 | [pn:spermidine n1-acetyltransferase] [gn:speg] |
| CONTIG513 | 25869028_c2_623 | 4586 | 10248 | 2325 | 775 | 3450 | 0 | Escherichia coli | b1587 | [pn:hypothetical protein] |
| CONTIG513 | 14572206_c2_624 | 4587 | 10249 | 621 | 207 | 1110 | 1.3(10)-112 | Escherichia coli | b0895 | [pn:anaerobic dimethyl sulfoxide reductase chain b] [gn:dmsb] |
| CONTIG513 | 13126632_c2_626 | 4588 | 10250 | 723 | 241 | 764 | 6.5(10)-76 | Escherichia coli | b1591 | [pn:hypothetical protein] |
| CONTIG513 | 2447593B_c2_629 | 4589 | 10251 | 291 | 97 | 156 | 8.4(10)-11 | Pseudomonas aeruginosa | Q01609 | hypothetical 40.7 kd protein in opde 3' region (orf2). |
| CONTIG513 | 14322166_c2_631 | 4590 | 10252 | 738 | 246 | 305 | 2.8(10)-27 | Bacillus subtilis | opuCB | [pn:glycine betaine/carnitine/choline abc transporter] [gn:yvbd] |
| CONTIG513 | 9899186_c2_632 | 4591 | 10253 | 912 | 304 | 362 | 2.6(10)-33 | Bacillus subtilis | opuCC | [pn:osmoprotectant - binding protein] [gn:yvbc] |
| CONTIG513 | 164182_c2_641 | 4592 | 10254 | 1338 | 446 | 1829 | 9.0(10)-189 | Escherichia coli | b1596 | [pn:hypothetical protein] [gn:ynfm] |
| CONTIG513 | 12597675_c2_643 | 4593 | 10255 | 843 | 281 | 1086 | 4.9(10)-110 | Escherichia coli | b1598 | [pn:hypothetical protein] |
| CONTIG513 | 16602291_c2_658 | 4594 | 10256 | 438 | 146 | 424 | 7.0(10)-40 | Klebsiella pneumoniae | P27506 | coenzyme pqq synthesis protein d. |
| CONTIG513 | 14744537_c3_660 | 4595 | 10257 | 2298 | 766 | 2069 | 3.3(10)-214 | Klebsiella pneumoniae | P27508 | coenzyme pqq synthesis protein f (ec 3.4.99.—). |
| CONTIG513 | 21729677_c3_684 | 4596 | 10258 | 666 | 222 | 928 | 2.7(10)-93 | Escherichia coli | b1412 | [pn:acyl carrier protein phosphodiesterase] [gn:acpd] |
| CONTIG513 | 31502177_c3_754 | 4597 | 10259 | 1299 | 433 | 434 | 8.9(10)-49 | Escherichia coli | b2796 | [pn:putative serine transporter] [gn:sdac] |
| CONTIG513 | 1206557_c3_755 | 4598 | 10260 | 246 | 82 | 263 | 8.0(10)-23 | Salmonella typhimurium | Q56031 | virulence protein msga. |
| CONTIG513 | 24813151_c3_764 | 4599 | 10261 | 897 | 299 | 1144 | 3.5(10)-116 | Escherichia coli | b1539 | [pn:hypothetical oxidoreductase in dcp-noha intergenic region] |
| CONTIG513 | 2189155_c3_775 | 4600 | 10262 | 708 | 236 | 998 | 1.0(10)-100 | Escherichia coli | b1540 | [pn:choline abc transporter] [gn:prov] |
| CONTIG513 | 14473425_c3_783 | 4601 | 10263 | 372 | 124 | 408 | 3.5(10)-38 | Escherichia coli | b1583 | [pn:hypothetical protein] |
| CONTIG513 | 10945780_c3_785 | 4602 | 10264 | 927 | 309 | 932 | 1.0(10)-93 | Escherichia coli | b1590 | [pn:hypothetical protein] |
| CONTIG513 | 6025635_c3_790 | 4603 | 10265 | 453 | 151 | 236 | 5.7(10)-20 | Escherichia coli | b1848 | [pn:hypothetical 10.7 kd protein in purt 5'''' region] [gn:yebg] |
| CONTIG513 | 13159433_c3_791 | 4604 | 10266 | 1257 | 419 | 806 | 2.2(10)-80 | Bacillus subtilis | opuBA | [pn:choline abc transporter] [gn:prov] |
| CONTIG513 | 29882802_c3_803 | 4605 | 10267 | 1416 | 472 | 1077 | 4.4(10)-109 | Escherichia coli | b1592 | [pn:hypothetical protein] |
| CONTIG513 | 10662961_c3_806 | 4606 | 10268 | 1065 | 355 | 1065 | 8.3(10)-108 | Escherichia coli | b1601 | [pn:hypothetical protein] |
| CONTIG513 | 36382212_c3_807 | 4607 | 10269 | 363 | 121 | 561 | 2.1(10)-54 | Escherichia coli | b0410 | [pn:yajd] |
| CONTIG513 | 16069816_c3_808 | 4608 | 10270 | 1038 | 346 | 1150 | 8.1(10)-117 | Klebsiella pneumoniae | P27509 | hypothetical protein in pqqa 5' region (orfx) (fragment). |
| CONTIG513 | 24066262_c3_810 | 4609 | 10271 | 843 | 281 | 1153 | 3.8(10)-117 | Klebsiella pneumoniae | P27505 | coenzyme pqq synthesis protein c. |
| CONTIG52 | 33807686_f1_1 | 4610 | 10272 | 1185 | 395 | 1943 | 7.5(10)-201 | Klebsiella pneumoniae | P27507 | coenzyme pqq synthesis protein e. |
| CONTIG52 | 4167842_c3_6 | 4611 | 10273 | 465 | 155 | 723 | 1.3(10)-71 | Escherichia coli | b0683 | [pn:ferric uptake regulation protein] [gn:fur] |
| CONTIG53 | 10359689_c2_3 | 4612 | 10274 | 240 | 80 | 250 | 1.8(10)-21 | Escherichia coli | b0682 | [pn:hypothetical protein] [gn:ybfn] |
| CONTIG54 | 14978382_f1_1 | 4613 | 10275 | 425 | 141 | 660 | 6.9(10)-65 | Escherichia coli | b1827 | mobilization protein mobl. |
| CONTIG56 | 4070952_f2_2 | 4614 | 10276 | 356 | 119 | 192 | 9.4(10)-15 | Thiobacillus ferrooxidans | P20085 | [pn:hypothetical protein] [gn:sfma] |
| CONTIG58 | 10947127_f1_1 | 4615 | 10277 | 303 | 101 | 92 | 0.00021 | Escherichia coli | b0530 | [pn:flagellar basal-body m-ring protein] [gn:flif] |
| CONTIG58 | 23641281_c2_7 | 4616 | 10278 | 459 | 153 | 543 | 1.7(10)-52 | Escherichia coli | b1938 | [pn:hypothetical protein] |
| CONTIG58 | 6350016_c2_5 | 4617 | 10279 | 477 | 159 | 186 | 1.2(10)-14 | Bacillus subtilis | ydfF | [pn:hypothetical protein] |
| CONTIG59 | 36350016_c2_5 | 4618 | 10280 | 744 | 248 | 1104 | 6.0(10)-112 | Escherichia coli | b3232 | [pn:hypothetical 43.1 kd protein in rplm-hhoa intergenic region] [gn:yhem] |
| CONTIG6 | 29877090_c2_8 | 4619 | 10281 | 339 | 113 | 92 | 0.00067 | Bacillus subtilis | ccpA | [pn:transcriptional regulator] [gn:graf] |
| CONTIG6 | 32494527_c3_9 | 4620 | 10282 | 426 | 142 | 217 | 6.0(10)-18 | Haemophilus influenzae | HI0522 | [pn:sp] |
| CONTIG60 | 29322524_c1_3 | 4621 | 10283 | 385 | 128 | 325 | 2.2(10)-29 | Bacteriophage phi-80 | P14819 | repressor protein ci. |
| CONTIG61 | 35550041_c2_6 | 4622 | 10284 | 1290 | 430 | 1593 | 9.3(10)-164 | Escherichia coli | b0955 | [pn:hypothetical protein] |
| CONTIG62 | 33261442_f1_1 | 4623 | 10285 | 1028 | 343 | 101 | 0.034 | Thiobacillus ferrooxidans | AF032884 | [de:*thiobacillus ferrooxidans* n-acetylglucosamine-1- |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG63 | 13071907_f2_3 | 4624 | 10286 | 246 | 82 | 339 | 7.0(10)-31 | Escherichia coli | b0957 | phosphateuridyltransferase (glmu) gnee, partial cds; glucosamine synthase (glms) and recg (recg) genes, complete cds; and transposon tn5468, complete sequence"] [pn:tnsd] |
| CONTIG63 | 22276682_c1_6 | 4625 | 10287 | 483 | 161 | 709 | 4.4(10)-70 | Escherichia coli | b0956 | [pn:outer membrane protein a] [gn:ompa] |
| CONTIG64 | 22847502_c1_6 | 4626 | 10288 | 198 | 66 | 100 | 8.0(10)-5 | Escherichia coli | b1987 | [pn:hypothetical protein in impa 3'" region] [gn:ycbg] |
| CONTIG64 | 26453393_c3_7 | 4627 | 10289 | 822 | 274 | 1178 | 8.8(10)-120 | Escherichia coli | b1987 | [pn:transcriptional regulator] [gn:cbl] |
| CONTIG65 | 25838388_c1_1 | 4628 | 10290 | 219 | 73 | 269 | 1.8(10)-23 | Escherichia coli | b0958 | [pn:transcriptional regulator] [gn:cbl] |
| CONTIG66 | 4866552_f2_2 | 4629 | 10291 | 426 | 142 | 120 | 1.1(10)-7 | Escherichia coli | L43373 | [pn:cell division inhibitor] [gn:sula] or:escherichia coli pn:pilin le:22 re:567 di:direct sr:escherichia coli (strain 31a/o6) dna |
| CONTIG67 | 13175643_f1_1 | 4630 | 10292 | 1026 | 342 | 135 | 1.7(10)-8 | Haemophilus influenzae | H11488 | [pn:e16 protein] [gn:mue16] |
| CONTIG7 | 31267540_f2_2 | 4631 | 10293 | 282 | 94 | 326 | 1.7(10)-29 | Escherichia coli | b1734 | [pn:phospho-beta-glucosidase b] [gn:celf] |
| CONTIG7 | 11729152_f3_3 | 4632 | 10294 | 345 | 115 | 138 | 1.1(10)-8 | Escherichia coli | b1734 | [pn:phospho-beta-glucosidase b] [gn:celf] |
| CONTIG70 | 22066625_f3_2 | 4633 | 10295 | 687 | 229 | 961 | 8.6(10)-97 | Escherichia coli | b0055 | [pn:hypothetical 30.6 kd protein in sura-hepa intergenic region] [gn:yabl] |
| CONTIG71 | 23880458_f2_2 | 4634 | 10296 | 579 | 193 | 962 | 6.7(10)-97 | Escherichia coli | b0675 | [pn:nagd protein] [gn:nagd] |
| CONTIG71 | 16251037_f3_4 | 4635 | 10297 | 345 | 115 | 370 | 5.7(10)-34 | Escherichia coli | b0674 | [pn:asparagine synthetase b] [gn:asnb] |
| CONTIG72 | 3943817_c1_3 | 4636 | 10298 | 684 | 228 | 104 | 0.00289 | Yersinia enterocolitica (type 0:8) | U46859 | or:yersinia enterocolitica (type 0:8) pn:rfbx gn:rfbx le:6526 re:7815 di:direct |
| CONTIG73 | 33719031_c3_4 | 4637 | 10299 | 594 | 198 | 1003 | 3.1(10)-101 | Escherichia coli | b0223 | [pn:hypothetical protein in gnha-fhia intergenic region] [gn:imp] |
| CONTIG74 | 431332_f3_4 | 4638 | 10300 | 987 | 329 | 94 | 0.07 | Bacillus subtilis | yvrC | [pn:hypothetical protein] |
| CONTIG77 | 32145043_c2_7 | 4639 | 10301 | 222 | 74 | 235 | 7.5(10)-20 | synthetic construct | M15619 | or:artificial sequence le:29 re:>232 di:direct sr:e. coli (strain se5000) synthetic dna, clone pkb1 nt:orf16-lacz fusion protein |
| CONTIG78 | 31901556_c2_6 | 4640 | 10302 | 1035 | 345 | 1101 | 1.3(10)-111 | Escherichia coli | X05874 | or:escherichia coli pn:mature receptor protein le:244 re:2367 di:direct nt:author-given protein sequence is in conflict with |
| CONTIG80 | 23629716_f3_2 | 4641 | 10303 | 614 | 205 | 909 | 2.7(10)-91 | Escherichia coli | b0054 | [pn:organic solvent tolerance protein precursor] [gn:imp] |
| CONTIG82 | 14570453_c3_4 | 4642 | 10304 | 366 | 122 | 159 | 8.4(10)-12 | Escherichia coli | b1160 | [pn:hypothetical protein] |
| CONTIG83 | 22166288_f3_3 | 4643 | 10305 | 801 | 267 | 1289 | 1.5(10)-131 | Escherichia coli | b0432 | [pn:cytochrome o ubiquinol oxidase subunit ii] [gn:cyoa] |
| CONTIG84 | 35663506_c1_7 | 4644 | 10306 | 441 | 147 | 419 | 2.3(10)-39 | Escherichia coli | b3344 | [pn:hypothetical protein] [gn:yhem] |
| CONTIG84 | 12203427_c2_8 | 4645 | 10307 | 441 | 147 | 396 | 6.5(10)-37 | Escherichia coli | b3345 | [pn:hypothetical 13.6 kd protein in rpsl-fkpa intergenic region] |
| CONTIG85 | 4538138_c3_6 | 4646 | 10308 | 615 | 205 | 328 | 1.0(10)-29 | Escherichia coli | b1025 | [pn:hypothetical protein] [gn:ycdt] |
| CONTIG85 | 26753386_3_3 | 4647 | 10309 | 390 | 130 | 545 | 1.1(10)-52 | Escherichia coli | b1642 | [pn:hypothetical protein] [gn:slya] |
| CONTIG86 | 2080192_c3_7 | 4648 | 10310 | 468 | 156 | 100 | 0.00064 | Haemophilus influenzae | H10676 | [pn:integrase-recombinase protein] [gn:xerc] |
| CONTIG87 | 36150166_c1_2 | 4649 | 10311 | 402 | 134 | 334 | 2.3(10)-30 | Escherichia coli | b1090 | [pn:plsx protein] [gn:plsx] |
| CONTIG87 | 12308130_c1_4 | 4650 | 10312 | 519 | 173 | 762 | 1.1(10)-75 | Escherichia coli | b1091 | [pn:3-oxoacyl-acyl-carrier protein synthase iii] [gn:fabh] |
| CONTIG88 | 20738833_c1_5 | 4651 | 10313 | 789 | 263 | 1231 | 2.1(10)-125 | Escherichia coli | b0931 | [pn:nicotinate phosphoribosyltransferase] [gn:pncb] |
| CONTIG88 | 6362961_c1_4 | 4652 | 10314 | 522 | 174 | 259 | 2.1(10)-22 | Escherichia coli | b1374 | [pn:hypothetical protein] |
| CONTIG89 | 22078757_c2_4 | 4653 | 10315 | 651 | 217 | 781 | 1.0(10)-77 | Escherichia coli | b0212 | [pn:hypothetical protein] [gn:glob] |
| CONTIG90 | 2150290_f1_1 | 4654 | 10316 | 420 | 140 | 511 | 4.2(10)-49 | Escherichia coli | b0213 | [pn:hypothetical protein] [gn:yafs] |
| CONTIG90 | 4538138_c3_6 | 4655 | 10317 | 849 | 283 | 853 | 1.6(10)-104 | Escherichia coli | b2581 | [pn:hypothetical 37.8 kd protein in ung 3"" region] [gn:yfit] |
| CONTIG91 | 135805_c2_5 | 4656 | 10318 | 429 | 143 | 734 | 9.9(10)-73 | Escherichia coli | b3231 | [pn:50s ribosomal subunit protein 113] [gn:rplm] |
| CONTIG92 | 117202_f1_1 | 4657 | 10319 | 396 | 132 | 645 | 2.7(10)-63 | Escherichia coli | b3230 | [pn:30s ribosomal subunit protein s9] [gn:rpsi] |
| CONTIG92 | 2525308_f1_2 | 4658 | 10320 | 609 | 203 | 849 | 6.4(10)-85 | Escherichia coli | b1818 | [pn:pts system, mannose-specific iic component] [gn:many] |
| CONTIG93 | 32478807_f1_1 | 4659 | 10321 | 474 | 158 | 748 | 3.2(10)-74 | Escherichia coli | b1819 | [pn:pts system, mannose-specific iid component] [gn:manz] |
| CONTIG93 | 2605671_f1_2 | 4660 | 10322 | 414 | 138 | 313 | 4.0(10)-28 | Escherichia coli | b1678 | [pn:hypothetical protein] |
| CONTIG94 | 3412917_c1_4 | 4661 | 10323 | 648 | 216 | 958 | 1.8(10)-96 | Escherichia coli | b0222 | [pn:phosphoheptose isomerase] [gn:gmha] |
| CONTIG96 | 128251_c2_4 | 4662 | 10324 | 870 | 290 | 152 | 9.5(10)-9 | Escherichia coli | b1959 | [pn:hypothetical 32.2 kd protein in vsr 5"" region] [gn:yeda] |
| CONTIG98 | 10161416_c1_4 | 4663 | 10325 | 270 | 90 | 326 | 1.7(10)-29 | Haemophilus influenzae | H11713 | [pn:phosphohistidinoprotein-hexose phosphotransferase] [gn:ptsh] |
| CONTIG99 | 13867212_f1_1 | 4664 | 10326 | 845 | 282 | 1035 | 1.3(10)-104 | Escherichia coli | b2416 | [pn:phosphoenolpyruvate-protein phosphotransferase] [gn:ptsi] |
| CONTIG99 | 3964643_f1_2 | | | | | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG99 | 12298262_c1_4 | 4665 | 10327 | 357 | 119 | 269 | 1.8(10)-23 | Salmonella typhimurium | S04160 | hypothetical protein k - salmonella typhimurium (fragment) |
| CONTIG103 | 26692751_f3_2 | 4666 | 10328 | 192 | 64 | | | | | |
| CONTIG104 | 4086013_f1_1 | 4667 | 10329 | 231 | 77 | | | | | |
| CONTIG107 | 2461718_f3_2 | 4668 | 10330 | 426 | 142 | | | | | |
| CONTIG107 | 160902_c2_4 | 4669 | 10331 | 198 | 66 | | | | | |
| CONTIG108 | 16922530_f2_1 | 4670 | 10332 | 369 | 123 | | | | | |
| CONTIG109 | 10550041_f3_3 | 4671 | 10333 | 258 | 86 | | | | | |
| CONTIG112 | 24298378_c2_2 | 4672 | 10334 | 411 | 137 | | | | | |
| CONTIG112 | 267327_c3_3 | 4673 | 10335 | 483 | 161 | | | | | |
| CONTIG114 | 24328157_c2_2 | 4674 | 10336 | 924 | 308 | | | | | |
| CONTIG116 | 32086557_c3_10 | 4675 | 10337 | 348 | 116 | | | | | |
| CONTIG118 | 24508568_c3_17 | 4676 | 10338 | 183 | 61 | | | | | |
| CONTIG12 | 24883437_c2_3 | 4677 | 10339 | 240 | 80 | | | | | |
| CONTIG123 | 15647957_c2_8 | 4678 | 10340 | 189 | 63 | | | | | |
| CONTIG124 | 31750177_f2_2 | 4679 | 10341 | 213 | 71 | | | | | |
| CONTIG124 | 11816581_c1_5 | 4680 | 10342 | 339 | 113 | | | | | |
| CONTIG124 | 24424137_c2_6 | 4681 | 10343 | 345 | 115 | | | | | |
| CONTIG124 | 26457507_c3_8 | 4682 | 10344 | 339 | 113 | | | | | |
| CONTIG127 | 6444530_f2_3 | 4683 | 10345 | 192 | 64 | | | | | |
| CONTIG133 | 863952_f3_3 | 4684 | 10346 | 492 | 164 | | | | | |
| CONTIG133 | 4724043_c1_4 | 4685 | 10347 | 294 | 98 | | | | | |
| CONTIG139 | 23650312_f1_1 | 4686 | 10348 | 291 | 97 | | | | | |
| CONTIG139 | 24022792_f1_2 | 4687 | 10349 | 189 | 63 | | | | | |
| CONTIG139 | 7229502_c3_10 | 4688 | 10350 | 195 | 65 | | | | | |
| CONTIG139 | 20594437_c3_11 | 4689 | 10351 | 213 | 71 | | | | | |
| CONTIG140 | 35683587_f1_1 | 4690 | 10352 | 432 | 144 | | | | | |
| CONTIG140 | 36535276_c3_11 | 4691 | 10353 | 195 | 65 | | | | | |
| CONTIG141 | 1602527_f1_2 | 4692 | 10354 | 297 | 99 | | | | | |
| CONTIG141 | 2362508_c1_4 | 4693 | 10355 | 393 | 131 | | | | | |
| CONTIG141 | 25975062_c2_5 | 4694 | 10356 | 696 | 232 | | | | | |
| CONTIG142 | 16994540_c2_5 | 4695 | 10357 | 225 | 75 | | | | | |
| CONTIG143 | 16538208_f3_4 | 4696 | 10358 | 255 | 85 | | | | | |
| CONTIG143 | 16015661_f2_3 | 4697 | 10359 | 228 | 76 | | | | | |
| CONTIG145 | 6149217_c3_5 | 4698 | 10360 | 270 | 90 | | | | | |
| CONTIG145 | 954717_f1_1 | 4699 | 10361 | 240 | 80 | | | | | |
| CONTIG147 | 6927293_f2_2 | 4700 | 10362 | 246 | 82 | | | | | |
| CONTIG148 | 5283461_f2_3 | 4701 | 10363 | 318 | 106 | | | | | |
| CONTIG148 | 1364166_f3_4 | 4702 | 10364 | 183 | 61 | | | | | |
| CONTIG154 | 10047752_c3_2 | 4703 | 10365 | 246 | 82 | | | | | |
| CONTIG158 | 406882_f1_1 | 4704 | 10366 | 555 | 185 | | | | | |
| CONTIG159 | 22382015_f1_2 | 4705 | 10367 | 183 | 61 | | | | | |
| CONTIG159 | 9766887_c2_6 | 4706 | 10368 | 246 | 82 | | | | | |
| CONTIG16 | 15651437_c1_4 | 4707 | 10369 | 309 | 103 | | | | | |
| CONTIG160 | 36136706_c3_11 | 4708 | 10370 | 213 | 71 | | | | | |
| CONTIG164 | 1353152_c2_4 | 4709 | 10371 | 195 | 65 | | | | | |
| CONTIG164 | 20704817_c3_6 | 4710 | 10372 | 312 | 104 | | | | | |
| CONTIG166 | 11751391_c1_3 | 4711 | 10373 | 255 | 85 | | | | | |
| CONTIG166 | 14461535_c3_7 | 4712 | 10374 | 183 | 61 | | | | | |
| CONTIG167 | 4790928_f1_1 | 4713 | 10375 | 234 | 78 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG167 | 7303250_f3_3 | 4714 | 10376 | 417 | 139 | | | | | |
| CONTIG17 | 48827028_c3_7 | 4715 | 10377 | 198 | 66 | | | | | |
| CONTIG171 | 6032517_f1_2 | 4716 | 10378 | 198 | 66 | | | | | |
| CONTIG171 | 20429702_f2_3 | 4717 | 10379 | 183 | 61 | | | | | |
| CONTIG172 | 5204702_f1_1 | 4718 | 10380 | 921 | 307 | | | | | |
| CONTIG172 | 26359452_f1_2 | 4719 | 10381 | 531 | 177 | | | | | |
| CONTIG172 | 5893755_f2_3 | 4720 | 10382 | 669 | 223 | | | | | |
| CONTIG172 | 195825_f2_4 | 4721 | 10383 | 498 | 166 | | | | | |
| CONTIG172 | 19535931_f2_5 | 4722 | 10384 | 270 | 90 | | | | | |
| CONTIG172 | 2117802_f3_6 | 4723 | 10385 | 195 | 65 | | | | | |
| CONTIG177 | 4870127_f1_1 | 4724 | 10386 | 234 | 78 | | | | | |
| CONTIG178 | 25392128_f1_2 | 4725 | 10387 | 186 | 62 | | | | | |
| CONTIG178 | 1070192_f3_5 | 4726 | 10388 | 231 | 77 | | | | | |
| CONTIG178 | 1318937_c1_6 | 4727 | 10389 | 507 | 169 | | | | | |
| CONTIG178 | 2925042_c1_8 | 4728 | 10390 | 204 | 68 | | | | | |
| CONTIG178 | 24442680_c3_11 | 4729 | 10391 | 213 | 71 | | | | | |
| CONTIG179 | 35391652_f1_2 | 4730 | 10392 | 717 | 239 | | | | | |
| CONTIG179 | 33752182_f2_3 | 4731 | 10393 | 585 | 195 | | | | | |
| CONTIG179 | 6250026_f3_5 | 4732 | 10394 | 690 | 230 | | | | | |
| CONTIG181 | 24650693_f3_2 | 4733 | 10395 | 510 | 170 | | | | | |
| CONTIG181 | 4739702_f3_3 | 4734 | 10396 | 258 | 86 | | | | | |
| CONTIG181 | 14539091_c2_5 | 4735 | 10397 | 183 | 61 | | | | | |
| CONTIG183 | 12207031_f1_1 | 4736 | 10398 | 183 | 61 | | | | | |
| CONTIG183 | 36134701_f1_2 | 4737 | 10399 | 711 | 237 | | | | | |
| CONTIG183 | 36134701_f1_3 | 4738 | 10400 | 711 | 237 | | | | | |
| CONTIG183 | 1659443_f1_4 | 4739 | 10401 | 204 | 68 | | | | | |
| CONTIG185 | 969827_c3_5 | 4740 | 10402 | 198 | 66 | | | | | |
| CONTIG189 | 22083507_c1_8 | 4741 | 10403 | 186 | 62 | | | | | |
| CONTIG191 | 9980208_f3_5 | 4742 | 10404 | 303 | 101 | | | | | |
| CONTIG194 | 4494002_f1_1 | 4743 | 10405 | 222 | 74 | | | | | |
| CONTIG194 | 16616077_f3_3 | 4744 | 10406 | 516 | 172 | | | | | |
| CONTIG194 | 4485092_f3_4 | 4745 | 10407 | 501 | 167 | | | | | |
| CONTIG194 | 9767885_c3_12 | 4746 | 10408 | 186 | 62 | | | | | |
| CONTIG196 | 23541552_f2_3 | 4747 | 10409 | 201 | 67 | | | | | |
| CONTIG198 | 12986016_c3_9 | 4748 | 10410 | 189 | 63 | | | | | |
| CONTIG201 | 22902166_f1_2 | 4749 | 10411 | 234 | 78 | | | | | |
| CONTIG204 | 24408531_f2_5 | 4750 | 10412 | 231 | 77 | | | | | |
| CONTIG205 | 564203_c2_6 | 4751 | 10413 | 1110 | 370 | | | | | |
| CONTIG207 | 5261287_f3_7 | 4752 | 10414 | 276 | 92 | | | | | |
| CONTIG208 | 33886591_f2_3 | 4753 | 10415 | 459 | 153 | | | | | |
| CONTIG208 | 22273462_f3_4 | 4754 | 10416 | 369 | 123 | | | | | |
| CONTIG208 | 25600262_f3_7 | 4755 | 10417 | 555 | 185 | | | | | |
| CONTIG208 | 22833262_c3_16 | 4756 | 10418 | 237 | 79 | | | | | |
| CONTIG211 | 2456516_f3_10 | 4757 | 10419 | 243 | 81 | | | | | |
| CONTIG212 | 9875632_f3_5 | 4758 | 10420 | 186 | 62 | | | | | |
| CONTIG213 | 34032182_f3_5 | 4759 | 10421 | 630 | 210 | | | | | |
| CONTIG214 | 1268757_c3_13 | 4760 | 10422 | 459 | 153 | | | | | |
| CONTIG216 | 23613160_f1_2 | 4761 | 10423 | 189 | 63 | | | | | |
| CONTIG216 | 5197128_f3_8 | 4762 | 10424 | 939 | 313 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG216 | 34382017_c2_15 | 4763 | 10425 | 291 | 97 | | | | | |
| CONTIG219 | 4589680_f1_1 | 4764 | 10426 | 597 | 199 | | | | | |
| CONTIG219 | 23948453_c1_5 | 4765 | 10427 | 453 | 151 | | | | | |
| CONTIG219 | 20349040_c1_6 | 4766 | 10428 | 414 | 138 | | | | | |
| CONTIG219 | 35390888_c1_7 | 4767 | 10429 | 222 | 74 | | | | | |
| CONTIG221 | 882808_f3_3 | 4768 | 10430 | 228 | 76 | | | | | |
| CONTIG221 | 1407886_c3_7 | 4769 | 10431 | 930 | 310 | | | | | |
| CONTIG222 | 34385156_f2_3 | 4770 | 10432 | 792 | 264 | | | | | |
| CONTIG222 | 10750925_f2_5 | 4771 | 10433 | 399 | 133 | | | | | |
| CONTIG224 | 7235025_f3_9 | 4772 | 10434 | 252 | 84 | | | | | |
| CONTIG228 | 22850390_f1_1 | 4773 | 10435 | 405 | 135 | | | | | |
| CONTIG228 | 24329555_f2_3 | 4774 | 10436 | 306 | 102 | | | | | |
| CONTIG228 | 3378181_f2_5 | 4775 | 10437 | 309 | 103 | | | | | |
| CONTIG229 | 5317907_c3_10 | 4776 | 10438 | 222 | 74 | | | | | |
| CONTIG230 | 1447201_f1_1 | 4777 | 10439 | 561 | 187 | | | | | |
| CONTIG231 | 29879930_f3_10 | 4778 | 10440 | 210 | 70 | | | | | |
| CONTIG232 | 10439637_f2_3 | 4779 | 10441 | 201 | 67 | | | | | |
| CONTIG233 | 34469636_c1_11 | 4780 | 10442 | 354 | 118 | | | | | |
| CONTIG233 | 35833587_c2_16 | 4781 | 10443 | 399 | 133 | | | | | |
| CONTIG233 | 24220308_c3_19 | 4782 | 10444 | 282 | 94 | | | | | |
| CONTIG233 | 31437882_c3_20 | 4783 | 10445 | 267 | 89 | | | | | |
| CONTIG234 | 12207001_f1_1 | 4784 | 10446 | 288 | 96 | | | | | |
| CONTIG234 | 11751391_f2_4 | 4785 | 10447 | 249 | 83 | | | | | |
| CONTIG235 | 19698591_f2_3 | 4786 | 10448 | 576 | 192 | | | | | |
| CONTIG235 | 29803965_f2_4 | 4787 | 10449 | 924 | 308 | | | | | |
| CONTIG235 | 6053417_f3_5 | 4788 | 10450 | 1353 | 451 | | | | | |
| CONTIG235 | 155_f3_7 | 4789 | 10451 | 345 | 115 | | | | | |
| CONTIG235 | 10398388_c1_8 | 4790 | 10452 | 327 | 109 | | | | | |
| CONTIG239 | 26049067_c1_17 | 4791 | 10453 | 564 | 188 | | | | | |
| CONTIG239 | 25397328_c2_20 | 4792 | 10454 | 342 | 114 | | | | | |
| CONTIG239 | 10266657_c2_21 | 4793 | 10455 | 198 | 66 | | | | | |
| CONTIG239 | 4016936_c2_23 | 4794 | 10456 | 270 | 90 | | | | | |
| CONTIG239 | 20506592_c3_26 | 4795 | 10457 | 309 | 103 | | | | | |
| CONTIG239 | 20080082_c3_28 | 4796 | 10458 | 237 | 79 | | | | | |
| CONTIG24 | 22831586_c3_7 | 4797 | 10459 | 498 | 166 | | | | | |
| CONTIG241 | 33882055_f3_13 | 4798 | 10460 | 201 | 67 | | | | | |
| CONTIG242 | 32130002_f3_7 | 4799 | 10461 | 264 | 88 | | | | | |
| CONTIG243 | 12791092_c1_12 | 4800 | 10462 | 690 | 230 | | | | | |
| CONTIG243 | 13680433_c3_18 | 4801 | 10463 | 591 | 197 | | | | | |
| CONTIG243 | 36589693_c2_15 | 4802 | 10464 | 198 | 66 | | | | | |
| CONTIG249 | 22682137_c3_19 | 4803 | 10465 | 312 | 104 | | | | | |
| CONTIG25 | 21620388_f3_3 | 4804 | 10466 | 372 | 124 | | | | | |
| CONTIG250 | 31275789_c1_13 | 4805 | 10467 | 257 | 85 | | | | | |
| CONTIG250 | 36379838_c3_18 | 4806 | 10468 | 378 | 126 | | | | | |
| CONTIG251 | 5334456_f2_10 | 4807 | 10469 | 183 | 61 | | | | | |
| CONTIG252 | 24619412_f1_4 | 4808 | 10470 | 321 | 107 | | | | | |
| CONTIG252 | 25401076_1_6 | 4809 | 10471 | 186 | 62 | | | | | |
| CONTIG252 | 14632816_c1_30 | 4810 | 10472 | 747 | 249 | | | | | |
| CONTIG252 | 10720376_c2_36 | 4811 | 10473 | 240 | 80 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG252 | 10333376_c2_40 | 4812 | 10474 | 243 | 81 | | | | | |
| CONTIG252 | 14492307_c2_41 | 4813 | 10475 | 663 | 221 | | | | | |
| CONTIG252 | 2213887_c3_49 | 4814 | 10476 | 249 | 83 | | | | | |
| CONTIG253 | 21739402_f2_2 | 4815 | 10477 | 249 | 83 | | | | | |
| CONTIG257 | 32213278_f1_1 | 4816 | 10478 | 195 | 65 | | | | | |
| CONTIG257 | 12313528_c2_9 | 4817 | 10479 | 363 | 121 | | | | | |
| CONTIG259 | 20963558_1_1 | 4818 | 10480 | 195 | 65 | | | | | |
| CONTIG26 | 35267665_c1_4 | 4819 | 10481 | 432 | 144 | | | | | |
| CONTIG260 | 6455338_f2_6 | 4820 | 10482 | 225 | 75 | | | | | |
| CONTIG260 | 4394036_c3_33 | 4821 | 10483 | 432 | 144 | | | | | |
| CONTIG261 | 10195340_c3_27 | 4822 | 10484 | 210 | 70 | | | | | |
| CONTIG262 | 5900260_f3_14 | 4823 | 10485 | 201 | 67 | | | | | |
| CONTIG262 | 3957016_f3_16 | 4824 | 10486 | 315 | 105 | | | | | |
| CONTIG262 | 25939886_c2_23 | 4825 | 10487 | 438 | 146 | | | | | |
| CONTIG263 | 35944827_f1_1 | 4826 | 10488 | 249 | 83 | | | | | |
| CONTIG263 | 24412582_f1_2 | 4827 | 10489 | 450 | 150 | | | | | |
| CONTIG263 | 22850400_f3_9 | 4828 | 10490 | 363 | 121 | | | | | |
| CONTIG263 | 34411305_f3_11 | 4829 | 10491 | 357 | 119 | | | | | |
| CONTIG263 | 20003_c2_18 | 4830 | 10492 | 537 | 179 | | | | | |
| CONTIG263 | 11020251_c3_25 | 4831 | 10493 | 198 | 66 | | | | | |
| CONTIG267 | 25662886_f2_10 | 4832 | 10494 | 216 | 72 | | | | | |
| CONTIG269 | 3464677_f2_4 | 4833 | 10495 | 942 | 314 | | | | | |
| CONTIG269 | 25517202_f2_6 | 4834 | 10496 | 1671 | 557 | | | | | |
| CONTIG269 | 25422211_f3_15 | 4835 | 10497 | 549 | 183 | | | | | |
| CONTIG269 | 24807707_c3_31 | 4836 | 10498 | 183 | 61 | | | | | |
| CONTIG272 | 6775775_f3_12 | 4837 | 10499 | 336 | 112 | | | | | |
| CONTIG272 | 14098378_c3_23 | 4838 | 10500 | 228 | 76 | | | | | |
| CONTIG278 | 812928_f2_5 | 4839 | 10501 | 786 | 262 | | | | | |
| CONTIG278 | 13790967_f3_8 | 4840 | 10502 | 666 | 222 | | | | | |
| CONTIG278 | 34197316_f3_13 | 4841 | 10503 | 318 | 106 | | | | | |
| CONTIG279 | 9880338_f1_2 | 4842 | 10504 | 240 | 80 | | | | | |
| CONTIG279 | 16804542_c1_15 | 4843 | 10505 | 1188 | 396 | | | | | |
| CONTIG279 | 33875256_c2_19 | 4844 | 10506 | 567 | 189 | | | | | |
| CONTIG279 | 6845277_c2_22 | 4845 | 10507 | 597 | 199 | | | | | |
| CONTIG280 | 23468812_f1_1 | 4846 | 10508 | 216 | 72 | | | | | |
| CONTIG280 | 16537813_f2_8 | 4847 | 10509 | 222 | 74 | | | | | |
| CONTIG280 | 26750627_c3_20 | 4848 | 10510 | 261 | 87 | | | | | |
| CONTIG281 | 32221062_c2_17 | 4849 | 10511 | 651 | 217 | | | | | |
| CONTIG281 | 22011032_c3_18 | 4850 | 10512 | 243 | 81 | | | | | |
| CONTIG283 | 32220943_f3_9 | 4851 | 10513 | 588 | 196 | | | | | |
| CONTIG283 | 10734627_c1_16 | 4852 | 10514 | 222 | 74 | | | | | |
| CONTIG285 | 35665791_f2_5 | 4853 | 10515 | 285 | 95 | | | | | |
| CONTIG285 | 15823317_f3_8 | 4854 | 10516 | 204 | 68 | | | | | |
| CONTIG289 | 9167115_c3_31 | 4855 | 10517 | 267 | 89 | | | | | |
| CONTIG29 | 24304180_c2_5 | 4856 | 10518 | 204 | 68 | | | | | |
| CONTIG290 | 22442153_c2_6 | 4857 | 10519 | 282 | 94 | | | | | |
| CONTIG291 | 5908451_f2_11 | 4858 | 10520 | 627 | 209 | | | | | |
| CONTIG291 | 16823250_f1_2 | 4859 | 10521 | 450 | 150 | | | | | |
| CONTIG291 | 19527_f1_3 | 4860 | 10522 | 681 | 227 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG291 | 11038201_f3_18 | 4861 | 10523 | 1008 | 336 | | | | | |
| CONTIG291 | 24400090_c3_40 | 4862 | 10524 | 228 | 76 | | | | | |
| CONTIG293 | 2773375_f1_1 | 4863 | 10525 | 201 | 67 | | | | | |
| CONTIG293 | 6254136_f1_4 | 4864 | 10526 | 1191 | 397 | | | | | |
| CONTIG294 | 10678936_f2_15 | 4865 | 10527 | 219 | 73 | | | | | |
| CONTIG295 | 4319768_f1_3 | 4866 | 10528 | 399 | 133 | | | | | |
| CONTIG295 | 16188531_f1_4 | 4867 | 10529 | 516 | 172 | | | | | |
| CONTIG295 | 36211655_f1_8 | 4868 | 10530 | 383 | 128 | | | | | |
| CONTIG295 | 24507257_c1_32 | 4869 | 10531 | 972 | 324 | | | | | |
| CONTIG295 | 25517202_c3_46 | 4870 | 10532 | 297 | 99 | | | | | |
| CONTIG296 | 3315963_c2_12 | 4871 | 10533 | 237 | 79 | | | | | |
| CONTIG296 | 4536580_c3_25 | 4872 | 10534 | 285 | 95 | | | | | |
| CONTIG297 | 32048291_f2_8 | 4873 | 10535 | 201 | 67 | | | | | |
| CONTIG297 | 12315842_f3_11 | 4874 | 10536 | 189 | 63 | | | | | |
| CONTIG297 | 36210812_c1_15 | 4875 | 10537 | 465 | 155 | | | | | |
| CONTIG297 | 24222153_c3_20 | 4876 | 10538 | 1242 | 414 | | | | | |
| CONTIG299 | 10941716_c1_13 | 4877 | 10539 | 261 | 87 | | | | | |
| CONTIG299 | 5901965_c1_14 | 4878 | 10540 | 453 | 151 | | | | | |
| CONTIG299 | 13947162_c2_15 | 4879 | 10541 | 540 | 180 | | | | | |
| CONTIG299 | 4804068_c3_22 | 4880 | 10542 | 915 | 305 | | | | | |
| CONTIG302 | 550265_c2_29 | 4881 | 10543 | 564 | 188 | | | | | |
| CONTIG303 | 14255181_f1_3 | 4882 | 10544 | 303 | 101 | | | | | |
| CONTIG303 | 9844161_f2_7 | 4883 | 10545 | 1407 | 469 | | | | | |
| CONTIG303 | 23563537_c2_26 | 4884 | 10546 | 219 | 73 | | | | | |
| CONTIG305 | 804006_c1_15 | 4885 | 10547 | 216 | 72 | | | | | |
| CONTIG307 | 4973426_c1_24 | 4886 | 10548 | 186 | 62 | | | | | |
| CONTIG309 | 183535_c1_45 | 4887 | 10549 | 261 | 87 | | | | | |
| CONTIG310 | 21958567_c2_8 | 4888 | 10550 | 321 | 107 | | | | | |
| CONTIG311 | 9767306_f2_10 | 4889 | 10551 | 234 | 78 | | | | | |
| CONTIG311 | 14116683_f3_17 | 4890 | 10552 | 198 | 66 | | | | | |
| CONTIG311 | 4159385_f3_20 | 4891 | 10553 | 201 | 67 | | | | | |
| CONTIG311 | 22925883_3_23 | 4892 | 10554 | 201 | 67 | | | | | |
| CONTIG312 | 9939052_c1_32 | 4893 | 10555 | 189 | 63 | | | | | |
| CONTIG312 | 23649137_c1_34 | 4894 | 10556 | 2130 | 710 | | | | | |
| CONTIG312 | 4884667_c1_35 | 4895 | 10557 | 711 | 237 | | | | | |
| CONTIG312 | 36134701_c1_36 | 4896 | 10558 | 711 | 237 | | | | | |
| CONTIG312 | 36134701_c1_37 | 4897 | 10559 | 204 | 68 | | | | | |
| CONTIG315 | 5164687_f2_15 | 4898 | 10560 | 183 | 61 | | | | | |
| CONTIG315 | 13008437_f2_22 | 4899 | 10561 | 234 | 78 | | | | | |
| CONTIG315 | 35739687_f3_27 | 4900 | 10562 | 213 | 71 | | | | | |
| CONTIG315 | 29927090_c1_38 | 4901 | 10563 | 765 | 255 | | | | | |
| CONTIG315 | 35203902_c2_39 | 4902 | 10564 | 213 | 71 | | | | | |
| CONTIG315 | 31883408_c2_41 | 4903 | 10565 | 429 | 143 | | | | | |
| CONTIG315 | 35647702_c3_47 | 4904 | 10566 | 660 | 220 | | | | | |
| CONTIG315 | 16219455_c3_49 | 4905 | 10567 | 477 | 159 | | | | | |
| CONTIG315 | 26071937_c3_50 | 4906 | 10568 | 186 | 62 | | | | | |
| CONTIG315 | 26447262_c3_53 | 4907 | 10569 | 255 | 85 | | | | | |
| CONTIG318 | 29322753_f1_1 | 4908 | 10570 | 705 | 235 | | | | | |
| CONTIG318 | 31848312_f1_5 | 4909 | 10571 | 237 | 79 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG318 | 26853468_f1_6 | 4910 | 10572 | 459 | 153 | | | | | |
| CONTIG318 | 35679031_f2_8 | 4911 | 10573 | 330 | 110 | | | | | |
| CONTIG318 | 2532543_f2_12 | 4912 | 10574 | 1824 | 608 | | | | | |
| CONTIG318 | 6814128_f3_13 | 4913 | 10575 | 213 | 71 | | | | | |
| CONTIG318 | 26363308_f3_18 | 4914 | 10576 | 309 | 103 | | | | | |
| CONTIG318 | 30579507_c2_25 | 4915 | 10577 | 195 | 65 | | | | | |
| CONTIG319 | 14957657_f1_2 | 4916 | 10578 | 186 | 62 | | | | | |
| CONTIG319 | 10440713_f1_6 | 4917 | 10579 | 381 | 127 | | | | | |
| CONTIG319 | 3039027_f1_7 | 4918 | 10580 | 555 | 185 | | | | | |
| CONTIG319 | 19776557_f3_26 | 4919 | 10581 | 225 | 75 | | | | | |
| CONTIG319 | 45245692_c2_30 | 4920 | 10582 | 333 | 111 | | | | | |
| CONTIG319 | 22459705_c2_32 | 4921 | 10583 | 186 | 62 | | | | | |
| CONTIG32 | 1979167_c1_2 | 4922 | 10584 | 186 | 62 | | | | | |
| CONTIG320 | 4348250_f3_14 | 4923 | 10585 | 198 | 66 | | | | | |
| CONTIG320 | 36378428_c1_22 | 4924 | 10586 | 228 | 76 | | | | | |
| CONTIG322 | 20941652_c3_44 | 4925 | 10587 | 207 | 69 | | | | | |
| CONTIG324 | 36022916_f1_1 | 4926 | 10588 | 249 | 83 | | | | | |
| CONTIG326 | 16225827_f2_12 | 4927 | 10589 | 192 | 64 | | | | | |
| CONTIG326 | 4094687_f2_13 | 4928 | 10590 | 273 | 91 | | | | | |
| CONTIG326 | 6839662_f3_23 | 4929 | 10591 | 900 | 300 | | | | | |
| CONTIG326 | 2346907_f3_29 | 4930 | 10592 | 198 | 66 | | | | | |
| CONTIG326 | 21579680_c1_41 | 4931 | 10593 | 219 | 73 | | | | | |
| CONTIG326 | 22345463_c1_43 | 4932 | 10594 | 417 | 139 | | | | | |
| CONTIG326 | 26847916_c2_54 | 4933 | 10595 | 288 | 96 | | | | | |
| CONTIG326 | 33790916_c3_56 | 4934 | 10596 | 342 | 114 | | | | | |
| CONTIG327 | 34666516_f1_8 | 4935 | 10597 | 732 | 244 | | | | | |
| CONTIG327 | 5117968_f1_9 | 4936 | 10598 | 597 | 199 | | | | | |
| CONTIG327 | 32313591_f3_18 | 4937 | 10599 | 378 | 126 | | | | | |
| CONTIG327 | 6119561_c2_37 | 4938 | 10600 | 219 | 73 | | | | | |
| CONTIG329 | 31900713_c3_35 | 4939 | 10601 | 255 | 85 | | | | | |
| CONTIG330 | 16015787_f1_7 | 4940 | 10602 | 432 | 144 | | | | | |
| CONTIG330 | 786402_f3_17 | 4941 | 10603 | 267 | 89 | | | | | |
| CONTIG330 | 22477305_c1_29 | 4942 | 10604 | 228 | 76 | | | | | |
| CONTIG330 | 9975431_c1_31 | 4943 | 10605 | 525 | 175 | | | | | |
| CONTIG330 | 118911652_c1_32 | 4944 | 10606 | 1206 | 402 | | | | | |
| CONTIG330 | 5976381_c1_33 | 4945 | 10607 | 282 | 94 | | | | | |
| CONTIG330 | 20006305_c1_36 | 4946 | 10608 | 441 | 147 | | | | | |
| CONTIG330 | 26753427_c1_37 | 4947 | 10609 | 714 | 238 | | | | | |
| CONTIG330 | 14844816_c2_38 | 4948 | 10610 | 1635 | 545 | | | | | |
| CONTIG330 | 6719787_c2_42 | 4949 | 10611 | 291 | 97 | | | | | |
| CONTIG330 | 26292592_c2_44 | 4950 | 10612 | 333 | 111 | | | | | |
| CONTIG330 | 24663201_c3_47 | 4951 | 10613 | 801 | 267 | | | | | |
| CONTIG330 | 25554761_c3_48 | 4952 | 10614 | 453 | 151 | | | | | |
| CONTIG330 | 23698253_c3_49 | 4953 | 10615 | 648 | 216 | | | | | |
| CONTIG330 | 36500637_c3_53 | 4954 | 10616 | 390 | 130 | | | | | |
| CONTIG331 | 1056537_f1_4 | 4955 | 10617 | 240 | 80 | | | | | |
| CONTIG331 | 14097265_f3_27 | 4956 | 10618 | 222 | 74 | | | | | |
| CONTIG331 | 3321012_c1_29 | 4957 | 10619 | 288 | 96 | | | | | |
| CONTIG331 | 21677281_c2_37 | 4958 | 10620 | 297 | 99 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG331 | 23476027_c2_39 | 4959 | 10621 | 240 | 80 | | | | | |
| CONTIG331 | 16835967_c3_41 | 4960 | 10622 | 1434 | 478 | | | | | |
| CONTIG334 | 25976457_f3_22 | 4961 | 10623 | 372 | 124 | | | | | |
| CONTIG335 | 26836387_f2_13 | 4962 | 10624 | 297 | 99 | | | | | |
| CONTIG335 | 25975292_f2_20 | 4963 | 10625 | 213 | 71 | | | | | |
| CONTIG335 | 4738406_f3_25 | 4964 | 10626 | 234 | 78 | | | | | |
| CONTIG335 | 25604511_c1_35 | 4965 | 10627 | 192 | 64 | | | | | |
| CONTIG335 | 15730042_c1_36 | 4966 | 10628 | 495 | 165 | | | | | |
| CONTIG335 | 34381300_c2_40 | 4967 | 10629 | 312 | 104 | | | | | |
| CONTIG335 | 4816918_c2_43 | 4968 | 10630 | 1068 | 356 | | | | | |
| CONTIG335 | 21754515_c3_45 | 4969 | 10631 | 198 | 66 | | | | | |
| CONTIG336 | 16071968_c3_43 | 4970 | 10632 | 282 | 94 | | | | | |
| CONTIG338 | 24098442_f3_19 | 4971 | 10633 | 207 | 69 | | | | | |
| CONTIG338 | 9899066_c1_25 | 4972 | 10634 | 243 | 81 | | | | | |
| CONTIG338 | 24026930_c1_27 | 4973 | 10635 | 213 | 71 | | | | | |
| CONTIG339 | 4718808_c2_42 | 4974 | 10636 | 225 | 75 | | | | | |
| CONTIG340 | 26595288_f3_25 | 4975 | 10637 | 204 | 68 | | | | | |
| CONTIG340 | 1064000_c1_30 | 4976 | 10638 | 339 | 113 | | | | | |
| CONTIG340 | 30339591_c2_35 | 4977 | 10639 | 654 | 218 | | | | | |
| CONTIG340 | 21742077_c2_37 | 4978 | 10640 | 324 | 108 | | | | | |
| CONTIG340 | 24410292_c3_41 | 4979 | 10641 | 534 | 178 | | | | | |
| CONTIG341 | 11882767_f2_16 | 4980 | 10642 | 309 | 103 | | | | | |
| CONTIG342 | 23563886_f1_5 | 4981 | 10643 | 231 | 77 | | | | | |
| CONTIG342 | 34072137_f3_12 | 4982 | 10644 | 489 | 163 | | | | | |
| CONTIG342 | 4710801_f3_17 | 4983 | 10645 | 219 | 73 | | | | | |
| CONTIG343 | 32521877_c1_42 | 4984 | 10646 | 234 | 78 | | | | | |
| CONTIG344 | 5722591_c1_40 | 4985 | 10647 | 273 | 91 | | | | | |
| CONTIG344 | 21579650_c3_65 | 4986 | 10648 | 249 | 83 | | | | | |
| CONTIG346 | 32422687_f3_27 | 4987 | 10649 | 342 | 114 | | | | | |
| CONTIG346 | 23439037_c2_38 | 4988 | 10650 | 477 | 159 | | | | | |
| CONTIG347 | 34180260_f3_25 | 4989 | 10651 | 461 | 154 | | | | | |
| CONTIG348 | 9765713_c2_32 | 4990 | 10652 | 243 | 81 | | | | | |
| CONTIG35 | 16600318_f2_1 | 4991 | 10653 | 198 | 66 | | | | | |
| CONTIG351 | 24301562_f1_12 | 4992 | 10654 | 342 | 114 | | | | | |
| CONTIG351 | 13864188_f2_13 | 4993 | 10655 | 408 | 136 | | | | | |
| CONTIG351 | 14101503_f3_30 | 4994 | 10656 | 357 | 119 | | | | | |
| CONTIG352 | 7228412_f3_12 | 4995 | 10657 | 1461 | 487 | | | | | |
| CONTIG352 | 21916333_c2_42 | 4996 | 10658 | 813 | 271 | | | | | |
| CONTIG352 | 14317812_c3_52 | 4997 | 10659 | 204 | 68 | | | | | |
| CONTIG353 | 1040932_f1_1 | 4998 | 10660 | 192 | 64 | | | | | |
| CONTIG356 | 29480293_c2_40 | 4999 | 10661 | 204 | 68 | | | | | |
| CONTIG356 | 10636455_f1_6 | 5000 | 10662 | 279 | 93 | | | | | |
| CONTIG356 | 26739062_c1_40 | 5001 | 10663 | 201 | 67 | | | | | |
| CONTIG357 | 19537803_f2_27 | 5002 | 10664 | 642 | 214 | | | | | |
| CONTIG357 | 583342_f3_38 | 5003 | 10665 | 183 | 61 | | | | | |
| CONTIG360 | 35814131_f2_20 | 5004 | 10666 | 207 | 69 | | | | | |
| CONTIG361 | 22135958_c2_49 | 5005 | 10667 | 186 | 62 | | | | | |
| CONTIG362 | 33704130_f3_18 | 5006 | 10668 | 222 | 74 | | | | | |
| CONTIG363 | 523436_c2_44 | 5007 | 10669 | 537 | 179 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG363 | 9901663_c3_51 | 5008 | 10670 | 393 | 131 | | | | | |
| CONTIG363 | 26069375_c3_52 | 5009 | 10671 | 366 | 122 | | | | | |
| CONTIG364 | 16189428_c2_72 | 5010 | 10672 | 234 | 78 | | | | | |
| CONTIG364 | 24647807_c2_76 | 5011 | 10673 | 972 | 324 | | | | | |
| CONTIG365 | 22291538_c1_42 | 5012 | 10674 | 225 | 75 | | | | | |
| CONTIG367 | 16931555_f1_3 | 5013 | 10675 | 354 | 118 | | | | | |
| CONTIG367 | 36197840_f1_6 | 5014 | 10676 | 507 | 169 | | | | | |
| CONTIG367 | 26369082_f1_11 | 5015 | 10677 | 930 | 310 | | | | | |
| CONTIG367 | 5214843_f2_14 | 5016 | 10678 | 396 | 132 | | | | | |
| CONTIG367 | 24476437_f2_15 | 5017 | 10679 | 234 | 78 | | | | | |
| CONTIG367 | 24650811_f2_17 | 5018 | 10680 | 456 | 152 | | | | | |
| CONTIG367 | 36348576_f2_19 | 5019 | 10681 | 1407 | 469 | | | | | |
| CONTIG367 | 6509831_c1_42 | 5020 | 10682 | 192 | 64 | | | | | |
| CONTIG367 | 3238260_c1_43 | 5021 | 10683 | 237 | 79 | | | | | |
| CONTIG367 | 33994068_c2_52 | 5022 | 10684 | 276 | 92 | | | | | |
| CONTIG367 | 23570303_c2_54 | 5023 | 10685 | 228 | 76 | | | | | |
| CONTIG367 | 16210202_c3_75 | 5024 | 10686 | 270 | 90 | | | | | |
| CONTIG369 | 429687_f1_3 | 5025 | 10687 | 186 | 62 | | | | | |
| CONTIG369 | 14882932_f1_5 | 5026 | 10688 | 270 | 90 | | | | | |
| CONTIG369 | 34024217_f1_6 | 5027 | 10689 | 2433 | 811 | | | | | |
| CONTIG369 | 23960885_f2_12 | 5028 | 10690 | 795 | 265 | | | | | |
| CONTIG369 | 22846010_f2_13 | 5029 | 10691 | 612 | 204 | | | | | |
| CONTIG369 | 23531258_c1_33 | 5030 | 10692 | 198 | 66 | | | | | |
| CONTIG369 | 3207208_c1_38 | 5031 | 10693 | 237 | 79 | | | | | |
| CONTIG369 | 12363916_c1_41 | 5032 | 10694 | 567 | 189 | | | | | |
| CONTIG369 | 24330056_c1_42 | 5033 | 10695 | 216 | 72 | | | | | |
| CONTIG369 | 19631640_c2_43 | 5034 | 10696 | 726 | 242 | | | | | |
| CONTIG369 | 24651077_c2_53 | 5035 | 10697 | 432 | 144 | | | | | |
| CONTIG369 | 26587501_c3_54 | 5036 | 10698 | 633 | 211 | | | | | |
| CONTIG369 | 12595667_c3_61 | 5037 | 10699 | 294 | 98 | | | | | |
| CONTIG37 | 14709456_f1_2 | 5038 | 10700 | 228 | 76 | | | | | |
| CONTIG37 | 4692027_c2_7 | 5039 | 10701 | 327 | 109 | | | | | |
| CONTIG370 | 10634580_f2_21 | 5040 | 10702 | 279 | 93 | | | | | |
| CONTIG370 | 19587651_f3_26 | 5041 | 10703 | 195 | 65 | | | | | |
| CONTIG370 | 2868876_c1_38 | 5042 | 10704 | 549 | 183 | | | | | |
| CONTIG370 | 34472152_c1_41 | 5043 | 10705 | 459 | 153 | | | | | |
| CONTIG370 | 2515956_c2_53 | 5044 | 10706 | 528 | 176 | | | | | |
| CONTIG370 | 5115877_c3_58 | 5045 | 10707 | 546 | 182 | | | | | |
| CONTIG370 | 32597762_c3_64 | 5046 | 10708 | 186 | 62 | | | | | |
| CONTIG370 | 12303966_c3_65 | 5047 | 10709 | 315 | 105 | | | | | |
| CONTIG370 | 4375015_c3_66 | 5048 | 10710 | 246 | 82 | | | | | |
| CONTIG371 | 29300800_f2_17 | 5049 | 10711 | 249 | 83 | | | | | |
| CONTIG371 | 36368932_c1_45 | 5050 | 10712 | 189 | 63 | | | | | |
| CONTIG371 | 30756575_c1_55 | 5051 | 10713 | 345 | 115 | | | | | |
| CONTIG371 | 14063790_c1_59 | 5052 | 10714 | 756 | 252 | | | | | |
| CONTIG371 | 11213517_c2_61 | 5053 | 10715 | 726 | 242 | | | | | |
| CONTIG373 | 25500292_f3_26 | 5054 | 10716 | 1917 | 639 | | | | | |
| CONTIG373 | 30191284_c1_30 | 5055 | 10717 | 296 | 98 | | | | | |
| CONTIG373 | 3261258_c1_34 | 5056 | 10718 | 372 | 124 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG374 | 6439203_f1_2 | 5057 | 10719 | 405 | 135 | | | | | |
| CONTIG374 | 5158567_c3_102 | 5058 | 10720 | 279 | 93 | | | | | |
| CONTIG375 | 30275201_f2_11 | 5059 | 10721 | 291 | 97 | | | | | |
| CONTIG375 | 23839830_f3_38 | 5060 | 10722 | 183 | 61 | | | | | |
| CONTIG376 | 36349057_f1_6 | 5061 | 10723 | 381 | 127 | | | | | |
| CONTIG377 | 23862591_f3_34 | 5062 | 10724 | 315 | 105 | | | | | |
| CONTIG378 | 31269500_f2_26 | 5063 | 10725 | 852 | 284 | | | | | |
| CONTIG378 | 6522827_f3_49 | 5064 | 10726 | 288 | 96 | | | | | |
| CONTIG379 | 4802268_f1_1 | 5065 | 10727 | 747 | 249 | | | | | |
| CONTIG379 | 5119018_f1_2 | 5066 | 10728 | 924 | 308 | | | | | |
| CONTIG379 | 12128967_f2_15 | 5067 | 10729 | 624 | 208 | | | | | |
| CONTIG379 | 34017126_c1_41 | 5068 | 10730 | 183 | 61 | | | | | |
| CONTIG379 | 4880330_c2_47 | 5069 | 10731 | 192 | 64 | | | | | |
| CONTIG379 | 1354826_c2_49 | 5070 | 10732 | 336 | 112 | | | | | |
| CONTIG379 | 26676040_c2_50 | 5071 | 10733 | 621 | 207 | | | | | |
| CONTIG379 | 32714208_c2_52 | 5072 | 10734 | 198 | 66 | | | | | |
| CONTIG379 | 16833962_c3_60 | 5073 | 10735 | 189 | 63 | | | | | |
| CONTIG379 | 2770052_c3_61 | 5074 | 10736 | 297 | 99 | | | | | |
| CONTIG379 | 24611583_c3_62 | 5075 | 10737 | 261 | 87 | | | | | |
| CONTIG379 | 26755215_c3_73 | 5076 | 10738 | 822 | 274 | | | | | |
| CONTIG380 | 4876543_f3_34 | 5077 | 10739 | 453 | 151 | | | | | |
| CONTIG380 | 47343_c2_65 | 5078 | 10740 | 225 | 75 | | | | | |
| CONTIG380 | 24406687_c3_86 | 5079 | 10741 | 276 | 92 | | | | | |
| CONTIG381 | 563752_f3_25 | 5080 | 10742 | 291 | 97 | | | | | |
| CONTIG381 | 16072086_c2_47 | 5081 | 10743 | 222 | 74 | | | | | |
| CONTIG384 | 5101692_f2_2 | 5082 | 10744 | 336 | 112 | | | | | |
| CONTIG384 | 29822937_f1_4 | 5083 | 10745 | 192 | 64 | | | | | |
| CONTIG384 | 29345712_f3_51 | 5084 | 10746 | 720 | 240 | | | | | |
| CONTIG384 | 4722302_c2_77 | 5085 | 10747 | 501 | 167 | | | | | |
| CONTIG386 | 15663438_f1_6 | 5086 | 10748 | 810 | 270 | | | | | |
| CONTIG386 | 6031530_f2_22 | 5087 | 10749 | 183 | 61 | | | | | |
| CONTIG386 | 4882193_f3_32 | 5088 | 10750 | 2016 | 672 | | | | | |
| CONTIG386 | 15057628_f3_50 | 5089 | 10751 | 324 | 108 | | | | | |
| CONTIG386 | 33775037_c1_62 | 5090 | 10752 | 555 | 185 | | | | | |
| CONTIG386 | 36445958_c2_73 | 5091 | 10753 | 606 | 202 | | | | | |
| CONTIG386 | 33885766_c2_76 | 5092 | 10754 | 270 | 90 | | | | | |
| CONTIG386 | 30205133_c3_96 | 5093 | 10755 | 210 | 70 | | | | | |
| CONTIG386 | 2552017_c3_97 | 5094 | 10756 | 825 | 275 | | | | | |
| CONTIG389 | 12970166_f1_5 | 5095 | 10757 | 363 | 121 | | | | | |
| CONTIG389 | 21579025_f3_38 | 5096 | 10758 | 507 | 169 | | | | | |
| CONTIG390 | 12969081_f1_9 | 5097 | 10759 | 183 | 61 | | | | | |
| CONTIG390 | 31823553_f1_11 | 5098 | 10760 | 204 | 68 | | | | | |
| CONTIG390 | 24304078_f3_38 | 5099 | 10761 | 237 | 79 | | | | | |
| CONTIG390 | 7305333_f3_50 | 5100 | 10762 | 186 | 62 | | | | | |
| CONTIG390 | 29307090_f3_51 | 5101 | 10763 | 1319 | 440 | | | | | |
| CONTIG391 | 25657907_f1_2 | 5102 | 10764 | 573 | 191 | | | | | |
| CONTIG391 | 58340_f1_12 | 5103 | 10765 | 474 | 158 | | | | | |
| CONTIG391 | 4881468_f2_17 | 5104 | 10766 | 441 | 147 | | | | | |
| CONTIG391 | 33804542_f3_33 | 5105 | 10767 | 702 | 234 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG391 | 31464808_f3_36 | 5106 | 10768 | 465 | 155 | | | | | |
| CONTIG391 | 6892062_f3_38 | 5107 | 10769 | 288 | 96 | | | | | |
| CONTIG392 | 36523503_c3_87 | 5108 | 10770 | 231 | 77 | | | | | |
| CONTIG392 | 35346907_c3_93 | 5109 | 10771 | 183 | 61 | | | | | |
| CONTIG392 | 6818751_c3_97 | 5110 | 10772 | 189 | 63 | | | | | |
| CONTIG393 | 4078393_c2_59 | 5111 | 10773 | 282 | 94 | | | | | |
| CONTIG394 | 20337881_f3_48 | 5112 | 10774 | 198 | 66 | | | | | |
| CONTIG394 | 26740637_c2_76 | 5113 | 10775 | 525 | 175 | | | | | |
| CONTIG394 | 23443808_c3_90 | 5114 | 10776 | 441 | 147 | | | | | |
| CONTIG395 | 32714562_f1_20 | 5115 | 10777 | 192 | 64 | | | | | |
| CONTIG395 | 978193_f3_36 | 5116 | 10778 | 210 | 70 | | | | | |
| CONTIG397 | 21564443_f3_33 | 5117 | 10779 | 522 | 174 | | | | | |
| CONTIG397 | 22859802_c3_73 | 5118 | 10780 | 183 | 61 | | | | | |
| CONTIG398 | 674191_f1_1 | 5119 | 10781 | 843 | 281 | | | | | |
| CONTIG398 | 34238555_f2_10 | 5120 | 10782 | 282 | 94 | | | | | |
| CONTIG398 | 24646910_f2_11 | 5121 | 10783 | 462 | 154 | | | | | |
| CONTIG398 | 35234806_c1_43 | 5122 | 10784 | 339 | 113 | | | | | |
| CONTIG398 | 12581253_c1_55 | 5123 | 10785 | 219 | 73 | | | | | |
| CONTIG398 | 24625127_c2_60 | 5124 | 10786 | 198 | 66 | | | | | |
| CONTIG398 | 29845262_c2_72 | 5125 | 10787 | 282 | 94 | | | | | |
| CONTIG398 | 6300465_c3_87 | 5126 | 10788 | 186 | 62 | | | | | |
| CONTIG399 | 9850631_f3_47 | 5127 | 10789 | 210 | 70 | | | | | |
| CONTIG399 | 4330033_f3_60 | 5128 | 10790 | 399 | 133 | | | | | |
| CONTIG4 | 23626662_c3_2 | 5129 | 10791 | 315 | 105 | | | | | |
| CONTIG4 | 24787507_c2_2 | 5130 | 10792 | 687 | 229 | | | | | |
| CONTIG400 | 25428882_f2_18 | 5131 | 10793 | 186 | 62 | | | | | |
| CONTIG400 | 4882068_f2_19 | 5132 | 10794 | 306 | 102 | | | | | |
| CONTIG401 | 24349015_c2_78 | 5133 | 10795 | 186 | 62 | | | | | |
| CONTIG402 | 30098465_c3_78 | 5134 | 10796 | 255 | 85 | | | | | |
| CONTIG403 | 976062_f1_6 | 5135 | 10797 | 339 | 113 | | | | | |
| CONTIG403 | 26578201_f1_8 | 5136 | 10798 | 324 | 108 | | | | | |
| CONTIG403 | 31256953_f2_22 | 5137 | 10799 | 282 | 94 | | | | | |
| CONTIG403 | 22384683_f2_27 | 5138 | 10800 | 570 | 190 | | | | | |
| CONTIG403 | 24063540_f2_31 | 5139 | 10801 | 360 | 102 | | | | | |
| CONTIG403 | 15098426_f3_45 | 5140 | 10802 | 297 | 99 | | | | | |
| CONTIG403 | 24644503_c1_57 | 5141 | 10803 | 417 | 139 | | | | | |
| CONTIG403 | 13162887_c1_58 | 5142 | 10804 | 582 | 194 | | | | | |
| CONTIG403 | 16145253_c1_61 | 5143 | 10805 | 213 | 71 | | | | | |
| CONTIG403 | 13083385_c1_66 | 5144 | 10806 | 1068 | 356 | | | | | |
| CONTIG403 | 2189012_c1_70 | 5145 | 10807 | 186 | 62 | | | | | |
| CONTIG403 | 24644661_c2_75 | 5146 | 10808 | 282 | 94 | | | | | |
| CONTIG403 | 36505133_c2_76 | 5147 | 10809 | 375 | 125 | | | | | |
| CONTIG403 | 969555_c2_83 | 5148 | 10810 | 183 | 61 | | | | | |
| CONTIG403 | 26619755_c3_88 | 5149 | 10811 | 237 | 79 | | | | | |
| CONTIG403 | 22070937_c3_90 | 5150 | 10812 | 837 | 279 | | | | | |
| CONTIG404 | 15132081_f1_25 | 5151 | 10813 | 219 | 73 | | | | | |
| CONTIG404 | 4088917_f3_55 | 5152 | 10814 | 324 | 108 | | | | | |
| CONTIG404 | 788562_c2_94 | 5153 | 10815 | 486 | 162 | | | | | |
| CONTIG404 | 24228382_c3_105 | 5154 | 10816 | 246 | 82 | | | | | |
| | | | | 480 | 160 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG405 | 16052187_c1_91 | 5155 | 10817 | 231 | 77 | | | | | |
| CONTIG407 | 4487555_f1_7 | 5156 | 10818 | 438 | 146 | | | | | |
| CONTIG407 | 15098163_c2_77 | 5157 | 10819 | 303 | 101 | | | | | |
| CONTIG408 | 36501525_c2_78 | 5158 | 10820 | 231 | 77 | | | | | |
| CONTIG409 | 562758_f1_5 | 5159 | 10821 | 201 | 67 | | | | | |
| CONTIG409 | 33244092_f1_10 | 5160 | 10822 | 615 | 205 | | | | | |
| CONTIG409 | 16257132_f2_33 | 5161 | 10823 | 195 | 65 | | | | | |
| CONTIG409 | 23860287_c1_73 | 5162 | 10824 | 570 | 190 | | | | | |
| CONTIG409 | 978382_c1_74 | 5163 | 10825 | 357 | 119 | | | | | |
| CONTIG409 | 4150463_c2_81 | 5164 | 10826 | 402 | 134 | | | | | |
| CONTIG409 | 26267713_c2_82 | 5165 | 10827 | 444 | 148 | | | | | |
| CONTIG409 | 30180187_c3_90 | 5166 | 10828 | 1122 | 374 | | | | | |
| CONTIG410 | 16535932_f1_1 | 5167 | 10829 | 192 | 64 | | | | | |
| CONTIG410 | 26756876_c2_87 | 5168 | 10830 | 315 | 105 | | | | | |
| CONTIG412 | 9781875_c1_56 | 5169 | 10831 | 468 | 156 | | | | | |
| CONTIG412 | 14067533_c1_59 | 5170 | 10832 | 1089 | 363 | | | | | |
| CONTIG415 | 36519025_f1_6 | 5171 | 10833 | 249 | 83 | | | | | |
| CONTIG415 | 1456966_f1_25 | 5172 | 10834 | 269 | 90 | | | | | |
| CONTIG415 | 7164127_f2_40 | 5173 | 10835 | 186 | 62 | | | | | |
| CONTIG415 | 14333277_f2_41 | 5174 | 10836 | 1011 | 337 | | | | | |
| CONTIG415 | 123754511_f3_45 | 5175 | 10837 | 360 | 120 | | | | | |
| CONTIG415 | 4016588_c1_62 | 5176 | 10838 | 1329 | 443 | | | | | |
| CONTIG415 | 24430387_c1_63 | 5177 | 10839 | 216 | 72 | | | | | |
| CONTIG415 | 16206933_c3_91 | 5178 | 10840 | 249 | 83 | | | | | |
| CONTIG415 | 11213890_c3_93 | 5179 | 10841 | 183 | 61 | | | | | |
| CONTIG417 | 14585875_f2_26 | 5180 | 10842 | 369 | 123 | | | | | |
| CONTIG417 | 4939068_f2_27 | 5181 | 10843 | 330 | 110 | | | | | |
| CONTIG417 | 16449033_f2_28 | 5182 | 10844 | 228 | 76 | | | | | |
| CONTIG417 | 25472775_f2_33 | 5183 | 10845 | 225 | 75 | | | | | |
| CONTIG417 | 24737777_f2_40 | 5184 | 10846 | 201 | 67 | | | | | |
| CONTIG417 | 4689377_f3_49 | 5185 | 10847 | 624 | 208 | | | | | |
| CONTIG417 | 13089755_f3_50 | 5186 | 10848 | 297 | 99 | | | | | |
| CONTIG417 | 13064701_c1_66 | 5187 | 10849 | 924 | 308 | | | | | |
| CONTIG417 | 5113818_c1_67 | 5188 | 10850 | 237 | 79 | | | | | |
| CONTIG417 | 36152043_c1_70 | 5189 | 10851 | 306 | 102 | | | | | |
| CONTIG417 | 12710313_c1_85 | 5190 | 10852 | 279 | 93 | | | | | |
| CONTIG417 | 29797152_c1_86 | 5191 | 10853 | 195 | 65 | | | | | |
| CONTIG417 | 22766715_c2_91 | 5192 | 10854 | 369 | 123 | | | | | |
| CONTIG417 | 1172783_c2_93 | 5193 | 10855 | 354 | 118 | | | | | |
| CONTIG417 | 596062_c2_94 | 5194 | 10856 | 189 | 63 | | | | | |
| CONTIG417 | 20176562_c2_95 | 5195 | 10857 | 192 | 64 | | | | | |
| CONTIG417 | 2830015_c3_106 | 5196 | 10858 | 522 | 174 | | | | | |
| CONTIG417 | 2425063_c3_107 | 5197 | 10859 | 231 | 77 | | | | | |
| CONTIG417 | 26751500_c3_108 | 5198 | 10860 | 243 | 81 | | | | | |
| CONTIG417 | 23944181_c3_109 | 5199 | 10861 | 237 | 79 | | | | | |
| CONTIG417 | 11149130_c3_110 | 5200 | 10862 | 327 | 109 | | | | | |
| CONTIG417 | 4095068_c3_111 | 5201 | 10863 | 291 | 97 | | | | | |
| CONTIG417 | 36573586_c3_112 | 5202 | 10864 | 618 | 206 | | | | | |
| CONTIG417 | 2926025_c3_120 | 5203 | 10865 | 351 | 117 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG417 | 31492187_c3_126 | 5204 | 10866 | 537 | 179 | | | | | |
| CONTIG419 | 25527333_f1_2 | 5205 | 10867 | 204 | 68 | | | | | |
| CONTIG419 | 31830442_f3_51 | 5206 | 10868 | 276 | 92 | | | | | |
| CONTIG419 | 17087599_c1_75 | 5207 | 10869 | 298 | 99 | | | | | |
| CONTIG419 | 34115881_c1_102 | 5208 | 10870 | 921 | 307 | | | | | |
| CONTIG419 | 25958441_c3_156 | 5209 | 10871 | 258 | 86 | | | | | |
| CONTIG420 | 17033191_f2_23 | 5210 | 10872 | 186 | 62 | | | | | |
| CONTIG421 | 35671890_f2_36 | 5211 | 10873 | 192 | 64 | | | | | |
| CONTIG422 | 1379750_c2_106 | 5212 | 10874 | 183 | 61 | | | | | |
| CONTIG422 | 24036533_f1_10 | 5213 | 10875 | 252 | 84 | | | | | |
| CONTIG423 | 24253275_f3_61 | 5214 | 10876 | 210 | 70 | | | | | |
| CONTIG423 | 4331568_c1_68 | 5215 | 10877 | 414 | 138 | | | | | |
| CONTIG423 | 35706317_c1_72 | 5216 | 10878 | 405 | 135 | | | | | |
| CONTIG423 | 4022201_c2_81 | 5217 | 10879 | 375 | 125 | | | | | |
| CONTIG423 | 32039193_c2_99 | 5218 | 10880 | 381 | 127 | | | | | |
| CONTIG423 | 32147708_c2_101 | 5219 | 10881 | 1419 | 473 | | | | | |
| CONTIG423 | 7132062_c3_109 | 5220 | 10882 | 498 | 166 | | | | | |
| CONTIG423 | 24506900_c3_110 | 5221 | 10883 | 378 | 126 | | | | | |
| CONTIG424 | 31735031_f3_78 | 5222 | 10884 | 474 | 158 | | | | | |
| CONTIG425 | 22145311_f1_6 | 5223 | 10885 | 243 | 81 | | | | | |
| CONTIG425 | 35292176_f1_16 | 5224 | 10886 | 234 | 78 | | | | | |
| CONTIG425 | 23990942_c1_56 | 5225 | 10887 | 1383 | 461 | | | | | |
| CONTIG426 | 5991452_f3_81 | 5226 | 10888 | 327 | 109 | | | | | |
| CONTIG427 | 36588177_c1_90 | 5227 | 10889 | 387 | 129 | | | | | |
| CONTIG428 | 32300383_c1_84 | 5228 | 10890 | 552 | 184 | | | | | |
| CONTIG429 | 20885931_f1_6 | 5229 | 10891 | 198 | 66 | | | | | |
| CONTIG429 | 3922262_f1_12 | 5230 | 10892 | 597 | 199 | | | | | |
| CONTIG429 | 5352318_f2_30 | 5231 | 10893 | 387 | 129 | | | | | |
| CONTIG429 | 31503775_f2_44 | 5232 | 10894 | 267 | 89 | | | | | |
| CONTIG429 | 25484790_c2_108 | 5233 | 10895 | 1167 | 389 | | | | | |
| CONTIG429 | 4813568_c3_109 | 5234 | 10896 | 1005 | 335 | | | | | |
| CONTIG429 | 675915_c3_128 | 5235 | 10897 | 801 | 267 | | | | | |
| CONTIG429 | 23676711_c3_138 | 5236 | 10898 | 342 | 114 | | | | | |
| CONTIG431 | 26681450_f1_24 | 5237 | 10899 | 363 | 121 | | | | | |
| CONTIG435 | 10439012_f1_1 | 5238 | 10900 | 390 | 130 | | | | | |
| CONTIG435 | 867157_f2_17 | 5239 | 10901 | 1152 | 384 | | | | | |
| CONTIG435 | 35286712_f2_20 | 5240 | 10902 | 1056 | 352 | | | | | |
| CONTIG435 | 13080152_f2_26 | 5241 | 10903 | 1500 | 500 | | | | | |
| CONTIG435 | 10430337_f2_28 | 5242 | 10904 | 522 | 174 | | | | | |
| CONTIG435 | 29944700_f3_38 | 5243 | 10905 | 885 | 295 | | | | | |
| CONTIG435 | 30351632_f3_39 | 5244 | 10906 | 1893 | 631 | | | | | |
| CONTIG436 | 3131557_f3_56 | 5245 | 10907 | 387 | 129 | | | | | |
| CONTIG436 | 22898890_c1_90 | 5246 | 10908 | 588 | 196 | | | | | |
| CONTIG436 | 26833427_c1_94 | 5247 | 10909 | 1032 | 344 | | | | | |
| CONTIG436 | 13942787_c1_97 | 5248 | 10910 | 630 | 210 | | | | | |
| CONTIG436 | 21756411_c2_108 | 5249 | 10911 | 555 | 185 | | | | | |
| CONTIG436 | 35631702_c2_109 | 5250 | 10912 | 1386 | 462 | | | | | |
| CONTIG436 | 13159783_c2_116 | 5251 | 10913 | 837 | 279 | | | | | |
| CONTIG436 | 12588182_c3_135 | 5252 | 10914 | 357 | 119 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG436 | 19581340_c3_144 | 5253 | 10915 | 396 | 132 | | | | | |
| CONTIG436 | 24065632_c3_145 | 5254 | 10916 | 987 | 329 | | | | | |
| CONTIG437 | 13697961_c2_99 | 5255 | 10917 | 207 | 69 | | | | | |
| CONTIG438 | 35835216_f1_16 | 5256 | 10918 | 300 | 100 | | | | | |
| CONTIG438 | 16985790_c1_93 | 5257 | 10919 | 258 | 86 | | | | | |
| CONTIG438 | 32660141_c3_187 | 5258 | 10920 | 219 | 73 | | | | | |
| CONTIG439 | 17000781_f1_25 | 5259 | 10921 | 192 | 64 | | | | | |
| CONTIG440 | 995140_f1_16 | 5260 | 10922 | 1038 | 346 | | | | | |
| CONTIG440 | 11738432_c1_80 | 5261 | 10923 | 327 | 109 | | | | | |
| CONTIG440 | 24817181_c2_100 | 5262 | 10924 | 930 | 310 | | | | | |
| CONTIG440 | 35339650_c2_122 | 5263 | 10925 | 246 | 82 | | | | | |
| CONTIG441 | 16848215_f1_14 | 5264 | 10926 | 195 | 65 | | | | | |
| CONTIG441 | 11022306_f2_29 | 5265 | 10927 | 183 | 61 | | | | | |
| CONTIG441 | 3409776_c2_87 | 5266 | 10928 | 183 | 61 | | | | | |
| CONTIG443 | 26251912_f1_4 | 5267 | 10929 | 258 | 86 | | | | | |
| CONTIG443 | 22853375_f1_10 | 5268 | 10930 | 480 | 160 | | | | | |
| CONTIG443 | 4726592_f1_14 | 5269 | 10931 | 420 | 140 | | | | | |
| CONTIG443 | 20156952_f1_16 | 5270 | 10932 | 387 | 129 | | | | | |
| CONTIG443 | 16526018_f1_17 | 5271 | 10933 | 873 | 291 | | | | | |
| CONTIG443 | 16673785_f2_27 | 5272 | 10934 | 501 | 167 | | | | | |
| CONTIG443 | 24778965_f2_30 | 5273 | 10935 | 273 | 91 | | | | | |
| CONTIG443 | 16619562_f2_33 | 5274 | 10936 | 444 | 148 | | | | | |
| CONTIG443 | 15862576_f2_34 | 5275 | 10937 | 408 | 136 | | | | | |
| CONTIG443 | 9806528_f2_35 | 5276 | 10938 | 573 | 191 | | | | | |
| CONTIG443 | 24407317_f2_39 | 5277 | 10939 | 453 | 151 | | | | | |
| CONTIG443 | 21992077_f2_42 | 5278 | 10940 | 204 | 68 | | | | | |
| CONTIG443 | 9897808_f3_48 | 5279 | 10941 | 462 | 154 | | | | | |
| CONTIG443 | 408457_f3_52 | 5280 | 10942 | 210 | 70 | | | | | |
| CONTIG443 | 3152003_f3_53 | 5281 | 10943 | 225 | 75 | | | | | |
| CONTIG443 | 26767342_f3_60 | 5282 | 10944 | 207 | 69 | | | | | |
| CONTIG443 | 4476518_f3_61 | 5283 | 10945 | 1398 | 466 | | | | | |
| CONTIG443 | 3004760_f3_67 | 5284 | 10946 | 210 | 70 | | | | | |
| CONTIG443 | 6292028_c1_79 | 5285 | 10947 | 384 | 128 | | | | | |
| CONTIG443 | 35338902_c2_110 | 5286 | 10948 | 225 | 75 | | | | | |
| CONTIG443 | 26462875_c3_131 | 5287 | 10949 | 258 | 86 | | | | | |
| CONTIG443 | 36150427_c3_142 | 5288 | 10950 | 195 | 65 | | | | | |
| CONTIG444 | 23869162_c2_140 | 5289 | 10951 | 282 | 94 | | | | | |
| CONTIG445 | 3940751_f1_2 | 5290 | 10952 | 225 | 75 | | | | | |
| CONTIG445 | 31932625_f1_3 | 5291 | 10953 | 183 | 61 | | | | | |
| CONTIG445 | 7008_f1_23 | 5292 | 10954 | 501 | 167 | | | | | |
| CONTIG445 | 24415875_f2_26 | 5293 | 10955 | 318 | 106 | | | | | |
| CONTIG445 | 33853806_f2_28 | 5294 | 10956 | 282 | 94 | | | | | |
| CONTIG445 | 24661425_f2_41 | 5295 | 10957 | 477 | 159 | | | | | |
| CONTIG445 | 24413887_c1_62 | 5296 | 10958 | 528 | 176 | | | | | |
| CONTIG445 | 22909516_c2_96 | 5297 | 10959 | 261 | 87 | | | | | |
| CONTIG445 | 1414837_c3_124 | 5298 | 10960 | 591 | 197 | | | | | |
| CONTIG445 | 16188917_c3_127 | 5299 | 10961 | 213 | 71 | | | | | |
| CONTIG446 | 42712_f2_27 | 5300 | 10962 | 333 | 111 | | | | | |
| CONTIG446 | 10411683_c1_67 | 5301 | 10963 | 363 | 121 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG446 | 32065641_c2_89 | 5302 | 10964 | 264 | 88 | | | | | |
| CONTIG446 | 35323312_c3_101 | 5303 | 10965 | 339 | 113 | | | | | |
| CONTIG448 | 32300026_f1_8 | 5304 | 10966 | 669 | 223 | | | | | |
| CONTIG448 | 33883541_f2_35 | 5305 | 10967 | 345 | 115 | | | | | |
| CONTIG448 | 7119500_f2_54 | 5306 | 10968 | 924 | 308 | | | | | |
| CONTIG448 | 23956880_f3_65 | 5307 | 10969 | 885 | 295 | | | | | |
| CONTIG448 | 21519626_c1_123 | 5308 | 10970 | 189 | 63 | | | | | |
| CONTIG448 | 3165933_c2_130 | 5309 | 10971 | 753 | 251 | | | | | |
| CONTIG448 | 2744655_c2_134 | 5310 | 10972 | 363 | 121 | | | | | |
| CONTIG449 | 15641942_c2_154 | 5311 | 10973 | 207 | 69 | | | | | |
| CONTIG449 | 25583402_f2_67 | 5312 | 10974 | 192 | 64 | | | | | |
| CONTIG449 | 11848555_c2_161 | 5313 | 10975 | 243 | 81 | | | | | |
| CONTIG450 | 984788_f2_32 | 5314 | 10976 | 222 | 74 | | | | | |
| CONTIG450 | 24081268_f2_60 | 5315 | 10977 | 354 | 118 | | | | | |
| CONTIG450 | 14160691_f3_66 | 5316 | 10978 | 198 | 66 | | | | | |
| CONTIG450 | 522142_c3_176 | 5317 | 10979 | 204 | 68 | | | | | |
| CONTIG451 | 33208290_f1_13 | 5318 | 10980 | 1626 | 542 | | | | | |
| CONTIG451 | 26223761_f3_96 | 5319 | 10981 | 429 | 143 | | | | | |
| CONTIG451 | 32057312_c1_110 | 5320 | 10982 | 333 | 111 | | | | | |
| CONTIG451 | 20156577_c3_166 | 5321 | 10983 | 243 | 81 | | | | | |
| CONTIG452 | 12535418_f1_4 | 5322 | 10984 | 204 | 68 | | | | | |
| CONTIG452 | 29329665_f1_33 | 5323 | 10985 | 312 | 104 | | | | | |
| CONTIG452 | 251877_f2_48 | 5324 | 10986 | 336 | 112 | | | | | |
| CONTIG452 | 13682961_c3_162 | 5325 | 10987 | 534 | 178 | | | | | |
| CONTIG453 | 1353518_f1_26 | 5326 | 10988 | 207 | 69 | | | | | |
| CONTIG453 | 12548216_f2_46 | 5327 | 10989 | 252 | 84 | | | | | |
| CONTIG453 | 2645626_f2_48 | 5328 | 10990 | 849 | 283 | | | | | |
| CONTIG453 | 564203_c1_83 | 5329 | 10991 | 1740 | 580 | | | | | |
| CONTIG453 | 26745133_c1_92 | 5330 | 10992 | 225 | 75 | | | | | |
| CONTIG453 | 5100032_c1_100 | 5331 | 10993 | 246 | 82 | | | | | |
| CONTIG453 | 29535313_c1_103 | 5332 | 10994 | 519 | 173 | | | | | |
| CONTIG453 | 30484791_c2_121 | 5333 | 10995 | 204 | 68 | | | | | |
| CONTIG453 | 23837802_c2_123 | 5334 | 10996 | 210 | 70 | | | | | |
| CONTIG453 | 23444717_c3_133 | 5335 | 10997 | 492 | 164 | | | | | |
| CONTIG453 | 10726592_c3_148 | 5336 | 10998 | 411 | 137 | | | | | |
| CONTIG454 | 13790832_f1_22 | 5337 | 10999 | 195 | 65 | | | | | |
| CONTIG455 | 34188765_f2_44 | 5338 | 11000 | 216 | 72 | | | | | |
| CONTIG455 | 12206653_f3_77 | 5339 | 11001 | 234 | 78 | | | | | |
| CONTIG455 | 26375632_c1_128 | 5340 | 11002 | 234 | 78 | | | | | |
| CONTIG455 | 6429627_c2_154 | 5341 | 11003 | 285 | 95 | | | | | |
| CONTIG456 | 24719182_f1_10 | 5342 | 11004 | 216 | 72 | | | | | |
| CONTIG456 | 21878392_f1_15 | 5343 | 11005 | 261 | 87 | | | | | |
| CONTIG456 | 14565641_f3_80 | 5344 | 11006 | 243 | 81 | | | | | |
| CONTIG456 | 24782768_c1_130 | 5345 | 11007 | 183 | 61 | | | | | |
| CONTIG456 | 3125905_c3_204 | 5346 | 11008 | 234 | 78 | | | | | |
| CONTIG457 | 16619540_f2_67 | 5347 | 11009 | 210 | 70 | | | | | |
| CONTIG457 | 30578461_f3_95 | 5348 | 11010 | 243 | 81 | | | | | |
| CONTIG457 | 16839066_c2_150 | 5349 | 11011 | 207 | 69 | | | | | |
| CONTIG458 | 21484377_f1_8 | 5350 | 11012 | 264 | 88 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG458 | 11117202_f2_132 | 5351 | 11013 | 222 | 74 | | | | | |
| CONTIG459 | 11179693_f2_21 | 5352 | 11014 | 465 | 155 | | | | | |
| CONTIG462 | 284787_f1_14 | 5353 | 11015 | 795 | 265 | | | | | |
| CONTIG462 | 24431415_f1_22 | 5354 | 11016 | 186 | 62 | | | | | |
| CONTIG462 | 22439131_c1_90 | 5355 | 11017 | 339 | 113 | | | | | |
| CONTIG462 | 14745665_c1_91 | 5356 | 11018 | 351 | 117 | | | | | |
| CONTIG462 | 10746018_c2_108 | 5357 | 11019 | 222 | 74 | | | | | |
| CONTIG462 | 2167311_c2_121 | 5358 | 11020 | 447 | 149 | | | | | |
| CONTIG462 | 10815718_c3_142 | 5359 | 11021 | 393 | 131 | | | | | |
| CONTIG462 | 20916702_c3_143 | 5360 | 11022 | 672 | 224 | | | | | |
| CONTIG462 | 32147708_c3_144 | 5361 | 11023 | 1347 | 449 | | | | | |
| CONTIG463 | 22541312_f3_61 | 5362 | 11024 | 207 | 69 | | | | | |
| CONTIG463 | 7213408_f3_62 | 5363 | 11025 | 234 | 78 | | | | | |
| CONTIG463 | 16207251_c1_91 | 5364 | 11026 | 324 | 108 | | | | | |
| CONTIG464 | 16533162_f1_2 | 5365 | 11027 | 1161 | 387 | | | | | |
| CONTIG464 | 23695751_f2_23 | 5366 | 11028 | 1665 | 555 | | | | | |
| CONTIG464 | 32226650_c1_70 | 5367 | 11029 | 228 | 76 | | | | | |
| CONTIG464 | 2131291_c2_85 | 5368 | 11030 | 741 | 247 | | | | | |
| CONTIG465 | 270807_c2_165 | 5369 | 11031 | 261 | 87 | | | | | |
| CONTIG465 | 6677291_c2_165 | 5370 | 11032 | 207 | 69 | | | | | |
| CONTIG467 | 9801927_f2_58 | 5371 | 11033 | 972 | 324 | | | | | |
| CONTIG468 | 17011062_f3_103 | 5372 | 11034 | 510 | 170 | | | | | |
| CONTIG468 | 1442175_f3_105 | 5373 | 11035 | 276 | 92 | | | | | |
| CONTIG468 | 10197555_c1_137 | 5374 | 11036 | 336 | 112 | | | | | |
| CONTIG468 | 23960941_c2_175 | 5375 | 11037 | 768 | 256 | | | | | |
| CONTIG468 | 16285050_c3_177 | 5376 | 11038 | 351 | 117 | | | | | |
| CONTIG469 | 900841_f1_2 | 5377 | 11039 | 195 | 65 | | | | | |
| CONTIG469 | 32691941_c1_105 | 5378 | 11040 | 213 | 71 | | | | | |
| CONTIG469 | 2132827_c3_173 | 5379 | 11041 | 189 | 63 | | | | | |
| CONTIG47 | 2154003_f2_3 | 5380 | 11042 | 207 | 69 | | | | | |
| CONTIG470 | 4429212_f1_11 | 5381 | 11043 | 534 | 178 | | | | | |
| CONTIG470 | 21522283_c1_106 | 5382 | 11044 | 255 | 85 | | | | | |
| CONTIG470 | 26252193_c2_153 | 5383 | 11045 | 207 | 69 | | | | | |
| CONTIG470 | 32117201_c3_204 | 5384 | 11046 | 225 | 75 | | | | | |
| CONTIG471 | 32213278_f1_1 | 5385 | 11047 | 195 | 65 | | | | | |
| CONTIG471 | 1043968_f1_2 | 5386 | 11048 | 198 | 66 | | | | | |
| CONTIG471 | 2129526_f2_27 | 5387 | 11049 | 192 | 64 | | | | | |
| CONTIG471 | 12313528_c2_113 | 5388 | 11050 | 363 | 121 | | | | | |
| CONTIG471 | 11728926_c2_116 | 5389 | 11051 | 225 | 75 | | | | | |
| CONTIG472 | 36117968_f1_1 | 5390 | 11052 | 219 | 73 | | | | | |
| CONTIG472 | 25525333_f1_2 | 5391 | 11053 | 426 | 142 | | | | | |
| CONTIG472 | 32301461_c1_109 | 5392 | 11054 | 195 | 65 | | | | | |
| CONTIG472 | 22283442_c2_149 | 5393 | 11055 | 1359 | 453 | | | | | |
| CONTIG472 | 10320382_c2_151 | 5394 | 11056 | 2247 | 749 | | | | | |
| CONTIG472 | 24491266_c3_177 | 5395 | 11057 | 3009 | 1003 | | | | | |
| CONTIG473 | 116287_f1_5 | 5396 | 11058 | 1971 | 657 | | | | | |
| CONTIG473 | 21742211_f3_70 | 5397 | 11059 | 1236 | 412 | | | | | |
| CONTIG473 | 3400141_c2_149 | 5398 | 11060 | 567 | 189 | | | | | |
| CONTIG475 | 12257018_f1_33 | 5399 | 11061 | 195 | 65 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG475 | 10955042_c2_180 | 5400 | 11062 | 249 | 83 | | | | | |
| CONTIG475 | 14661680_c3_220 | 5401 | 11063 | 201 | 67 | | | | | |
| CONTIG476 | 35646916_f2_49 | 5402 | 11064 | 183 | 61 | | | | | |
| CONTIG476 | 25634437_c2_169 | 5403 | 11065 | 216 | 72 | | | | | |
| CONTIG477 | 32116557_f1_24 | 5404 | 11066 | 282 | 94 | | | | | |
| CONTIG477 | 2931552_c1_143 | 5405 | 11067 | 384 | 128 | | | | | |
| CONTIG477 | 32617003_c1_144 | 5406 | 11068 | 183 | 61 | | | | | |
| CONTIG477 | 4144552_c1_162 | 5407 | 11069 | 228 | 76 | | | | | |
| CONTIG477 | 22772687_c1_169 | 5408 | 11070 | 186 | 62 | | | | | |
| CONTIG477 | 4787518_c2_187 | 5409 | 11071 | 336 | 112 | | | | | |
| CONTIG478 | 12697175_f2_69 | 5410 | 11072 | 429 | 143 | | | | | |
| CONTIG478 | 4352253_f3_109 | 5411 | 11073 | 345 | 115 | | | | | |
| CONTIG478 | 1058452_f3_140 | 5412 | 11074 | 234 | 78 | | | | | |
| CONTIG478 | 4551262_c2_204 | 5413 | 11075 | 675 | 225 | | | | | |
| CONTIG479 | 5136015_f1_1 | 5414 | 11076 | 249 | 83 | | | | | |
| CONTIG479 | 23706377_c1_147 | 5415 | 11077 | 186 | 62 | | | | | |
| CONTIG479 | 2538508_c2_193 | 5416 | 11078 | 1002 | 334 | | | | | |
| CONTIG479 | 16284462_c3_238 | 5417 | 11079 | 186 | 62 | | | | | |
| CONTIG479 | 31410277_c3_252 | 5418 | 11080 | 234 | 78 | | | | | |
| CONTIG480 | 34261542_c1_168 | 5419 | 11081 | 1395 | 465 | | | | | |
| CONTIG480 | 19581591_c2_205 | 5420 | 11082 | 2637 | 879 | | | | | |
| CONTIG480 | 3923507_c3_234 | 5421 | 11083 | 219 | 73 | | | | | |
| CONTIG482 | 32032765_f1_44 | 5422 | 11084 | 204 | 68 | | | | | |
| CONTIG482 | 34178455_f3_122 | 5423 | 11085 | 783 | 261 | | | | | |
| CONTIG482 | 22910842_c1_140 | 5424 | 11086 | 351 | 117 | | | | | |
| CONTIG482 | 14073293_c2_195 | 5425 | 11087 | 240 | 80 | | | | | |
| CONTIG483 | 11738212_f1_15 | 5426 | 11088 | 219 | 73 | | | | | |
| CONTIG483 | 7157901_f3_87 | 5427 | 11089 | 237 | 79 | | | | | |
| CONTIG483 | 22911318_f1_17 | 5428 | 11090 | 195 | 65 | | | | | |
| CONTIG483 | 11973425_f2_92 | 5429 | 11091 | 285 | 95 | | | | | |
| CONTIG485 | 14535938_f3_125 | 5430 | 11092 | 381 | 127 | | | | | |
| CONTIG485 | 1307942_c1_151 | 5431 | 11093 | 741 | 247 | | | | | |
| CONTIG485 | 36447656_c1_153 | 5432 | 11094 | 549 | 183 | | | | | |
| CONTIG485 | 19540843_c1_155 | 5433 | 11095 | 699 | 233 | | | | | |
| CONTIG485 | 31439827_c1_158 | 5434 | 11096 | 636 | 212 | | | | | |
| CONTIG485 | 21756332_c1_165 | 5435 | 11097 | 411 | 137 | | | | | |
| CONTIG485 | 14969588_c1_166 | 5436 | 11098 | 369 | 123 | | | | | |
| CONTIG485 | 22678752_c1_171 | 5437 | 11099 | 474 | 158 | | | | | |
| CONTIG485 | 12120966_c1_172 | 5438 | 11100 | 195 | 65 | | | | | |
| CONTIG485 | 11772250_c1_173 | 5439 | 11101 | 489 | 163 | | | | | |
| CONTIG485 | 9970466_c1_185 | 5440 | 11102 | 327 | 109 | | | | | |
| CONTIG485 | 24886586_c2_189 | 5441 | 11103 | 570 | 190 | | | | | |
| CONTIG485 | 22830405_c2_193 | 5442 | 11104 | 270 | 90 | | | | | |
| CONTIG485 | 25494591_c2_196 | 5443 | 11105 | 765 | 255 | | | | | |
| CONTIG485 | 11192582_c2_202 | 5444 | 11106 | 783 | 261 | | | | | |
| CONTIG485 | 36463300_c2_204 | 5445 | 11107 | 264 | 88 | | | | | |
| CONTIG485 | 6852282_c2_207 | 5446 | 11108 | 978 | 326 | | | | | |
| CONTIG485 | 15863536_c2_210 | 5447 | 11109 | 2946 | 982 | | | | | |
| CONTIG485 | 10960457_c2_211 | 5448 | 11110 | 633 | 211 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG485 | 6067678_c2_218 | 5449 | 11111 | 1557 | 519 | | | | | |
| CONTIG485 | 32595657_c3_233 | 5450 | 11112 | 786 | 262 | | | | | |
| CONTIG485 | 5292657_c3_235 | 5451 | 11113 | 540 | 180 | | | | | |
| CONTIG485 | 12971931_c3_236 | 5452 | 11114 | 537 | 179 | | | | | |
| CONTIG485 | 9895406_c3_243 | 5453 | 11115 | 405 | 135 | | | | | |
| CONTIG485 | 667336_c3_245 | 5454 | 11116 | 672 | 224 | | | | | |
| CONTIG485 | 29782891_c3_249 | 5455 | 11117 | 702 | 234 | | | | | |
| CONTIG485 | 30746081_c3_256 | 5456 | 11118 | 1008 | 336 | | | | | |
| CONTIG485 | 9771937_c3_261 | 5457 | 11119 | 231 | 77 | | | | | |
| CONTIG485 | 33364217_c3_262 | 5458 | 11120 | 204 | 68 | | | | | |
| CONTIG486 | 4070286_f2_106 | 5459 | 11121 | 186 | 62 | | | | | |
| CONTIG486 | 10578140_f2_107 | 5460 | 11122 | 183 | 61 | | | | | |
| CONTIG486 | 16877166_c1_187 | 5461 | 11123 | 450 | 150 | | | | | |
| CONTIG486 | 3005462_c1_188 | 5462 | 11124 | 789 | 263 | | | | | |
| CONTIG486 | 24789202_c2_234 | 5463 | 11125 | 642 | 214 | | | | | |
| CONTIG486 | 33236566_c2_237 | 5464 | 11126 | 768 | 256 | | | | | |
| CONTIG486 | 30082802_c3_250 | 5465 | 11127 | 225 | 75 | | | | | |
| CONTIG486 | 25525076_c3_251 | 5466 | 11128 | 459 | 153 | | | | | |
| CONTIG486 | 33673125_c3_270 | 5467 | 11129 | 372 | 124 | | | | | |
| CONTIG486 | 35289692_c3_271 | 5468 | 11130 | 357 | 119 | | | | | |
| CONTIG487 | 3181431_f2_69 | 5469 | 11131 | 240 | 80 | | | | | |
| CONTIG487 | 10820955_c1_188 | 5470 | 11132 | 201 | 67 | | | | | |
| CONTIG487 | 3323463_c2_240 | 5471 | 11133 | 279 | 93 | | | | | |
| CONTIG487 | 26260450_c3_265 | 5472 | 11134 | 183 | 61 | | | | | |
| CONTIG488 | 4067713_f1_44 | 5473 | 11135 | 399 | 133 | | | | | |
| CONTIG488 | 14581501_f2_57 | 5474 | 11136 | 213 | 71 | | | | | |
| CONTIG488 | 36343791_f2_71 | 5475 | 11137 | 450 | 150 | | | | | |
| CONTIG488 | 35384761_f3_104 | 5476 | 11138 | 303 | 101 | | | | | |
| CONTIG488 | 31652041_c1_149 | 5477 | 11139 | 303 | 101 | | | | | |
| CONTIG488 | 16251580_c2_168 | 5478 | 11140 | 360 | 120 | | | | | |
| CONTIG488 | 14275257_c3_198 | 5479 | 11141 | 462 | 154 | | | | | |
| CONTIG488 | 31880405_c3_222 | 5480 | 11142 | 318 | 106 | | | | | |
| CONTIG488 | 48778140_c3_231 | 5481 | 11143 | 327 | 109 | | | | | |
| CONTIG489 | 17775_c1_171 | 5482 | 11144 | 645 | 215 | | | | | |
| CONTIG489 | 6929561_c3_215 | 5483 | 11145 | 183 | 61 | | | | | |
| CONTIG489 | 35553307_c3_240 | 5484 | 11146 | 1059 | 353 | | | | | |
| CONTIG49 | 24626301_c2_2 | 5485 | 11147 | 225 | 75 | | | | | |
| CONTIG490 | 4962506_f2_66 | 5486 | 11148 | 186 | 62 | | | | | |
| CONTIG490 | 32520126_c3_253 | 5487 | 11149 | 273 | 91 | | | | | |
| CONTIG491 | 4882827_f1_6 | 5488 | 11150 | 363 | 121 | | | | | |
| CONTIG491 | 10162806_f1_17 | 5489 | 11151 | 312 | 104 | | | | | |
| CONTIG491 | 36142937_f3_113 | 5490 | 11152 | 660 | 220 | | | | | |
| CONTIG491 | 157911_c1_175 | 5491 | 11153 | 234 | 78 | | | | | |
| CONTIG491 | 5275437_c3_281 | 5492 | 11154 | 231 | 77 | | | | | |
| CONTIG491 | 26362906_c3_293 | 5493 | 11155 | 189 | 63 | | | | | |
| CONTIG491 | 25907187_c3_294 | 5494 | 11156 | 222 | 74 | | | | | |
| CONTIG491 | 16276452_c3_296 | 5495 | 11157 | 339 | 113 | | | | | |
| CONTIG492 | 34573286_f1_6 | 5496 | 11158 | 249 | 83 | | | | | |
| CONTIG492 | 5894682_c1_172 | 5497 | 11159 | 213 | 71 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG492 | 35290792_c3_293 | 5498 | 11160 | 252 | 84 | | | | | |
| CONTIG493 | 21915776_f1_3 | 5499 | 11161 | 297 | 99 | | | | | |
| CONTIG493 | 792028_f2_68 | 5500 | 11162 | 426 | 142 | | | | | |
| CONTIG493 | 15020387_f2_75 | 5501 | 11163 | 843 | 281 | | | | | |
| CONTIG493 | 22390825_c1_158 | 5502 | 11164 | 372 | 124 | | | | | |
| CONTIG493 | 179128_c1_161 | 5503 | 11165 | 204 | 68 | | | | | |
| CONTIG493 | 26759780_c2_187 | 5504 | 11166 | 219 | 73 | | | | | |
| CONTIG493 | 1600028_c2_216 | 5505 | 11167 | 570 | 190 | | | | | |
| CONTIG494 | 12600187_f1_8 | 5506 | 11168 | 366 | 122 | | | | | |
| CONTIG494 | 10648890_f1_59 | 5507 | 11169 | 633 | 211 | | | | | |
| CONTIG494 | 6453891_f2_78 | 5508 | 11170 | 186 | 62 | | | | | |
| CONTIG494 | 131875_c1_239 | 5509 | 11171 | 477 | 159 | | | | | |
| CONTIG494 | 1000208_c3_316 | 5510 | 11172 | 183 | 61 | | | | | |
| CONTIG494 | 1192055_c3_349 | 5511 | 11173 | 192 | 64 | | | | | |
| CONTIG495 | 24790951_f1_37 | 5512 | 11174 | 2325 | 775 | | | | | |
| CONTIG495 | 31424206_f2_68 | 5513 | 11175 | 312 | 104 | | | | | |
| CONTIG495 | 20192701_f2_75 | 5514 | 11176 | 375 | 125 | | | | | |
| CONTIG495 | 6830017_f2_89 | 5515 | 11177 | 183 | 61 | | | | | |
| CONTIG495 | 13679702_f3_112 | 5516 | 11178 | 723 | 241 | | | | | |
| CONTIG495 | 24020336_f3_114 | 5517 | 11179 | 819 | 273 | | | | | |
| CONTIG495 | 15713312_f3_119 | 5518 | 11180 | 759 | 253 | | | | | |
| CONTIG495 | 2945936_f3_126 | 5519 | 11181 | 594 | 198 | | | | | |
| CONTIG495 | 39129133_f3_136 | 5520 | 11182 | 672 | 224 | | | | | |
| CONTIG496 | 4164012_f1_1 | 5521 | 11183 | 717 | 239 | | | | | |
| CONTIG496 | 5286318_f2_87 | 5522 | 11184 | 732 | 244 | | | | | |
| CONTIG496 | 16823958_f3_109 | 5523 | 11185 | 237 | 79 | | | | | |
| CONTIG496 | 32245257_c1_161 | 5524 | 11186 | 1119 | 373 | | | | | |
| CONTIG496 | 3923578_c1_164 | 5525 | 11187 | 282 | 94 | | | | | |
| CONTIG496 | 29355150_c1_170 | 5526 | 11188 | 210 | 70 | | | | | |
| CONTIG496 | 36048131_c1_171 | 5527 | 11189 | 456 | 152 | | | | | |
| CONTIG496 | 32522917_c1_186 | 5528 | 11190 | 258 | 86 | | | | | |
| CONTIG496 | 957681_c2_207 | 5529 | 11191 | 498 | 166 | | | | | |
| CONTIG496 | 32706703_c2_240 | 5530 | 11192 | 219 | 73 | | | | | |
| CONTIG496 | 31438381_c3_260 | 5531 | 11193 | 357 | 119 | | | | | |
| CONTIG497 | 7167137_c3_262 | 5532 | 11194 | 1152 | 384 | | | | | |
| CONTIG498 | 23730293_f1_5 | 5533 | 11195 | 462 | 154 | | | | | |
| CONTIG498 | 5086036_f3_170 | 5534 | 11196 | 345 | 115 | | | | | |
| CONTIG498 | 31647162_c2_263 | 5535 | 11197 | 291 | 97 | | | | | |
| CONTIG499 | 4103552_c2_275 | 5536 | 11198 | 186 | 62 | | | | | |
| CONTIG499 | 2037513_c1_186 | 5537 | 11199 | 192 | 64 | | | | | |
| CONTIG500 | 7167942_f3_140 | 5538 | 11200 | 210 | 70 | | | | | |
| CONTIG500 | 15824191_c3_329 | 5539 | 11201 | 459 | 153 | | | | | |
| CONTIG500 | 24097701_f2_68 | 5540 | 11202 | 288 | 96 | | | | | |
| CONTIG501 | 15753916_f2_103 | 5541 | 11203 | 225 | 75 | | | | | |
| CONTIG501 | 632950_f2_117 | 5542 | 11204 | 258 | 86 | | | | | |
| CONTIG501 | 995376_f3_137 | 5543 | 11205 | 210 | 70 | | | | | |
| CONTIG501 | 3638041_f3_150 | 5544 | 11206 | 240 | 80 | | | | | |
| CONTIG501 | 14650468_c2_270 | 5545 | 11207 | 429 | 143 | | | | | |
| CONTIG501 | 5898592_c3_306 | 5546 | 11208 | 255 | 85 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG501 | 14864187_c3_330 | 5547 | 11209 | 486 | 162 | | | | | |
| CONTIG501 | 19563436_c3_331 | 5548 | 11210 | 1332 | 444 | | | | | |
| CONTIG501 | 22834391_c3_352 | 5549 | 11211 | 192 | 64 | | | | | |
| CONTIG502 | 10034426_f3_172 | 5550 | 11212 | 399 | 133 | | | | | |
| CONTIG502 | 4489213_c1_203 | 5551 | 11213 | 483 | 161 | | | | | |
| CONTIG502 | 15042252_c1_228 | 5552 | 11214 | 231 | 77 | | | | | |
| CONTIG502 | 24219402_c1_231 | 5553 | 11215 | 480 | 160 | | | | | |
| CONTIG502 | 3161577_c3_296 | 5554 | 11216 | 1242 | 414 | | | | | |
| CONTIG503 | 33869182_f1_36 | 5555 | 11217 | 879 | 293 | | | | | |
| CONTIG503 | 12317341_c1_194 | 5556 | 11218 | 201 | 67 | | | | | |
| CONTIG503 | 4883290_c3_318 | 5557 | 11219 | 195 | 65 | | | | | |
| CONTIG503 | 35755433_c3_338 | 5558 | 11220 | 312 | 104 | | | | | |
| CONTIG504 | 2907061_f1_55 | 5559 | 11221 | 189 | 63 | | | | | |
| CONTIG504 | 35651391_f2_68 | 5560 | 11222 | 282 | 94 | | | | | |
| CONTIG504 | 32674183_c2_296 | 5561 | 11223 | 516 | 172 | | | | | |
| CONTIG504 | 24659582_c2_311 | 5562 | 11224 | 363 | 121 | | | | | |
| CONTIG504 | 6770186_c2_315 | 5563 | 11225 | 417 | 139 | | | | | |
| CONTIG505 | 29345303_f1_52 | 5564 | 11226 | 240 | 80 | | | | | |
| CONTIG505 | 17073283_f3_156 | 5565 | 11227 | 252 | 84 | | | | | |
| CONTIG505 | 16261277_c1_226 | 5566 | 11228 | 249 | 83 | | | | | |
| CONTIG505 | 253787_c3_325 | 5567 | 11229 | 231 | 77 | | | | | |
| CONTIG506 | 13932051_c2_261 | 5568 | 11230 | 483 | 161 | | | | | |
| CONTIG507 | 33448312_f1_22 | 5569 | 11231 | 207 | 69 | | | | | |
| CONTIG507 | 5205268_f2_98 | 5570 | 11232 | 444 | 148 | | | | | |
| CONTIG507 | 22536641_f2_124 | 5571 | 11233 | 195 | 65 | | | | | |
| CONTIG507 | 3159411_f2_140 | 5572 | 11234 | 210 | 70 | | | | | |
| CONTIG507 | 13791702_f3_172 | 5573 | 11235 | 195 | 65 | | | | | |
| CONTIG507 | 3989417_f3_176 | 5574 | 11236 | 453 | 151 | | | | | |
| CONTIG507 | 22693756_c1_229 | 5575 | 11237 | 204 | 68 | | | | | |
| CONTIG507 | 781307_c1_238 | 5576 | 11238 | 234 | 78 | | | | | |
| CONTIG507 | 32461662_c1_281 | 5577 | 11239 | 258 | 86 | | | | | |
| CONTIG507 | 5350010_c1_283 | 5578 | 11240 | 372 | 124 | | | | | |
| CONTIG507 | 33705457_c2_304 | 5579 | 11241 | 924 | 308 | | | | | |
| CONTIG507 | 21673966_c2_308 | 5580 | 11242 | 228 | 76 | | | | | |
| CONTIG507 | 3260812_c3_347 | 5581 | 11243 | 192 | 64 | | | | | |
| CONTIG507 | 31378517_c3_389 | 5582 | 11244 | 186 | 62 | | | | | |
| CONTIG507 | 23960325_c3_402 | 5583 | 11245 | 228 | 76 | | | | | |
| CONTIG507 | 10197707_f2_122 | 5584 | 11246 | 219 | 73 | | | | | |
| CONTIG508 | 25976708_f3_203 | 5585 | 11247 | 258 | 86 | | | | | |
| CONTIG508 | 2189712_f3_216 | 5586 | 11248 | 201 | 67 | | | | | |
| CONTIG508 | 33375383_c2_380 | 5587 | 11249 | 204 | 68 | | | | | |
| CONTIG508 | 35411068_c3_433 | 5588 | 11250 | 321 | 107 | | | | | |
| CONTIG509 | 3029052_f2_92 | 5589 | 11251 | 942 | 314 | | | | | |
| CONTIG509 | 14866461_c1_256 | 5590 | 11252 | 333 | 111 | | | | | |
| CONTIG510 | 32210916_f1_22 | 5591 | 11253 | 225 | 75 | | | | | |
| CONTIG510 | 32475833_f1_31 | 5592 | 11254 | 477 | 159 | | | | | |
| CONTIG510 | 6130216_f2_139 | 5593 | 11255 | 417 | 139 | | | | | |
| CONTIG510 | 9970317_f3_167 | 5594 | 11256 | 216 | 72 | | | | | |
| CONTIG510 | 24407506_c3_486 | 5595 | 11257 | 204 | 68 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG510 | 10600691_c3_487 | 5596 | 11258 | 339 | 113 | | | | | |
| CONTIG511 | 12306581_f1_44 | 5597 | 11259 | 201 | 67 | | | | | |
| CONTIG511 | 2817256_f2_95 | 5598 | 11260 | 207 | 69 | | | | | |
| CONTIG511 | 6267652_f2_99 | 5599 | 11261 | 210 | 70 | | | | | |
| CONTIG511 | 24491051_f3_195 | 5600 | 11262 | 219 | 73 | | | | | |
| CONTIG511 | 31854643_c1_281 | 5601 | 11263 | 294 | 98 | | | | | |
| CONTIG511 | 35659541_c1_317 | 5602 | 11264 | 216 | 72 | | | | | |
| CONTIG511 | 22386068_c2_411 | 5603 | 11265 | 480 | 160 | | | | | |
| CONTIG511 | 22891878_c3_451 | 5604 | 11266 | 198 | 66 | | | | | |
| CONTIG511 | 1256931_c3_490 | 5605 | 11267 | 849 | 283 | | | | | |
| CONTIG511 | 12345167_f1_20 | 5606 | 11268 | 1233 | 411 | | | | | |
| CONTIG512 | 25680317_f1_26 | 5607 | 11269 | 603 | 201 | | | | | |
| CONTIG512 | 16664785_f1_29 | 5608 | 11270 | 1434 | 478 | | | | | |
| CONTIG512 | 4033568_f1_92 | 5609 | 11271 | 189 | 63 | | | | | |
| CONTIG512 | 22039540_f2_125 | 5610 | 11272 | 1665 | 555 | | | | | |
| CONTIG512 | 29535333_f3_196 | 5611 | 11273 | 225 | 75 | | | | | |
| CONTIG512 | 35798332_f3_212 | 5612 | 11274 | 969 | 323 | | | | | |
| CONTIG512 | 29303340_f3_216 | 5613 | 11275 | 519 | 173 | | | | | |
| CONTIG512 | 4429662_c1_292 | 5614 | 11276 | 249 | 83 | | | | | |
| CONTIG512 | 24303790_c1_293 | 5615 | 11277 | 201 | 67 | | | | | |
| CONTIG512 | 4102090_c1_317 | 5616 | 11278 | 951 | 317 | | | | | |
| CONTIG512 | 4479193_c2_427 | 5617 | 11279 | 981 | 327 | | | | | |
| CONTIG512 | 26219653_c3_443 | 5618 | 11280 | 183 | 61 | | | | | |
| CONTIG512 | 24491512_c3_514 | 5619 | 11281 | 1257 | 419 | | | | | |
| CONTIG513 | 11761717_f1_65 | 5620 | 11282 | 381 | 127 | | | | | |
| CONTIG513 | 36516877_f1_72 | 5621 | 11283 | 189 | 63 | | | | | |
| CONTIG513 | 16494757_f1_107 | 5622 | 11284 | 564 | 188 | | | | | |
| CONTIG513 | 10644651_f2_173 | 5623 | 11285 | 183 | 61 | | | | | |
| CONTIG513 | 13884401_f2_189 | 5624 | 11286 | 186 | 62 | | | | | |
| CONTIG513 | 13066307_f2_226 | 5625 | 11287 | 294 | 98 | | | | | |
| CONTIG513 | 22663931_f3_260 | 5626 | 11288 | 543 | 181 | | | | | |
| CONTIG513 | 165802_f3_269 | 5627 | 11289 | 186 | 62 | | | | | |
| CONTIG513 | 14337781_f3_378 | 5628 | 11290 | 438 | 146 | | | | | |
| CONTIG513 | 22057040_f3_384 | 5629 | 11291 | 528 | 176 | | | | | |
| CONTIG513 | 12991255_c1_424 | 5630 | 11292 | 468 | 156 | | | | | |
| CONTIG513 | 6744762_c1_429 | 5631 | 11293 | 279 | 93 | | | | | |
| CONTIG513 | 25496067_c1_435 | 5632 | 11294 | 765 | 255 | | | | | |
| CONTIG513 | 29718808_c1_465 | 5633 | 11295 | 660 | 220 | | | | | |
| CONTIG513 | 31517316_c1_531 | 5634 | 11296 | 258 | 86 | | | | | |
| CONTIG513 | 14181925_c2_552 | 5635 | 11297 | 573 | 191 | | | | | |
| CONTIG513 | 24413961_c2_627 | 5636 | 11298 | 198 | 66 | | | | | |
| CONTIG513 | 1354152_c3_686 | 5637 | 11299 | 1131 | 377 | | | | | |
| CONTIG513 | 16189443_c3_700 | 5638 | 11300 | 210 | 70 | | | | | |
| CONTIG513 | 22839138_c3_747 | 5639 | 11301 | 210 | 70 | | | | | |
| CONTIG513 | 972812_c3_800 | 5640 | 11302 | 330 | 110 | | | | | |
| CONTIG52 | 29502261_c3_8 | 5641 | 11303 | 219 | 73 | | | | | |
| CONTIG55 | 11820252_f2_1 | 5642 | 11304 | 231 | 77 | | | | | |
| CONTIG56 | 21756280_f2_1 | 5643 | 11305 | 462 | 154 | | | | | |
| CONTIG57 | 197135_c1_2 | 5644 | 11306 | 258 | 86 | | | | | |

TABLE 2-continued

| Contig | Orf | nt ID | aa ID | nt Length | aa Length | Blast Score | Blast Probability | Subject Taxonomy | Subject Name | Subject Description |
|---|---|---|---|---|---|---|---|---|---|---|
| CONTIG58 | 2469800_f2_4 | 5645 | 11307 | 297 | 99 | | | | | |
| CONTIG60 | 4178160_c2_4 | 5646 | 11308 | 339 | 113 | | | | | |
| CONTIG68 | 6922902_f2_1 | 5647 | 11309 | 342 | 114 | | | | | |
| CONTIG68 | 34551450_f3_2 | 5648 | 11310 | 363 | 121 | | | | | |
| CONTIG69 | 14460950_c2_5 | 5649 | 11311 | 663 | 221 | | | | | |
| CONTIG69 | 19553_c3_6 | 5650 | 11312 | 633 | 211 | | | | | |
| CONTIG75 | 23553182_c1_2 | 5651 | 11313 | 237 | 79 | | | | | |
| CONTIG76 | 17007692_f2_1 | 5652 | 11314 | 363 | 121 | | | | | |
| CONTIG77 | 32213278_c1_5 | 5653 | 11315 | 195 | 65 | | | | | |
| CONTIG79 | 10976406_c3_4 | 5654 | 11316 | 609 | 203 | | | | | |
| CONTIG8 | 2634382_f1_2 | 5655 | 11317 | 220 | 74 | | | | | |
| CONTIG81 | 14104500_c3_4 | 5656 | 11318 | 855 | 285 | | | | | |
| CONTIG82 | 3252313_c1_2 | 5657 | 11319 | 192 | 64 | | | | | |
| CONTIG89 | 34272811_f1_1 | 5658 | 11320 | 216 | 72 | | | | | |
| CONTIG90 | 31800306_f2_2 | 5659 | 11321 | 297 | 99 | | | | | |
| CONTIG95 | 406661_c3_5 | 5660 | 11322 | 237 | 79 | | | | | |
| CONTIG97 | 5995312_f1_1 | 5661 | 11323 | 210 | 70 | | | | | |
| CONTIG97 | 836_c3_2 | 5662 | 11324 | 579 | 193 | | | | | |

SEQUENCE LISTING (11326 sequences)

SEQ ID NO: 1 - DNA, 432 bp, Enterobacter cloacae
tgttgtcgccgtctttctggatcggcgtcgcctcggtggtctttgtgtctctgctggtgttctggctgctgtcgcgcctgttcgccttcgttttgtttgggttctcctcctggggcgtcttgctcccctgctccttccggttgcgctttttcctgtcggttttgcttttccgctcctgccgcgtcctgctttatattagtcgtggcgctgttgttctgcctgcgtttcgtcgtctttccggttcttctctttggttccgtgtgcctcgcctggttcctggtcttcgctttccttgtggcgctgtggatggatcagggggtggtgtcgtggcttcgtcacgtcttgctggcgccgggaagccataaaaacccggtgacgctggtgatcacggggcttatcctccgtgccattgtctggtcagtgatgctgctg

SEQ ID NO: 2 - DNA, 231 bp, Enterobacter cloacae
  unsure (217)
  unsure (218)
agcaggacgcggcaggagcggaaaagcaaaaccgacaggaaaaagcgcaaccggaaggagcaggggagcaagacgccccaggaggagaacccaaacaaaacgaaggcgaacaggcgcgacagcagccagaacaccagcagagacacaaagaccaccgaggcgacgccgatccagaaagacggcgacaacatcagcacgaagaagacgaaccgggacnnaaatcgtacttaa

SEQ ID NO: 3 - DNA, 490 bp, Enterobacter cloacae
ccccaaccagagcgaggccctcggcggcacaatcgccagagggatggtcaatacccagaccggtcaggaggagaagaaagtcggcacgcgcaggatcgagcggaagaagccccccgtcgtcaccggggcggaggagaaggcgaaaggccagaacctcgcgccgaaagcggagaagagcgaatccggctcaccgaaagaaagcaggaaggcggagaaaacggagcagagcatcggcgaggaggcggtcaaaacgcgcggcaagatccagcggcagcagatccaggacgggcagaaagcggccagtcaggtgaacgcgcagcaggcgaacgagatcggcctcggcaaaccggaagatttcacacagattcatcaggccgccaggatcggcaagccgcacataacctcgcccacctttaacgttcaggcgatgatgctcatcgcccctggtcttcacctggcgactggacggatacgcgcatatgttagttta

SEQ ID NO: 4 - DNA, 267 bp, Enterobacter cloacae
agcagtgggtgccggcaggaaaatcgcctatctgtgggcaacagcattggtcaggatcgtcgtttcctgtttaagtacatgccggagctggagtcctacttccactaccgctatctggatgtgagcaccctgaaagagctggcccgccgctggaaaccggaaattttcgacggcttcacaaagcaggggacgcaccaggcgatggatgacatccgtgagtctgttgcggagctggcgtactatcgcgaaaactttattaagctctga

SEQ ID NO: 5 - DNA, 393 bp, Enterobacter cloacae
cctgctactgccggttatgcgagaagggtggaaaataacatgagcgcggacgaaaacaacctgatttggatcgatctggagatgaccggccttgatcccgagcgcgatcgcattattgagatcgccacactggtcaccgatgccaacctcaatattctggcggaaggcccaacgattgccgtgcaccagtccgatgaccagcttgcgctgatggatgagtggaacgtgcgtacccataccggcagcgggctggtggaacgcgtgaaggccagcaccctgggcgaccgcgaagcggagctggcgacgcttgaatttctgaagcagtgggtgccggcaggaaaatcgcctatctgtgggcaacagcattggtcaggatcgtcgtttcctgtttaa

SEQ ID NO: 6 - DNA, 675 bp, Enterobacter cloacae
cccctcccgctgtcctggcagtcggtggtgaagacatccgccaccttcttcaccaacatcaccctgggcaagctgtcgctgctgtttcttgcgctgggggtcgcgtatgccgccatcaggcgtaccctgctcattgtctaccctcccattctgagcgatgggctgtttaatttcgtggtgatgcagaccctgttctacattcccttcttcctgattggggcgctggcatttattcatccccggcttaaagcgctgtttaccaccccctccccctggtgtgcggtgggtgctgcgctggcctttgccgcctatcttctcaatcagcgctatggcagcggggacgcgtggatgtatgaaacagagagcgttataacgatgctgatgggcctgtggatggtgaacgtggtgttcgcccttggccatcgtctgctgaattttaaatccagtcgcgtcacctatttcgttaatgcttcgctgtttatctacctggttcaccatccgctgacgctgtttttcggggcgtacattacgccgcatatcgcctcgaatgcgctgggcttcttcaccggcctggtctttgtggttggcattgccatcgtgttgtatgaaatccacctgcggatcccgcttttgcgtttcctgttctcaggcaaacctcaggttaaagcgggataa

SEQ ID NO: 7 - DNA, 647 bp, Enterobacter cloacae
  unsure (41)
  unsure (54)
  unsure (60)
ggcggttcgttccagtgggattaccggtaaccgacgttttnttcgcggcagttnttctcnttctccctgtgggatacattggtgaaaaaggcgggttgcagagggtgtttatgagaccgcaaatcgacgttattcatggcgatatcacgacggtgcgcgttgacgtgatcgtcaacgcagccaattcctccctgatgggtggtggcggggtggacggtgccattcaccgggccgcaggccctcaactccttgaagcatgcaaaaccgtgcgtcagcagcagggagagtgcccgccggggcatgctgttattacgcttgcgggcgatctcccggccaaagcggtgatccataccgttggacccgtctggcacggtggcgaccgccatgaggctgagattctggagcaggcgtatcgtaactgcatgcggcttgcggcggataacgggtataagaccatggcgttccccgccattagcaccggggtgttcggctatccaaaggaagcggcagctacgatcgccgtgaataccgtttatcaatacctttccctcaaacccatgccggaaaaagtcatttttgtctgtttcgatgagcacaccgccgacctgtatcagcggattttgaccgcgcgcagccaggcattttga

SEQ ID NO: 8 - DNA, 924 bp, Enterobacter cloacae
tccccctgcattattgccacgctattcgcgcctgaaccgagcgatgtgattccgtttccccgctcgctggagcaggccgtcgccgcaccgttccgggatttctttggtcgcaataatgcctggctgatcctgctgctgattgtcctttataagctcggcgacgctttcgccatgagtctgaccaccaccttcctgatccgcggcgtcgggtttgatgcgggggaggtcggcgtggtgaacaaaaccctggggctgtttgccacgatcgtcggcgcgctgtacggcggcgtattgatgcagcgtctgtcgctgttccgtgctctgctgatcttcggcatccttcagggcgcttcgaatgccggttactggctgctgtcgatcaccgacaagcatatgatcagcatggcgacggcggtattctttgaaaatctgtgcggaggtatgggcacagcggcatttgtcgccctgctgatgacgctgtgcaataagtcattttccgccacccagtttgccctgctctctgccctctcagccgtcgggcgcgtgtacgtaggtcccgtcgcgggctggtttgttgaagcccacggctggccgacattttatctcttctcggtggtggcggctgtgccggggattttattgttgctggtctgtcgccagacgctggaatatacccagcggacggaacacttcatgccgcgcacggaatatcaggctgcctaccggtttgccctgcgtctgctgatggcaggttgtcttgcgctggtagtgtggctcgcggtactcattatcaatgcgacgaccaccttgtcgcttccttttgaaacccagctgcttgatgcaggcgtgtttctcgccatcgtgggtatcctgaccggtgggatgctggatttcatgtcactgcggaaaacgcagatgacatga

SEQ ID NO: 9 - DNA, 1005 bp, Enterobacter cloacae
  unsure (997)
atggctaattatactgtagatgaatttattattcagctaggctttaacgaaaccgtttcaaagaatcttcaaaagctcgaaagcagaactcttaaagtagctgaacgaattgaaaagaatctcaaccgtgcattcacaccaaagggtgattttggaagagtaatttcttcagcaaataacgcatcaaaacaaattaaccgtgcattttcaaagagcatgaattttgatgaagctggtaaatcctctgtgaaatctgtagagaatgctgctaaggcttctgcaaaacgcattaaggatatgtatcaggacgcttacggggctaaaggaaaaggccgctcaaatccaccagcagccggaaagccacaaggcagaggctcagatttaacagccgctaattcaatccgttcactcgctaatactcagttctattcgaatctgacaagacgcttagagggtatgggttcaactggacaagcaagggcgatgaaattacgccagcaggttcacggattgagagatgatgctttagccaatccctcagccagtttgaatcaattccgtttagcattacgtgcagccactgatagcgcgtctaaatgggcttctcagaaccgtaaacaggtatctaatgcagaagggttatcaagctccttcggtcgtctggtaagcgtttcagcggcgttatacgggacatttgaagccgtccgtaaggtggttgaaacaggtgtagcccgtgaaggtgtgaatctctctgctgaagctgtctttaaagggcaatcgaaaaatgctaagacattcgcggctcagttctctgaccaaatcggacagggtgtcactgagaccttgaaacagtacactggctttgctgcgggtgctcagaattcgttaggctatcagggtacacaggacttctataagaatgctgctgtattcggtcgtattcgtgggcttgatgctgaacagcgtacaggcatcatgattttcaccagccgcgcgnggtcataa

SEQ ID NO: 10 - DNA, 1170 bp, Enterobacter cloacae
aacaagctaaattccggcataagacgagttttaacgggcgtatttaaagtgataatcataagatatctggttcgggagacgctgaagagccaactggcgatcctctttatcctccttctgatctttttctgtcagaagctggtcaggatcctcggcgcggcggttgatggcgaaatcccaacgaatctggtgctttccctgctcgggcttggcgtgccggaaatggcgcagcttatcctgccgttaagcctgttccttggtctgctgatgaccctgggtaagctctataccgaaagtgaaatcaccgtgatgcatgcctgcggcctcagtaaagccgtactggtaaaagcagccatggtgctggcgctgtttacgggcattgttgccgcggttaacgtcatgtgggcggggccgacctcctctcgtcatcaggatgaggtgctggcggaagcaaaagctaacccggggctggcggcgctggcgcaggggcagttccagcaggcgaccgacggtaactccgtgctgtttatcgaaagcgtcgatggcaaccgcttcaatgacgtgtttcttgctcaactgcgcccgaaaggtaacgctcggccttctgtggtggtggcggactccggtcagctgtctcagcgtaaagacggctctcaggttgtcacgctgaacaaaggaacgcgtttcgaaggcacggctatgctgcgcgacttccgtattaccgatttccagaactaccaggccatcattgttcatcaggccgtcgcgctcgatccaacggatactgagcagatggatatgcgcaccttaatgaataccgataccgatcgtgcgcgtgctgaactgcactggcgtatcacgctggtattcaccgtatttatgatggcgctgatggtggttccgctgagcgtggtgaacccgcgccagggccgcgtgctgtcgatgctgccagcgatgctgctgtatctggtgttcttcctgctgcaaacctcaatcaagtctaacggcgggaaaggaaaaattgacccgatgatctggacctgggtcgtgaatggtttgtatctgctgctggcagtcggactcaacttgtgggacacggtgcctgtgcgtcgtcttcgtgcccggtttacgcgtaaaggatcttcaccacggggtggaaggaccgcgtcg

SEQ ID NO: 11 - DNA, 756 bp, Enterobacter cloacae
  unsure (672)
cgtgagcggaccaacggggacaccatgactctgccctcttttattaacgcctcccctgccctgccggcgacaggccagtcggctggcctggactacggccgcgcgctttcgctacgcgaaatggcccggcactacaccgagctgccaaaatatctgctggctccggaagtggccggactgctgcactttgttcaggactggggtcagcacgctttttttaatacgttatggaataccggggcacgcctgaacgaaggccttgccctgagacggcgtgactttcaccttaacgagagcattccgcatgtcgttcttcgcaccgccaaacagcggcgtgccggcggcggccgtccgcgtaagggaaaaagtgccaaccgggtggtgccgttatcggacccggcctatgtcgatgagatgcgccggctgttcgccagcacgaaggagcagtttgaagatgatccgattacaggcgaacgtcgcgcgcaaccggtgtggaatgtttccgaccggacggtgcgtaactggctggtccgggcgactgatgccgcggatcgtgacggcgtcagactgagcatcgacgtcagcccccataccttccggcacagttttgcaatgcaccttttatatggccacgttcaccctaaggtactccagggtctgctggggcatganaagtttgagagtactgaggtctatacgaaaatatttgcgctcgacgtggctgccagtcagcagctgcgcttcaccctcgataca

SEQ ID NO: 12 - DNA, 951 bp, Enterobacter cloacae
  unsure (937)
aatgccactggcaaacatctgccagagggcggtgtttgcattttaccggagttaaaaatgtctaatgccgctatgaagttaaatgaaacatcttctgatgcttatgaaaaattagaagctcttctttccccggatgttataaagttaaaacattatgtggataaaggtgagtatcttttagttctagcaaaggacctttttggtattccagaaatggatccaaagatggctgtgcctgttttcaaaactaaaacctcgtatcgagctccgctgaacaaagactacataccaaatccccgaatacttgaacaagtggttaaactgcttatcagtccggatatagatttaagtgtgtgtcttaaaggtgagtccggttctggcaagactgaaatggtaatgtacattagccacatgatgaattggccgctgacaattaagcagatcaacagcaatattcgagttgatgagcttgaaggtgagcgcagtcttaatggtggtaatacaggttttgtacacagcgatttggtaacgggatttcgtaatggtcacctcattcttctggatgaagtggacaaaatcgatcctgatacggcagcaaaacttcacatgcccattgaacgtaagccctggtcactcagtgctaatggtggtgaggttataactgctaatggctacacgcgatttattggtactgcaaacacaaacatgagtggaggcgctcgccggttcgtttcttctcaacgtcaagatgcagcttttataaagcggttcttgatagttgaaatggagaagcccgacaaagttgctttaaccaatgtgcttactaaacgatatagctctttgccttttcaggtcattgagaagttcgtaagagtagcgattgcagtaaatgactctggtacagaagacagtgtgatggatattcgtcaattagtancttgggttggcacg

SEQ ID NO: 13 - DNA, 519 bp, Enterobacter cloacae
gtcctagaggtgaaaactgcccagatggggcatgaaagcaccagatttacccggctggtggaaaacctgaattacgcggttgaaaacttagtgccgacgttcggcagccaccgcatcactcaacagcaatccgccgcacttggcagaacggcaacgcaaccggcaaaccagaaagcgatcgccaatctggtatacggtggtgagtggggaaaagaacaccttggcaatcaggtcgctggtgatggctggaaatatcgcggtcgtgggctgaaacagattaccggcctgagcaactatcgcagttgtggccaggcgttgaaactggaccttgttactcatccggagctgcttgaaaaggatgaatacgccgcgcgctcagccgcatggttctatgcctcccgcggttgcctgcttcattccggcgacgtggagcgcgtgacgcttcttatcaatggtggcagaaacgggctggataaacgccgcgcgctgtttaacctggcgaaatcagttctggtgtga

SEQ ID NO: 14 - DNA, 345 bp, Enterobacter cloacae
  unsure (97)
  unsure (98)
  unsure (99)
  unsure (100)
  unsure (101)
  unsure (102)
  unsure (103)
  unsure (104)
  unsure (105)
  unsure (106)
  unsure (107)
  unsure (108)
  unsure (109)
  unsure (110)
  unsure (111)
  unsure (112)
  unsure (113)
  unsure (114)
  unsure (115)
  unsure (116)
  unsure (117)
  unsure (118)
  unsure (119)
  unsure (120)
  unsure (121)
  unsure (122)
  unsure (123)
  unsure (124)
  unsure (125)
  unsure (126)
  unsure (127)
  unsure (128)
  unsure (129)
  unsure (130)
  unsure (131)
  unsure (132)
  unsure (133)
  unsure (134)
  unsure (135)
  unsure (136)
  unsure (137)
  unsure (138)
  unsure (139)
  unsure (140)
  unsure (141)
  unsure (142)
  unsure (143)
  unsure (144)
  unsure (145)
  unsure (146)
  unsure (147)
  unsure (148)
  unsure (149)
  unsure (150)
  unsure (151)
  unsure (152)
  unsure (153)
  unsure (154)
  unsure (155)
  unsure (156)
  unsure (157)
  unsure (158)
  unsure (159)
  unsure (160)
  unsure (161)
tggcgtaactgtgtcagaatagagacttctcttttcacgacgccagaatgtatgaaagcgatcactctttatgacgttgcccgcgtggcaggcgttnnnnnnnnnnnnnnnnnnnnnnnnnnnnnnnnnnnnnnnnnnnnnnnnnnnnnnnnnnnnnnnnnggtccggcaggccatggcggcgctacactatgtgcccaaccgtggcgcgcagcagctggccgggaaacgcacccgcacgctggggctgatgaccagcgatctggcgctacatgcgccgtcgcaaatcgcctcagctgtaaaatcccgtcttcaccacggggctggcaggttccgcgctaagcgt

SEQ ID NO: 15 - DNA, 342 bp, Enterobacter cloacae
  unsure (40)
ttccctgagctcacttcgttgcccgtgcgcatcaccttgntggtttcgggcattgtggttaacgcccttgccaccgggatgtatatcggcgcgggttttggcgcaggcccgcgcgacggcctgatgaccggcatacacgcccggctgggctggtcgatccgcagcgtgcgtaccgcgatcgaggtgactgtgttgatcgtcggctacctcctcgggggagcgtttggcgttggaaccgtgctgtatgcattaaccatcggcccgctgatccagctctgtttgccgtggtttcgccagagaccgcgcattcagaaagctgcacagccggagcggattgtttaa

SEQ ID NO: 16 - DNA, 1110 bp, Enterobacter cloacae
  unsure (1022)
agtttacatatatgcgtaaaagtcggttttcagtgcaaaaaggtcataaccatgaatttacttgaaaagatcgccctcgttggtcagcgcatgaaaagcgagcagatttctctaaaggaatctctgatggcttcatcaagagtatctgtttctgatgatagtgttgatggtgttgatagactgatctataaccactgtttgaataaaaaaaatctctctgatttttttgggaagtcacgagtaacgttcaataaaatactttcggacttagaagaaaaagaacttgttggtgcacctatttatcaaaacaaaaatcatctttacacccgctgggatgttcaaaaaataatggatgccctgggttatcccaagtaccgcgatcattactttagcagagctattgttactcagaatcataaaggcggtacagggaaaagcactacatctgtagctttagcagtagcagctgctttagatctacaactcaatgcacgtgtattaatgatcgaatgggacccacaaggttcgattggaagcagcatgattcaaagtgtctcagaagatgatgtcttccttacagcaattgatgcaatccttggaatttatgaagaaaattctgagtataaaaaatatttagattcaggattctctgaagaagaaatcatcactaatatgcctttttcaacgcatctgccaaacttggacgtaataacggcttttccgacagatgctcgttttaaagataaatactggcaatgttctagagaagaacgtacgtctttgttactacgtttcaaggaagttatcttaccggtactgaagcagaactatgatttgattattatagacactccacctgaagattcacctttgatctgggctgctgacgaagcggccgatgggattcttgtcgcagtgtcaccacgtgaatatgattacgcctctactacagacttcatgcttacaataagtgaaaggtgtaaacaatcaccaagtaagggcgacaatttaaaatggttcanagttcttgctgtcaatgtaaatgacaaaagtccatatgaaagaatagttttggataaattaatcaaaactgttcaaggacccttttga

SEQ ID NO: 17 - DNA, 1056 bp, Enterobacter cloacae
  unsure (1030)
agactactcgatccgggtaattttgcgaccaacattcaggccggggccagtttcggctataaactgctgtgggttgtggtctgggccaatctgatggcgatgctgattcagatgctctccgcgaagctgggtattgctaccggaaaaaacctggcggagcaaatccgcgatcattatccacgtccggcagtttggttttactgggttcaggcggaaattatcgccatggccaccgatctcgccgagtttatcggggcggcgatcggctttaagcttattctgggcgtctctctgcttcagggggccgtgctgaccggtatcgccactttcctgattctgatgctccagcggcgggggcaaaaaccgctggagaaagtcatcggtggcctgctgctgttcgtcgctgccgcctatattgttgagctgattttctcccagccgaatctggcgcagctgacgaaagggatggtgatcccgtcgttacccacttctgaagccgtttttctggctgccggggtgctgggggcgaccattatgccgcacgtcatttatctacactcttcattaacccagaatctgcatggcgggacgagtaaagagcgctactccgcctcgaaatgggatgtggctatcgcgatgaccattgccggatttgtgaatctggcgatgatggccaccgccgccgccgcgttccactttaacgggcataccggggttgccgatcttgaccaggcttacctgacgctggagccgttgctgagtcatgccgctgccactatttttggtttaagcctggttgctgcgggcctttcatctacggttgtggggacactggccgggcaggtggtgatgcaggggttcgtacgtttccatattccgctgtgggttcgccgctcggtcacaatgctgccttcctttgttgtgatcctgatggggctggatccgacccgcattctggtgatgagtcaggtgctgctgagtttcgggattgcgctggcgctggtgccgctgctgatattcgacgtcatcncgcccggaatggaaggtagcgcgctc

SEQ ID NO: 18 - DNA, 1071 bp, Enterobacter cloacae
  unsure (1061)
actgacgaaaggatattaactatgagtaatgtattttatatgccgcctgtaaccctaatgggacttaatgctattcgtcttttaggggatgaacttgtttcaagggagttaaaaaaagcgctgatcgtcactgaccgtgttttggctgacacgggactggttaacaaactgacagatgagcttgaggcgcataaaattagttatgcaatatttgatggtgttcaacctaatccaacagagaaaaatattgatgacggtttagccttgcttgcaaaaagtaatgctgattttgtcatttcctttggtggggggtcttctcacgatacagctaaaggtattgcattggtggccactaatggtgggcatattcgggattactcgaaaggtgtgcatctgtccaaaaaaccacaattaccattagttactgtaaatacgacagcgggtacggcatcggaaatgaccgtatttgcaatcgtcactaaccaggaagatgaaactaaatacccggtagtggataagcactttacgcctatcattgcggttaacgattctgaacttatggtcgcaatgcctgcgttccttacggcaactacaggtatggatgccttaactcatgcaattgaagcgtatgtatcaacagcagctacgcctgttactgatgcttgtgctatcaaagcaattgaaattattgttaataatcttaaagacgttgtagatgatggccaaaaccgcgaagcacgtgatgccatgcaatatggtgaatatctggctggaatggcattttcaaacgcgtctcttggttatgtccattcaatggctcaccagttaggtggcgtttataatctgtctcacggtttgtgtaatgcgatcctgctgggtgaagtatcccgatttaatgcgaaaaaggttcccgatcgttttgttgaaatcgcccgggcaatggggattgatgtctcaacaatgactcaggagcaggccattaattctgctatcgaagcaattgagatgttgtcgcaaaaagtcggtacgaatcaacgcctggctgatcgtgcgtcacggtnttctccgtaa

SEQ ID NO: 19 - DNA, 537 bp, Enterobacter cloacae
ggccctaaggatctgttcccccaaaaatgcgatcgcgtgatgatcgatgccagcagcgtggtcattggtgatgttcgcatggccgatgatgtcagcatctggccactcgtcgcgatccggggcgatgttaactatgttgcaatcggtgcacgcaccaatattcaggacggcagcgtgctgcatgtgactcataagtcatcttataaccctgagggcaatccgctcatcattggggaagatgttaccgtcggtcataaagtaatgctccacggctgcacaatcggtaacagggttctcgttgggatgggatcgattttgctggatggcgtcatagtagaagatgacgtaatgattggcgcaggaagcctagttccgcaaaacaaacgcctggaaagtggctatctctatttaggcagtccgattaaacagatccgccccctaaaggaggcggagatcgaaggattgaaatactcagcgaacaattacgttaaatggaagaatgactatctggatcaggataaccagacccagccctga

SEQ ID NO: 20 - DNA, 199 bp, Enterobacter cloacae
catctacgcctatgacatgttttatcaaaaagggaaaacgccatttctgacctggtgcgaacaacagggggcaaaacatgtggctgatggtctgggcatgctggtggggcaggcggctcatgcggtgctactctggcatggcgtgttacctgctgtagaaccggtgatcgaaaagctgaaaaaggaactgatggtatga

SEQ ID NO: 21 - DNA, 357 bp, Enterobacter cloacae
tggtctgggcatgctggtggggcaggcggctcatgcggtgctactctggcatggcgtgttacctgctgtagaaccggtgatcgaaaagctgaaaaaggaactgatggtatgaatcaggcgattcattttcccgacagagaaatctgggatgaaaacaagcaagcggtgtgtttcccggtgctggtgcatggaatgcagctcacctgtgcgattaaaggggagacgttgcttcagcgctttggtggttcagatccgttagcggtcttttgtgaaaatcgctgggatctggaagaggaagccagcgatttgatccgcgtacagcaggaagacgatcagggctgggtctggttatcctga

SEQ ID NO: 22 - DNA, 198 bp, Enterobacter cloacae
  unsure (142)
tccacgcattatgcgcagcgaaaactggggggacggtggcaactacggcaaaattttgtatatctggtcgcgatcttcgcccatattcataacctgtggtcggtgaagattttatcccctcagccggtcatttacgccctgntggccctggcccttttagcgtggcgttacaagaagttccgccagtggttgcgatag

SEQ ID NO: 23 - DNA, 522 bp, Enterobacter cloacae
aagggtgacaattgcgctttgagggtatatgttgttttttacccgaaaatcgcaggagatagcggcataatggctgataaattccaaattttagttttaaacggaccgaacctgaacatgctcggcacccgtgagccagagaagtacggcacgctaacattgagcgaaattgttaaccgtctgagtacggaagcagcgtcgctgaatgtggatttggaccattttcagtctaacgcggagtacgcaatcatcgaccgtattcatcaggctaaagacactgtggactatatcctgatcaatccggccgcgtttacgcacaccagtgttgctatacgcgacgcactgctcgcggtgagtatcccgtttatcgagatccacctgagtaacgtgcacgcccgagagccgttccgccaccactcctacctgtcagatatcgccgctggcgtgatttgtgggctgggtgcagacggctattcatacgctttacagacagcggtaaaacgcttgtcacaatcacactaa

SEQ ID NO: 24 - DNA, 591 bp, Enterobacter cloacae
cagagacatacacccgctgcaaaaaactggcatccatattgcaaaacctgtttaacaacacagccgttaccggcacgctattttcgaacagggggcaacatgaacttaagacgactgaaatacttcgtaaaaatcgtcgatatcggcagcctgacccaggcggctgaagtgctgcatatcgcgcagcctgcgctgagccagcaggtcgcgactctggaaggcgaaatggaccagcaactgttgatccgcaccaagcgcggcgtaacgcctaccgaagcgggaaaaattttatatacccatgcccgcacgatcctgcgtcagtgtgaacaagcgcagctggccgtgcacaatgtgggtcagaccctgagtggccatgtctctatcgggctggcgccgggaacggccgcatcgtcggtaaccatgccgctgcttcaggcggtgcgagcagagctaccggaagtgctggtttatctgcatgagaacagtggttccgtgctcaatgacaaactgctcaacggtcagctggatatgggcggtgctgtacgatcgctccccggttgccgggatcaccagccagccgctgctgaatga

SEQ ID NO: 25 - DNA, 240 bp, Enterobacter cloacae
cttatcgatcagcccgtaaaagtgaccacggagccggacggtagccgttgggtagaggttcacgagccgctttcacgcaatcgcgcggaatttgaatcgacaaataaggtgccgctgcccatttcagccgcacaaaggacgcagctgataagtgaaggggcgggcgctgaactggaacggcggtcggggatgccggtgaagcttgctatgactggtagcgcttcgcttgccgggccttga

SEQ ID NO: 26 - DNA, 342 bp, Enterobacter cloacae
ccatgccgctgcttcaggcggtgcgagcagagctaccggaagtgctggtttatctgcatgagaacagtggttccgtgctcaatgacaaactgctcaacggtcagctggatatgggcggtgctgtacgatcgctccccggttgccgggatcaccagccagccgctgctgaatgaagatctttatctggtcggtacccgtgattgccctggccagagcattgatttaaccgctgtggcacagatgaacctgtttcttgcgcgcgactacagtgccctgcgccttcgctttgacgaaaccccctcgctgcgccctctgaacgcgaataattttctgttagaatga

SEQ ID NO: 27 - DNA, 492 bp, Enterobacter cloacae
ccagtatacactccgctagcgctacgtgactggttcagggctgcgccccgaaacccgctaaaaccactgccgcgtctgcggcttgtccaacaccgtgccgaccgggaaaagatttcccgtccgtcccggcgttatcaggaggccggattggcagacaaacgcagcaaaatgctcaccatgtgggtgactgaggacgagcaccggcgtctgctggagcgctgcgagggtaagcaactcgcggcctggatgcggcagacgtgcctggacgagaagcccgcacgcgccggcaaacttccgtcgatctcgccggcgctgcttcgtcagcttgccggcatggggaacaaccttaaccagattgcccgccaggttaacgccggtggtggaagcggacacgaccgcgtgcagattgtcgccgcgctgatggccatcgatgccggactcgagcggttgcggcatgccgtactggaaaagggtgctgatgatgatcgttaa

SEQ ID NO: 28 - DNA, 696 bp, Enterobacter cloacae
  unsure (418)
tggccatcgatgccggactcgagcggttgcggcatgccgtactggaaaagggtgctgatgatgatcgttaagtttcatcctcgggggcgcggcggcggcggcgggccggtcgattatctgctgggtaaagatcgccagcgcgacggcgccagcgttctgcaggggaagccggatgaagtccgggagcttatcgacgcctcgccctacgccaaaaagtacacttccggcgttctgtcttttgccgaacaggatttaccgcccggccagcgcgaaaagctgatggcgagtttcgagcgggttctgatgcccggactcgataaagaccagtacagcgtgctgtgggttgagcaccgggacaaggggcggctggagctgaacttcctgatcccgaacacggagcttctgaccggcaagcggntacagccgtattacgaccgcgccgaccgtccgcgcatcgatgcctggcagaccatagtgaacggcaggctggggctgcatgacccgaacgcgccggagaaccggcgggtgctggtctcgccttccgcgctgccggaagcgaagcaggaagccgcccaggcgattacgagcggcctgcttgcccttgcctcatccggggagctgaaaacgcgtcaggacgtcactgaggcgctggaaagcgcaggttttgaggtggtgcgcaccacacaaggccgcatc

SEQ ID NO: 29 - DNA, 1392 bp, Enterobacter cloacae
cggatggcaggtaacatagatatcccccctataagggcggacaagtgtttattttttccgactattaacagagagaatattatgagcgttgtgcctgtagccgacgtactccagggccgtgtcgccgttgaccaggaggtcaccgtgcgcggatgggtgcgtactcgccgagattctaaagctggcatctccttcctcgccgtctatgacggttcctgctttgatcctgtacaggccgtcattaataattctctgcccaattacaatgatgacgttctgcacctgacaaccggttgttccgtgatcgtcaccggtgtagtggtggcctctccgggccagggtcagagctacgaaattcaggcgacctcggtggaagtgaccggctgggttgaagatccggacacctacccgatggctgcaaagcgtcacagcatcgaatatctgcgtgaagttgcgcaactgcgtccgcgcaccaacctgattggtgcggttgcccgcgtgcgtcatacgctggcgcaggcgctgcatcgcttctttgacgagcagggttacttctgggtttctactccgctgatcacggcatccgataccgaaggcgcaggtgaaatgttccgcgtttcaacgctggatatggaaaacctgccgcgtacgccggaaggtaaagtggattacgacaaagacttctttggtaaagaagccttcctgacggtttctggccagctgaacggcgaaacctacgcctgtgcactgtctaagatctataccttcggcccaaccttccgtgcggaaaactccaacaccagccgtcacctggcggaattctggatgctggagccggaagtggcctttgccgatctgaatgacgtggctggcctggcagaagcgatgctgaaatacgtgttcaaagcggttctcgaagagcgcgcagacgacatgaaattcttcgctgagcgtgtcgataacgacgccatcgcccgtcttgagcgcttcgtctccgcagacttcgcgcaggtggattacaccgacgcggtcgctatcctggaaaaatgcggtgagaaattcgaaaacccggtttactggggtgtggatctctcctccgagcacgaacgttatctggcagagaagcacttcaaagcaccggttgtggtgaaaaattatccgaaagacattaaggcgttctatatgcgccttaacgaagacggtaaaaccgttgccgcgatggacgtgctggcgccgggcatcggtgagattatcggtggctcccagcgtgaagagcgactggatgtgctggacgcgcgtatgcaggagatgggtctgaacccggcggactacagctggtatcgcgatctgtcttcacctacgggagctggcaggatccgcgcttacttaacc

SEQ ID NO: 30 - DNA, 567 bp, Enterobacter cloacae
acgaccgtccttccagccggccttggtgaaaacaatacaatttcgggccttttgtttttatgggttccgacccgtaaaacgaattttattcacggggagcctctccgaggcgttattacccaatcagaggattttagaatggctaagaaagtacaagcctacgtcaagctgcaggttgcagcaggtatggcgaacccaagtccaccagttggtccagctctgggtcagcagggtgtgaacatcatggaattctgtaaagcgttcaacgccaaaactgaatccatggagaaaggtctgccaatcccagttgtaatcactgtttacgctgaccgttctttcactttcgttaccaaaacccctccagcagcagttctgctgaagaaagcagcgggcatcaagtctggttccggtaagccgaacaaagacaaagtgggtaaaatttcccgcgctcagttgcaggaaatcgcgcagaccaaagctgccgacatgactggttccgacattgaagcgatgactcgctccatcgaaggtactgcacgttccatgggcctggtagtggaggactaa

SEQ ID NO: 31 - DNA, 708 bp, Enterobacter cloacae
gaaatggctaaactgaccaagcgcatgtccgtgatccgtgacaaagttgatgcgaccaaacagtacgacatcaacgaagctatcgctctgctgaaagaactggctaccgctaagttcgttgaaagcgttgacgttgccgttaacctgggcatcgacgctcgtaaatccgatcagaacgttcgtggcgcaactgtactgccacacggtactggccgttccgtacgcgtaactgtatttgctcaaggtgcaaacgctgaatctgctaaagctgccggcgctgaactggtaggtatggaagatctggctgatcagatcaagaaaggcgaaatgaactttgacgttgttattgcttctccagatgcaatgcgcgttgttggccagctgggccaggttctgggtccacgcggcctgatgccaaacccgaaagtgggtactgtaacccctaacgttgctgaagcggttaagaacgctaaagcaggtcaggttcgttatcgtaacgacaaaaacggcatcatccacaccaccatcggtaaagtggactttgacgctgacaaactgaaagaaaacctggaagctctgctggttgcgctgaaaaaagcaaaaccaactcaggcgaaaggcgtgtacatcaagaaagttagcatctccaccaccatgggtgcaggtgttgcagttgaccaggctggcctgagcgctgctgcaaactaa

SEQ ID NO: 32 - DNA, 315 bp, Enterobacter cloacae
  unsure (294)
agtgagttccggaacatgagttccggcaaacatccaggagcaaagctaatggctttaaatcttcaagacaaacaagcgattgttgctgaagtcagcgaagtagccaaaggcgcgctgtctgcagtagttgcggattcccgtggcgttactgtagacaaaatgactgaactgcgtaaagcaggtcgtgaagctggcgtatacatgcgtgttgttcgtaacaccctgctgcgtcgcgtagttgaaggtactcagttcgagtgcctgaaagacacgcttgttggtcttcaccacagngcggcgcaaggaccagcaata

SEQ ID NO: 33 - DNA, 384 bp, Enterobacter cloacae
cggagcactaaaatgatccaagaacagactatgctgaacgtcgccgacaactccggtgcacgtcgcgtaatgtgtatcaaggttctgggtggctcgcaccgtcgctacgcaggcgtaggcgacatcatcaagatcaccatcaaggaagcaattccacgtggtaaggtcaaaaaaggtgatgtgctgaaggcggtagtggtgcgcaccaagaagggtgttcgtcgccctgacggttctgtcattcgcttcgatggtaatgcatgcgttattttaaacaataacagcgagcagcctatcggcacgcgtatctttgggccggtaactcgtgaacttcgtactgagaagttcatgaaaattatctctctggcaccagaagtactctaa

SEQ ID NO: 34 - DNA, 600 bp, Enterobacter cloacae
cagcgaaactatcaagtaatttggagtagtacgatggcgaaactgcatgattactacaaagacgaagtagttaacaaactcatgactgagtttaactacaattctgtcatgcaagtccctcgggtcgagaagatcaccctgaacatgggtgttggtgaagcgatcgctgacaagaaactgctggataacgcagcagctgacctgacagcaatctccggtcaaaaaccgctgatcaccaaagcacgcaaatctgttgcaggcttcaaaatccgtcagggctatccgatcggctgtaaagtaactctgcgtggcgaacgcatgtgggagttccttgagcgcctgatcactattgctgttccacgtatccgtgacttccgtggcttgtccgctaagtctttcgacggtcgtggtaactacagcatgggtgtccgtgagcagatcatcttcccagaaatcgactacgataaagtcgaccgcgtgcgtggtttggatattaccattaccactactgggaaatctgatgaaaaaggccgtgctctgctggctgcctttgaattccccgttccgcaagttaaggtaaggtttaccgaaatggcttaa

SEQ ID NO: 35 - DNA, 357 bp, Enterobacter cloacae
aaattatctctctggcaccagaagtactctaaggagcgaatcatggcagcgaaaatccgtcgtgatgacgaagttatcgtgttaaccggtaaagataaaggtaaacgcggtaaagtaaaaaatgttctgtcttccggcaaactcgtcgttgaaggtatcaacctggttaagaaacatcagaagccggttccggccctgaaccaaccaggcggcatcgttgaaaaagaagctgctattcaggtttctaacgttgcaatcttcaatgcggctaccggtaaggctgaccgtgtaggctttagattcgaagacggtaaaaaagtccgtttcttcaagtctaacagcgaaactatcaagtaa

SEQ ID NO: 36 - DNA, 1055 bp, Enterobacter cloacae
  unsure (832)
ttacgcttagctttgggaggcgtaacgcatactgattccttcttgcacctgaaaataaaaggtgacatgattgcgcgaattttctccttcctgtctcaccgttcggtgagggtatttgcgcctatgaaaaccatgaaaattgccgtcagccgcgagctggtatccaaagtttctacgcatcgcgaaaaggttatgctggataacactgatttcaccgatgtggcggcagtcgtcattacggttgttgaaagctacagcggcattctcgcgttgctgaagcgtacgggctttcagctaccggtatttatgttctcaacagagccaggagaggtgccagagggtgtcacggcgatcatctcgggtaaagcacaggaattgctggaactggaatctgccgcctgccggtatgaagagaacctgctgccacccttttttgacaccctgagccagtatgtggcgatgggaaacagcacctttgcctgtccgggtcaccagcacggcgcctttttcaaaaaacacccggcggggcggcagttctacgacttcttcggtgaaaacgtgtttcgtgccgatatgtgcaatgccgacgtgaagctcggtgatttgctgatccacgaaggttctgccaagcacgcgcaaaagttcgcggcgaaagtgttcaacgcggataaaacctacttcgtgctgaacggcacgtcggcggccaataaagtggtgaccaatgcgctgctgactcgtggcgatctggtgctgttcgatcgtaacaaccacaagtccaaccatcatggggcgctgatccaggccggggcaacgcctgtctatcttgaggcancccgtaatccgtttggttttatcggcgggattgatgagcactgctttgatgaggcctggctgcgggaactgatccgtgacgtcgcgccgcagaaagccgccgaggcgcgcccgtttccgtctggcgatcattcagctccgcacctacctatggcacgaatctacaacgcccggtcaggtgaatcgaccaatattcgggcacctttgcgactaacatccctctt

SEQ ID NO: 37 - DNA, 531 bp, Enterobacter cloacae
caggagttaaacgtggtaattggaccctttatcaatgcgggagccgtattgctgggcggtgtacttggggcagtattaagccagcggttgccggagcgtattcgcgtctccatgccctccatttttggcctggcgtcgttagggattggtatccttttagtggtgaaatgcgccaacctgccggtgatggtactggcgacgctgctcggcgcgctgatcggcgaattttgctatctggaaaagggcatcaatcacgcggtaggcaaagccaaaaatctgattgcccgaccgggcaaggcgaagcacggcacgcacgagtcgtttattcagaactacgttgcgatcattattctgttctgcgccagcggcacggggatattcggttcgatgcaggaagggatgaccggcgatcccagcatattgattgcgaaagcgtttctggatttctttactgccaccatctttgccaccaccctcggcatcgccgtcgccgcgagtcttcaccacgggccggaaggaccgcgcatgcgc

SEQ ID NO: 38 - DNA, 516 bp, Enterobacter cloacae
attattacgagtatgcgctcaaaccgttttgaggctttcgctatgctactgtccctcccctttctgctgatctattttgctttatcggccttgcttgttcgcaccgatattcgcacggggcttcttcccgataaatttctttgcccgctgctatggaccggcctgctttaccagctctgcctccatcctgattttttgccgagcgcggtggtgggtgcgatggcaggatacgccggattcgccgttatctattggggatatcggctcatctgccgacgtgaaggtatgggatatggcgacataaaatatctggcggcgctgggggcatggcatggctggtgtgtactgccagtactggcactcgtagccgcgttaatggctctgctgtatctggttgctttctcgttgtttactcctgataagcaggcattaaaaaacccactgccttttgggccatttctggcggcagcgggtttatgcgttggctgggaaagcctgattaactttccactttga

SEQ ID NO: 39 - DNA, 519 bp, Enterobacter cloacae
cccgatttacgcttcaatgagtggaagcggagggactatataatgaaaggtgatgttaaaatcataagttatctcaataaattattgggaaatgagcttgtcgcaatcaatcagtattttctccatgcaagaatgttcaaaaactggggactgactcgcctcaacgatgttgaataccatgagtccattgatgaaatgaaacacgccgataaatacattgagcgtattttattcctcgaaggcattcctaacctacaggatctcggaaaactgggcatcggagaagatgtcgaagagatgctgcgttctgatctccggctggagctggagggtgcaaaagacctgcgtgaagccattgcctatgcggacagcgtacatgactacgtcagccgcgatatgatgatccagatcctggccgatgaagaagggcacatcgactggcttgagaccgaactggatctcattagcaaaattggcctacagaactaccttcagtctcagatcaaagtggaaagttaa

SEQ ID NO: 40 - DNA, 1173 bp, Enterobacter cloacae
tcagcaacaaaatcaggcacaggtacaggcagaacaacaatgatcaagtcgacggacagaaaattggtagtaggactggagattggcaccgcgaaggttgccgctttggtaggggaagttctgcccgacggtatggtcaatatcattggcgtgggcagctgcccctcccgtggtatggataaaggtggggtaaacgaccttgagtcggtggtgaaatgcgttcagcgcgccatcgaccaggctgaattgatggcagattgccaaatttcctctgtctatctggccctttctggtaagcatatcagctgccagaatgaaatcggtatggtgccgatttccgaagaagaagtgacgcaggaagacgttgagaacgttgtccacacggcgaaatccgtgcgtgttcgcgacgagcaccgtgtgctgcatgtgatcccgcaggaatacgcgatcgactaccaggaaggcatcaagaatccggtcggtctgtcgggcgtgcgtatgcaggcaaaagtgcacctgatcacatgtcacaacgatatggcgaagaacattgtaaaagccgttgaacgttgtggcctgaaagttgaccaactcattttcgccggacttgccgcgagctattccgtgctgaccgaagacgaacgtgaactgggcgtctgtgtggtcgatattggtggtggtacaatggacatggctgtctataccggcggtgcgttacgccacaccaaagtgatcccgtacgcagggaacgtcgtgaccagcgatattgcttacgcttttggtacgccaccgagcgatgcagaggcgattaaagtgcgccatggttgcgcgctgggctctatcgtcggcaaagacgagagcgttgaagtgccgagcgtaggcggtcgaccgccgcgcagcctgcaacgccagacgctggcagaggtaattgagccgcgttataccgagctgctcaacctggtcaacgaagagattttgcagttacaggaacagcttcgccagcagggtgtgaaacatcatctcgcggcggggattgtattaaccggcggggcagcgcaaattgaaggtcttgcggcctgcgctcagcgcgtgttccatacgcaggtgcgtatcggtgcgccgctgaatatcaccggtttaacggatttcttaacgcgcggtggagtaaaacgt

SEQ ID NO: 41 - DNA, 255 bp, Enterobacter cloacae
gcgcgccgttcctggcagttgaccttaacgaatggcatcaagctcaaccttggccgcggcgatacaatgaaacgtctggcgcgttttgtagaactttacccggttttacagcagcaggcgcagacggatggcaaacggataagctacgttgatttgcgctatgactcaggcgcagcagtcggttgggagccggctccggtcgaggaacctaatcagcaacaaaatcaggcacaggtacaggcagaacaacaatga

SEQ ID NO: 42 - DNA, 657 bp, Enterobacter cloacae
atatacctggaggttttcatggctgtcgctgccaacaaacgttcggtaatgacgctgttttctggtcctactgacatttatagccatcaggttcgtatcgtgctggccgagaagggtgtcagttttgagatcgagcatgtggaaaaggataacccgcctcaggatctgatcgatctcaacccgagccaaagcgtaccgacgctggtggatcgcgagctgaccctgtgggaatcccgtatcattatggaatacctggatgagcgtttcccgcatccgccgctgatgcctgtttatcctgttgcgcgtggtgaaagccgcctgtacatgcagcgtatcgagaaagactggtactcgctgatgaacgttattgtcaacggttcctcttctgaagcggatgctgcacgtaaacagctgcgtgaagagctgctggcgattgcgccggtatttggtcaaaagcctttcttcctgagcgacgagttcagcctggtagattgctacctggctccgctgctgtggcgtctgccaaccctgggcgtagagttcagcggtcctggcgcgaaagagctgaaaggctacatgactcgcgtctttgaacgcgactctttcctggcatccttaactgaaccggaacgtgaaatgcgtctcggccgaggctaa

SEQ ID NO: 43 - DNA, 216 bp, Enterobacter cloacae
aatgcgtctcggccgaggctaatgactgtggaaatgtcacaactttcaccacgccgtccgtatatgctgcgcgccttttatgaatggctgctggataaccagctcacgccgcacctggttgtggatgtgacgttgccgggcgtgctggttccaatggaatacgcgcgcgacggacagtcttcaccacgacgctggcaggatccacgcttagcgcta

SEQ ID NO: 44 - DNA, 333 bp, Enterobacter cloacae
tatactgaaattgctttcagaaaaacatgcattgaacctcaaagtcgttgtcttctaacacgcattaagggggttataatggaaaagaatagtgaagtgatccagacccatccgcttgttggctgggatatcagcaccgtagacagctacgatgcgctgatgctgcgtttgcactaccagaccccaaatcagctaaaccgtgatgaagcggaagttggacagacgctgtggcttacaacagacgtcgcccgtcagtttatctctattttggaagcaggcatcgcaaaaatagaatctggcgactaccaggaaaatgagtataaacggcattaa

SEQ ID NO: 45 - DNA, 699 bp, Enterobacter cloacae
caaagcgttagtaaagagaagcctatgaaatacgatttgatcattatcggaagcggctccgtaggatctgccgccggttattacgccacgcaggcgggtctgaatgtactgatgattgacgcccatcgtcccccccactctgaaggaagccatcacggcgatacccgtctgatacgtcacgcttatggcgaaggtgagcgctatgtaccgctggtgcttcgggctcagacgctgtgggatgagctggccgccctcaccgaagaacgcatttttgagcgcaccggggtcgttaacctggggccagccagctccacgtttctggcgaccgtcgaggagagcgcgaaagcctaccgcctggacgtcgagcgtctggatgcgaacggcatcatggcgcgctggccggaaatttctgtccctgaagactacattgggttgtttgaagccaactctggcgtactgcacagcgaaacggccattaacacctggattgatctcgccgccaaagcgggctgcgcgcagttgttcaactgtccggtcacgggcatcacccaccatgcagaaggttcaaccgtcaccacctctgaaggtgaatataccgccacgcgtctgctggtgagtgcgggaacgtgggtgacgaaactgctgccggacctgcccatccacccggtgcgaaaagtcttctcctgggttccagtctga

SEQ ID NO: 46 - DNA, 474 bp, Enterobacter cloacae
caccttttcgacgtagccctaaaatttcgcgtcctcatattgtatgaggtcgttttattacgtgtttacgaagcaaaagctaaaaccaggagctatttaatggcaacagttaaccagctggtacgcaaaccacgtgcacgcaaagttgcaaaaagcaacgtgcctgcgctggaagcctgcccgcagaaacgtggcgtatgtactcgtgtatataccaccactcctaaaaaaccaaactccgcactgcgtaaagtatgccgtgtgcgtttgactaacggttttgaagtgacttcctacatcggtggtgaaggtcacaaccttcaggagcactccgtgatcctgatccgtggcggtcgtgttaaagaccttccgggtgttcgttaccacaccgttcgtggtgcgctggactgctcaggtgttaaagaccgtaagcaggctcgctccaagtacggcgtgaagcgtcctaaggcttaa

SEQ ID NO: 47 - DNA, 411 bp, Enterobacter cloacae
caacggagtaatcccatgccacgtcgtcgcgtcattggtcagcgtaaaattcttccagatccgaaattcggatcagaactgctggcaaaatttgtaaatatcctgatggtagatggtaaaaaatctaccgcagaagcaatcgtatacagcgcgctggagaccctggctcagcgttctggtaaaaatgaactggaagccttcgaagtcgctctcgacaacgtgcgcccgactgtagaaattaagtctcgccgcgttggtggttctacttatcaggttccagttgaagttcgtccggttcgtcgtaatgctctggcaatgcgttggatcgttgaagctgctcgtaaacgcggtgataaatccatggctctgcgtctggcgaacgaactttctgatgctgcggaaaacaaaggt

SEQ ID NO: 48 - DNA, 339 bp, Enterobacter cloacae
acctttgttttccgcagcatcagaaagttcgttcgccagacgcagagccatggatttatcaccgcgtttacgagcagcttcaacgatccaacgcattgccagagcattacgacgaaccggacgaacttcaactggaacctgataagtagaaccaccaacgcggcgagacttaatttctacagtcgggcgcacgttgtcgagagcgacttcgaaggcttccagttcatttttaccagaacgctgagccagggtctccagcgcgctgtatacgattgcttctgcggtagattttttaccatctaccatcaggatatttacaaattttgccagcagttctga

SEQ ID NO: 49 - DNA, 555 bp, Enterobacter cloacae
  unsure (493)
aaactatacgcgagggaagcatttatgccacggcgacagatactgagcagtgaagagcaggaacgcttactggttataccagatgatgaaattattctgacccgaatgtgttttctgaacgaaccggatattgcgctcattaataagcaccgacggccagcgaatcgcctgggctttgctgtattactctgttatctgcgtggacctggatttattccggacaaaagcagtgctcctcacaatggcgttgtatccagggttgcttcccgactgaaacttcagcctgatttatggccggaatatgcatccagagagcaaacccgctgggaacatctgaccgaactttatcgctacctggaactatccccgttcagccggtcaatgcaaaaagaatgtatccgccatctgcaaccctatgccatgcgaactgacaaaagatttatgctggcgggaagaaatgctcaccttggctacataaacaataatgtttatnttcccctcctgttgaaagtgattcaaaccgacgccttgccgaaatccttcaccctccgctaa

SEQ ID NO: 50 - DNA, 636 bp, Enterobacter cloacae
tttcggacacacgttataattcggacatccatttcgtacggaaagtttcccatgtcacgtgtttttgcctactgcagggtctcaactctggaacagaccacagaaaaccagcgtcgtgaaattgaagcggcgggttttgccatcagatcccaacgacttattgaggagcatatcagtggctcggttgctgccagcgaacgccccggatttatccggttgctagatcgcatggaaaatggggatgtactgattgtcaccaaacttgaccgtctgggtcgtaatgcgatggatatccgaaaaacagtagagcaactggcggctttagatattcgcgttcattgtctcgcactcggaggtgttgacttgaccagtccggccggaaaaatgactatgcaggtaatttctgctgtagcggagtttgagcgagatttgctgcttgagcgaacgtattcaggtattgcgagggcaaaagcggctggaaaacgcttcggtcgcccccccatcctgagcgaggaacaaaagcaaacagtgacagagcgcctaaatgctggcatcagtatcagtgctattgcccgggaatttaataccacccgccagattatccttcgggtaaaggctggattgctgcaagagtga

SEQ ID NO: 51 - DNA, 402 bp, Enterobacter cloacae
tcccctttcgcgggtcttcggctctttggtgaaaagagcgatagcgttatttgcggccactccaactgcggcgcgatgaaggcgattgctgacaacgccgatctggagccgatgccggccgtttcccactggctgcgctattctgatgcggcaaaagcggtggtggagaagaaaacctgggataagccaatcgataaagtgaatgcgatggtgcaggaaaacgtctttgcgcagctgagcaacatcaagacccatccgtcggtggcggtaggcctgcgcaacaatgccattcgcctgcacggctgggtatatgacatcgaaagcggcaaaatccttgccctggacaagaacactaaatcgttcgtgtcgttgtcggaaaacccggaagtcttcttcgagtaa

SEQ ID NO: 52 - DNA, 909 bp, Enterobacter cloacae
  unsure (8)
ggggtggnattattcggatccgccgctcccttggtgaagacggaggccgatttttactgccctatcccttatgaaccactgtcggtgttaacggattgtgtggtggcaagcgaaatcgacaaaggcccggatgggctgcttgaccgcatctttgcgctgatggtgaaagagcttgagctggccgatccgcgatggtgtcaggcgatagcgctcggcacgctgaatgccgacacgctccgtgatgcctggtttgaggatcgtaaaaagcacggtcctttcacctgggccgaagcgaatctgaaagaagtggagcgcaacaagcgcgaaaaacgcaccgttgcctggcgctataccgtgcttcgtctgcatgaagtggtacaggccatcgtcccttcactcaatgagcatgacagagagcggtttaaatccgggctggagcgtgtgtttatcgataattatgccgccattccaccgcagtctatccgccggttactggcgctgcgcgaggcagggatcattagcgtggtcgcactcggtgatgattacgatctggatatcggcagcgatcagaccgtcatcaccacggcaaaaaaaagttaccgcttcgacgtgtttatcgacgcgcgcggacaaaagccgctcagaaacaaggacattcccttccccaccctgcgtaaacagcttgcgggaaccggcgatgacgttccggacgtgggggaagactatacgttgctggcgccggcatcactgcgggggcgtatcgcttttggggcgatcccctggctgatgcacgatcatccgtttgttcagggtttgtctgagtgcgctgaaattggtaaagcgatggcgaaagcggctggaaaacctgcgtcgggggtgcgaaggaagttaccttacatggagttttaa

SEQ ID NO: 53 - DNA, 380 bp, Enterobacter cloacae
aactgcttcttaatacccctcattcaggagaatgacactatgctggactggaacaactatcgctcagagttaatgcaacgtttaggcgagttgggcaaactgacccccgagaccatgaaaggcgtggttgccctgggcaacgcaggtaacaaaactgaccttttgggcgcaaaagtgcgtgaactcattgccctggcgtgcgcagtcacaacccgctgcgacggctgtattgcttttcacgccgacgccgctgtgaaagccggtgcaaccgacgctgaaattgctgaagcgctgggcgtggcgattaacctcaacgctggcgcggcggtcatttcattcagcccgcatctgtctacagcccgggatgaagtagcggctcc

SEQ ID NO: 54 - DNA, 357 bp, Enterobacter cloacae
ctcatgcgcggtccggcggctcccttggtgaaaactaccggcatgagcccgactgaatacatcatgcaggcgctggctggctgttataccgccacccttaccatgatggctgctgaaaaagggatcgacctggacggtatcgagctggatcttaatttcgatatcaacctcaacggcttccttgggctggacagcaacgtgcgtaaaggtgcgaaatctattcgcgtcgatgttcaccttacgagcaataccgccagtcgcgaggagttagaagcgctggtcagcgaaatgcaaaagaattcgccaatccacgatactctggctaatccggttgaaatgattacacgcctggcgtga

SEQ ID NO: 55 - DNA, 624 bp, Enterobacter cloacae
caacaatataatctatcaactagtagattatatggagtaattatgacaaccatgacacgggaacggctgctcagcgaagcagaacacctgatgcgcgaaaaagggtattcagcattcagctatgctgatttatcaaaaatagtgggtatcaccaaggccagtattcatcaccatttcccgaccaaagatattctgggtgagcaggtggtaatacaggcgttctctgatacacaacgcgtatttgagcagatagaggcgactgagaaaagcgcggagagaagaattgcggcttacatcgatatcttcgcgcaaagccataaagcttcgctactgccactgtgttgtgcgttgtcagcagagaccgccaatctgcctcaggcaattactgtacagacatcactttatttcgatatgcaaatcgagtggctcacaaaagtcgtcagggcgggcatggagtcaggtgagttttcatcccatgccgaaccatcagatattgctttgatgatcattaatgtctgtgaaggctcaagcgtagtggcgcatgcaacggccagacccgaagtcttcgccaacagccttaagtatataaaactgcttcttaatacccctcattcaggagaatga

SEQ ID NO: 56 - DNA, 786 bp, Enterobacter cloacae
tcgaggttgcaccgaagaatcgctccctttgaagatcatgctatctctgccactttaaaagagtcgcttactaaacagggtgttgagtttttgaccggggcagacttaaaacaagttaaggtgggtggtgatttagttatttgtacggttatcgtcggtgaggatactcacgtaattacggcagagaaaattcttatcgcaacagggcgccgccctgtgactgaaaaactgaatctggacgctgtcaatgtgtcggtcggtgcgcgtggacaggtcattgtcgataagcatctaatgacatcgaatccacggatctgggctgcaggtgatgttacaggtgaagcacaatttgtttacgtcgctgttgaacaaggaagattagcggcaagcaatgcacttgggggcgagctctcctctctggattacaatgccctccctcgggttaccttcacctcccctgagttggcttctgtaggtttgactccattgcaagctgaagaaagaggaatcccatatgagatccgagaactccctgtagcttttgttttacgtgctattgtcagccgccatagcgatggtttaatcagactggtttctgatagtcaaaccggaacgattttaggcgttcacatggtcagtgaatccgcaggtgatgtgatagcagctgcgacctatattatttccgccaatatgactgtgcatcagttagcaaacatttggtcgcctgagtttaccatgacggagtcactgaagaatgttgcaaaaacttcccctataactaactga

SEQ ID NO: 57 - DNA, 249 bp, Enterobacter cloacae
  unsure (75)
ggtcacatgagccagcaattaacctttgccgacagtgagttttccagtaaacgtcgcctgacgaggaaagaaatnttcttatcccggatggatactctgctgccgtggcctcaactgctgggcaacattgaacctgtctatccaaaaacaggtaatggccgccgaccttattcgctggaaacaatgtcccgtaatccctgcctgcaactgtggtacaacctcggtgatgaaacgatggaagacgcattg

SEQ ID NO: 58 - DNA, 498 bp, Enterobacter cloacae
agggagccatctatgaacagtcttttaacgctggcgaaggacttagagcagaaatcgaaagcgcagcagcagactaccggcgagatgctgaaagccgcattcagcgagcacgagaagtctgtcagagcggaactgagcgaaagcgagaagagaatcagcgccgccatcctcgaccacgaccggaagctgtcctcagccatgagccagcgcacgaaagggatgctgcgcatggtcagccagacgtggctgaccatcgttctggtctccgcgctgctgatagcgtcgagcgcgggcattctgtggtggcaggggcagcagatactcgagaactatacgaccatccgggagcagaagagcacgcaggccatgctgtcagagaggaacagcggcgtacagctctcgacctgcggcgagcagagacgccgctgcgtgagggtgaacccggaagcgggacagttcggagaggactcgagctggatgatactggcggggaaatag

SEQ ID NO: 59 - DNA, 219 bp, Enterobacter cloacae
cacatgacggagctggaaaaacagttgctgagcgcattagagcagctacagcaggactactcgaaaaggctggacgagtgggagaacgccttcgcggaatggcggacgatgtctggtcttattcaacgggagaacgcggcgctgaacgagcgcgtcacggtcttgagcaggcaggtgcagagtttgagcgagcagctgcgccggttgtcgaaaggctga

SEQ ID NO: 60 - DNA, 861 bp, Enterobacter cloacae
  unsure (16)
ccaacattgccgagcncggacggggggcgaaacatccgactgaagggagccatctatgaacagtcttttaacgctggcgaaggacttagagcagaaatcgaaagcgcagcagcagactaccggcgagatgctgaaagccgcattcagcgagcacgagaagtctgtcagagcggaactgagcgaaagcgagaagagaatcagcgccgccatcctcgaccacgaccggaagctgtcctcagccatgagccagcgcacgaaagggatgctgcgcatggtcagccagacgtggctgaccatcgttctggtctccgcgctgctgatagcgtcgagcgcgggcattctgtggtggcaggggcagcagatactcgagaactatacgaccatccgggagcagaagagcacgcaggccatgctgtcagagaggaacagcggcgtacagctctcgacctgcggcgagcagagacgccgctgcgtgagggtgaacccggaagcgggacagttcggagaggactcgagctggatgatactggcggggaaatagcacatgacggagctggaaaaacagttgctgagcgcattagagcagctacagcaggactactcgaaaaggctggacgagtgggagaacgccttcgcggaatggcggacgatgtctggtcttattcaacgggagaacgcggcgctgaacgagcgcgtcacggtcttgagcaggcaggtgcagagtttgagcgagcagctgcgccggttgtcgaaaggctgaacgcgatagaaactcaccggcagcaggagcgggcggtgcagcaccagaaagcgctggagctggaacgatcgcagtggcagcatcatggtccttcgctatga

SEQ ID NO: 61 - DNA, 627 bp, Enterobacter cloacae
tggcggcaatttttctctttttgcttacgattcgttgagaacccgaaaatgttaaaaaaactcttctttccgttggtagcactctttatgctcgccggctgcgcgactccgccgacgaccattgacgtttcaccaaaaattaccctgcctcagcaggatccaagcctgatgggcgttacggtcagcattaatggcgccgatcagcgtcaggaccaggcgctggcgaaagtgactcgcgacaaccagcaggtcacgctgaccgcctcccgcgacctgcgcttcctgttgcaggaagtgctggagaaacagatgacctcccgcggctacatgattggcccaagcggcgcggttgatctgcaaatcatcgtgaacaacctgtacgctgacgtctcccagggtaacgttcgctacaacattgcgactaaagccgatatcgccatcatcgctaccgcgaagaacggcaacaaaatgaacaaaaactaccgtgcgagctattccgttgaaggcgcattccaggcctccaacaaaaatatcgctgacgcggttaacagcgtgctgactgacaccattgccgacatggcacaggacaccagcattcacgacttcatcaagcagaacgcccgttaa

SEQ ID NO: 62 - DNA, 372 bp, Enterobacter cloacae
  unsure (363)
  unsure (369)
ctgacccggtgcttcaccgggtcagttcataagaacatgtccagtcactacttacgcattttccagcaaccgaaatcagctattttgctgatccttggtttcgcttccggtttgccccttgcgctcacctccggcacgttacaggcgtggatgacggttgagaacatcgatcttaaaaccattggtttcttctcgctcgtcggccaggcttacgtctttaagttcctgtggtcgccggtgatggatcgctataccccaccgttcctcgggcgccgtcgcggttggttagcgatgacgcaggcgctgctgttgctggccattgccgcaccggtttccttgagctgtgaacaaagcggctcaccnaagggntga

SEQ ID NO: 63 - DNA, 237 bp, Enterobacter cloacae
cgttgtcggaggagtgatttcatgatgatacgtgaacagatagaagaaaaattaagggcagcgttcaaccctgtgtttctcgaagttgtcgacgaaagctatcgtcataacgtgccggcaggttctgaaagccactttaaagtggttctggtcagcgatcgcttcacgggagaacgtttcctgaaccgacaccgctccatctgtcttcactgccgagtgccggtacgcgctatgtta

SEQ ID NO: 64 - DNA, 765 bp, Enterobacter cloacae
  unsure (757)
acggctcctgttcactcaggagccgttttgacatttttaaaaacgctgcgaaagcgacgttattttgaattttatgaggcttcaaacatggtacctgtggtcgcgcttgtcgggcgccctaacgttggaaaatccactctttttaaccgtttaacacgcacccgtgatgcgctggttgcggatttcccggggctgacgcgtgaccgtaagtacggtcgtgcagaggtggaaggacgcgagttcatctgtatcgataccgggggtattgacggtacggaagacggcgtagaaacccgcatggcagagcaatctctgctggctatcgaagaagcggatgtcgttctgtttatggtggatgctcgcgctggcctgatgcccgcggattctgctatcgctaaacatctgcgttcacgcgaaaagccaaccttcctggtggcgaacaaaactgacggcatcgatgccgatcaggccattgcggatttctggtctttaggcctgggcgatatttatcctatcgcggcctcgcatggccgtggcgtcaccagcctgctggaaaccgttctgctgccgtgggttgatgaagtaaacccaccggaagaggtggatgaggacgctgaatactgggcgcagtttgaagccggagaagaaggagaggaagagccggaagacgacttcaacccgcaggatctgcctatcaagctggctatcgtgggtcgcccaaacgtgggtaagtctacgcttactaaccgtattttcnggcgatga

SEQ ID NO: 65 - DNA, 606 bp, Enterobacter cloacae
ttattttcgcggggctgctcctacgtagtgaagacgttcggtgccgccattgtgggcggtgacaacggccgagtcagcgcggtactgatgcagcagggccagatgatctggcagcagcgtatttcccaggcgaccggttcaactgaaatcgaccgtctgagtgacgtggacaccacgccagttatcgtcgacggtgtggtttacgcgctggcgtataacggcaacctgacggcgctggacctgcgtagcggccagatcatgtggaaacgtgagctgggttccgtgaacgatttcatcgtcgacggcaaccgtatttatatggtggatcagaacgaccgcctgctggcgctgagcaccgaaggtggcgtaacgctgtggacgcaaagcgatctgctgcaccgtctgctgaccgcaccggcactgtataacggcagcctggtggtgggcgacagcgaaggctatatgcactggatcgatccagagaatggccgcttcgtggcacagcagaaagtggatagctcaggcttcctgacggagcccgttgtggctgacggcaaactgctgattcaggcaaaagacggcacgctgtacgcgatcacgcgttaa

SEQ ID NO: 66 - DNA, 462 bp, Enterobacter cloacae
gttatagtaacacatcatccttcattattatgtttgaaaaactctcgggtacaacccccgaaaagtaccgcaaaaacatataaccacaccattaagccaagtgactttcaaatgtgtagaactgacaaatttcagcttagcgtcttaaacaccatcatttttacaatagatgcacctataaaaacagggttatcaatcaatcatttatctattatttcaggatatagtaaatggcatcttcaaaaaattttcaaacaccattttggcatgtctttaggtacatatattagacgaaaaaggatagagtatgctgctcatgaaattataaataaaaaatgcaaaatcattgatgtagtgattgatttcaatttcagcaatcaatcatcgttttgtagaacctttaagtcaatatatggtgtatcacctaaagaatttaagagtgaacatattaaccacttataa

SEQ ID NO: 67 - DNA, 192 bp, Enterobacter cloacae
aaagggaagtgggtgtctttccgtgaatggagagcaagagtgcgttttttaaattcgctaccattattgaggacagaaaaaaccatccaagagatatcttatttgctaggttatagtaacacatcatccttcattattatgtttgaaaaactctcgggtacaacccccgaaaagtaccgcaaaaacatataa

SEQ ID NO: 68 - DNA, 360 bp, Enterobacter cloacae
tcatgtctgtttttgtgtttcttttgtccttttatgttaattattttcaacaccatgtgcgttattataattgccactgaactggaaaaaaggtgtatcatgaaaaacgtcctctcattgtcattgctactatttatttcaagtggttatgcagcttcagaagtcacctatttaaaccccacacctcaaggagcggtacgaattggtgaggtaagcttctttaaagcaggaagtgcaacgcagtcagaagtaattgggtcactatcaaagaaagcagattcattgggtgggactcatttcgaaatttcgtcacttaattcttccgataatacgtatgcaaccgctattgtgtacaagtag

SEQ ID NO: 69 - DNA, 216 bp, Enterobacter cloacae
acgttgggaactgtgctgtttctttgctttagtatcggattggcaatcacaatggtagctatcggtgctgttgcagctgtaagcgtagaacaggcatcaaagcgttgggacgggttggatgttttagcccgaagagcaccatatttttcaagtgctttgattgcgttagggggaatttatatgggttatcacggatggttgggcataacaaattga

SEQ ID NO: 70 - DNA, 312 bp, Enterobacter cloacae
ccggattttgatttaccaaacacaacctggcaacccaccaagctggaccttgaaaatattctggaaccttcacccagacgcatctggccggatgcttacgaacgtctgctgttggaaaccattcgtggtatccaggcgctgttcttccaccgcgatgaagtggaagaggcgtggaagtgggtcgactccatcaccgaagcgtgggcagccgaccaggacgcgccaaaaccgtatcaggcgggaacatggggacctgtcgcctccgttgcgatgatcacccgtgatggccgctcctggaacgagtttgaataa

SEQ ID NO: 71 - DNA, 885 bp, Enterobacter cloacae
attagaggagcttttatgaatccgacattgttacgcgtaacacaacgcattgttgaacgctcgaaagagacccgtgctgcctaccttgcccgcatcgaacaggcgaagagtgaaacggtccatcgctcacagctggcctgcgggaatctggcccacggctttgcggcctgccagcctggtgataaagacgcgctgaaaagcatgttgcgtaacaatatcgccatcattacctcctataacgacatgctttcagcccaccagccgtatgaggtctacccgtctatcatccgcaatgcgctgcacagcgtgaacgcggtgggccaggttgcaggcggcgtgccggccatgtgtgatggcgtaacccagggccaggacggtatggagctgtccctgctgagccgcgaagtgatcgccatgtcagcggcagtgggcctgtctcacaatatgtttgatggcgcgctttatctgggcgtgtgcgacaaaatcgtcccggggctggtgatggccgcgctgtcgtttggccacctgccagcgatttttgtgccgtcaggcccgatggcaagcggtctgccaaacaaggaaaaagtccgtatccgccagctgtatgccgaaggaaaagcggaccgtcaggcactgctggaagcggaagccgcgtcttatcacgcgccgggcacctgtacgttctacggtacggccaacaccaaccagatggtggtggagtatatggggatgcagctaccgggctcgtcgttcatccagccggatgcgccactgcgtaaagcgctgaccgaagccgcatcccgtcaggtgacgcgcctgaccggtaacggcaacgagtggatgccaatgggcaaaatggtggatgaaaaagttatcgtaaaacgc

SEQ ID NO: 72 - DNA, 387 bp, Enterobacter cloacae
  unsure (43)
  unsure (281)
caaaatggacgtcacatgcttacgtgttatgcgcttaatcatntccgcaccaaaacccaattggcaacggcagcaggtgtaaaactgcaatccatttacaattggaaagagcttgtacctgaaacccgtgctcaccggcttgaaacaaccttcgggcgggttctgacattccacaaaaccattttcgaaccacaccgtaaagcacaaacaactgggaaaaagaatacctccccccccccaagggactcgaatttatggaaattccaaccgaccccttccantgcgttctgcttggctggggcggcggaattaagggagggcctttccccggaggggaatcccgcacaaattaccccgcccagggggggcccaccttcccctgggtgg

SEQ ID NO: 73 - DNA, 423 bp, Enterobacter cloacae
aattgtctaactatgaaaaatatgaacagtctgggacagcgaatccttgccagacgcaaggagctgaaattaactcaacgagaagccgccaaactcgcaggcgtagcgcatgtaaccatttcgcaatgggagcgtgacgagacgcagccggtaggtgcaagattatttgcgcttgcaaaggctctttcctgcaccccaacatggctgatgtttggtgatgacgatcaagctccagttccagcagaagatatccaattagcgccgcaattatctgacaagcacagagagttaattgatctctacgattccctgccagagtcagagcaagaggcacagctcgagcaattgcgtgctcgcgtgaaaaacttcaataagctcttcgaagaattactcaaagccagacagcgccaatccaaaaaataa

SEQ ID NO: 74 - DNA, 1260 bp, Enterobacter cloacae
  unsure (44)
aatgggttaggggactcttgcccgggattaatggagaaggggcnatggatttctggcgaattatttgtacctcttcctgggtatttatttggctatcacctggagtcgggggatattatgaagatgaaatgcaataacaggttactcagattatctgcctccctgaccttaatttcgttggtggtgactgcggctaatgcaaataacggccaggcggggatatctcccgttgcggcaatgacgatgaaagaaagtattcttttcgctctcgatcgcgacccctcggtgagtcagcaggcggcacagctggggatcggccaggcacaaatagacgaagcgcgcagtggctggatgccacaaatagccctgaacgggcgtacaggtcacagccagaccaccgattcaagcggctcgttgcgaaattccgcagcctggggcctgagtctgacgcagctggtgtacgattttggcaagaccaacaacagcatcagccagtcttcagctcagcgtgacagctatcgctaccagctgatgagcacgatgtctgccgtcgcggaaaaaacggcgctcagctatgtggaagtgaaacgctacagcgatctgttgcaggcggcaaaagagaacgtgcaggcgcttaaaaacgttgagcagctggcaaaactccgcgccgacgctggcgtaagctccacctctgatgagcttcagacccgcacccgtattgccgggatgcaggcgacggtagagcagtacaatgcatccctgaacagcgcccgcgcgcggctggcggtattaactggcatacaggctgaacgctattcaccggttccgggaggtctggccgtggagccggattctctcaatcggattgattattcactgatcccaacggtgatggccgcgcagaacatggagcgttcagcccagtacggcgtagaaaccgcgaagtctcagcactggccgaccttaagcctgaaagggggccggacccggtatgagtcggataatcgcgcgtactgggatgatcagatccagctcaatattgacgcaccgctttatcagggcggcgcggtctcggcgcgcgtccgtcaggccgagggcgcaagggcaatggcatcgtcgcaggtcgatcaggcccgttttgatgtcctgcaaaaaatcctccgtcgcacaggccgactggaccggggcgcgtggactaatggaagccgggaaacgtcagctggaaaatgcgttgcgcgcccgcgatgtctacaaaaatga

SEQ ID NO: 75 - DNA, 1197 bp, Enterobacter cloacae
  unsure (1156)
aggtcaggcggcgtaacacaacaaagcaaaacatcacattggagcacaataatgagtatttccttgaagaagtcagggatgctgaagcttggtctgagtctggtggccatgaccgttgcagcaagcgtacaggcaaaaaccctggtttactgttctgaaggctctccggaaggctttaacccacagctctttacctctggtacgacttacgacgcaagctctgtaccgatctataaccgtctggttgaatttaaaaccggcaccacggaagtgattcctggcctggctgaaaagtgggatatcagcgaagacggtaaaacctataccttccacctgcgtcagggcgtgaagtggcaggacagcaaagaatttaaacctacgcgcgactttaacgccgacgacgttgtgttctccttcgaccgtcagaaaaatgcccagaacccgtaccataaagtgtctggcggcagctatgaatacttcgaagggatgggtctgccagacctgatcgctgaagtgaaaaaagtggacgataaaaccgtccagtttgtgctgacgcgtccggaagcgccattcctggctgacctggcgatggacttcgcctcgattctctctaaagagtacgctgacaacatgctgaaagccggcactccggaaaaagtggacctgaacccaatcggtaccggcccgttccagctgcttcagtaccagaaagattcccgtattctgtataaagccttcccgggctactggggcaccaagccgcagatcgaccgtctggtcttctccatcacgcctgacgcatccgtgcgttacgcaaaattgcagaaaaacgaatgtcaggtgatgccgtatccaaacccggctgacatcgcgcgcatgaagcaggacaaaaatatcaacctgctggagcaggcgggcctgaacgtgggttatctctccttcaacaccgaaaagaaaccgttcgatgacgtgaaagtgcgtcaggcgctgacctacgcggtgaacaaagaaacgatcatcaaagccgtttaccagggcgcaggcgttgcggccaaaaacctgatcccaccaaccatgtggggctataacaacaaccttaaggactacacctacgatcccgagaaaaccgaaaccgttgctgaaaaaaaccggccangaacaaggctttaccgccaacctgtgtgcgatgccggttaa

SEQ ID NO: 76 - DNA, 336 bp, Enterobacter cloacae
atggcaatcgcagatttggataagcagccagattctgtttcttccgtgctgaaggtgtttggcatcttgcaggcgctcggagaagagcgtgaaattggtattacagagttgtcgcagcgtgtgatgatgtcgaaaagcaccgtttatcgctttttgcagacgatgaaatcattgggttatgtcgcgcaggaaggagaatcagaaaaatattctctgacgctgaaactgtttgaactgggcgcccgcgctttgcaaaacgtggatctgatccgcagcgctgacattcagatgcgtgaactttcacgattgacgaaagagacaattcacctcggtgcg

SEQ ID NO: 77 - DNA, 987 bp, Enterobacter cloacae
aatagttactctgaaaataatttcacgctgagtcattcttttcccatgcaaaaaaacgtttctgatggcctgcccttaccgcagaggtacggggcaattgccactattgtcatcggtatttcgatggctgtccttgacggtgcgattgccaacgttgctcttcctaccattgcaaaagaccttaatgcttctcccgcaagctccatctggattgtgaacgcgtaccagatagcaattgtgatttccctcctgtcactctctttcctgggcgatatgtttggctatcgccgggtttaccagtgcgggctggtggtctttaccctcacctcgctcttctgtgccctttccgattcactgcacaccctcaccctggcgcgtatcgcgcagggctttggcggcgcggcgctaatgagcgtgaacacggccctcatacggcttatctatcctcaccgccacctggggcgcggcatgggcattaattcctttattgtggccgtgtcgtccgctgccgggccgacgattgccgccgccattctgtccgttgcctcgtggcagtggctgtttgccattaatgtgccgctgggtattgtggcgatcttcttcgccctgcgctatcttccggaaaatggtccgaaaaacaccatgccgcgttttgacctgcccagcgccgtgatgaacgcgctgacctttggcctgctgattaccgcgctgagcggatttgcgcaggggcagtctctgtcgctcattgccgcagaaatcgttgccatgcttatcatcggatttttcttcgtacgacgtcagctggcgctgcccgtgccgttactgccggtggatttgctgcgtattccgctgttttcgctatccatttgtacctccatttgctcgttctgcgcccagatgctggcgctggttgcgctgccgttctttttgcagagcgtgactggccgttcggttgtgtcatcaccggcggtagaagtatacctcccc

SEQ ID NO: 78 - DNA, 711 bp, Enterobacter cloacae
aatgacattagcagccagccggggagcaagatgaaaatattgatcgtcgaagacgaaattaaaacaggtgaatatctcagcaaagggcttacagaggcagggttcgtagtggatcacgctgataatggtcttaccggatatcatctcgccatgacagccgagtatgatttagtcattctggatatcatgctacctgatgtgaacggctgggatatcatccgcatgctgcgcactgccggaaagggtatgccggtcttactgctgacagccctcggcacgatcgaacatagggtcaaaggactggaactgggtgcggacgattatctggttaaaccctttgcgtttgccgaactgctcgcccgggtgagaacccttctgaggcggggaaacacgatgatcacggaaagccagtttaaggtggctgacctctcgattgatctcgtatccagaaaagtcagtcgcgccggaaaccgcattgtgctcaccagtaaagagttcagcctgctggaattcttcattcgccatcagggagaggttcttccccgctccctgattgcctctcaggtctgggacatgaattttgacagcgacactaatgcgatcgatgtcgcagtaaagcgactccgcgctaaaatagacaacgattacgagacaaagctgatccagacagtccggggcgtgggctacatgctggaggtcccggatgcatag

SEQ ID NO: 79 - DNA, 342 bp, Enterobacter cloacae
tccagacagtccggggcgtgggctacatgctggaggtcccggatgcatagcaaaccttccagacgccctttctcactcgctctgcggctgaccttttttatcagcctgtccacgatactggcttttatcgcattcacctggtttatgctgcattctgttgaaaatcattttgccgagcaggatgtcagcgatcttcaacaaatcagcaccacactgaaccgtatactgcagtccccggtggatccggatgataaaaaaataagcaaaataaaggaatcaattgccagctaccgcaacgttgcccttttgctcctcaatcccagggggggaagtgctctttag

SEQ ID NO: 80 - DNA, 603 bp, Enterobacter cloacae
atcatactcggctgtcatggcgagatgatatccggtaagaccattatcagcgtgatccactacgaaccctgcctctgtaagccctttgctgagatattcacctgttttaatttcgtcttcgacgatcaatattttcatcttgctccccggctggctgctaatgtcattctattgcgcccacgatcgttatcaacggattacagcaaaaatgacaacattgtcattatcctgtcacccggcaaacagagagcgttaggtaaagtacccctatcaatactctggacttcatttgaaccatttaccaggtctgcctggacgagaagcgttatgttcaaattaaaattactcagcattagcacgatattcatcctggcaggctgcgtgtcgcttgcgcctgaatatcagcggcccgcagcaccggtaccccagcagttttcactgtcccataacagcctgacgccagcggtaaatggctatcaggatacgggctggcgtaacttttttgtcgatccccaggttacccggttgatcggtgaagctctgactaataaccgtgatttgagaatggctgccctgaatgttgaagaggcccgagcccagttc

SEQ ID NO: 81 - DNA, 1296 bp, Enterobacter cloacae
ttttcttttattgttcgagtggagtccgccgtgtcactttcgctttggcagcagtgtcttgcccgattgcaggatgagttaccagccacagaattcagtatgtggatccgcccgttgcaggcggaactgagcgataacacgctggctttgtatgcgccaaaccgtttcgtgctcgattgggtaagggataaataccttaataacatcaatggactgctgaatgatttctgcgggtcagatgccccacagctgcgttttgaagtgggcacaaagccggtcacccaaaccgttcgtgaagttgtcaatgtggcagcccctgcacaggcggcgcccgctccagcgcctcgcgttgcaccggctcgtcagggctgggataacgttccggcccccgctgagcctacctaccgctctaacgttaacgtgaaacacacgttcgataacttcgttgaaggtaagtcgaaccagctggcgcgcgcggcggctcgccaggttgccgataaccccggtggcgcttacaacccgctgttcctgtatggcggcacgggtctcggtaaaacgcacctgttgcatgcggtgggcaacggcattatggcgcgtaagcccaatgccaaagtagtgtatatgcactccgaacgcttcgttcaggacatggtaaaagccctgcaaaacaatgcgatcgaagagtttaaacgctactaccgttccgttgatgcgctgctgatcgatgacattcagttctttgccaataaagaacgatcgcaggaagagtttttccatacctttaacgccctgctggaaggtaatcagcagatcattctgacctcggatcgttatccaaaagagatcaacggcgttgaagatcgtctcaaatcccgcttcggctggggcctgaccgtggcgatcgagccgccggagctggaaacccgcgtcgcgatcctgatgaaaaaagccgacgagaacgacattcgcctgccgggtgaagtggcgttctttattgccaagcgcctgcgttccaacgtgcgtgagctggaaggggcgctgaaccgcgttatcgctaacgccaacttcaccggtcgtgcgatcaccatcgattttgtgcgtgaagcactgcgcgatttattggctttgcaggaaaaactggtcactatcgacaatattcagaagacggtggctgagtactacaagatcaaagtggcagatttactgtctaaacgtcgttcccgctcggtggcgcgtccgcgtcagatggcgatggcgctggcaaaacagctaagcaaccatagcctgccggaaatc

SEQ ID NO: 82 - DNA, 288 bp, Enterobacter cloacae
tttaataagcgcgggtccggcagctccgtggtgaagatccagatggcgctcactacgctgttgcgctttgaacatgagacggtgatgccgcctgaaatgaaattcagcaagcgtgaacgggaaattctgaagtggaccgcagaagggaagacgtcggcagaaatcgccatcattctttccatctcggaaaataccgtcaatttccaccagaagaatatgcagaagaaattcaacgcaccgaataagatccagatagcgtgttatgccgcggcgacgggacttatctga

SEQ ID NO: 83 - DNA, 461 bp, Enterobacter cloacae
acccaattagcagtcagtagcgttatccctattctggagacatttcctttgatcaacgtccttcttgttgatgaccacgaactggtgcgcgcagggatacgacgcattcttgaagatataaagggtattaaagttgccggcgaggcgtgctgtggcgaagatgccgtcaaatggtgtcgcgctaactccgcagacgtggtgctgatggatatgaacatgcccggtattggcgggcttgaagccacgcgcaaaatcgcgcgcatgttcgttgataccttagttatcatgctgaccgtccataccgaaaatccgctgcctgccagagttatgcaggcgggtgctgccgggtatctcattaaaagcgccgcgccgcaaggaagtggtcaatgcgatccgccaccgtataccccggggcaaggttacattccttctgaatatgctcaacaaaatggctctgaatc

SEQ ID NO: 84 - DNA, 225 bp, Enterobacter cloacae
atgagcacacctgaatttgccactgccgagaataaccaggaactggcacaggaagtaaactgcctgaagtcgctgctgacgcttatgctacaggcgatgggccaggctgatgctggtcgtgtgatcattaaaatggaaaaacagatcgcgcagatggaagaccaggcggaatccgctgtttttgccaatacggttaagcaaattaaacaagcctaccgccagtaa

SEQ ID NO: 85 - DNA, 366 bp, Enterobacter cloacae
catgggtcgcatgcgatctctctttactcacaacacgcttttgaccccagacaagaaacactaattttaaccgaaacggtgaccaccatgagtaaagcgattatgcagcagacgtataattttgaagccttgcacgataaaggactggcggaacattttcttaatgcaggaaaacatctcagtggtgaggttgaagtgttgggctcggcaatacgctgtattatgctgaccggtgacaatctctctaataaagagattatcctgcaactgattcacgccctcgaaattaccgaggagcccgaagcctgcgatgtcattcgaaatacgcttgaaattgttgtcggttttacgcgcgatgatatctga

SEQ ID NO: 86 - DNA, 888 bp, Enterobacter cloacae
gttgttcagataaaaccatttataccccatagaaaagtggggttggataaattatatcttatcagggtgtggtttagcgatgcacgtgttttcagagatgaagtctgtgcagtaaaaaataatccgcaggggttttcggatgcggaaattgatattttgcaggcgttacataagcgggaaatctttgcggcttatcaaattattaccgatggcgataaaaaaggagtaggctttgaaattctgctgcgctggcataaaaacggtcaggttctgaaggctgcccaatttctgggtggggtgaaaaatggcgaaatatggctcaagctgacggcgttagtcatccacgcggccgtgtcaggtatcaacagatacaatgggaaatattatttttcggttaatattccgcctccactggctaccgggaacgcgctgccgggaatggcgaaaaaagccgttgagatgttactgaagccgcagtgggccgggaaacttgtctttgaattagctgaagcgattgatgtgacaaaggatccaaatattcctgtcactcttcagcgtttacgcgccgaggggtgtcggctgtttctggatgattgcttttccagagattacgctatgttacccatccgacagattaatgttgatggattgaagcttgaccgcgatatagttgagcactttgttgctaacgacaatgactatagcattattaaagcgatacagatatacagcgacatgacgggaagggaatgcgttgcggaaggcgtcgatagcgaagaaaaatttaaaaaacttgtcgcgttaggggttaaacgctttcagggatattatctttcccgggcggttaaagaagaagagcttgatcgaatggtacggctatttagttaa

SEQ ID NO: 87 - DNA, 558 bp, Enterobacter cloacae
acaaatgttatccacgctacccatgctgcacagttcgctaaaattttcggagtaaaagtcgatgatttcagcccatcccttgcagctgagatatcagctatgtttgaggcgattgcgaacggaaggaatcattcctctgtgtatgagtacccgctattaaccgaagtacaggctggctcattttgcccggttaatacatacacagaacgagacgcgaaggaatgggtttcaacgactgttaaagccagtgattctgccttttggcttgaggtatcaggtcattcgatgactgccccgccaggagtaaaaccgagttttcctgagggaatgcttatactcatagatccagaacaggatgttgagcctggtgatttctgtgttgcaggtatcttcaacgattcagaggtcacttttaaaaaatatgttcgagaagatgggaagccatggcttgaacctctaaaccccagccctcgctatcaggccattgaatgtaatgagaattgcaggataataggcaaagttgttaaggcccaatggcctgaaaatatcttcgaataa

SEQ ID NO: 88 - DNA, 467 bp, Enterobacter cloacae
  unsure (399)
  unsure (404)
aaatcttcgggtcgtcgatggctttttggatgttgtcgcgctggcgctgttcgtctttttctttgccgttgcgtcgctgggttcgtcctcctcggcggtccttttcctgctgctgttccgcgtctccttcttcgtgttttgctgtttcgacggtgtccgcgctggtctcgtctccgcctggcgtgcgctggtttccgcgttgccgtttttgtccgtcgggcgtcctttggtttcgctttttgttcctgcccgtcggtgttgtcccggtttcgctggtgcgttttgtgggctttgcggcgtttgaagcgcggcatggagcaagctcagccgctctccacgtttctgtttaacagcctgatgccgcaggttgatttgagtacccctgtacggcgcgcgcanctcancacgctggcgctgccgttaatcagccatgtgcccggcgaaacgctgcgcatctatctgcgtca

SEQ ID NO: 89 - DNA, 330 bp, Enterobacter cloacae
tttttcctttcggcactcggcggtgaaaatcttcgggtcgtcgatggctttttggatgttgtcgcgctggcgctgttcgtctttttctttgccgttgcgtcgctgggttcgtcctcctcggcggtccttttcctgctgctgttccgcgtctccttcttcgtgttttgctgtttcgacggtgtccgcgctggtctcgtctccgcctggcgtgcgctggtttccgcgttgccgtttttgtccgtcgggcgtcctttggtttcgctttttgttcctgcccgtcggtgttgtcccggtttcgctggtgcgttttgtgggctttgcggcgtttga

SEQ ID NO: 90 - DNA, 195 bp, Enterobacter cloacae
ggacatagaaacagtggtcattggtgtggtacgtcatctcgttcactccttcaaattccgggatgcctgagcatgtttgcgctggtcgatgtgaattctttttatgcttcatgcgaaaccgttttcaggccagacctccgtggcaaacctgtggttgtactatccaataatgatctgagtggtgagaagtgttag

SEQ ID NO: 91 - DNA, 258 bp, Enterobacter cloacae
agtggggacaagatgtacatctcagaaattcagattgagaattttcggctgttcgattccgctgaaaaagcttttgtactatcactcaaccccgggctgaccgctttggtaggcgaaaatgatgcgggaaagacggctgttattgatgctctccggttggtattaggaacccgcgatcaggagatgctgcgtatagatatgttaattatgcaccattggggggaggcaaaatctcgaacttccccttttcgctcatag

SEQ ID NO: 92 - DNA, 825 bp, Enterobacter cloacae
ggatataacatggcgtttaaatttaagaccttcgcagcagtaggcgcactgattggctcgctggcactggtgggttgcggtcaggacgaaaaagatccaaaccacatcaaagtaggcgttatcgtcggtgcagaacagcaggttgctgaggccgcgcagaaaatcgctaaagagaaatatggcctggacgttgaactggtgaccttcaacgattacgttctgccgaacgaagcgctgagcaaaggcgacattgacgctaacgccttccagcataaaccgtacctggatcagcagatcaaagatcgcggctacaaactggttgctgtcggtaacaccttcgtttacccgattgccggctactccaagaaaattaaatctctggatgaactccagccgggttcacaggttgccgtccctaacgacccaaccaaccttggccgttccctgcttctgctacagaaagtgggcctgattaaactgaaagaaggcgttggcctgttaccgaccgttctggacgtaaccgaaaacccgaaaaatctgaaaattgttgagctggaagcaccacagctgccacgttctctggacgatgcgcagatcgccctggccgtgatcaacaccacttacgccagccagatcggcctgaccccagcgaaagatggcatcttcgttgaagataaagattccccgtacgtcaacctgatcgtgactcgcgaagacaacaaagacgcggagaatgtgaagaaattcatacaggcatatcagtctgaagaagtgtaccaggaagccaataaggtgtttaacggcggcgcggttaaaggctggtaa

SEQ ID NO: 93 - DNA, 931 bp, Enterobacter cloacae
ttcccgacgcggatcttccagccccgtggtcaagaccccggtgcgtggagtagcttcattgaagagcaatcctgatggtgcttcctgtcttggcccgatggcagggctggagaaacagcgtgagcagtattcacacgccgtccaggcattgtctgatccggatcgtacgaggctggttttagtggctcgactgcaaaaatcaacgcttcaggaagtcgcccgtactcatgatgagcttgcggcgataggtctcaaaaatcagtatctggtcatcaacggcgtgttacctgagacagaagcagtcaacgatactctggcggctgcaatatggggccgggagcaggaggcgctggcaagtcttcccgctggtctggacgctctccctactgacacattattccttcaaccagtgaatatggtcggtgtgtctgctttaaggggacttctcacctcccaacctgagacggcttcatttgctgaagtgtccgccctgcaaaaaccagcgatatcgtcgttgtctgctctggttgatgagattgcccttaatgaacacggcctgattatgctgatgggtaaaggtggcgtgggtaaaacaaccatggctgcggccattgcagtcagactggccgaaatgggatttgatgtgcatctcacgacgtcagatcctgctgcacacctgagcacaaccctcaatggaagcctcaataacctgcaggtcagcagaatcgaccctcatgatgaaacagaacgttatcgccagcatgtccttgaaacgaaaggacgtgacctggatgaagcagggaaacatctgctggaagaggatttacgctctccgtgtaccgaagagattgctgtgttccaggccttctcacgggtgatccgtgaagcgggtaaacggtttgtcgtcatgcatacttcttcaccttcgtag

SEQ ID NO: 94 - DNA, 183 bp, Enterobacter cloacae
aacagaaacaccacctccgcagagaaggtagaaaacgttgttaagccgccgcagaaaccggttgtaatcagaaccttccacatagggtcgatgttggtcatgcgattaaaccaggccagccccatcccaataataaacgccccgatcagatttgccgccagtgtccccatcggaatggcctga

SEQ ID NO: 95 - DNA, 945 bp, Enterobacter cloacae
tgcagagggttaaaccgcatgcttaagagccaccgcgcaacgctacccgtgcctccaccaataaaaacggctataagtagttgtaacactgtcaatacctgctatttgctgtgtaagtgcgtcgagtgtaacgctgtttttgaccgggagacaattatgtatgttgcagtagggcagttcgcggtgacgccggactggaatgaaaacgcggaaaaatgcgtctccctgatgcatgcggcgaagcaaaagggggcgtcgttgctggtacttcccgaggcgttactggcccgtgatgatggcgatccggacctgtcggtaaagtctgcgcaaacgctggaaggggcgtttctgaaacgactgctggccgaaagcgttggcaacacgctcaccaccatattgacggtccatattccgtcctcgccggggcgcgcggtgaacacgctggtggcgatacgtgagggtgccattgtcgcgagctacgccaaacttcatctgtatgatgcgttcagcgttcaggagtcgcgcctggtcgatccggggagtgtaattccgccgctgattgaggtggagggttttaaggttggcctgatgacctgctacgatatccgttttcccgagctggcgctgaacctggcattgcagggggcggaggtgctggttctgcccgccgcgtgggtcaaaggaccgcttaaggagcatcactgggcgacgctgctggcagcacgcgcgctggataccacctgttacgtggtagccgcgggtgaatgtggtaacaaaaatattgggcagagcagggttgtcgatccgctgggggtgacggttgttgcggcagcggagacgcctgcgttattgctgacggagataatttcagcccgaatagcgcttgcgcggcagcaattacctgttctgcgcaaccgcaggtttgcgccaccgcaattaatgtga

SEQ ID NO: 96 - DNA, 396 bp, Enterobacter cloacae
caggtattgacagtgttacaactacttatagccgtttttattggtggaggcacgggtagcgttgcgcggtggctcttaagcatgcggtttaaccctctgcatcaggccattccgatggggacactggcggcaaatctgatcggggcgtttattattgggatggggctggcctggtttaatcgcatgaccaacatcgaccctatgtggaaggttctgattacaaccggtttctgcggcggcttaacaacgttttctaccttctctgcggaggtggtgtttctgtttcaggaaggccggatgggctgggcgctgacgaacattgccgttaacatgcttggctcgtttgcgatgactgcgatcgcattctggttattttcctccgccagcggacattaa

SEQ ID NO: 97 - DNA, 456 bp, Enterobacter cloacae
ttacacatgaatatattaatcacgaccactgcgtttacagctttattttgtggggcagcttttgctcagtccagtgatattgcccatgaagcacatcgatttgttaataatgcctcagccgtcagtcatgtgaattcctcgacgcatgaaaacttaccggacagggttaataaaaacaacacgccctcattctctgaaatgaatgaacatgaaagggccattgttgctcattcatttatgaacaacagcgcgtcctatgcgcatcagaaaatgattgaggaacataaaaaaatgctgtccggcagtgatgcaaattcaaagacctcgtcttcttcttttaacgaactgaatgccggagaaaaagccgctctcgtgcatgagcaggtcaataatgccggtgcggaagcacatcagacgcaggcaagaaagcttcgcgggctgtattcgaccaggtaa

SEQ ID NO: 98 - DNA, 839 bp, Enterobacter cloacae
cgcccccttgcacgcttgtccttccagccggctggggaagacctattgcgggcgcgggtggacgtatgggtcgccagctgattcaggcggcactacagatggatggcgtggcactcggcgcggcgctggagcgtgagggttcatccctgctgggagccgatgcaggcgaactggcgggcgcgggcaagacaggcgtaaccgtacagagcagccttgaggcagtgaaagaagactttgatgtgttcatcgactttacccgtccggaaggcacgctggctcatctggcgttttgccgtcagcacggtaaagggatggtgattggtaccactggtttcgatgatgccggtaaacaggccattcaggacgcagccaccgacattgcgattgtcttcgctgcgaactttagcgtcggcgttaacgtcatgctgaaactgctggaaaaggcagcgaaggtgatgggcaattataccgacattgagattgttgaagcacaccaccgctataaagttgatgctccatcaggcacggcgctggcgatgggcgaagcgattgctcatgcacttgatagggatttaaaagagtgcgcggtctatacccgtgaaggacataccggcgaacgcgtgcccgggacaattggtttcgcaaccgttcgtgcaggcgatatcgtcggtgaacatacggcgatgttcgccgatattggcgaacgtgttgagattacccacaaagcgtcaagccgcatgacgtttgcgaatggtgcagttcgcgccgctttgtggcttaacgcgaaggaaaagggtctttttgatatgcgagatgtgcttgatctcaataatttgtaa

SEQ ID NO: 99 - DNA, 390 bp, Enterobacter cloacae
tatgcaaataaagtgagtgaatattctctggagggtgttttgattaagtcagcgctattggttctggaagacggaacccagtttatcggtcgggccataggggcaacgggttcggcggttggggaagtcgttttcaatacttcaatgaccggttatcaagaaatcctcactgatccttcctattctcgccaaatcgttactcttacttatcctcatatcggcaatgtcggcaccaatgcggctgacgaagaatcctctcaggtacatgcgcaaggcctggtcattcgcgacctgccgctgattgccagcaacttccgcaacaccgaagacctctcttcttacctgaagcgccataacattgtggcgattgccgacatcgatacccgtaag

SEQ ID NO: 100 - DNA, 1269 bp, Enterobacter cloacae
  unsure (1251)
tgcatggagttcagtgtaaaaagcggtagcccggagaaacagcggagtgcctgcatcgttgtgggcgtctttgaaccacgccgactctccccgatcgccgagcaactcgataaaatcagcgacggctatatcagcgccctgctgcgccgtggcgaactggaaggcaaaccagggcagaccttgttgctgcaccatgttccgaacgtcctgtccgagcgtattctgctgattggctgtggtaaagaacgtgagcttgatgagcgccagtacaagcaggttattcagaaaaccattaatacactgaatgatactggttcgatggaagccgtctgcttcctgacggagctgcacgttaagggccgcaacacgtactggaaggtgcgccaggccgtcgaaaccgcaaaagagagcctctacagctttgatcagctgaagaccaccaaaagcgagccgcgtcgcccgcttcgtaaaatggtctttaacgtgccaacccgtcgcgagctgaccagcggcgagcgcgccattcagcacggtctggccattgccgccggtatcaaagcggcaaaagatcttggcaatatgccgccaaacatctgtaacgccgcgtacctggcgtctcaggcgcgccagctggctgacgcctacagcaagaacgttatcacccgcgttatcggcgaacagcagatgaaagagctggggatgcactcttatctggcggtcggtaacggctcccagaacgaatccctgatgtcagtcattgagtacaagggcaatccgtctgaagatgcgcgtccgatcgtgctcgtcggtaaagggctgaccttcgactcaggcggtatctccatcaagccttcagaaggcatggatgagatgaagtacgacatgtgcggcgcggcggcggtttacggcgttatgcgcatggtcgcggaacttcagttgcccatcaacgtgatcggcgtgctggcgggctgcgaaaacatgcctggcggccgcgcttatcgtcctggtgatgtgctgaccaccatgtccggccagaccgttgaggtgctgaacaccgacgccgaaggccgtctggtgctgtgcgacgtgctgacctacgttgagcgtttcgaacctgaagcggtgattgacgtggctacactgaccggcgcctgcgtgattgcgctggggcatcacatcaccggcctgatgtcgaaccacaacccggtgccgcatggaccgatcggcgcatttgtcacaaccgccgtgatnggtccgcagtattgggtt

SEQ ID NO: 101 - DNA, 2103 bp, Enterobacter cloacae
  unsure (258)
ccgccaggcgccgctttcgctgcttcaaccaccgaagataccgttgtcgttgacgggggttttgacaacacacaggatctttctgccagccaggatcaggattacagcgtaaaaaccaccaccaccggcaccaaactgttgttggttccccgcgacatcccacagtccgtcagcgttatcagccagcaacgtatggctgaccagaatctgcaatccatcggacaggtgctgacgaacaccacgggcattacggcccangtgcaggacagcgaccgtaccgtgttttactcacgcggctttttcgtcagcaactacgcctatgacgacctgccaacctccatcagtgaagtgtggaactttggtgataccgccgccgataccgcgatttatgaccgcattgaagtggttcgcggcgccaccggcctgatgtccggcacggggaacccggcggcgtacgttaatatggtgcgtaagcacgcggacagcccggaatttaaaggtaacgtctccgccagctacggcagttgggacaagcagcgttacgtgctggatctccaggcgccgctggtagagtcaggtaaggtacggggtcgtctgatcaccggttatcaggacaacgacagcttcgtggataactaccactaccggaagaaattcctctacggcgtgatggacgcggatgtcaccgacagcacgactctctcggtagggtatgagtatcaggaaagccataccgccgacccaacctggggcggactgccgacctggtacagcgacggaagtaagaaccactacaatcgcagccagaccgttgcgcctgactgggcttattcagataaagacagcacccgcatcttcgctaacctgactcagcgtttcgataatggctgggaagcgcacatcaacggtatgcacgctgaaaccaacttcgactccaaactgatgtatatgtccggctatccggataaagagaccggcgcgggtctggtgggttatggcggctggaaccgtggagaacgtaaacaggatgcggttgacgccttcctgcgcggcggcttcgatctctttggtcgtcaacatgaaatgatgttcggcggcagcttcagccgtcaacgtaaccattacgacaactccatgccggatgcggtatacggcatggtggatgtcggcaactttaagaactggaacgggaacatcgccgatccgcagtggacgccatggaaactctacagcaaggatgatattcgccagtcttcagcctattcgtcggctcgtttctcgctggccgatccgctgcacctgatcctgggcgcgcgctacacccaatacaatattcgttataacccggcaggatcgccgaatacccgtctggaaagtaccaaagatgatgtcacgccgtacgctggcctggtgtatgacatcaatgaggactggtcgacctacgtcagctatacctctatcttccagccgcaggataatcgcgacgccagcggacgttatctcgaccctaccacgggtaaaagctaccaagccggggtgaaggcagactggtttaatacccgcctcaacaactcactggcgattttccgcattgagcatgataacgtcgccagcaatacctacacctacttgccgagcggtgagtcgatctatgaatcgctggacggggtggtcagcaaaggggtcgagttcgagctcaacggtgccctgaccgataactggcagctgaccttcggcgcgacgcgttacatcgcagaagataagaatggcaacgccgtcagctccgatcagccgcgcacaaccatgaagctcttcacccgctatcagttgccaatgctgccggaactgaccgtgggcggtggcgtaaactggcagaacaaagtgtggacggacgtggaaggcggcccggcaggacgttcccgcgcggagcaaggcagctatgggctggtgaacctgttcagccgttatcaggtcaccaaagattttgcggtacaggctaacgtcaacaacctgttcgacaaagagtattacgactacgtcggatcgtatgcggtgtatggcgcgccgctgaacgtctcggtgagcgcgagctacgatttctga

SEQ ID NO: 102 - DNA, 492 bp, Enterobacter cloacae
  unsure (344)
tggactctatcaatgtcaaacactcttcagccccgcagggcgcgggcgtcctactcaatggactttaagctggctctcgtcgaaaagtcatatcagcctggagcctgtgttgcccggttggcgcgggataatggaattaatgacaatctgctgtttacctggcgccagcgttacagacatcttctgcccgatgaaatacaacggtcaatcagagagcaagactctgttatccccgttgtcctgcctgatatggccctgtcacaccatgctgagccgcactatgaaaccgccgctccagcctgccgcgaggccatgacatgcgatgtgactgtcggcggtggcancctgcgtctgtccgggggatttatcaccttgcacttcttgaaaacgctgatccgcgcacctgaccggggagggagccgaatgattccccttaccgtccgggcactccgtattctggctgggttgccggggttcccgaaaaatgcttaa

SEQ ID NO: 103 - DNA, 726 bp, Enterobacter cloacae
  unsure (547)
  unsure (649)
atttcaccgccggtgaatactttagcgctgggttatgcagcattccgttttgggcgccgggaagctgacagcaaacgaacctttggatatttgcgatttgaagtcatcgctggattctttaacgccctgacactcttcgctattgtggcgtggattgcatatgaagcatgggagaggttacaagctccaccagcgatactggcaggcccaatgctgatcgttgccattgtaggattgttggtcaacgtattggtattatggatcatgacccgtggtgagactgatcatgtaaacgtcaaaggcgctattttacatgtgatgggggatctactgggttctgttggcgctattgtcgccgctattgtcatttactatacgggctggacaccaattgatccaatactctccgttctcgtcgcagcactggttttacgtagtgcctggaagttattagcaaaatctctgcacatcctgttagaaggtgctcccgaaaatgcttccccagacaaggtaaagcagagactaatcaattctgttcaaggcttanctgccgtaagtcatattcatgtctggcaaataacctcaggccgaataatggcaacactggaagtaagagcaaaggaagatgtggacgtgaaagacgtagtanagcttgttaaacaagaactttatgagcatttcaaaaatagaacacgcaactgtgggcatcgactggaattacgatga

SEQ ID NO: 104 - DNA, 390 bp, Enterobacter cloacae
tgcactaccaattctggagggagaaccataatgtccaacacatcagattgcggcaacgtacgaaactgttccgcgacagattatggcacagagccagatctatcaatgctctcgcaaaatgaaattgggctactttccgagattttccatctactgggggaccagtcaagactacgaatcctgctttactgtatgcgtggttcggtctctgtaggtgacattgctgagtcgctccagttatcacaatctctggtcagtcatcatctgaggttgttgcggggtgcaagactcgttcgaggagagagaaagggcaagtacatcttttatagcattatggatcagcatgtaagccatgttcttcaggatatggcatttcacatagcagaataa

SEQ ID NO: 105 - DNA, 285 bp, Enterobacter cloacae
aagaccgtgaatgtggattggttcatcgctgaacgttcagggaaagtcaggatattgaaagagcacccccgcaaaaacaaagccgccatcatactcgaatacctgaaagccagcatcagggcaaaggtggagcacccgtttagggttattatacgtcagtttggttttatcaaagcacgctacaaggggttgatgaaaaatgactcacagttagcgatgctattcacgctagcgaacctgtttaaagtggatcagatgatacgacgacagactaaatccgcctaa

SEQ ID NO: 106 - DNA, 435 bp, Enterobacter cloacae
ccagccactatcgtcatcgtttctctccccgatacgtattcttcggtacgagaagcaatatttgtgccttttcaaagaacaggagtcaacatgcagaagattgtgatagtagccaacggtgcggcctacggcagtgaatccattagaaacagcttgcgccaggcaatcgcgcagcgagaaaaggagagagagcaggagcagcgccacaaaaagaagaccgacgccgtcacggccggggggtgcagaaggggcaaaaacccgcagagggcaacaacaatcaacaaaagcaggagatccagaccgcgcaaaacgaaccggacaaacagagcaaaaccagaaccgacgggcgaggcaaaaccgggcagccgcagaaagaaggagaggaaaaaggaacgcaggaggagcaggcagaaaggacgcaatccagccggataa

SEQ ID NO: 107 - DNA, 510 bp, Enterobacter cloacae
atgctgggtaaacaggttgcgcaatgcgttcctgcgggctcgacgctgtttctggatgccggaagcacactgctggccgttgcctctttccttcaggggccgctgaccatcatcaccccttctcttgatatcgcccaacaggtgagcgatcgggaaggtatcgacctgatcctgctcggtggaaagtgggatcagaaacagcgcctgtttgccggaagcgccaccctttcgctgctctctcgctaccgggcggatattgccattcttggcgcatgcgccatccatgccgaactcggattgagcgccagtcaggaggcggatgccgaagtgaagcgtgccatgctggccgcaagccaggcgcactgggtagtcgccgaccatctaaaactcaatcagtgcgaaccgtatctggtgtcagggttatccgagattcatcaactgtttttagatcgtccctgggcagagctcggggaccatagcgccgtgcaggttaccgtttgcgcacattaa

SEQ ID NO: 108 - DNA, 1143 bp, Enterobacter cloacae
atcgtccctgggcagagctcggggaccatagcgccgtgcaggttaccgtttgcgcacattaacgtggagaaggtcatgaataaagtgaagacaatgaatattgcgctgatcgggtatggttttgtgggtaagacgttccatgccccgctgatccagtccgttgacggcctgaagctggcggtgatctcatcccgggatgaagagaaagtgaaacgcgatctgccggacgtgctcgttgtcgccacgccggaagaggccattcagcacccggatatcgatctggtggttatcgcctcccctaacgcgacccatgcgccgctggccaccctggcgctcaatgccggcaagcatgtggtagtggataagccgttcacgctggatatgcaggaagcgcgggatctgattgcgctggctgaagaaaaacagctgctgctttctgtcttccataaccgccgctgggacagcgattttctcggcattaagcaggtgattgcgcaaggcagcatcggcaaggtgaaacattttgagtcgcatatcgatcgtttccgcccggaggttcgcgtgcgctggagagagcaaaacgttcccggtagcggcctgtggttcgatttaggcccgcacatgattgaccagacgctacagctttttggtctgccgcagtcggtacagggcaacatcgccaccctgcgtgacggcgcggagattaacgactgggcgcacgtggtgctgaattatccggaacacaaagtggtcctccattgcagcatgctggtggcgggcggcgtatcccgctttaccattcacggtaacaaggctagcgtggtgaaagcgcgcatcgatcagcaggaagcccagctgctggcaggcgtcattccgggtagtgaaagctggggtgaagacagcgacgctatggtgctgcttaatgcccagcgtgaagccagcgctatccctgcgccaaaaggcgaccagcgacagtactatataaacgtgcgcgatgccctgaacggcaagattgacaacccggtcccgccggtggaagccctggcggtgatggcggtgctggaatcggcggtaaaatcttcagaaacgggtacaactcacgaactggacttaacggcgcatgatcgcgcgcaactgcaataa

SEQ ID NO: 109 - DNA, 762 bp, Enterobacter cloacae
acagtaaaaccgaaatcgccgaggctattcgcgatttcaactccggccgctttggccaaatctaaacgtaaaaaggagcgcattatgtctacccctgcaaacttcaacggtgcacgtcccgttattgacgtaaacgatgccgttatgctgcttatcgatcaccagagcgggctgttccagaccgttggagacatgccaatgcctgagctgcgcgcccgtgcagcagcgctggcaaaaatcgcctcgctggcgaagatcccggtgatcaccacggcgtcggttccacagggaccgaacggcccgcttatcccggagatccacgccaacgcgccgcacgcacagtatgtggcacgcaagggtgagatcaacgcctgggataacccggagttcgtggcggcggtgaaagccaccgggcgcaaaacgctgattatcgcggggacgatcaccagcgtctgcatggccttcccgtccatcagcgcggtggcggacggatataaagtgtttgcggtgattgatgcctccggcacctacagcaaaatggcgcaggagatcaccctggcgcgcgtggtgcaggcaggcgtggtgccgatggacacggcagccgttgcttccgaaattcagcgcacgtggaaccgtgaagatgcgggtgaatgggcagaggtgtacacacacatcttccctgtctaccagctgctgatcgaaagctacagcaaagcgcaggacgtggtgaaaaatagcgaagtgctcgattcgcagcgttaa

SEQ ID NO: 110 - DNA, 582 bp, Enterobacter cloacae
cgtgcagtggatgacggcgggcccagccattttgcacgaggagttccactccagcgcttttcgcagaaagccggtgaattgaaaatgatgcagctgtggttcaacctgcccgccaaggacaaatggggaacgcctggataccagagcatcactcaggcggatatcccggtggtcaccctgccggataacagcggaacattgcgcgtgattgctggccgctttggagaggtaaccggcccggcgcataccttctcaccgctgaacgtgtgggatctcgcgctgcatcagggtagccacctgacgcttaatcagcccgaaggctggagcacggcgctggttgtcgttgaaggcagcgtgacggtgaacggcaccacgcctgccggtgaggcgcaactggtcgtgctgagccagagcggtgacaaactgcatctcgaagccagcagcgatgccaaagtgctgctgatggccggggagccgctgaatgaacccatcgtgggctatggcccgtttgtgatgaacagtaaaaccgaaatcgccgaggctattcgcgatttcaactccggccgctttggccaaatctaa

SEQ ID NO: 111 - DNA, 372 bp, Enterobacter cloacae
tctgctcgggtctggcgcttcgtagtgaagaggctcggcccagaacagcgcgccgaactggtattaaacgcgctggtggcgatccgtttcctgaaaccgcaaatgccgaaaagctggcatttccttgcgcacggcatgagctggaccccggctatcggcgatgcggcgagcgtcaatctgagcgataccgaagaggaggtgaatttgctggtggttgaacccggtgaaaacgctgcgctctgtttgctggcccaacccggcgtgaacattgccgggcgagttatgcagttaggtgatgccatcaaagtgatgaacgacaggctgaagccacagctgcgcgttgattccttcagcctcgaacaggcggtttaa

SEQ ID NO: 112 - DNA, 972 bp, Enterobacter cloacae
accgcacgtcagttcccgcagatggttcgctttacgccttccccgcttcatgacgggctgcatttgaccgcgccagacggttcaagcgtcgtgatccgctttgctgattttgcgccgcttgatgcgccaacggaagtgtggggcaatcattttaccgcgcgtatcgcgccggataacattaaccagtggctcagcggctttttctcccgtgacgttcagttgcgctgggttgggcctgcgctgacccgtcgcgtgaagcgccacgatgcggttcccctctccttcgcggatggttttccctttctgctgaccagcgaggcctcgctgcgagatttacaaaaacgttgcaaagccagcgtgcagatggagcagtttcgcccgaatctggtggtgaccggagcggaggcctgggatgaagatacctggaaagtcatccgcatcggcagcgttatttttgacgtggtgaaaccgtgcagccgttgtattctcaccaccattagcccggagaaaggccagaagcatccttccggtgaaccgctaaaaacgttgcagtcatttcgcaccgcgcaggataaaggtgatgtcgatttcggccagaacctgatcccccgctccagcggcgtgatccgcgtgggcgacgagatcgagatccttacccgagggcctgccagggtgtatggcgcaggtcaggaagaagagatggttgacgtggtaaccaacgtcgcttccgcggtggatattcactgggaaggcaaagttatccgtggtaacaatcagcaggtgctactggaacaactggaacaggcgggtatccgcgtaccgtattcctgtcgcgcggggatttgcggatgctgtcgcattaaactggtcgatggtgaagtgagtgccctgaagaaatctgcgattggcggtgacggcacgatcctgtgctgtagctgtgtcccgaaaacatccgtacagctggaagcttaa

SEQ ID NO: 113 - DNA, 792 bp, Enterobacter cloacae
  unsure (60)
aacagggggcatcggtattccccggtgttggcgattgtgctgttggtgcgatctttattntatgaaccgttccagatccggtcaggatcgatgatcccaacgctgctgatcggtgatttcattctggttgagaagtttgcctatggcatcaaagatccgatctaccagaaaacgctgatcgaaacgggtcatccgaaacgtggcgacatcgtggtgtttaaatatccggaagatccacggctggattatattaaacgcgcggtaggtctgccgggcgataaagtgacctacgatccggtggcgaaagaggtgaccattcagccaggctgtagctctggaactgcatgtgaaaatgcgctgccagtcacttactccaacgttgagccaagtgattttgtgcagacctttgcccgccgtaacggcggtgaagcgaccagcggattcttccaggtgccaaaaggtgaaaccaaagagaacggtattcgtctggttgaacggaaagagacgctgggcgatgtcactcaccgcattctgaccgtgccaatcgcacaggatcaactggcaatgtactaccagcagccaggccaacagctggcgacctggattgtgccaccgggacactacttcatgatgggtgacaaccgcgataactctgcggacagccgttactggggctttgtgccggaagcgaatctggtcggtaaagcaaccgctatctggatgagttttgagaagcaggaaggcgagtggccgaccggcgttcgcctgaatcgtattggcggaattcattaa

SEQ ID NO: 114 - DNA, 531 bp, Enterobacter cloacae
acaggctgccgccgaacaggcgttaaaaatgctggagctggaatgagcatcgacaaaacctattgcggatttattgccatcgtcggacgtccgaacgttggcaaatccaccctgctgaataatctgcttgggcagaagatttctatcacctcgcgtaaggcgcagaccacgcgtcaccgcatcgtcggtatccatactgaaggcgcgtatcaggcgatttacgtcgataccccgggcctgcacatggaagagaagcgcgccattaaccgtctgatgaacaaggcggcgagcagctccattggcgacttagagctggtgattttcgttgtggaaggcacccgctggacgccggacgacgaaatggtcctgaacaagctgcgcgacggcaaaacgccggtgatcctcgcggtcaataaagtggacaatgtgcaggaaaaagccgatctgctgccgcacctgcaatggctgggcagccatatgaacttcctcgacatcgtctcgctgtctgcggacacgggtctgaacgttgat

SEQ ID NO: 115 - DNA, 801 bp, Enterobacter cloacae
aatattcccccgaagtttaaggttggccctgcaagggtgccacggcacacgaaaccgcgttggttttctcaggtcggtttcgtgtgctgcatttttgacgcattcatttattggtatcgcatgaaccccatcgtaattaatcggcttcaacggaagctgggctacacttttcatcatcaggagttgttgcaacaggcattaacccatcgcagtgccagcagcaaacataatgagcgtctcgagtttttaggcgactctattttaagtttcgtgattgcaaatgcgctttatcatcgttttccgcgtgtggacgaaggtgatatgagccgcatgcgcgccacgctggtgcgcggcaataccctcgctgaaatcgcacgcgagtttgagctgggtgaatgtctgcgtctggggccaggtgagctgaaaagtggtggtttccgtcgtgaatccatccttgccgatacggtcgaggcattgatcggtggcgtgttcctggacagcgatatccagaccgtagaaaagctgatcctgaactggtatcagacccgcctggacgaaatcagcccgggcgataaacaaaaagatcctaaaacgcgtctgcaagaatatttgcagggtcgtcatctgccgctgccatcctatctggtggtgcaggtacgtggcgaagcgcacgatcaggaatttaccatccattgccaggtcagtggcctgagtgaaccggtggtcggcacgggttcaagccgtcgtaaggctgaacaggctgccgccgaacaggcgttaaaaatgctggagctggaatga

SEQ ID NO: 116 - DNA, 1307 bp, Enterobacter cloacae
acaggaaaatatcacatggtagatcaggtcaaagtcgccgccgcagaagaggcgacgtctgaacagtcgctacggcgaaatctcacgaaccgtcacattcagcttattgccattggcggagccatcggcacagggctgtttatgggctcgggcaaaaccatcagtcttgccggcccgtcgatcatcttcgtttatatgatcatcggttttatgctctttttcgtgatgcgtgcaatgggtgaattgctgctctcgaatcttgaatacaaatccttcagcgacttcgcgtcagacctgctcggcccgtgggcgggctattttaccggctggacctactggttctgctgggtggtcaccggcatggctgacgttgtggccatcacggcgtacgcgcaattctggttcccagggctatcggactgggtggcttcgctggcggtgattgtcctgctgctgagcctgaacctcgccaccgttaaaatgttcggtgagatggagttctggttcgcgatgatcaaaatcgtcgccatcatcgcgctgattgtcgtcgggctggtgatggtgctgacgcacttccagtcgccaaccggcgtacaggcgtcgtttgcccatctgtggaatgacggcggctggttcccgaaagggatcagcggcttctttgccggcttccagattgcggtgttcgcgtttgtcgggattgagctggtcggtaccacggcggcggaaaccaaagatccggagaaatccctgccgcgcgcgatcaactccattccgctgcgtatcatcatgttctacgtgttcgcgctgatcgtcattatgtccgtgacgccatggagttcggtggtgccaaccaagagcccgttcgtcgagctgttcgtgctggtgggactgcctgctgccgcgagcctgattaacttcgtggtgctgacctctgcggcctcttccgcgaacagcggcgtcttctccaccagccgtatgctgttcggtctggcgcaggaaggcgttgctccgagcgcgtttgccaaactgtctaaacgcgcggtaccggcgaaagggctgaccttctcctgcatctgtctgctgggcggtgtggtgatgctctacgtcaacccgagcgtaatcggcgcgttcaccatgatcactacggtgtcggcgatcctgttcatgttcgtctggaccattatcctctgctcatacctggtgtaccgcaaacagcgtccacacctgcatgagaagtcgatctacaagatgccgctgggcaagctgatgtgctgggtgtgcatggcgttcttcgtcttcgtgctggt

SEQ ID NO: 117 - DNA, 636 bp, Enterobacter cloacae
gagagggaagacgctgtccttccacctgctggtgaagagctcgaagcgcaggcaagctacggcatcggcttgcaggtaggacagcagctgagcgaatccggcctggaaggtctgttaccggaagcgctggtggcgggtatcgctgacgcgctggaaggcaagcagcccgctgtgccggttgacgttgtgcaccgtgcgctgcgtgaaatccacgaacgtgctgacgccgtacgtcgcgcgcgtttcgaagagatggcggcagaaggcgtgaaatatctggaagagaaccgtgagcgtgaaggcgtgaacagcaccgagtccggcttgcagttccgcgtaatcaatcagggtgatggcgcaatcccggcgcgtaccgaccacgttcgcgtacactacaccggtaagctgatcgacggtaccgtgttcgacagctccgtagcgcgtggcgaaccggctgagttcccggtcaacggcgttatcgcaggctggatcgaagccctgaccctgatgccagtaggttccaaatgggaactgactatcccgcacaacctggcttacggcgagcgtggcgctggcgcgtccattccgccattcagcaccctggtgtttgaagtcgagctgctggaaatcctgtaa

SEQ ID NO: 118 - DNA, 1200 bp, Enterobacter cloacae
gatgaaactcggatttattataggcgctctctttgcaacatggctgacgataaattatccggaccagatgagaagttattttaccaaagccgtcgactatatcgaaagtgttgcaacatttattacatccaagtgagcatgatggtgaaaaaattcaaaaagttacttttagagttcattgtagcagttatgctttcgctttctataccgggtatggctatggcagcagatgctggagtccctggggctatgtgtcagtcagctggagtgtggcagggcttgattaagaatatctgttggagctgcatttttcccatgaggataatgggcataggggcagctccagaaggcgctgctccttcacgtccgggttgctactgcacagatcagaacggcgtaccggaaataggttggcaattgagcttctttcagccggtgaagattgtagaagttgtaaagagcccctggtgcagcccctttcttgaaggcacgatgcttcaaaaatcgcagtttgatattggtaaaagcaacacaaatcagccaatgacagcaactgaagccggattttacgatgttcatctttgggagttcccaatcatgacaatgctcaaattactgattattggcgagtgcactgctgaaccctatatagatgccagcctgacctatataagcgaagtggaccctatgtgggaaagtgatctgcttacactcgtcctgaatccagaggcagtagtttttgcaaacccaattgcctcaatggtgtgcgctgctgactgtgtagcagtaacagcaggaaaggataatctcgctgcatacttttgtgccggatgcgatggcaacctttatccattaaccggccacatgtacgcaaatgatgacgctgtaaggacgagttcactgataacccatcgtcttctgactaaactacatcgccagggaatgctgatgcgaacgatgggagcagacgcaatgtgtgagaaaacgtgggaatactttacacctcgttcccagtatcggctttcaatgcttttcccaactcctgaggcgaaagggccggattgctgtcatcgtcttggtgattcggtacatgactggtcaacccttaaaggtgggcgcaaaaaaataggcaatgataattatgtctatatgttgtggcgttacaatgactgttgcgtcagatatataccaggcgcttga

SEQ ID NO: 119 - DNA, 879 bp, Enterobacter cloacae
caaatatggagcatatacatggcgtggaatcagcccggtaataacggacaagaccgcgacccgtggggaagcagcaataatcaaggcggcaactctgggggaaatggcaacaaaggtggtcgcgagcaggggccgccggatctggatgatatcttccgcaaactgagcaaaaagcttggtggccttggcggaggaaaaggttctggctcgggtggcaattccactcagagtccgcgcccgccaatgggtggccgcgtggtgggcattgtcgccgctgcggtagtaatcatctgggcagccagcgggttctacaccattaaagaagcagaacgcggtgtggtcacccgtttcggtaagttcagccatctggttgaaccgggcctgaactggaagccgaccttcattgatgacgtgaccgcggttaacgtggagtccgttcgcgaactggccgcctctggcgtgatgttgacctctgacgagaacgtggtgcgcgttgagatgaacgtacagtaccgcgtgaccgatccggaacgttatctgtttagcgtgaccagcgccgatgacagcctgcgtcaggcgaccgacagcgccctgcgtggcgtgatcggtaaatacaccatggaccgtatcctgaccgaaggtcgtaccgttattcgtagcgatacccagcgtgagctggaagagaccatccgtccgtacaacatgggtatcaccctgctggacgtcaacttccaggctgcacgtccgccggaagaggtgaaagccgcctttgacgatgcgattgccgcgcgtgaaaacgaacagcagtacatccgtgaagcggaagcgtacaccaaggacgttcgtcttcacctcggaagagcggatccgcgtagagct

SEQ ID NO: 120 - DNA, 333 bp, Enterobacter cloacae
accaaaatggatatgctggaggattttgaaccgcgtattgaccgagacgaagagaacaaaccgattcgggtctggctgtatgctcaggccgggattggtgtgccactgcttttccaggctttgacagaacgtctttccggtgaggtagctcagcacacgctgcgactgccgccacaggaaggcaggctgcgcagccggttttatcagcttcaggcgatagaaaaagagtggatggaggatgacggcagcgtggggatgcaggtgcgtatgccgatcgttgactggcgtcgcctctgtaaacaagaacctgcgctggcggactatatcgtctga

SEQ ID NO: 121 - DNA, 597 bp, Enterobacter cloacae
ggacatcatcaccccgttttagggattgtgataaaatgcccgctctctggtgaaacccaacaggaaagaatcatgatgagcctggccggtaaaaaaatcgttcttggcgtcagcggcggtattgctgcctataaaacgccagacctggtgcgccgtttgcgcgagcgcggggccgacgtacgggtcgcgatcaccgaaggcggcaaagcctttatcaccccactgagcctgcaagccgtctcgggatacccggtatccgacagccttctcgacccggcggccgaagccgcaatgggccacattgagctggggaaatgggccgatctggttatccttgcccccgccacggcagatttaattgcccgcctggcaaccggtatggcgaacgatctggtaacgaccatttgcctcgccacgcctgcgcccgtcgcggttgtgcccgcaatgaaccagcagatgtaccgcaacgccgctacccagcacaatctggacacgctggcctcgcgcggcctgctgatttggggaacggacagcggcagccaagcctgcggggaaattgggggcaggggttttcctcaacccattaacgattgttga

SEQ ID NO: 122 - DNA, 204 bp, Enterobacter cloacae
  unsure (153)
  unsure (155)
tttggggaacggacagcggcagccaagcctgcggggaaattgggggcaggggttttcctcaacccattaacgattgttgatatggccgccgcccatttctcccctgtcaacgatctgcaacatctcaacatcatgaataccgcgggccccccncncaaaccgctgggattccgtgcgttacatcaacaaccaaaggttcgggaa

SEQ ID NO: 123 - DNA, 852 bp, Enterobacter cloacae
ttctttcctgttgggtttcaccagagagcgggcattttatcacaatccctaaaacggggtgatgatgtccttaattcactttgcgaggcgttacgcaagaacgaaatgccagcatcgaaccccgaatttgcctgtggcagcataatggcaaacagaaggaggccaggcatggaagagactgaactgctgctaccgcgtgaaaaaatgctgcgtcatggcgtcacgttgttaaaggacgacgagctgctggcgctctttttacgcacaggcacgccggggaaaacggtatttacgctggcgaaagaactgatagaccatttcggttcactgtatggattgctgaccgctgagctggaggcgtttacgcacgttgagggtattggcgtggcgaaatatgcccagttgcggggcattgccgagctggcccggcgattttacaacgtgcgtatggaggaagaagacccgatcctcacccccgacatgacccgcgaatttttgcaaagccagctatccgatctggagcgggagatctttatggtgatctttctcgacaacaaaaaccgggtactgaaacatacccgccttttttcgggaacattgagccatgttgaggtgcatccgcgtgaaattgtgcgggaagcgataaaagtgaatgcagccggcgtgatcctcgcgcataatcacccctctggctgtgcagaaccaagcagagctgacaaagcaattaccgaacgtattatcaaatgctgtcaattcatggacattcgtgtgctggaccatctgataattggccgcggagagtacatttgtcttcaccacagggggtcgaaggagccgcgctatgcgtgtata

SEQ ID NO: 124 - DNA, 336 bp, Enterobacter cloacae
atgaatatgttgagttttgaaggcaaagagatcgaaaccgataacgacggttatctgaaagagagcagccagtggagcgaagcgctggcggagaaaattgcggataacgaaggaattaccctctccccggaacactgggaagtggtgcgcttcgtgcgagaattttaccttgaattcaacacgtcgccagctatccgcatgctggtcaaagccatggcgaataaatttggcgaagagaaaggcaacagccgttatctgtatcgcctgtttccgaaaggcccggctaaacaggcgacaaaaatcgccggcctgccaaagccggtaaaatgcatttaa

SEQ ID NO: 125 - DNA, 663 bp, Enterobacter cloacae
ctcatggatcgtataattacttcttcacgcgaccgcacatcgctactcagcacccataaggtgctgcgcaatacctatttcatgctcagcctgacgctggcgttttcggcgatcaccgcaacggccagcaccgtactgatgctgccttctccaggcctgatcctgacgctggtgggtatgtacggtctgatgttcctgacctacaaaaccgcggataaaccggtggggattctctccgcgttcgcctttaccggcttcctgggctacattctggggccaatcctgaatgcctatctgtctgccggaatgggcgacgtgattggtatggcgctgggcggtaccgcgctggtgttcttttgctgctcggcctacgtgctgaccacccgtaaggacatgtccttccttggcggtatgctgatggcgggtatcgtgattgtactggtcggtatgctggcgaacatcttcctgcaattgcctgcgctgcatctggcaatcagcgcggtgtttatcctgatttcatccggcgcaatcctgtatgaaaccagcaacatcattcacggaggtgagacgaactatatccgcgccaccgtgagcctgtatgtgtcgctgtacaacatttttgtcagcctgctgagcatcctgggcttcggcagccgcgattaa

SEQ ID NO: 126 - DNA, 282 bp, Enterobacter cloacae
tgtcaaatgtttgcaccattgcctgggtcccatggcgtgggacagggcatcggattccgatacagcacccagcgcgaagcccttcagctcgggctgacggggtatgcgcgtaacatggatgatggcagcgtggaggttgtggcctgcggtgaggcggatcgggttgagaagctggtggcgtggctgaaagcgggcgggccgcgcagcgcgcgggttgataaggtgctaacggaaccgcatcaacccggccgggaatacgctgacttcagtattcgctattaa

SEQ ID NO: 127 - DNA, 1152 bp, Enterobacter cloacae
  unsure (1)
  unsure (16)
  unsure (1109)
  unsure (1113)
  unsure (1151)
naaatattgcgttatntccctaaggccgctaagaattatttccggatcgtcataaaaacagacaataaggcgaaggaaatgaaaccacaaacacgcacgcactttacactctctttgttaaccgcagggatcctgtgcgccagcacggcaacctgggcggctaacgtgccggcaggaacccagctggcagataagcaggaactggtcaggaacaacggcagtgaacccgcctcgctcgacccgcataaagtcgaaagcgatgtcgaattcaatattatcagcgatttattcgacgggctggtcagcgtctctccggcaggtgaaatccagccgcgcctggcggagaaatgggaaaataaagacaacaccgtctggacgttccatctgcgcccgggcattacctggagcgatggaacccccatcaccgcggaagatattgtctggagctggcagcggctggtcgacccgaaaaccgcctctccgtatgccagctatcccggtagtatgcgtatcgtcaacggcactgatatcgcagaaggcaaaaaagcgcccgagtcgctgggggtgaaagccatcaatgacaccacgctggaagtgacgctcacgcaacctaacgccgctttcctggcgatgctggctcacccgtctctggtgccaattgataaagtcctggtaggccgtttcggtgataagtggaccaaaccggagcacttcgtcagcagcggggcctataaactgtcacagtgggtggttaacgaacgcattgtggcggtgcttaacccgaaatattgggataacgaacataccgtcattaacaaggtgacctatctgcccatttcctctgaagctgctgacgttaaccgctacaaagcgggcgaaatcgacattgtctacacggtgccgatcaaccagtttgctcagctgaagaaaacgctggggagcgagctggatgtatcgccgcagcttgccacctattattacgaattcaacaccacccggccgccgttcaacgacgcccgcgtgcgcaaagcgctgaacctggcgctggataaagacattatcgccgataaagttataaggcagggtcagcgcccggcatggctcatcanccanccggatattggcggcgtcaagctccaaaaccccggatna

SEQ ID NO: 128 - DNA, 948 bp, Enterobacter cloacae
aaggtccttcccggcgtatctgctcatatgaagaaaatggctgatgaagcagggggattagaccgtgtttcacagatggctgtaactggtatcggacgtgttaaagcagcgatggagaatgaccttaacaaggctttcaccagctctgagaagggcttcggacagttcaatgcttctgtagctaacatgctcaacgatgcttcaccgattgctgaggctttagggcatatcctcggaaaggttgcctctatgacatctggagcggttgaccatgtagatgagtggagccgcaaactctcagccctgattctacgcacatcagcgtggtatgatgacttatcagatgggcagaaaaagttagtggatagtgctgaacaatttgctatcggggctgctggtgtgttggtgctggttaagtctatcgctggtgtggctaacaagctgaaatggcttagtgctctgttaggtggtggtgctgaagctggtgcggctgctggtgcaggtggattactcaagggtgcatcccgtttagctggccctgttggtgtcgctctggttgctcatgacgctgtagacgcttcaggtgttgaacagaactatccaaacgctgttggtactggaaacccgattgctcaggttcttaactggcttacaaacccgtctaagattcttggggcaactgaacaagactcactgacaaacagtccgtttacaaggatgatgggttcattgggtgactggcttcagggtaacaatgcgctgtccggtcaggctaatacatttgctgtcccgtctatgtataaccctgctcagacaactatccgaaatgaccaaagaatcaatattagcgttaacatggattctcaaaagattggaacattccagacacaggttcttactggtggctttgaagacctgaatattaacgctgaacatttgggcgattaa

SEQ ID NO: 129 - DNA, 555 bp, Enterobacter cloacae
actggacaggatcgtatctatcgtcttgagctcttctgccgtgaaccgacaattttcaagcacgcctgctgcatcatcaatttgtccggtcttgcttgcgccgatgagcacggatgtcaccgcatcgtggcgcaggatccaggccagtgccatttgcgacagcttttgcctccgtttttccgccagcgcattcagcttacgtaccttttccagctttttgtcggtgatctgttccggattaaggaacttactgccgcttgctgcgcgagaatccgccgggatgccgttcagatagcgatcggtcaactgtccgcccgccaggggagagaaggggatacatcccacccctttttgctgcaacacgtccagcaacccctcttcaggcgcacgttcaaacatggagtacttcggctggtggatcaaacatggcgtgcccagatcctccattatttcaatcgcctgccgtgccatttctgccgggtagttggacagaccgatgtacagcgctttgccctgacgcaccacatggtcaagcgctttcatggtttcacgtag

SEQ ID NO: 130 - DNA, 1047 bp, Enterobacter cloacae
tgtaaacgtatacacggatgtttctttccagcgccagaggtctcacaaatgggttatcagcctgacaaaaatcgttatcagacaatgcaatatcgccgctgtgggcaaagcggtcttaagcttcccgccatctcgttggggctgtggcataattttggcgacgcgacgttgctcgaaaacagccgtcaacttttacagcgtgctttcaatttgggtattacgcattttgaccttgccaataattacggcccgcctcctggttcggccgaacgtaattttgggcgcattttgcaggaggatttcctgccctggcgcgatgagctgatcatctccactaaagcgggctacaccatgtgggacgggccttacggtgactggggctcgcgtaaatatctgatcgcaagcctggaccagagcctcaagcgtatggggctggagtatgtcgatatcttctatcaccaccgcccggatccacacacgccgctacgtgaaaccatgaaagcgcttgaccatgtggtgcgtcagggcaaagcgctgtacatcggtctgtccaactacccggcagaaatggcacggcaggcgattgaaataatggaggatctgggcacgccatgtttgatccaccagccgaagtactccatgtttgaacgtgcgcctgaagaggggttgctggacgtgttgcagcaaaaaggggtgggatgtatccccttctctcccctggcgggcggacagttgaccgatcgctatctgaacggcatcccggcggattctcgcgcagcaagcggcagtaagttccttaatccggaacagatcaccgacaaaaagctggaaaaggtacgtaagctgaatgcgctggcggaaaaacggaggcaaaagctgtcgcaaatggcactggcctggatcctgcgccacgatgcggtgacatccgtgctcatcggcgcaagcaagaccggacaaattgatgatgcagcaggcgtgcttgaaaattgtcggttcacggcagaagagctcaagacgatagatacgatcctgtccagttcagattaa

SEQ ID NO: 131 - DNA, 1392 bp, Enterobacter cloacae
ggtaacaagatgcaagtttcagttgaaaccactcaaggccttggccgccgtgtaacgattactatcgctgctgacagcatcgaaactgctgtgaaaagcgagctggtcaacgtagcaaaaaaagtacgtattgacggcttccgcaagggcaaagtaccaatgaatgttgttgctcagcgttatggcgcttccgtgcgtcaggatgtgctgggtgaactgatgagccgcaactttatcgacgcgatcatcaaagaaaaaatcaatccagccggtgcgccgaactacgttccaggcgaatacaagcagggcgaagacttcacctactccgtagagttcgaagtgtacccggaagttgagctgaaaggtctggaatctatcgaagttgaaaaaccgatcgtttccgtgaccgacgaagacgttgacggcatgctggataccctgcgtaagcagcaggcgaactggaaagagaaagaaggcgctgttgacgcagaagaccgcgtaaccatcgacttcaccggttctgtagacggcgaagagttcgaaggcggtaaagcgtctgatttcgtactggcgatgggccagggtcgtatgatcccaggcttcgaagacggtatcaaaggccacaaagccggcgaagagttcaccatcgacgtgaccttccctgaagaataccacgctgaaaacctgaaaggtaaagcagcgaagttcgttatcaacctgaagaaagtggaagagcgcgaactgccagaactgactgaagaattcatcaagcgtttcggcgtggaagacggttctgttgcgggcctgcgtaccgaagtgcgtaaaaacatggagcgcgagctgaacggcgctgtacgtaaccgcgtgaagtctcaggcgattgaaggtctggtgaaagcgaacgacatcgacgttcctgctgccctgatcgacagcgaaatcgacgttctgcgccgtcaggctgcacagcgcttcggtggcaaccagcagcaagcgatggaactgccacgcgagctgttcgaagagcaagcgaaacgtcgcgttgttgttggcctgctgctgggcgaagtgattcgtacccacgagctgaaagctgacgaagagcgtgtgaaaggcctgatcgaagagatggcttctgcatacgaagatccatcagaagtgatcgagttctacggtaagaacaaagagctgatggacaacatgcgcaacgtcgcgttggaagagcaggctgtagaagcggtactggcgaaagcgaaagtcaccgaaaaagagacctctttcaccgaactgatgaaccaccagggcgtaatttcgccccaacggtttaaagttttgaacaaaaaacccgttggccctcccggcgacggggttttttttaatcacaagctttaa

SEQ ID NO: 132 - DNA, 1092 bp, Enterobacter cloacae
ggtctccaccacgctggggatcccggttaccgccgtgcgtattgtcttattgctgacctgtgccattgttaccgcaacgctggtgagcgccaccggcgcagtggggtttgtcgggctggtcattccccatgtgacgcgcatgctatgcgggccgggccatcgtcgctcgatcccgctgacgtttcttatcggcgcccactttatgatcctcgccgatatcgtctcacgcacgctgattgtgcaccaggttctgcccatcggggtggtgactgcgctggtgggcgcccccgtctttgtggcgttgctttatcaaaaccgaaaggagcatccatgaatattactgtggccgggttaaccgtaacccgacaagcgcagacggtgcttaagaatatcgatctcgacctgccatccgggcagattatcggcctgttagggccaaacggctcgggcaagtcgacgctgctgcgctgtctcgccgggctgtttccacgactcagcgaacgcgtggcgcttaatggcacaacgttcggcatgatgccgctgaaaaaacgcgcgcagcacatggcgtttgtcccgcaacatgctgaggtcgacggagaactgaccgttgaggacattgtcagactggggcgtacgccctaccggaaaacattccagagaacctcgcgcgacgatgaggctgcggttgagcaggcgattggcctgatgcagttatgccgcttacgccagcggcgatggcactctttgtctggcggagagcgccagcgaagccagatagcccgcgcgctggcccagcagccgcaggtgctgttgctcgatgaaccgacaaaccacctggacattcagcaccagctggagctgatgcggctcgtttcacagctgccgcttacggtggtggttgcactgcacgatctcaatcttgcagccaattattgccagcgtctgatcctcctgaaggccgggcagatcgccgccacgggcgcgcccgaagcggttctgacgccggcaaacattgaggacacctggtgcgtaaaagctcaggtctgcaaagccgacgccgggatcacgataagctacaacatggtggcatga

SEQ ID NO: 133 - DNA, 558 bp, Enterobacter cloacae
ctggctggcattgcgggcgcccagctcttcaacgccatgaccgcgtacgtcgtcggcacgtccgccaatgccgagcagtcccgtagcgtcatgttctggctgctgggaagtctgagcggcgtgcgctggcctgacgcgctgctggcgctggccgttacgctggcgggtttactggtggtattgctcttttcacgggcgctggacaccttcaccttcggggatgaggtctccaccacgctggggatcccggttaccgccgtgcgtattgtcttattgctgacctgtgccattgttaccgcaacgctggtgagcgccaccggcgcagtggggtttgtcgggctggtcattccccatgtgacgcgcatgctatgcgggccgggccatcgtcgctcgatcccgctgacgtttcttatcggcgcccactttatgatcctcgccgatatcgtctcacgcacgctgattgtgcaccaggttctgcccatcggggtggtgactgcgctggtgggcgcccccgtctttgtggcgttgctttatcaaaaccgaaaggagcatccatga

SEQ ID NO: 134 - DNA, 402 bp, Enterobacter cloacae
  unsure (4)
aagnacctcggcgtggaggcgaagctgcaaaatcaggagtggaaaaccatgcttgataccatgcacacccataactttgacgcggtacgctacgcctggattgccgattacgacgatgcggcaaccttcctgaacaacttccgtaccggggacagccaaaacaccactcagtacagcaatccggactacgatcgggcactggtgaacgcggcgaaatcgaaaacggcggaggagcgcggtaaattctaccagcaggcagaagatctgctgggacgggatgtaccggcgatccctgtttatcattacgtgcgcacgcacctggtgaaaccgtgggtagggggcttcacgccagacaagctcgggtactactacaccaaagatatgtacatcaaaaagcactaa

SEQ ID NO: 135 - DNA, 576 bp, Enterobacter cloacae
  unsure (123)
  unsure (201)
  unsure (212)
  unsure (215)
cttacttacgataaaaataatctaatgattaaactttccaatatcaccaaagtgttccagcaggggaaccgaaccattcaggcgctgaacaacgtcagcctgcatgttcctgctggtcagatntatggcgtcattggcgcatcgggtgcaggtaaaagtacgctgatccgttgtgttaacctgcttgagcgcccaacccangggcagcgtanaanttggcggccaggagctcaccgctctctcagaaaaaagaactcaccaaagcgcgtcgcccagattggcatgattttcctgcactttaacctgctggcctcacgctccgttttcggtaacgttgcgttacccctggagctggatttctcacctttagaagaaatttcgcgtcgcgtctccgaactgctcgatctggttggtctgggtgataaacatgacagctacccggctaatttgtccggcgggctttatctgcgagtatctatcgctcgcgcgctggctaacaacccaaaagtgctgctgtgcgatgaatcctccagcgcattatatccggctaccacgcgctctattctggaactgtaa

SEQ ID NO: 136 - DNA, 483 bp, Enterobacter cloacae
aaagacattaaccgtcgtctgggcctgactatcctccttattacgcatgaaatggatgtagtgaaacgtatctgcgactgtgtagcagtcatcagcaacggtgagctgattgagcaggacacggtgagcgaagtcttctcgcacccgaaaacgccgctggctcagcagttcattcagtccacactgcatcttgatattccggaagattatctggaacgactgaaaacagaagccgttgcagacagcgttccaatgctgcgcatggagtttacgggtcagtccgttgacgcaccgctgctgtccgaaaccgcgcgtcgctttaacgttaataacaacattattagcgcgcagatggattacgccggtggcgtgaagttcggcattatgctgacggaaatgcacggcacacaggaagaaacccaggcggcaattgcctggctgcaagaacatcacgtaaaagtagaggtactgggttatgtctga

SEQ ID NO: 137 - DNA, 614 bp, Enterobacter cloacae
aggtactgggttatgtctgagccgatgatgtggctactggttcgcggcgtttgggaaacgctggcaatgaccttcgtatcgggcttctttggttttgtgattgggctgccggtcggcgtgttgctgtacgtcacgcgcccgggtcaaattattgaaaacgcgaagctgtatcgcacgctctctgcgctggtgaacattttccggtctattccgttcattattctgctggtgtggatgattccgtttactcgcgtgatcgtcgggacgtcgattggtttgcaggcggcaattgtcccgctgacagtaggcgcggcaccgtttatcgcccgtatggtggaaaacgccctgctggaaatcccaacaggcctgattgaagcttcccgcgcgatgggtgcaacaccaatgcagatcgttcgcaaagttctgctgccagaggcgctgcctgggctggtgaacgcagcaaccatcacgcttatcacgctggtcggttattccgcaatgggcggcgccgtaggtgctggcggtttaggccaaattggatatcagtacggctatattggctataacgctaccgtaatgaataccgttctggtattgctggttgtgctggttta

SEQ ID NO: 138 - DNA, 630 bp, Enterobacter cloacae
gcactttattgcgctgcgattcatgagatactagctgaacaagcctttttcaggagcaaaccggtggcaaaatctgtacccgcaatttttctcgatcgtgacggcactattaatgtggatcacggttacgtccatgagattgatgagttcgaatttatcgagggcgtaatagatgccatgcgccagttgaaagagatgggctatgcgctggtggtggtaactaaccagtccggtatcgcccggggtaaatttaccgaagcgcagttcgagacgctgacggaatggatggactggtctctggccgatcgcggcgtcgatcttgatggcatctattattgtccgcatcacccgcagggaagtgtagaggcgtatcgtcagacctgcgattgccgtaagccacacccgggcatgtttatctctgcacaggaattcctgcacattgatatggccgcatcttatatggtgggcgataaactggaagatatgcaggcagcaacggcggcaggtgtaggtaccaaagtattagtgcgtaccggtaaaccggtcaccccagaagcagaaaatgcagccgactgggtgataactagtctggcagaactgccaaaagagattaaaaagcaccaaaaatag

SEQ ID NO: 139 - DNA, 525 bp, Enterobacter cloacae
cgacgctggaaattcagttattaccctttatactgccctatcccattaccgcgcggccattacgggttaaacacatcgatgagtcagactgaaactaccgccccaagcaaattctcccttctaccgggcagcatcacccgtttctttcttctgttgatcgttgtgctgttagtcacaatgggagtgatgatccagagcgccgttaacacctggcttaaagataaaagctatcaaatcgtcgatatcacccatgcggtgcataagcgcattgatacgtggcgctatgcgacctggcaaatctacgacaatatcgctgccgcgcccgccacctcatcaggcgaagggttgcaggaaacgcgccttaagcaggatgtgtattaccttgaaaaaccgcagcgtaagacggaagccctgattttcggctcgcacgacagcgccacgcttgagatttaccaacggatctcctcctatctggacaccctgtggggccccgaaaacgtaaccgtggttccatgtattacctga

SEQ ID NO: 140 - DNA, 429 bp, Enterobacter cloacae
ttgctcataaaggatgagttatttattcaggagataaaaatgaaacaaaccagattggtgctggctggtatactggtattagccccggtattttccgcaatggcggctcctcaggctgcaaccggttgcgaagccaaacgccagaatattgaacaacagatagaacacgccagaacccataataacgatcatcgtgtagcgggcctgcaaaaagcgctttctgaacttaacgctaactgcacggaggaaggattacgtgctgaacgtcaagctgatgttcgcgaaaaagagcgtaaggttgaagagcgacgccaggagttggctgaggcacaggctgacggccgtactgataaaataagtaaaaaggaaagaaaactgaaagacgctcaggctgagcttgatgaagccagaagtgtgttgaataaataa

SEQ ID NO: 141 - DNA, 654 bp, Enterobacter cloacae
agaacccagcctatggctgggtttttgcttttctgtccccgctacgcattgaattttcccttctgtcaggtaatagtgattttttttcctgacaatgaaaatgatatgaccttatctgctttaaaagccgggtcactgctcctgctgatgatcctgttttataccggcctgttcacgagcgatcgcgtcacctggttgatggaggtgacgcccgtcattatcatcatcccacttctgcttgccacacaccggcgataccctttgactccccttctctatactctggttttcttccacgccatcattctgatggttggtggaatgtacacctacgcaaaggttccggttggttttgaggttcaggagatgctcgggcttagccgaaatccgtatgacaagctcggtcacttcttccaggggctggttcccgcactggcagcgcgagaaattctgctgcgcggtgggtatgttcgtggacataagatgacggggtttctggtgtgctgtgttgctctggccattagcgccacctttaactcattgagtggtgggctgctttggcgatgggacagggtgcggatgattttctggggacgcagggcgatccatgggatacccagtctgatatgttttgcgcgctgcttggtgcgttaa

SEQ ID NO: 142 - DNA, 189 bp, Enterobacter cloacae
ctcattgagtggtgggctgctttggcgatgggacagggtgcggatgattttctggggacgcagggcgatccatgggatacccagtctgatatgttttgcgcgctgcttggtgcgttaacgacggtgctgatccttgggcgtttccatcagcggcaattgcgtcgtttgaatgtggatagtgcgctctga

SEQ ID NO: 143 - DNA, 369 bp, Enterobacter cloacae
atgtgtcctccgcggctgttgaaaacttgcggggccgaaatagccatctccatccctgcgcatgtccgcctggtgatggtggcagaagcgccgcctgccctgaacgagcccctgattgaggatgtccttcgcagcctgaaggtgacccacgatcaggtattacagctggcgcccgaaagcgtcgcgatgcttccctctgacagccgctgtaacagctggcgaatcggggcggtggatgagctaccccttgaaggaagccagatcagttctccagcgctggacgaactgaaagccaacccaaaagcgcgtagcgcgctatggcaacaaatttgcgaatatgaacacgatttcttccctcacgacggctga

SEQ ID NO: 144 - DNA, 492 bp, Enterobacter cloacae
aagccaacccaaaagcgcgtagcgcgctatggcaacaaatttgcgaatatgaacacgatttcttccctcacgacggctgacctgaccaccgcgttcgcgattgaaacccgcgcccatgcctttccgtggagcgaaaagacgtttgccagcaatcagggcgaacgctatttaaatctccgcctggacgttgacggtgcgatggctgcgttcgccatcacgcaggtcgttctggacgaggcgacactgtttaatatcgcggtcgatcccgcataccagcgccgcgggctgggcagggaactgcttgagcacctcattcatgagctggaaacccgtgacgttttcaccctgtggctggaggtgcgcgcgtccaatgtcgccgccatcgcgctctatgaaagcttaggcttcaacgaggcgactatccgccgtaactactaccccaccgcagagggacgtgaagacgccattatcatggctctgccgattggataa

SEQ ID NO: 145 - DNA, 351 bp, Enterobacter cloacae
gaagaattgattatgacgttgtctccttatctgcaagaggtggccaaacgccgcacttttgccattatctcgcacccggatgccggtaaaacgaccatcaccgagaaggtgttgctgttcggacaggcgatccagaccgcgggtaccgttaaaggccgtggctccagccagcatgctaaatccgactggatggagatggaaaagcagcgtggtatttcgattaccacctccgtgatgcagttcccgtatcacgactgtctggtgaacctgctggacaccccggggcacgaagacttctccgaagatacctaccgtaccctgacggggccggaggtcttcacttcggattga

SEQ ID NO: 146 - DNA, 786 bp, Enterobacter cloacae
gcttcaacgaggcgactatccgccgtaactactaccccaccgcagagggacgtgaagacgccattatcatggctctgccgattggataacgaaaataaggttgtaacgatgaaatgggactggattttctttgatgccgacgaaacgctgtttacgtttgactcgttcggcggcctacagcggatgtttctcgactatagcgtgacgttcaccgcggaagattttcaggactatcaggcggtgaacaaaccgctgtgggtggattaccagaacggagccatcaccgcgttacagcttcagcatcagcgttttgacgtgtgggctgaacggttaaacgtgagtcctggggtgctgaacgaggccttcctgaatgcgatggcggatatctgcgcgccgctgcccggcgccgtttctttgctggattcgctgaaagggaaggtgaagcttgggatcattaccaacggctttaccgcgcttcagcagattcgccttgaacgcaccggcctgcgcgatcatttcgacgcgctggtgatctccgaagaggtgggcgtaccgaagccggatccgcgtattttcgattatgcgttggcgcaagcgggcaatcctgaccgcgatcgcgtgctgatggtgggggatacggcagaatctgatattctgggaggtatgagatcgggcctgtcgaccgtctggctgaatgcgcatggccgcatgctgccggaaggcatcgagccgacctggaccgttacgtcattgaacgaactggagcagctcctgtgtaaacaatga

SEQ ID NO: 147 - DNA, 696 bp, Enterobacter cloacae
aaacctaacgacaggctcctgaaaaggagtgtttttttcatgtccaggtcgcttttaaccaacgaaaccagtgaacttgatttgctggatcaacgtccatttgatcagaccgacttcgatattctgaaatcctacgaagcggtagtggacgggttagcgatgctcattggttcccactgcgaaatcgtattgcattccctgcaagatcttaagtgttccgctatccgcattgcgaatggtgagcacactggccgtaaaattggttcgccaatcaccgaccttgcattgcgtatgttgcatgacatgaccggcgcggacagcagcgtctcaaaatgctatttcacccgcgccaaaagcggcgtgctgatgaaatcagaaacgatcgcgattcgaaaccgcgaacaccgggtaatcggtttgctgtgcatcaacatgaaccttgatgtgccattctcgcaaatcatgagcaccttcatcccgccagaaacgccggacgtgggctcatcggtgaactttgcttcttcggttgaggatctcgtgacccagacgctggagttcaccattgaagaagtgaatgccgatcgcaacgtatccaacaacgccaagaatcgtcagatcgtcctgaacctctatgagaaagggattttgatatccaagatgccatcaacccagtggcccgatcgcctgaatatctcc

SEQ ID NO: 148 - DNA, 684 bp, Enterobacter cloacae
  unsure (28)
cgaccagaaatccgctacgcactggggngttttctgggtcgttacatggaaaactctctgaaagaacaagagaaactgggcatcaaactggacaaaaaccagctgatcgcaggggtccaggatgcgttcgcagacaagagcaaactgtctgaccaggaaatcgagcagactctgcaagcgtttgaagcgcgcgtgaaaggcgccgctcagaccaagatggaagcagatgctaaagataacgaagcgaaaggcaaagcctaccgcgacaagttcgctaaagagaaaggcgttaaaacgtcttctactggcctgatctataaggttgagaaagaaggtactggcgacgcgcctaaagacagcgacaccgttgtggtgaactacaaaggtacgctgatcgacggtaaagagttcgataactcttatacccgtggtgagcctctctccttccgtctggatggtgtgatcccgggctggaccgaaggcctgaagaacatcaagaaaggcggtaaaatcaagctggtcatcccaccggatctggcttacggcaaaaccggcgttccgggtatcccggctaactccacgctggtatttgatgtagaactgctggacatcaaaccggcgccgaaagcggatgcgaaaacagacgcaccggctgacgacaaagccgcagcagctaagaagtaa

SEQ ID NO: 149 - DNA, 1331 bp, Enterobacter cloacae
  unsure (12)
cctccccgtgtnacctatcgcggtccttcggccccttggtaaagatcgcaaccgctacagaccgtttgaaagctattctgattcatggcgtgaacgtggttacattgactgaccagaagcaatacacctccgaatcactgaacagtccaatggacttgataatgtctatcctgaccgctcaaagagcgcatgaagaaagtcagtcaaagtctaagaggatgcgtgaagtatgggctaaaaaacgaacagaggcagaggaaagcggaaagattatcactaagtcgtgtcctcgttggttaaccgtgaacagtgaccgtacaggctttgaacctatacctgaacacgttgaatcaatccggcttatgttcgaaatgaggctatcagggaaaggctttgcaggtatcgcacaggctctaaacgagtctggaagattgacccttacaggacgctctaaagggtggaatcagtcatctgtacagcagcttttaagtaacaaggctctgataggttacaagataccatcccgtaaagctgtggtgaattacattgagatacccgactatttcccctctgtgattcctcttgaacagtttcaacaggttcagttaatcggtgcagataagcagggacaaagggcagctaatgaccgccctatgaatgttaacctgttcaggggtgtaatgaagtgcgctgaatgtggtgcaactgtgattgttagcggggtggatgataaaagggctggttattattcttgctcattcagacggttaggacgctgtaacacctctaaaccaatgaacaggggaatggttgacgaagcactgataaaggggcttctctattctctggacagactgactcttcagggacaaggtgaaaaccccctcataaagctggaagcaaagagggcagacttaacagaacgctctcagaagctgttagcagcccttgaaatagctgatgatgtcacagccatagccacacgcttaaaagctgtcacagatgagattaaagccattgagacacagattaagacctgtaaagaccttgaacaggttcacactgttcagagtgttcagggtatggatttaaccgtcaaatctcaaagggaagaggttcagttactggttaagaaaaccttcagagaaatcaacttagacggcatcagaaagacggttaacgtttatcttcacaatgggcttacattgcttaatgttccggtaaatcagattgtggatgctggagagtggatagaactgttacccgtcattggtggcgatacagtagacttcaaagacatcagcttcaaagcccctcgttaccttgattaa

SEQ ID NO: 150 - DNA, 669 bp, Enterobacter cloacae
gggtcgaccatgtatcaacatcataactggcaaggtgcattactggattatcccgtcagcaaagtggtctgcgtgggcagcaactatgcaaaacatattcaggagatgggcagcgccgtgccggaagagccggttctgtttattaagccagaaaccgcactgtgcgatattcgccagccgctggttctgccgcagggactgggctcggtgcatcatgaagtggagctggcggtgctgatcggcgcgacgctgcgccaggcgaccgaagagcatgtagagaaagcgattgcgggttacggtgtcgcgcttgacctgacgctgcgtgatgttcagggcaaaatgaagaaagcggggcagccgtgggaaaaagcgaagggttttgataattcatgcccgatttccggtttcattccggtgagtgaatttaccgacgatccgcagaacacgccgctcagcctgaaggtcaacggcgagatccgccagcagggaacgaccgctgacatgatccataagatcgttccgctgattgcctacatgagccgcttcttcaccctgaaacctggcgacgtgatcctcaccggcactccggaaggtgtggggccgctgcttagcggcgacgaactggatgtcagttttaacggcctgtcgctgaaaacccgcgtgctgtaa

SEQ ID NO: 151 - DNA, 402 bp, Enterobacter cloacae
catcctggccttactcaatttgctattaaccgcaacacatcgccgcgatattccgaagagtatcaggcatgttatagtcaggagtatattgaggcaagcaaccacccgttaattcagagtaaaaacatgttttgtgtgatctacagaagtaccagccgcgaccagacctacctttatgtcgaaaagaaagacgatttttcccgcgtgcctgaagaattaatgaaaagctttggccgaccgcagctggcgatgctgctgccgctggacggccgtaagaagctggtgaacgccgatctggagaaagtcaaaaaggcgttaaccgagcagggctattatttacagcttccgccgccaccggagaatttattaaaacagcatcttgaggtgagcggaaagaaataa

SEQ ID NO: 152 - DNA, 726 bp, Enterobacter cloacae
  unsure (681)
  unsure (717)
caaggaatttctatggcacgcattattgttgtgacttcgggtaaaggaggcgttggcaagaccacctccagcgcggccatcgctactggtttggcccagaagggaaagaaaaccgtcgtaatcgacttcgatatcggtctgcgtaacctggacctgatcatgggttgcgagcgtcgcgtggtgtatgacttcgtgaacgtcattcagggcgatgccacccttaaccaggcgctgattaaagataagcgtaccgagaacctctacattcttccggcgtcccagacccgtgataaagacgccctgacccgcgaaggcgtggaaaaggtgctcgacgatctgaaaaagatggagttcgactttgtggtctgcgactccccggccggtatcgaaaccggcgcgctgatggcgctctacttcgcggatgaagccatcatcaccaccaacccggaggtctcgtcagtacgtgattccgaccgtattctcggcattctggcctcgaaatcccgtcgcgcggaaaatggccaggagccaatcaaagagcacctgctgctgacccgctacaacccgggccgggtgaacaaaggtgacatgctgagcatggaagacgtgctggagatcctgcgcatcaaactggttggcgtgatcccggaagatcagtccgtgttgcgcgcctctaaccanggcgagcccctgatcctggatacacaggcagaagcnggtaaagcg

SEQ ID NO: 153 - DNA, 807 bp, Enterobacter cloacae
cgggtggttgcttgcctcaatatactcctgactataacatgcctgatactcttcggaatatcgcggcgatgtgttgcggttaatagcaaattgagtaaggccaggatgtcaaatacgcccatcgagcttaaaggcagtagcttcaccttatcagtggttcatttgcatgatgcaaaacccgaggttattcgtcaggcgttagaagacaaaatcgcgcaggctcccgcttttcttaagcatgctcctgtcgtcgtcaatgtaagcgaccttgaggggccggttaactggaagcggctccagcaggccgtcacctccacggggttgcgcatcgtgggcattagcggctgcaaagacgcagagttaaaagccgaaattgaacgcgcgggtttgcccttgttaaacgagggcaaagaaaaagccccacgtgcaacgcctgcaaccgttcccgctcccccgcctccggcgcaaaatgtagccccagtcacaaaaacgcgattgattgatctgccggttcgttccggtcagcgcatttatgcgccaaactgtgatctgattgttacaagccacgtcagtgcgggcgctgaactgattgcagatggcaatattcacgtttacggtatgatgcgtggacgtgcgcttgcgggcgccagcggcgatcgagaagcacaaattttttgtactcacctgacggcagaactggtgtctatcgcaggtgaatattggctgagcgataaaatcccagccgaattttatggcaaagcggcccgtctgcaactggcagataacgctttgaccgttcaaccgtga

SEQ ID NO: 154 - DNA, 1848 bp, Enterobacter cloacae
ttcgtgcaattaataaacctattatccatccggtcaataagacgatggttaaatagatcacacggattaatgaatagaaaaatttacaataatgtaaaaatatttatgattgtcctggcgttaagcctgattacgatccccttttcccgttatatctccccgcgcgctatcgtcaacgaaaatgatgtttatttagcgtggttgcccttaagcgccatgctcgccatcgtattgttatttggacgtcgggcaatcattcctttactgattggatttagtgttactaacatttattactttgatttagcattactacaatcttccgtgttattaatttgtcagacgtttgccgtcttcgctgcctgtggcgtcatccgtctgatgctgggcaaacgctggcgacacagcatcccgaataagtacatcgggatacgtattttctggctcggatttgtggttcctgtaggcatcaaattatcgatgtatctggcgggatatttatttgattttccggtgacaatctcctcctatttcggcgaaggctctgcaatttataacgttatcgatattcaaagcctgatttgtgccgccctgattttcaccatgatgttctactacccgttaagaatgataattaatccccggtatgcccgaacattctggcggcgaagcgtgaagcccctcttttgtcacaaaaaagtgttatttatcgttgtgtggctgatgctgttggtctcgatgatcgctattttgtgcgcgcctttcgagtcacagtttattgctggttatttgatgccaatcgtttttattctttttaccctggggattggtcgtctgagctatgcgctcatctctttactctgggcggcctcggcgctcatgctgttgacctacaattataattttcttaatggcgttgaatcgggccactcgctctcctttatcttgtcggtactgatctctttcgccatctgcctgctttacatgtcgcggatctatcagaaaagtgaatggctgaaacaggggtggcaggagagggcgcttaccgatccgctcaccggtctgcctaacattcgtgcgctggaagtgtttttacagcaccatcccgaagccaaaatctgctgcctgcgcctggataatctggaatttctgagccgtcattacggcatcctcatgcgtgtacactgtaaaaagatgatcaccgcgtcgctgcaaccgttattgcaaaaagacgagaagctctttcagttgccaggcagtgagctggtggtggtcttgttggggccgggcacggctgaacgtctgcaatatatggttgatcatctgaacagccgtaagattgtctggaacaagactgagctcgacattgagtttggcgcctcctggggcgaagtaccggatggggaaagcctgcaccacacgctgggtcagctgagctggctgtccgagcaatcctgtggcgggcataacgttctggcgttaaccaacagtctggatgatgtctctggtcagacgacggacagggtgctaatgctggcccgcataaaacgcgcccttgatatcggcggtcttcacctttacgcccagccaattcacacagcccgcggggaaaggtacttcgacatcccctccacgctggaaagcgatggcgagattctccaccccgaccggcttattccgccgatggctcaattcaacctgaacccccggtttgactcgaacttttggaacaaatgtggatgtcgattcgccaccacccctctcgaactgatcgaaagccctccccgtcaaactgatgccctgaacctcaagcaacataaaatgggggcgaaattcttcgccttttga

SEQ ID NO: 155 - DNA, 1506 bp, Enterobacter cloacae
cgcgccggctttgttgaaaacgtagcggcaacagcacaaacggtggagcaactgcttaaactgggttttaccgtcgcgattgaaagcggcgcgggcacactggcgagtttcgatgacgaggcctttactcaggctggcgcggacgtcgtggacggtgctgaggtctggcaatcacccatcattctgaaggtaaacgcaccggaagagggtgaaattgaactgctgaacgcgggcactacgctggtgagctttgtctggccagcccaaaacccggagttgatggagaagctggcggcacgcggtgtcaccgtgatggcgatggactccgtgccgcgtatttcgcgcgcgcagtctctggatgcgctgagctccatggcgaacattgccggctatcgcgccattgtcgaagctgcgcatgagtttggtcgcttctttaccggtcagattacggcggcaggtaaagttccacccgcgaaggtgatggtgattggtgccggtgtggcaggtcttgctgctatcggggccgcaaacagcctgggcgctattgttcgcgcgtttgatacccggccggaagtgaaggagcaggtgcagagtatgggcgccgaattccttgagctggacttcaaggaagaagcgggcagcggtgatggttacgcgaaggtcatgtctgaagcctttatcaaggcggaaatggcgctctttgcggcgcaggcaaaagaggtagacatcattgtcaccaccgcgcttattccgggtaaaccggcgccgaagctgatcacccgtgagatggtggattccatgcagccgggcagcgttatagtcgatctggcggcgcaaaacggcggtaactgtgagtataccgtgccaaatcaggtcacgacgaccgcgaacggcgtgaaggtgatcggttataccgacctgccagggcgtctgccaacccagtcctctcagctgtacggcacgaacctcgttaacctgctgaagctgctctgcaaagagaaagacggcaacattaccgttgattttgatgatgtggtggtgcgtggcgttaccgtggtgcgtgaaggggaaatcacctggcctgcaccgccgattcaggtttccgctcaacctcaggctgcgccgaaagcggcaccagagcccgcggagccagcaaaacctgcgtcgccgtggcgcaaatacgccatcatggcgctggtcataatcctgtttggctggctggcggacgtcgcgccaaaagagttccttggccacttcaccgtcttcgcgctctcctgcgtggtgggttactacgtcgtgtggaacgtttcccatgcgctgcataccccgctgatgtcggtcaccaatgccatctccgggattatcgtggtcggggcattgctgcaaattggtcatggcggctggatcagcttcctgagcttcattgcggtgctgatcgccagtatcaatattttcggtggtttcaccgtgactcagcgcatgctgaaaatgtttcgtaaaggctaa

SEQ ID NO: 156 - DNA, 579 bp, Enterobacter cloacae
  unsure (39)
  unsure (172)
  unsure (195)
  unsure (247)
cagcgaggaaatttaatttggacatggtatggggcaagnatttttcatacccccgtgaatgaggttgcgcacggtaaatgggcgctgctgacttcgggttccaaaagctttcacattccggcgctgacgggcgcctgggggcttttcgccgatgacgccagccgtaacgccnatctgaatgcattaaaaggtcgngacggactctcttccctttccgtgctggcgctgaccgcgcatattgctgctnaccgacagggcgaaccctggctggacgcgctgcggacctatctcgaagagaatctgcggtatgttgctcgcgaattaaacagtgcttttccggcactcagctggcaaccacctgaggctacctatcttgcctggatcgacctcagcccgctcggtattgacgacaatacgctgcaaaaggtgcttattgagcagcaaaaagtggccatcatgccgggatatacctatggagccgaagggaaaggctacgttcgtctgaacgcgggttgcccccgtagtaagcttgaacagggcgttcagcgcctcatcgcgggcatcaacacgctgctgtaa

SEQ ID NO: 157 - DNA, 1011 bp, Enterobacter cloacae
ccagcaaagagtgcgaccatgattgatacacgcctgcctttaactgatattcaccgccacctcgacggaaacattcgtgcccaaaccattctcgatcttggtcgccagttcaatttaaccctccctgccgaaacgcttgaaaccctgatccctcatgttcaggtcacgtcgaacgaaccggatctggtgagctttctgagcaagctcgactggggcgtgaagatgctggcctcggtcgatgcctgtcgccgtgtcgcctttgaaaacatcgaagatgccgcgcgcaacggcctgcactatgtcgaactgcgtttctccccgggctatatggcgatgacccacaatctccccgtagcgggcgtggttgaagcggtcattgaaggcgtgcgtgaaggctgcaaaacctttgacgttcaggcgcgtttgatcggcattatgagccgtaccttcggtgaagcggcctgtcttcaggagctggaagcattactggcgcatcgcgaccagatcaccgccatcgacctggccggtgacgagctgggcttcccgggcagcctgttcctgtctcatttcaaccgcgcacgtgatgcaggatggcatattaccgttcatgcaggcgaagccgcggggccggaaagcatctggcaggccattcgtgaactgggtgcggaacgtattggtcacggcgtgaaagccattgaagatcgcgcgctgatggatttcctcgccgaacaacgtattggaatcgaatcctgcctgacctccaatattcagaccagtacagtggcatcgctggcgcaacacccgctgaaaaccttccttgaacacggggtgctggcttcactgaacacggacgatccggcggttcagggcgtggatattattcacgaatacaacatcgccgcgccgcaggccgggctgagccgcgagcagatccgtcaggcgcaaatcaacgggctggagatcgccttcctgatcttcaccacgcgggccgaaagatccacgctatgcgtt

SEQ ID NO: 158 - DNA, 399 bp, Enterobacter cloacae
  unsure (376)
cgcgatcaacgggcaggaaacattcccctttcgtgcatggcaggcgcacacgagttcagacagcacggtttccatgcgcgccaagtcggccatcttctcgcgcacgtccttgagcttgtgttcggccaggctgctggcctcctcgcagtgggtgccatcgtcgagccgcaacagctcggcaatctcgtccagactgaaccccagccgctgtgccgatttcacgaatttcacccgaaccacgtccgcctccccatagcggcggatgctgccgtaaggcttgtccggttcccgcaacaggcccttgcgctgatagaagcggattgtctccacgttgaccccggccgccttggcaaaaacgccaatggtcaggttttcnaaattattttccatatcgcttga

SEQ ID NO: 159 - DNA, 297 bp, Enterobacter cloacae
ggcatagctgaccttgccaggcctgcttcgccctgtagtgacgcgatcaacgggcaggaaacattcccctttcgtgcatggcaggcgcacacgagttcagacagcacggtttccatgcgcgccaagtcggccatcttctcgcgcacgtccttgagcttgtgttcggccaggctgctggcctcctcgcagtgggtgccatcgtcgagccgcaacagctcggcaatctcgtccagactgaaccccagccgctgtgccgatttcacgaatttcacccgaaccacgtccgcctccccatag

SEQ ID NO: 160 - DNA, 339 bp, Enterobacter cloacae
  unsure (41)
  unsure (214)
  unsure (217)
  unsure (218)
  unsure (219)
  unsure (220)
  unsure (221)
  unsure (222)
  unsure (223)
  unsure (224)
  unsure (225)
  unsure (226)
  unsure (227)
  unsure (228)
  unsure (229)
  unsure (230)
  unsure (231)
  unsure (232)
  unsure (233)
  unsure (234)
  unsure (235)
  unsure (236)
  unsure (237)
  unsure (238)
  unsure (239)
  unsure (240)
  unsure (241)
  unsure (242)
  unsure (243)
  unsure (244)
  unsure (245)
  unsure (246)
  unsure (247)
  unsure (248)
  unsure (249)
  unsure (250)
  unsure (251)
  unsure (252)
  unsure (253)
  unsure (254)
ccccggccgccttggcaaaaacgccaatggtcaggttttcnaaattattttccatatcgcttgactccgtacatgagtacggaagtaaggttacgctatccaatccaaattcaaaagggccaacgtatgtctgaaccaacaaaacggcgcggtgcgctcttcgcccgcgggctggccggcattcttgcatcgacctgctgcctgggggcgctantannnnnnnnnnnnnnnnnnnnnnnnnnnnnnnnnnnnnnacaacgttttctgcctctgaagcctccttttattggtctcaaaatgttctttgggtcacaatttctgccagcggtgaaggaataa

SEQ ID NO: 161 - DNA, 663 bp, Enterobacter cloacae
  unsure (30)
  unsure (31)
  unsure (32)
  unsure (33)
  unsure (34)
  unsure (35)
  unsure (36)
  unsure (37)
  unsure (38)
  unsure (39)
  unsure (40)
  unsure (41)
  unsure (42)
  unsure (43)
  unsure (44)
  unsure (45)
  unsure (46)
  unsure (47)
  unsure (48)
  unsure (49)
  unsure (50)
  unsure (51)
  unsure (52)
  unsure (53)
  unsure (54)
  unsure (55)
  unsure (56)
  unsure (57)
  unsure (58)
  unsure (59)
  unsure (60)
  unsure (61)
  unsure (62)
  unsure (63)
  unsure (64)
  unsure (65)
  unsure (66)
  unsure (67)
  unsure (70)
  unsure (243)
aaggaggcttcagaggcagaaaacgttgtnnnnnnnnnnnnnnnnnnnnnnnnnnnnnnnnnnnnnntantagcgcccccaggcagcaggtcgatgcaagaatgccggccagcccgcgggcgaagagcgcaccgcgccgttttgttggttcagacatacgttggcccttttgaatttggattggatagcgtaaccttacttccgtactcatgtacggagtcaagcgatatggaaaataatttngaaaacctgaccattggcgtttttgccaaggcggccggggtcaacgtggagacaatccgcttctatcagcgcaagggcctgttgcgggaaccggacaagccttacggcagcatccgccgctatggggaggcggacgtggttcgggtgaaattcgtgaaatcggcacagcggctggggttcagtctggacgagattgccgagctgttgcggctcgacgatggcacccactgcgaggaggccagcagcctggccgaacacaagctcaaggacgtgcgcgagaagatggccgacttggcgcgcatggaaaccgtgctgtctgaactcgtgtgcgcctgccatgcacgaaaggggaatgtttcctgcccgttgatcgcgtcactacagggcgaagcaggcctggcaaggtcagctatgccttag

SEQ ID NO: 162 - DNA, 960 bp, Enterobacter cloacae
cgtaagcttgctcccgcgctgatcaccggcaacaccatcgttatcaaaccgagcgaatttaccccaaacaacgccattgcgtttgccaaaatcgtcgatgagattggcctgccgaaaggcgtctttaacctggtgctgggccggggtgaaaccgtcggacaggagctggccgggaatccgaaagtggcgatggtcagcatgaccggcagcgtcggggcaggtgaaaagatcatggctgcggctgcgaaaaacatcaccaaagtggggctggagctgggcggtaaagccccggccatcgtgatgggcgatgccgatcttgagctggccgtgaaggccattgtggattcacgcgtcatcaataccgggcaggtgtgtaactgcgcggaacgtgtctatgtccagaaggggatctacgaccgctttgtgaatcgtctgggcgaggcaatgaaagccgtccagtttggcaatccggctgagcgaacggatattgccatggggccgctgatcaacgccgccgcgctggagcgcgtggagcagaaggtggcgcgcgcggtgcaggagggggccaaagtggtccttggcggtaaagcggcagaaggtaaagggtatttttatcccccaacgctgctgttggacgtgcgtcaggatatggccatcatgcacgaagagacctttggcccggtgctgccggtggtggctttcgacaccctggaagaggccctgaacatggccaacgacagcgactacggtttaacctcgtctgtttatacgcaggacctgaacgtcgccatgaaagccattaaggggcttaagttcggcgagacctacattaaccgtgaaaactttgaagcgatgcagggcttccatgcgggctggcggaaatccggaatcggcggggcagatggtaaacacggtctgaatgagtatttgcagacgcaggtggtctatttacagtcgtaa

SEQ ID NO: 163 - DNA, 444 bp, Enterobacter cloacae
tcaggagccccctccatgcgagggggttcacattttcaggaaaggtggttatgttggcgcgataatggttatttatcgggaaacaacatgcgcacaaaatatacgggtctgcaaatcagcattcactggctggtttttctgttagttattatggcctattgcgccatggagttcatgggatggttcccgcgaagcgatcgtccgctcattaatatgatccacgtttcctgcgggatcagcatcctggtgctgatggtggcgcgcctgcttatccgcctcaaattcccggctccgcctattcaaccgaaaccaaaagcgatgatcaccgggctgtcccatctggggcatctggttatctacctgctgttcattgccctgccgctgatctgcatggtgatgatgtataaccggggaaatgactggtttgcgttttggcctgactaa

SEQ ID NO: 164 - DNA, 204 bp, Enterobacter cloacae
tgtataaccggggaaatgactggtttgcgttttggcctgactaatccgcatgccgctgaagggaattttgacctggtggataccctaaaaacgtggcacgtgaacctggcgattctgggaaattcccttattggtttgcacccccttgccccgctgaatcctccctatttccttgaaaagacaacacccctgctgccccattaa

SEQ ID NO: 165 - DNA, 345 bp, Enterobacter cloacae
atccacaatggccttcacggccagctcaagatcggcatcgcccatcacgatggccggggctttaccgcccagctccagccccactttggtgatgtttttcgcagccgcagccatgatcttttcacctgccccgacgctgccggtcatgctgaccatcgccactttcggattcccggccagctcctgtccgacggtttcaccccggcccagcaccaggttaaagacgcctttcggcaggccaatctcatcgacgattttggcaaacgcaatggcgttgtttggggtaaattcgctcggtttgataacgatggtgttgccggtgatcagcgcgggagcaagcttacg

SEQ ID NO: 166 - DNA, 390 bp, Enterobacter cloacae
acacgttccgcgcagttacacacctgcccggtattgatgacgcgtgaatccacaatggccttcacggccagctcaagatcggcatcgcccatcacgatggccggggctttaccgcccagctccagccccactttggtgatgtttttcgcagccgcagccatgatcttttcacctgccccgacgctgccggtcatgctgaccatcgccactttcggattcccggccagctcctgtccgacggtttcaccccggcccagcaccaggttaaagacgcctttcggcaggccaatctcatcgacgattttggcaaacgcaatggcgttgtttggggtaaattcgctcggtttgataacgatggtgttgccggtgatcagcgcgggagcaagctta

SEQ ID NO: 167 - DNA, 735 bp, Enterobacter cloacae
tgtcgaactgactcacctggccattcgccatggtttgtgcaatgcggagtcgttaataagtcagtgagtgaagcgttcgattcaaaagcatttctgaaaaccgtcaccagccagccgggcgtctaccgaatgtacgacgctggcggtacggttatctatgtcggtaaggcaaaagatctgaaaaaacgcctttccagctatttccgcagcaaccttgcctcccgtaaaaccgaagcgctggtcgcacttatacacaacattgatgtcaccgtgacgcacacggaaacggaagcgctgctgcttgagcacaactatatcaagctgtatcagccgcgctacaacgtcctgctgcgcgatgataagtcctacccgtttatcttcctgagcggtgatacccatcctcgcctggcgatgcatcgtggcgctaagcatgcgaagggtgaatactttggccctttcccgaacggttatgccgtacgcgaaacgctggcgctgttgcaaaaaatcttccccgttcgccagtgtgaaaacagcgtctaccgcaaccgttcccggccgtgcctgcaatatcagattggccgctgcctggggccgtgcgttgaagggctggtaagcgaagaagagtacgcgcagcaggtggaatatgtccgcctgtttttagccgggaaagacgatcaggtgctgacgcaactgattactcgtatggaaaaagccagcgcggcgctgggaatttga

SEQ ID NO: 168 - DNA, 240 bp, Enterobacter cloacae
caacagacagttaccgtcatcatgcgatttaatatccctacgttgctcactctctttcgcgttgtgctcattccgttcttcgtcctggcattttacctgccggtcgtctgggcgccttttgcctgtgcgcttattttcctgatcgctgccgtgacggactggtttgacggttatctggcgcgtcgctggaaccagagcacccgctttggcgccttcgtcttgccgcacaggcctggctga

SEQ ID NO: 169 - DNA, 1203 bp, Enterobacter cloacae
ttactcgtatggaaaaagccagcgcggcgctgggaatttgaagaggccgcacgcatccgcgaccagatccaggcggtgcgcagggtgaccgagaagcagtttgtttctaatacgggcgacgacctcgatgttatcggcgtagcctttgacgccggtctggcctgtgttcacgtgctgtttattcgtcagggcaaagtgctcggcagccgcagctacttcccgaaagtgccgggcggcactgagctgggtgaagtggtggagacttttgtcggccagttttatttgcagggcagccagatgcgtacgctgccctcggagatccttctggacttcacgctcgacgataaaaccctgctggcagattcgctttcagagctggcaggccgccgggtgaatgtccagacgaaaccgcggggcgatcgcgcgcgttatctgaagctggcgcgaaccaatgccgccacggcgctgaccaccaaactgtcccagcagtcgaccgtcagtcagcgtttaaccgcccttgctacgctgctcaagctgccggaagtgaaacgcatggaatgcttcgacatcagccatacgatgggtgagcagaccgtggcgtcgtgtgtggtctttgatgcgaatggccccctgcgggcagagtatcgtcgctataacatcaccggcattacgcccggtgacgattatgccgccatgaaccaggtgctgcgccgtcgctatggtaaagcgattgaagagagcaaaatcccggacgttatccttatcgacggcgggaaagggcagttggggcaggcgaaggcggtattcgaatcgctcgacgtagagtgggacaagaaccatccgctgctgctaggggtagcgaagggggcagatcgtaaggctggcctggaaacgctgttctttgagccggaaggcgagggctttagcctgccgccggattcccctgcgctgcacgtgatccagcatattcgcgatgagtcgcacgatcatgccatcagcgggcaccgtaaaaaacgggcgaaagtgaaaaataccagtacccttgagacgattgaaggcgtcgggccaaaacgtcgccagatgctgttgaagtatatgggcggattgcaaggattactcaacgccagtatggaagaaattgcaaaagtgccgggtatttcgcaagggctggcagaaaagatctactactcgttgaaacattga

SEQ ID NO: 170 - DNA, 522 bp, Enterobacter cloacae
caaagactctgttatcaacgtgaaacagttcggcggcggcaacggcgcggcggtagaccagacagcgtccggctcaacggtgactgtgcaccaggttggctttggcaacaacgcgaccgcacaccagtactgattcatttctgtaccaaaaaacagggcatgcgccctgttttttttcgggaggatctcatgagcaccttcattctccttgccgcgcttgccagccagataacgttcagcacctcacagcaggcaaatatgacaaccattattcctcaggtcacgctggcagacgcctgcgaatgtcaggttgaggtgttatctgtccgacaggggcaggggggacaaagtacatcgcggcagaaaaatactctttttatacccgctaatcagccgattgatttaacgcgaatcagtttaaatattcgctcaggggatgcggtaaaaataatcgtcaccgtttccgatggaaaatcgcttcatttatcacagcagtggaacgcaccggtaagtgcgctttaa

SEQ ID NO: 171 - DNA, 561 bp, Enterobacter cloacae
acatgtttcggcagacatactcttttccgtaacgcggcgttaacaaaacgaatcgcgttaacggagcaagagatacttttttatagccaggtccagggtgacagcatgaaaaacaaaacgttgtttatgatgtttacattactgggtgcgcctgggtttgtaatcgcaggtgattcagatttagccagttctgaatataattttgcgataaatgaattaagtaaagcttcatacaatcaggcagccattattggtcaacagggttcaggaaataattctgatgtacgccaggacggttctaaattgctgtccgttatttctcaggagggcgggaataaccgcgcgaatgttgatcagtcagggacgtataaccttgcttatatcgatcagaccggcaacggcaacgatgcgagtattaagcagggcgcttttggcaacaccgccatgattatccagaaaggctcgggtaacagggcgaatataacgcagtatggtacgcagaaaacagcagttgtagtacagagacagtcgcaaatggctattcgcgttattcaacgttag

SEQ ID NO: 172 - DNA, 477 bp, Enterobacter cloacae
tcaatccgatgggggtttaccatgaaacttttcaaagtggcagttattgcagcaatcgtagtttctggcagtgctttcgcaggtgcggtaccacaatttggcggcggccacggtggtggctggggtggcggcaataacggccctgactcaaccctgagcatttaccagtacggcggcggtaactccgcgcttgctttgcagacggacgcccgagattctgaattgaccattacccagcatggtggtggtaacggcgcagatgttggccagggctctgatgacagttctatcgatctgctgcaaaaaggctttggtaacagcgccaccatcgaccaatggaatagcaaagactctgttatcaacgtgaaacagttcggcggcggcaacggcgcggcggtagaccagacagcgtccggctcaacggtgactgtgcaccaggttggctttggcaacaacgcgaccgcacaccagtactga

SEQ ID NO: 173 - DNA, 891 bp, Enterobacter cloacae
aagaatattatgatgcgaatcgcgctcttcctgctcaccaacctggcggtgatggtggtattcgggctggtgctaagcctgacgggaattcagtcgagcagcgttcagggtctgttgattatggcgctgctgtttggtttcggtggctctttcatttcactgctaatgtcgaagtggatggcactgaaatccgtgggcggtgaagttattgagcaaccgcgtaacgatatggagcagtggctgatgagcacggttgctcagcagtcaaagcaggcaggcattgccatgccgcaggtagccatctaccacgcgccggatatcaacgcgtttgctaccggtgcgcgtcgtgacgcgtccctggtggccgtcagcaccggtctgctgcaaaacatgagccgtgacgaagcggaagcggttattgctcacgagatcagccacatcgctaatggcgatatggtcaccatgaccctgatccagggcgtggtgaacaccttcgttatctttatttcccgtattctggcgcagattgctgccgggtttatgggtggcaaccgtgatgagggtgaagagagcaacggcaacccgctgatctattttgctgtttcaatggtgctggagctggtgttcggtatcctggcaagcattattaccatgtggttctcccgtcatcgtgagttccatgcggatgccggttccgcgaaactggtgggtcgtgaaaagatgattgctgcgctgcaacgtcttaaaaccagctacgagccgcaggaagcaaacagcatgatggccttctgcatcaacggcaagtcaaagtcgctgagcgagctgtttatgtctcacccgccgctggataaacgtattgaagcgctgcgtagcggcgaatatctgaagtaa

SEQ ID NO: 174 - DNA, 1608 bp, Enterobacter cloacae
ttggaccgcagcaaagctccatggccgaaagacgaggctgaactgaatgtgctgtgggatggaaaagtcaaatatgacgaactgagcctcaagctcacaggcaaagacgagaaagagatccgtgagacgttaaaccgacgctacaagttcgatattcgccgtctggcgcagaccaacagtgaagatgttttctcgctggcgatgaccgcgtttgcgcacgaaattgatccgcacactaattatctctctccacgtaacaccgaacagttcaataccgaaatgagcctgtctctggaaggtatcggtgctgtgcttcagatggacgatgactacactgtaatcaactccatggtggccggtggccctgcatcgaaaagcaaagcgatcagcgtaggcgaccgtattgtcggtgtgggccaaaccggaaagagcatggtggacgtgattggctggcgtcttgatgacgtagttgcgctgatcaaagggccgaagggcagcaaagttcgccttgagatcctgccagccggtaaggggaccaaaacccgtatcgttactctgacccgtgagcgtatccgtctggaagatcgcgcggtgaaaatgtcggtgaaaaccgtgggtaaagagaaggttggcgttctggatatcccaggtttctacgtcggcctgaccgatgatgtgaaagtgcagcttcagaagcttgaaaagcagaatgtcagcagcgtgatcattgacctgcgcagcaacggcggcggggcattgaccgaggccgtctcgctttccgggctgtttatcccgtctggcccggtggtacaggtgcgcgataacaacggtaaagtgcgtgaagatgcggataccgatggtgtggtctactataaggggccgctggtggtgcttgtcgatcgcttcagcgcctctgcatcggaaatcttcgctgctgccatgcaggattacggccgggcgttaatcgtcggcgaaccgacgtttggcaagggcaccgttcagcagtaccgctctctgaaccgtatttacgaccagatgctgcgccctgaatggccggcgctgggctcagtacagtacaccattcagaagttctaccgcgtcaacggcggcagcacgcagcgcaaaggcgtgacgccggatattatgatgccgacaggtaccgaagagacggaaacgggcgagaagtttgaagataacgcgctgccgtgggatagcattgatgccgcgacattcgtgaaatcgggtgatatgaaacagttcggaccggaactgctgaaaaatcacaacgatcgcatcgggaaggatccggaattccagtacatcatgaaagacatcgcgcgtttcaacgccctgaaagcaaaacggaacattgtgtctctgaactacgctcagcgtgagaaagagaacaatgaagatgacgcgacacgtctggcgcgtatcaacgatcgcttcaaacgtgaaggcaagcctctgctcaaaaaactggacgatctgcctaaggattaccaggagcccgatccgtatctggacgagaccgtgcatatcgcgcttgatctcccgaagctggaaaaaaataaacctgctgttcaacctgctcccacaaaataa

SEQ ID NO: 175 - DNA, 926 bp, Enterobacter cloacae
ctcaccttcgccgatagtgaattcagcactaagcgccgtcagacccgaaaagagattttcctctcccgcatggagcagattctgccatggcagaatatgaccgctgtcatcgagccgttttatcccaaggcgggcaatggccgacggccctatccgctggagaccatgctgcgtattcactgcatgcagcattggtacaacctgagcgacggtgccatggaagatgccctgtacgaaatcgcctccatgcgcctgtttgcccgattatccctggatagcgccctgccggatcgcaccaccatcatgaatttccgccacctgctcgagcagcatcaactggcccgtcaattgttcaagaccatcaatcgctggctggccgaagcaggcgtcatgatgacccaaggcactttggtggatgccaccatcattgaggcacccagctctagcaagaacaaagagcagcaacgcgatccggagatgcatcagaccaagaaaggcaatcagtggcactttggcatgaaggcccacattggtgtcgatgccaagagtggcctgacccacagcctagtcaccaccgcggccaacgagcatgacctcaatcagctgggtaatctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaagccagcatccgtgccaaggtggagcacccgtttcgcatcatcaagcggcagttcggcttcgtgaaagccagatacaaggggctgctgcaacacgataaccttttcaccagccgcggaggatcagcatccggaaa

SEQ ID NO: 176 - DNA, 279 bp, Enterobacter cloacae
tctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaagccagcatccgtgccaaggtggagcacccgtttcgcatcatcaagcggcagttcggcttcgtgaaagccagatacaaggggctgctgcaacacgataa

SEQ ID NO: 177 - DNA, 300 bp, Enterobacter cloacae
gctgtgggtcaggccactcttggcatcgacaccaatgtgggccttcatgccaaagtgccactgattgcctttcttggtctgatgcatctccggatcgcgttgctgctctttgttcttgctagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataa

SEQ ID NO: 178 - DNA, 348 bp, Enterobacter cloacae
tcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacagcggtcatattctgccatggcagaatctgctccatgcgggagaggaaaatctcttttcgggtctgacggcgcttagtgctgaattcactatcggcgaaggtgagttaatggctcatgatgtccctctgggatgcgctccggatgaatatgatgatctcatatcaggaacttgttcgcaccttccctag

SEQ ID NO: 179 - DNA, 1560 bp, Enterobacter cloacae
gtccttccagccgcctgtggtgaaaacgattcccgtcgggcagaaatgctgcaacaggccaacgcgctggacgagcgcgaaagtttctcgtcattacgccgtcttgcctggcagaatggtcactactttacgctgcgaaccacctttaaccagccgggccatctggcgaccgtggttgccttcgacctgccgattaacgatctcatcccaccggatatgccgctggacagcttccgtctggagccagacaacagcacccaaaatatgcgctcgccgtcggataaagaaggcgcggacagcgtagccatctcatttaatggctcaaagattgagattgcctcatcgctcaactcaaccggtatgcgtctggtgtggcaggtgccttttggcaccctgatgcttgatactctgcaaaacattctgctgccgctgctgctgaatatcggcctgctggcgctggcgctgtttggttacagcaccttccgtttccagtcgggccgccagagcgactcgacatcggtatcagccgggaccagcaacgagctgcgcattcttcgtgccctgaatgaagagattatttccgtgctgccgcttggggtgctcgttcacgatcaggaggcaaaccgcacggtaatgagcaataaaattgccgatcaccttctgccgcatcttaacctgcaaaatattacggccatggcggaccagcatcagggcgtcatccaggccaccattaataatgaactgtatgagatccgtcagttccgcagtcaggtcgcgtcgcgcacgcaaatcttcatcattcgcgatcaggatcgcgaagtgctggtgaataaaaagctcaagcaggcgcaaaggctgtacgagaaaaaccagcatggccgcgccgcgtttatgcaaaatattggcgatgcctttaaacagccgttgaagtcactcgccacgcagattgctgatctgagcacgccagaaagccgacagctaagcagccaggccgattcactggttcgtctggtggacgaaatccagcttgcgaacatgctggagaatgacatctggaagggcacccctacgctcttctccatccaggacctgattgatgaggtggtgccggaagtcctgccggtgatcaagcgcaagggactccagctgctgatcaacaaccatttaccggccaacgacgaacgtcatggcgatcgcgatgccctgcgtcgcatcctgatgatgttgattcagtatgccgtcaccacgacgcagatcggcaagatcacccttgaagtcagcaccgatgagtccaccgacgatcgtctgacgttccgcatccttgatacgggtgaaggcgtgaccgtgagcgaaattgataacctgcacttcccgttcctgaacgatacccagcgcgaccactacggtaaggcgaatgccctcaccttctggctttgcgatcagctggcgcgtaagctgggcggtcatctgaacattaaggcgcgcgaatccctcggcacccgctactctttacacgttaaaatggtgtcttcaccacggggatggagcatccgcccttga

SEQ ID NO: 180 - DNA, 414 bp, Enterobacter cloacae
tccgtaaggagcaattcgatgcgtcattacgaaatcgtttttatggtccaccctgaccagagcgaacaggttccgggcatgatcgagcgttactctgctgccatcactggtgcagaaggcacgatccaccgtctggaagactggggccgccgtcagctggcttacccgatcaacaaactgcacaaagcacactacgttctgatgaacgttgaagctccgcaggaagtgatcgatgagctggaaactaccttccgcttcaacgatgccgttatccgcagcatggttatgcgtaccaaacacgcagtgaccgaagcatctccgatggttaaagcgaaagacgagcgccgtgagcgtcgcgatgatttcgcaaacgaaaccgcagatgattctgatgctggggattctgaagagtaa

SEQ ID NO: 181 - DNA, 216 bp, Enterobacter cloacae
tttctgatgaccaaccgtctggtgttgtccggcaccgtgtgcaggaccccccttcgaaaggtcagcccatcaggaattccgcattgccagttcgtgcttgagcatcgttctgtgcaagaggaagccgggtttcaccggcaggcgtggtgccaaatgcccgtaattattagcggacacgaaaaccaggccattactcacagttttaacggtcggtaa

SEQ ID NO: 182 - DNA, 399 bp, Enterobacter cloacae
acaacatcatcagaaatggtcacccatcccaacccgggtagcgattacactttaatcagaaaccctgaacagagaaggagagcattcccccgtatcacagcacgcagtcgtggagcgcatatcatgaaaagaatcgcaatcgccattttggctgcgcttttgctcagtgcaaacgcgatggcagccatcagaatagacagccaacaggccagaaacatggatgatgtgcagagcttaggcgttatttacatcaatcataacttcgccactgaaagtgaagcagatcaggcgcttaatgaagaaaccgatgcgcatggcgcaaaatactatcacgtcatgctgacacgtgagcccggcagcaacggtaatatgcacgccagtgcagatatttaccagtaa

SEQ ID NO: 183 - DNA, 564 bp, Enterobacter cloacae
aatcgggcgtttgctgaatgtaaacacgacggaagatttgcagatgatgcaggagagaaaatgatacccgtattagcgatctcagcctggagtggcaccgggaaaacttcgctgctaaaaaaactgatacctgcactttgcgccaaaggcattcgtcccggattgattaagcatacgcaccataacatggatgtcgataaaccggggaaagatagctatgagctgcgtaaggctggcgctgcacaaacgatggtggcgagtaaccagcgctgggcgttaatgacagaaacaccggatgaagcaccgctggatctcgcttatcttgtcagccggatggatcactccacgctggatctggtgctggttgaggggtttaagcatgaggctgttgcgaagatcctgctattcagaagcgatgccggacatgacgtaagtgagttaacgctggatgaacatgtgattgccgtggccagtgacgttgcgttgacgctgaaagtaccggttctggatttgaataatgtggaggggattgcagcgtttatttcggcgtggtgtgcagtctga

SEQ ID NO: 184 - DNA, 729 bp, Enterobacter cloacae
tttattcgtaaaggccagggcgtaacccccaccgcgtacgccaccattctgcatgagtacatcagccagggtctggaatcgattctgggcgcgctggatctcaccggcagttacgataagcaacgaaccatcaccataggcacctctccctctgtgggcgttctggtcatgcccgctatttaccaggctgttaaacagcatgcgccacagctgctgatccgcaacgtgcccgttaacgatccggaaactcagctggcgcaattccagacggacctgatcatcgacagcaacagcttcgcggccagagcattagggcataacgttctctataccgactctctggcgctcgtttgtcgtcagaatcatcctgtattgagcgcacctttgacgcctgaaaatttgcgtcattacgaacatgcaacctttatgtccgaggggcagggcccggatccgctgcgccagcgtattgacgaactgttcccggaccgtctgatcagcttcagcagttacaatatgtttaccctcgcggccctgattggcagcagcgatttgctctgtattatgcctgtgcgtctcttcgctttgcttcaaaaatgctggccgctggagagcattccattgagtcaacttacgacggaatctgttgaaatctcactgcattacaacaagctaagcctgcgcgatccggtgctggaaaacgtcattaacgtgatccgccaggctttctga

SEQ ID NO: 185 - DNA, 1011 bp, Enterobacter cloacae
attgaaacgctttccttcgatattcgcaactggaacacgcacgctatgagtaaacccattgtgatggaacgcggtgttaaataccgcgatgccgataaaatggcccttatcccggttaaaaacgtggctacagagcgcgaggcgctgttaagaaaaccggaatggatgaaaatcaaacttccggccgactcttcgcgtatccaggggatcaaagcggcgatgcgcaaaaatggtcttcactctgtctgtgaagaggcctcgtgccctaaccttgctgaatgtttcaatcacggtaccgcgacatttatgattctgggtgccatctgcacccgccgctgtccgttctgtgacgttgcccatggccgtcccgttgcgccagacgctaacgaaccgcaaaaactggcgcagacgattgccgatatggcgctgcgttatgttgttattacctccgttgaccgtgacgatctgcgcgatggcggtgctcagcattttgctgactgtattaccgccatccgcgaaaaaagcccgaacattaagattgagacgctggtgccggatttccgtggccgtatggatcgcgcgctcgatatcctgaccgcgacgccaccagacgtgttcaaccacaacctggagaacgtaccgcgtatctaccgtcaggtacgtcccggtgcagactacaactggtcgctgaagctgctggaacgctttaaagaagcccatccgcatattccaaccaagtctggtctgatggtcggcctgggtgaaaccaacgctgagatcattgaagtgatgcgcgatctgcgccgccacggcgtcaccatgctgacgctgggccagtacctccagccaagccgtcaccacctgcctgtacagcgttacgtaagcccggatgagttcgatgaaatgaaagccgaagcgatggcgatgggctttacccatgccgcgtgcggtccgtttgttcgctcctcttatcacgccgatatgcaggcgaagggcgaagaagtgaaataa

SEQ ID NO: 186 - DNA, 561 bp, Enterobacter cloacae
aggtgcatctgcctagtaaaaatattcttcagtgccagtgagaaaaatatgagcgactacatacctaaaaagagagggctgcttatactggattggtatgtcccccttaatattttattgctgattctcgttatgtgtgtctttttcacccgttatacatttggatacggtttattgaatgggtgcctgcctgctgatttttatatgattgatcattcggataaaagtattaaaactggtgaactcataccatttaacatgccgaaatcggtacgttttatcccacaaaatgaacgagtcataaaaattgttgccggtgtgggcggtgacaaacttaaagtaacaatggatggggtttataacggggacaaattttttgaaactaatgcacgtcgtatttcgaagaaatacaatattccgtccattttgattgaaaaagaattgataattcctgaaggcgaagttttcctaattgggcaaaccgatcactcatgggattcccgtttttggggaacagtaaagctgaattcagtaattgggaaaacatatgcgatcttttaa

SEQ ID NO: 187 - DNA, 813 bp, Enterobacter cloacae
tgtgcagttttaagtaatacaaatgcaagcactgaatatcaacatgatgctgacctaatcgctcagcaagcaaaggggcttggggcacaggctaaaggtgcacagcagccagatggggctcttagccttgatgctacgctaaaatcaccagatgtgcagaagtacatagcgcaagctgaagcactccaaaaaaaccaggacctgagcaagcaaataaaccgtggttacgtccccggtatgaatgcggatagtgttcaagcagttatagaccatacccaggctatcagggcccaaagtaataactctgaagctgtcaacgatataattagaagacgtgatgaaattcaagaaaacgccagccttaatgaagcggctctgaaagctgtggaaaataagccggaagtcatgcgaggacaagctaaaaatatcgaaaaattgtttggttcctcgggcatcacagctgctgacttcgaaagaaaaatggatagcacacgtgaagaagcactatcaactgaaaatggaataacgatctttgcttcatttagcttgccggattatgtactggaagaccttctacgtacggcctcagagcataaagctcgtgtagttttcaatggtctaaagaaaggaactactcggctaccagagacacaggcagcaataaaccaaatgattgtcaaaggaaaatttgaatctcctttgattacaattgatcctgatagcttcagtcaatatcaagtaactcaagtaccgacaattatttctagggagcaagctcgttttgccaaaatgggtaagctccttcaacgttga

SEQ ID NO: 188 - DNA, 741 bp, Enterobacter cloacae
atgaatttacgaacaaagggatttctgttaatcattaaagatgaaggtgacaccaaagaatttacaattgaaaatcctggcaaatatacattgatggttgttttcaaagataaccgaaacaatgaacagcgtatcgaaaatacctttgttgtcgatgaacaaacgccaatgaacgttgagatgacacccaagttctctaacaaatatatgagagctccactcgatgtaaccttaaggtcaaacatcaagatatctcattcggcggactcgatagatacggtcacatacaaggtgaacggtgaagtaatacccagcggcaaaaattattgggctcaactgatctcgggtttaaaagaaaagaaatacgagattacaattgatgttgttagtaaacttggacagagaggttcagcatctgttgagtttgatgtcgttaaaaacgcagtgcctaattgtacattgagctacacggaaaccaacctaagctggagctttaccaataaatgtgatgatactgatggaaaaatggttagatatgaatggttcatcaacggcgaattaaggaacgttttcggtagtacggctacactttctaaaaaccttaaccgtggtaagcaggacataaaagtaattgcttatgatgatagtggagactttgcaacacagcacgtgacagttttcggaccggctgaagaggcaagtaagtctgaaaacactgtatcaataccaagcagtgagtag

SEQ ID NO: 189 - DNA, 417 bp, Enterobacter cloacae
  unsure (153)
gtacttgacgcgcaaatatcagtttgtgcgtgctcgtcgctgattcgctgtattaatacaaccccgcatatgcggggtttttttgttcccgattccagggtatcgtgcggatgccgggtggcggttgcgcattacccggcatacagaattcantatgctcgaatcgaaccttggtcgaagctttttatccgtccccgcatgggagaaccatggggcattgtgcttttggatagtgctaaagaatccggaagtgatggtggtgggggaaggattactcagcgcttcgcgcttcgcccttcgggtcgttgcatgcggcaacgctttctcgatacgctcgaatcgaaccttggtcgaagcttctcatcattccccgcactgaagaaccatggggcattgtgctttgagagagtgctgtag

SEQ ID NO: 190 - DNA, 336 bp, Enterobacter cloacae
  unsure (110)
ttcgctgtattaatacaaccccgcatatgcggggtttttttgttcccgattccagggtatcgtgcggatgccgggtggcggttgcgcattacccggcatacagaattcantatgctcgaatcgaaccttggtcgaagctttttatccgtccccgcatgggagaaccatggggcattgtgcttttggatagtgctaaagaatccggaagtgatggtggtgggggaaggattactcagcgcttcgcgcttcgcccttcgggtcgttgcatgcggcaacgctttctcgatacgctcgaatcgaaccttggtcgaagcttctcatcattccccgcactga

SEQ ID NO: 191 - DNA, 519 bp, Enterobacter cloacae
  unsure (490)
ttcgaggaagccgaagaccacgcggggaactccacagaggcgaaaaccatccgcgatgaccgcaaatacaccaagcgcgagcgcgaactgccagcgaatcgtctcaaccgaaagcgagcccgcagccaggcgaagaaggacggcaacgcaaaagagcagcagcaggatcagatcgaaaccaaaatcgaacagcaggcggaagaaatcgaaaacatcaacagcgaccaggaaaagcagagccgcgagatcaaggaaggccatcagggagaagagaacgacgaagcgaagaccacgcaggcagagcaggaagaaatcggcaggaaggagcgaaagagacagaaggaaacccagcgcgcgaagaacatccaggagcgcaaggcgcgtcagccgggcggacagcaggagcaggcgcgagagatcaaacgcgaaatcgaatcccagcagccgcacaacgaatccctgttccagaaggtcaattacctgagctatnttaaccgccggggtcgaaggacacgcgca

SEQ ID NO: 192 - DNA, 810 bp, Enterobacter cloacae
cctttttgccgggacactgttatgcaggccgaaattctcctcaccctacgacttcagcagaagcttttcgccgatccgcgacgtatcgccctgttaaaacaaatagaacaaactggctcgattagccagggagcaaaaaacgccggcatcagctataaaagtgcctgggatgcgattaacgacatgaacaccctgagtgaacacacgctggttgagcgcgccaccggcgggaaaggcggcggcggcgccgtgttgacgcgttacgggcaacgtctgatccagctctacgatttactggcgcagatccagcaaaaagcatttgatgtgctgagcgatgacgacaacctgccgctggacagcctgctgggcgccatctcccgtttctctttgcagaccagcgcccgtaaccagtggtttggtacggtgacggggcgcgatcattcgcaggtgcaggagcatattgagatcctgctcgcggacggcacgacgcgcctgaaagccgccatcaccgcgcaaagtggtcaacgccttgggctgaacgaaggtcaggaggtgctggtattactcaaagccccctggatcagcatcacgcttaaccctgagcaggccgcagaggccgacaaccagctgcggggacgcatcagccacatcgagcgcggcgcagaacagtgtgaagtgctgatgaccctgccggatggacagttgctctgcgccaccgttccggtgaacgacgcgaccgaattagacgaaggtgctgtggtgaccgcatatttcaatgcagacagggtaattatcgccacattgtgctaa

SEQ ID NO: 193 - DNA, 1164 bp, Enterobacter cloacae
  unsure (985)
  unsure (1131)
cacatgtcatcattgcatatttcgcaaggcacgtttcgtcttagcgatacccgtaccttatcgctgccagagttaacccttcgcgccggagaaagctgggcgtttgtgggctctaatggcagcggaaaatccgcgctggcccgcgctttggctggcgaaataacccaactgaagggtgaacgtcggtgcacctttacccggctgacgcgcctttccttcgaacagctgcaaaagctggtcagcgatgagtggcagcgtaacaataccgatttgctcagccccggcgaagaagataccggccgcacgacggcggaaattatccaggatgagataaaagatcctgcccgctgtcagcagctggcggagcaatttggcattaccgccctgcttaaccgccgtttcaaatatctttctaccggcgagacgcgcaaaacgctgctgtgccaggcgctgatgagcgagccggaactcttgatcctggatgaaccgtttgacggactggatgtgcagtcccgcgcgcagctggcagcgttgctggcgtcgcttaaccagcagggatacacgcttgtgctggttcttaaccgctttgatgagatcccggatttcgtacattatgcaggcgtgctggcggactgtagcctgaccgaaatcggcgagaaggccgtcctgctccgtcaggcgctcattgcacagctggcccacagcgagaaactggacggtattgccctgccggagccggatgcgccttcggcgcgccacgggctggagcctgaccagccgcgcattgtgctgcgcgatggggtggttgcttacgacgatcgccctattcttaatcacctcagctggacggttaatcctggtgagcactggcagatcgtcggccccaacggggcgggtaaatccacgctgctgagcctgatcaccggggatcacccgcagggatacagcaacgatctcaccctgttcgcccgtcgccgcgggcacngggataccatctgggatatcaaaaagcacttccggtatgtcagcagcaccctgcatctgggactaccgggtgagcaacaccgttgcaaaacgttatcctctctggcttccttcgactccattgggtatttatcaaggcggttcccnacaaaccaccaccaacttgcgccaacattgggt

SEQ ID NO: 194 - DNA, 792 bp, Enterobacter cloacae
ggaaagacgatgattacactctgtaaaacctgcggtaccgcttacgatgaacagcccaaaaactgccctatttgcgacgatgagcgccagtatgtcccggtgacgggccaggcatggacggacttcgacagccttacgaccacgcacaccaacaaatggcaacagctggagccgcagctgttcagcatcaaaaccgttcccgcttttgccatcaaccagcgcgcgcttctgctgcgtacgccacagggcaatgttctgtgggactgcatcgccaatcttgacccggcgaccagagcgttagttgacgcgctcgggggcatcagcgcgatcgcgatttcgcacccgcattactacaccaccatgcaggagtgggccgccgcgtttaacgcgccgatctacctgcacgccagcgatcggcagtgggtgatgcgtgacagcccggcgatacgcttctgggaggaggacgccctggagattatgcctttggtgactctgctgcggctgggcgggcattttgcaggcggcacggtgctgcactggcagtcaggcgacggcgtgctgctggccggtgatattttgcaggttacacccggaaaagacgccgtgtcgtttatgtggagttatccgaatatgctgccgctgcctgcccgcaccgttgagtcgttgatcggccgactgaccgggaaaacgtaccagcgcctgtacggggcctttgaaggacagaacatcccggtgaacgcagatgagatcgtgcagcggtcgggccagaaatatattgcttgtctccgctaa

SEQ ID NO: 195 - DNA, 831 bp, Enterobacter cloacae
gccccccccattcgcgggggttcgcggctcttccaggcccgtgtcaagttgttgatcccgacgcccttcggcgcagacacggtgttagctgatacccagttcggttcgctgacgcgacctgtacaggatgaagcgatggcgaactggcaggaggagggctggaaggaagcgccgctgccggtgtggaatctgcttaactacgcggtgctccaggaacggcgtaacgggatggcgctgtttaccgaagggttacgcgaatttgaagtgactggcgagcgtcaaaaaacgtttgccctgacgttgcttcgcggcgtgggagtacttgggaaggaagatttactgctgcgccccggcagaccgtccgggatcaaaatgccggtgcctgattcgcagatgcggggccagttaacctgtcgctttagcctgttcagttttaatggtacgcccgtcagtgctggtgttgcgcagcaggcgaagtcgtggttaacgccagtgcactgttataacaaaattccgtgggatgcgatgaagcttaaccgcgcctctttcaccaccccctgtagctatagtctgctaacgctggcgcctaacggatgcgtactcagtgcgctgaaaaaagcggaggatcgtgacgagatgattcttcgtctgtacaacccttcggagacccgctcctgtgacgtggctttgtctgtgaaccgtgagatccaggcctgctgcgaaacggacatgaatgaggtgtacaaggcgcaaggggaagagggctcagccattacggggtctttccggccaggccagtcacgtaccttcagcataaaaattgaaaggtaa

SEQ ID NO: 196 - DNA, 204 bp, Enterobacter cloacae
  unsure (51)
ggacttatcctggcggggtttataaattcccctatggttggccaggggttnttcttattcaacatcccaattggcggccacgttagttgtggggggtttcttaaggtgcccagttacaggccaaaaccggaggatgtggaatttgatgccaggagggacctttttttttgccatcattgggccttccctttgcagtcgggataa

SEQ ID NO: 197 - DNA, 741 bp, Enterobacter cloacae
accagatcgataccactgaccttcacagggagtttgatgaggcccattgtagtggtacttctcatcctggcagcggcactcacacccatactttggagggttgaaagggctgcacccgatcccgtggtgcaggttgacctgctggccagccgtgaggtccgcattgcaaccgcaatctctgctggtaatggcctatcccaggctgcaatcgtattcatacccagctacgccttcctcgccctttcactgtcagagtccatggccagtttcagcctcctccccttcgtcaccaccatggccctctcggcccccattgtgggtgttctgctggacagggttggttcaagggtagtgatgatctcagggagccttatcctgatggttgggtgtaccatcatggccctcctctcatcaaccacccctctcttcatacttgctgaggtgctcatggccctcggactcataaccgtcataggggcacccctcaggtacataatgctatctgaaactccccccgaacacagggcatctggacaggccctgataaacatattatcaagtgcagggcagcttgttggaggtgcactcatcggtggcattgtagcgtccatgggtagtggagtaatgggttacaggttctcattcctcttccttgttgcagttgcattcacactcttcctgctatcaaccggtctcaagggaagagacgtagagcttgagacaatgaagagggacagctgc

SEQ ID NO: 198 - DNA, 750 bp, Enterobacter cloacae
tttatgtttcttagcgtcattactgtcgcctttcgtaactacgaaggggtggtaaaaacctggcgctcgctgcgcaacctggcgcgcgatccgagcctcacttttgagtggatcgtggtcgatggcggctcgaacgacggcacggcggagttcctggaaaaactcaacggtgagttcaacttacgttacatcagcgagaaagataaaggcatttacgatgccatgaataaaggcatcaacatggcgcaggggcgttacgccatcttcctcaattccggcgatgtgttccatgaaaatgtggcgctgtttgcccgtcagctggcgcgccagaaagaagatgccatgtttatcggtgatgcgctgcttgatttcggcgaggggaaaaaagtgctgcgcggtgcgaaaccaggctggtatatctaccacagcctcccggccagccatcaggctattttcttcccaatgagcggtctgaaaaaacagccttacgatttgcgctataaagtgtcatcagattatgccctggccgccagtctttacaaatctggctacccgttccgtcgaattaaaggactggtatctgaattttcaatgggcggcgtgtcaacctcgaataatctggaactgtgccaggatgccaaaaacgtgcagcgtaaaatattacgcgtgccggggttctgggcggaattatcttatttcttacgtctgaaaacgacgggtaaagcgaaagccttatataacaaagcctga

SEQ ID NO: 199 - DNA, 351 bp, Enterobacter cloacae
ggaaacgtaatgcaggaattaaatggattctccgtaccgaaaggttttcggggcgggagcggtattaaagttcaactgtggtgggctgtacaggcaacgttatttgcctggtcgccgcaaatactgtaccgctggcgcgcatttttactgcgtctgtttggcgcaaaaataggaaaaaacgtagtcattcgaccttcggtgaaaattacttatccctggaaattaacacttggggattacgcctgggttggggatgacgcagtgttatatacccttggtgagattacgattggcgcaaattcggtggtttcacagaagtgttatttgtgcaccggtagccacgattttatg

SEQ ID NO: 200 - DNA, 228 bp, Enterobacter cloacae
attatctatttttcctggttcgccgtactgttgacactgtggtatctgtttaaagttttcaaaatgatgattaacgcgtttggtgataaccagaactttcgcgtgcaactttatctgttcacaccggtgtcgttgttttttaccgggtcaatatttagcccggaatatgcattcttaattgtatgtccgtttattttgcgcaaggcgctgaatattacgagcgtatga

SEQ ID NO: 201 - DNA, 372 bp, Enterobacter cloacae
acagcagcggacctgctgctacagttgtccacttcacagcgtcagggccgttacaaaacgactctcaatcgtggtgtcatggccccgaagctgcttatcatcgatgaaataggttatctgccgttcagtcaggaggaagccaagctgttcttccaggtcatcgccaaatgttacgagaagagcgcgatgatcctgacctccaacttgccgttcgggcagtgggatcagacgttcgccggtgatgcagcgctgacatcggcgatgctggaccggatcttacatcactcacacgtcgtgcaaataaaaggggaaagctatcgactgaagcagaaacgaaaggccggggttatagctgaagctaatcctgagtaa

SEQ ID NO: 202 - DNA, 2127 bp, Enterobacter cloacae
acgaggaatcaaatggctcgtacaacacccatcgcacgctaccgtaacatcggtatcagtgcgcacatcgacgccggtaaaaccactactaccgaacgtattctgttctacaccggtgtaaaccataaaatcggtgaagttcatgacggcgcagccaccatggactggatggaacaggagcaggagcgtggtattactatcacctccgcagcgactactgcattctggtcaggtatggctaagcagtacgaaccgcatcgcgtaaacatcatcgacaccccagggcacgttgacttcaccatcgaagtagaacgttccatgcgtgttcttgacggcgcggtaatggtttattgcgcagttggtggtgttcagccacagtctgaaaccgtatggcgtcaggcaaacaaatataaagttccacgcatcgcgttcgttaacaaaatggaccgtatgggtgctaacttcctgaaagttgttggccagatcaaaacccgtctgggcgcgaaccctgttccgcttcagctggcaattggtgctgaagaaggcttcaccggcgttatcgacctggtgaaaatgaaagccatcaactggaacgaaacagatgcgggcgttaccttcgaatacgaagatatcccggcagagatgcaggacctggctgacgaatggcaccagaacctgatcgaatccgcagcagaagcttctgaagagctgatggaaaaatacctgggtggtgaagaactgtctgagcaagagatcaaatctgctctgcgtcagcgcgttctgaacaacgaaatcatcctggtaacctgtggttctgcgttcaagaacaaaggtgttcaggcgatgctggatgcggtagttgactacctgccatccccgattgacgttcctgcgatcaacggcatcctggacgacggtaaagatactccggctgagcgtcacgcaagtgatgaagagccattctctgcactggcgttcaaaattgctaccgacccattcgtgggtaacctgaccttcttccgcgtttactctggtgtggttaactccggtgacaccatcctgaactccgtgaaagcggcgcgtgaacgttttggccgtatcgtacagatgcacgctaacaaacgtgaagagatcaaagaagttcgtgcgggcgacatcgctgctgctatcggtctgaaagacgtgaccactggtgacactctgtgtgatccggatcacccgatcattctggagcgtatggaattccctgagccggtaatctccatcgcagttgaaccaaaaaccaaagctgaccaggaaaaaatgggtctggctctgggccgtctggcgaaagaagacccatcattccgtgtatggactgatgaagaatctaaccagaccatcatcgctggtatgggtgaactgcacctggacatcatcgttgaccgtatgaagcgtgaattcaacgttgaagcgaacgtgggtaaacctcaggttgcttaccgcgaagcgattcgcgcgaaagttaccgacgttgaaggtaaacacgctaagcagtctggtggtcgcggtcagtacggtcacgttgtgatcgacatgtacccactggagccgggctctaacccgaaaggttacgagttcatcaacgacatcaaaggtggtgtaattcctggcgaatacatccctgccgttgataaaggcatccaggagcagctgaaagctggtcctctggctggttacccggttgtagacatgggtgttcgtctgcacttcggttcttaccacgacgttgactcctctgaactggcgtttaaactggctgcgtctattgcctttaaagaaggctttaagaaagcaaaaccagttctgcttgagccgatcatgaaggttgaagtagaaactcctgaagagaacaccggtgacgttatcggtgacttgagccgtcgtcgcggtatgctgcgtggtcaggaatccgaagtaactggcgttaagatccacgctgaagttccgctgtctgaaatgttcggatatgcaactcagctgcgttctctgaccaaaggtcgtgcatcatacactatggaattcctgaagtatgatgatgcgccgaacaacgttgctcaggccgttatcgaagcccgtggtaagtaa

SEQ ID NO: 203 - DNA, 378 bp, Enterobacter cloacae
tccacaggattaaaacctaagtcccgtgctctctccgaaggggagagcactatagtaaggaatatagccgtgtctaaagaaaaatttgaacgtacaaaaccgcacgtcaacgttggtactatcggccacgttgaccatggtaaaactaccctgactgctgcaatcactaccgtactggctcaaacctacggcggtgctgctcgtgctttcgatcagatcgataacgcaccagaagaaaaagctcgtggtatcaccatcaacacctctcacgttgagtatgacaccccgactcgccactacgcacacgtagactgcccaggccacgccgactatgttagtcttcacccacgggcgctggacggatccacgcttaggtaa

SEQ ID NO: 204 - DNA, 705 bp, Enterobacter cloacae
tgcacgacctttggtcagagaacgcagctgagttgcatatccgaacatttcagacagcggaacttcagcgtggatcttaacgccagttacttcggattcctgaccacgcagcataccgcgacgacggctcaagtcaccgataacgtcaccggtgttctcttcaggagtttctacttcaaccttcatgatcggctcaagcagaactggttttgctttcttaaagccttctttaaaggcaatagacgcagccagtttaaacgccagttcagaggagtcaacgtcgtggtaagaaccgaagtgcagacgaacacccatgtctacaaccgggtaaccagccagaggaccagctttcagctgctcctggatgcctttatcaacggcagggatgtattcgccaggaattacaccacctttgatgtcgttgatgaactcgtaacctttcgggttagagcccggctccagtgggtacatgtcgatcacaacgtgaccgtactgaccgcgaccaccagactgcttagcgtgtttaccttcaacgtcggtaactttcgcgcgaatcgcttcgcggtaagcaacctgaggtttacccacgttcgcttcaacgttgaattcacgcttcatacggtcaacgatgatgtccaggtgcagttcacccataccagcgatgatggtctggttagattcttcatcagtccatacacggaatga

SEQ ID NO: 205 - DNA, 1113 bp, Enterobacter cloacae
tgggtcttctttcgccagacggcccagagccagacccattttttcctggtcagctttggtttttggttcaactgcgatggagattaccggctcagggaattccatacgctccagaatgatcgggtgatccggatcacacagagtgtcaccagtggtcacgtctttcagaccgatagcagcagcgatgtcgcccgcacgaacttctttgatctcttcacgtttgttagcgtgcatctgtacgatacggccaaaacgttcacgcgccgctttcacggagttcaggatggtgtcaccggagttaaccacaccagagtaaacgcggaagaaggtcaggttacccacgaatgggtcggtagcaattttgaacgccagtgcagagaatggctcttcatcacttgcgtgacgctcagccggagtatctttaccgtcgtccaggatgccgttgatcgcaggaacgtcaatcggggatggcaggtagtcaactaccgcatccagcatcgcctgaacacctttgttcttgaacgcagaaccacaggttaccaggatgatttcgttgttcagaacgcgctgacgcagagcagatttgatctcttgctcagacagttcttcaccacccaggtatttttccatcagctcttcagaagcttctgctgcggattcgatcaggttctggtgccattcgtcagccaggtcctgcatctctgccgggatatcttcgtattcgaaggtaacgcccgcatctgtttcgttccagttgatggctttcattttcaccaggtcgataacgccggtgaagccttcttcagcaccaattgccagctgaagcggaacagggttcgcgcccagacgggttttgatctggccaacaactttcaggaagttagcacccatacggtccattttgttaacgaacgcgatgcgtggaactttatatttgtttgcctgacgccatacggtttcagactgtggctgaacaccaccaactgcgcaataaaccattaccgcgccgtcaagaacacgcatggaacgttctacttcgatggtgaagtcaacgtgccctggggtgtcgatgatgtttacgcgatgcggttcgtactgcttagccatacctga

SEQ ID NO: 206 - DNA, 189 bp, Enterobacter cloacae
tccggatcacacagagtgtcaccagtggtcacgtctttcagaccgatagcagcagcgatgtcgcccgcacgaacttctttgatctcttcacgtttgttagcgtgcatctgtacgatacggccaaaacgttcacgcgccgctttcacggagttcaggatggtgtcaccggagttaaccacaccagagtaa

SEQ ID NO: 207 - DNA, 825 bp, Enterobacter cloacae
cctcatatcctggacttattcgcaccttccctagagccggggcattctaaaacaatgatggccgcatttattgtggctatcaggggaacggtcacacaagcagtattgttaggtcttgcggcgacaatttctcatacctctattgtctggctcattgcactgggcgggatgtatatccgtcagaaatttacggcagaatcagccgaaccctggttccagctgatttcagccatcattattcttgccactgcggcatggatgttctggcgtacatggcgcggagaaaagctttggaggatggagcaggaagatgagcatggccacgttaatcaccctcatgatgaaacccgcgtcattgataccggtcatggcagcgttgaactctcaattttcgaagaaggtcagccaccccactggcgtttacgctcgctcagtggcaggaaatgggaggccagcgatattactctggtcactaaccggggtacagggacattttcacaggtgtttaatttcgtagaaaaagacgggtttatggaatctgcccagccgatccctgagccgcacaactttgaggtttgtctatctctaggccatcgtggtcatgtacacgactatgatgtggagttccgcgagcatgatcataaccacgatcactccgcacttgagggacttgatgttagttcactcgagtatcaggacgcgcacgaaaaagcacatgctaacgacatcaaaaaacgctttgctaatagcagcgtaacaaccggacaaattatcctttctcggcctgacggtcttcaccacgccgatggaaagatcaagcgctcc

SEQ ID NO: 208 - DNA, 447 bp, Enterobacter cloacae
gtcatttttcatcagccccttgtagcgtgctttgataaaaccaaactgacgtttaataaccctaaacgggtgctccacctttgccctgatgctggctttcaggtattcgagtttgatggcggctttgtttttgcgggggtgctttttcaatatcctgactttccctggacgttcagcgatgaaccagtccacatcacggtccttcagctcatcccgtttctctgcgccacgataacccgcatcggcggagacaaattcttcgtcaccgtgcagaagattattcaattggttcaggtcatgttcattagcggcggtggtcaccagcgtatgagtaaggccgctttcagcatcgactccaatatgagccttcatgccaaagtgccactgatttccttttttggtctgatgcatatcggggtcacgctgtttgtttttattcttggttga

SEQ ID NO: 209 - DNA, 987 bp, Enterobacter cloacae
ggtcacatgagccagcaattaacctttgccgacagtgagttttccagtaaacgtcgcctgacgaggaaagaaattttcttatcccggatggatactctgctgccgtggcctcaactgctgggcaacattgaacctgtctatccaaaagcaggtaatggccgccgaccttattcgctggaaacaatgttccgtattcactgcctgcaactgtggtacagcctcggtgatgaagcgatggaagacgcattgtatgagattgcttcgatgcgccaatttgccttgctgtcattggataaagctattcctgaccgtactaccatcatgaactttcggcacttgctggaaaaatacaaactgactcgcaaaatatttcaaaccgtcaatcagtggctgttggattgcggcgtgatgatgactcagggtaccctggttgatgccacaattatcgaagcaccaagctcaaccaagaataaaaacaaacagcgtgaccccgatatgcatcagaccaaaaaaggaaatcagtggcactttggcatgaaggctcatattggagtcgatgctgaaagcggccttactcatacgctggtgaccaccgccgctaatgaacatgacctgaaccaattgaataatcttctgcacggtgacgaagaatttgtctccgccgatgcgggttatcgtggcgcagagaaacgggatgagctgaaggaccgtgatgtggactggttcatcgctgaacgtccagggaaagtcaggatattgaaaaagcacccccgcaaaaacaaagccgccatcaaactcgaatacctgaaagccagcatcagggcaaaggtggagcacccgtttagggttattaaacgtcagtttggttttatcaaagcacgctacaaggggctgatgaaaaatgactcacagttagcgatgctattcacgctagcgaacctgtttaaagtggatcagatgatacgacgacagactaaatccgcctaa

SEQ ID NO: 210 - DNA, 1032 bp, Enterobacter cloacae
cgactaccagcgtcagggggaataaggatgcgtaagtcagttattgcgatcatcatcattgtactggtcgtgctctacacctccatctttgtggtgaaagagggcgagcgtgggatcaagttccagttcagcagcgtcgtgcgtgacggcgacaagcgtccggtgatttatgagccgggtctgcactttaagatcccgttcattcagtcagtgaaaacgctcgatgcgcgtatccagaccatggataaccaggccgatcgtttcgtgaccaaagagaagaaagacctgatcgttgattcctatatcaaatggcgcatcagcgatttcagccgctacttcctggcaaccgggggtggcgacgtttctcaggcagaagtgctgctgaaacgtaagttctctgaccgtctgcgttctgaaattggtcgtctggatgtgaaagacattgtgaccgactcccgtggtcgtctgacgctggaagtgcgtgatgcgctgaactccggctctgcgggcaccgaggatgaagttgaaaccccggcggcagacgatgcgattgccaaagcggctgaacgtgttcaggctgaaaccaacggtaaagtgccggtgatcaacccgaacagtatggcggcgctgggcatcgaagtggttgatgtgcgcatcaagcagatcaacctgccagcggaagtgtccgaggcgatctacaaccgtatgcgcgccgagcgtgaagcggtagcccgtcgtcaccgttcacagggtcaggaagaagcggaaaaactgcgcgcggcagcggactatgaagtcaccaagacgctggcggaatctgagcgccagggtcgtatcctgcgcggtgaaggtgatgcggaagccgcgaaactgtttgctgatgcattcagccaggatccggacttctatgccttcattcgtagcctgcgcgcttacgagaatagcttcaagagcaaccaggatgtgatggtgctcagcccggacagcgatttcttccgttatatgaagacgccgaccaacgcaacgcgataa

SEQ ID NO: 211 - DNA, 504 bp, Enterobacter cloacae
gggggggtcgatgatttcgcccgctgcgtaaaatacatccgtgaagggcaagcgtacaccaacgaagttcagccgcgtgcaaacggtcaggcacagcgtattctggaagaagcgcgtgcgtataagacccagaccatcctggaagcacagggtgaagtggctcgcttcgcgaagatcctgccggaatataaagccgcgccggaaattacccgtgagcgtctctatatcgagaccatggaaaaagtgctgagccatacgcgtaaagtgctggttaacgacaacaaaggcggaaacctgatggtcctgccgctggatcagatgctgaaaggcggttctgcaccggcagcaaaagacaacagcggtgcgaacaacctgctgcgtctgccaccggcctcctctggcagcgccagtgcgaacacaacgccttcttcgaacgatggtgacattatggaccaacgccgtgccaacgcgcagcgtaacgactaccagcgtcagggggaataa

SEQ ID NO: 212 - DNA, 909 bp, Enterobacter cloacae
  unsure (756)
  unsure (764)
  unsure (765)
  unsure (766)
  unsure (767)
  unsure (768)
  unsure (769)
  unsure (770)
  unsure (771)
  unsure (772)
  unsure (773)
  unsure (774)
  unsure (775)
  unsure (776)
  unsure (777)
  unsure (778)
  unsure (779)
  unsure (780)
  unsure (781)
  unsure (782)
  unsure (783)
  unsure (784)
  unsure (785)
  unsure (786)
  unsure (787)
  unsure (788)
  unsure (789)
  unsure (790)
  unsure (791)
  unsure (792)
  unsure (793)
  unsure (794)
  unsure (795)
  unsure (796)
  unsure (797)
  unsure (798)
  unsure (799)
  unsure (800)
  unsure (887)
gtacgactgcgcgggtcttcgctccccttggtgaaaattatgaccgatccagcaggtgccagcgaacttgtctttggccttttctggctgctgggataccagttttctccacgcctggctgatgccggtgcttcggttttctggcgaatggaccatgatgccgactatggcgtgctgaatgatattgccagagggcaatcagatccccgaaaaatagtccttcagtgggacgaaatgatccggaccgctggctccctgaagctgggcaaagtacaggtttcagtgctggtccgttcattgctgaaaagtgaacgtccttccggactgactcaggcaatcattgaagtggggcgcatcaacaaaacgctgtatctgcttaattatattgatgatgaagattaccgccggcgcattctgacccagcttaatcggggagaaagtcgccatgccgttgccagagccatctgtcacggtcaaaaaggtgagataagaaaacgatataccgacggtcaggaagatcaactgggcacactggggctggtcactaacgccgtcgtgttatggaacactatttatatgcaggcagccctggatcatctccgggcgcagggtgaaacactgaatgatgaaaatatcgcacgcctctccccgctttgccacggacatatcaatatgctcggccattattccttcacgctggcagaactggtgaccaaaggacatctgaaaccattaaaagaagcgtcagaggcaganaacgttgnnnnnnnnnnnnnnnnnnnnnnnnnnnnnnnnnnnnntactaaccggcccaggcaccaggtccatgccaaaatgggcggccaccccgccggcgaaaaagcgccccgcgccgttttggtggtccnaacttccgttggccccttttga

SEQ ID NO: 213 - DNA, 2229 bp, Enterobacter cloacae
aaccctgaaagaaaatttcccgaaggtattcagtatagtatcgcgtatgacccaacattttttgctagcgcatcgttgaaatctgttgcaacgactttactggaagcaacaatcctcgtggtgcttgtcgttatgttatttctacaaacatggcgagcatcgattattccattagttgccgtgccgatttcactagtaggcacctttgcgttaatggatgtattcggattttctctcaatacgttatcgttgtttggccttgttctttcaattggcatcgttgtggatgatgcgatcgtcgttgttgagaacgtagagcgacatattgcaaggggactatcacctaaagatgcagccagaaaggcaatggatgaagtaacgggtcctatattagctattacttctgtactggctgcagtatttattccttcagcgtttctttcgggattacagggagaattttatcgtcaattcgcgttgacgattgccatctcgaccatcctgtcggcgatcaactctttaacgttatctccagcactggcttctgtactgcttaaaccacatcaaggtacagataaaaaagacatgctgactcgggtgttggagcgccttttaggttcgttcttcggccgtttcaacacatttttcgacaggttatcggaaaagtacgtagatactgtaagacgtatagttcgcgggagtactatagtcctgattttgtatgctggttttctggcaatgactttcctgggattcaagcaagttccgggtggctttgttccggcgcaggataagtattatctcgttggtatagcgcagttgccgacaggagcctcgctggacagaacagaagcagtcgttaaggaaatgaccagacttgcattagctcagcctggagtggaaagcgtggttgcatttccaggtttatctgtaaacgggccaaacatgccgaactcagctttgatgtttacgatgctgaagccttttaaggatcgtcaggacccttccttatctgcatatgccatagctggtagccttatggggaaatttagcaaaatacctgatggttttgttgggatattcccaccaccacctgttccaggtttgggaagtatgggcgggttcaaactccaaattgaggacagagcaggattaggttttgaagaactggcccgagtgcaaggaacgatcatggctaaagccatgcaaactccagaattagctgggatgatggctagttttgaaactaattcacctcagatccaggttgacatcgatcgcgtaaaagcaaaatctcaaggagtggctttaactgacatctttgatacattgcaggtcaatttgggatcactatatgttaatgattttaataggtttggccgtacatatcgtgtaattactcaagctgatgctccattccgcatgcaggctgaagatatcggattacttaaagtgcgaaatgcggctggagaaatgatcccgttatcggctttgattaatatcaaactaacttcaggccctgatcgtgtgatgcgctataacggttatccatcagcagatattacaggtggaacagcccccggttattcttctggccaggcaaccgatgctattgaaaaaatagtgaaggaaagcttacctgaggggatggcatatgaatggacggatctcacttatcaggaaaaattagcgggtaattctgcgctatatattttcccattagcagttttctttgcattcttgatcctggctgcacagtacaatagctggtcgctcccattcgctgtactactgattgcgccaatggcgttgctttcggcaattggtggggtctggatttctaatggtgataacaatatcttcacacaaattggttttgtcgttttagtcgggctggccgctaaaaatgccattttaattgttgaatttgcccgaactcaagagaatgaaggactctctcctttggaggccgtacttgaggctgcacacttacgcttacgtccaatcctcatgacgtctcttgcatttattgctggcgttattccattggtactggcgagtggcgcgggtgctgaaatgagacatgctatggggattgccgtttttgcaggaatgctaggtgtaacgttctttggattactgcttaccccagtattttatgttgtggtgcgtagtttttcgataagacgaaaagtgaactcccatcaattgttgagtgagaaaagatag

SEQ ID NO: 214 - DNA, 279 bp, Enterobacter cloacae
  unsure (272)
ttgcaacaaatgaatggcaaggctcttgaccttacaacggtggtaagccctaaactaaagggcaccacaactaaacaggatacttatatgcaatttcatcttgacaacatgacatgcggtggttgtgcccgtactgtgactaaagtaattcagaaccttgatccggatgctagcatcgtaactgatcctccaactcgtaaagttgagatacaaacgttgttatcggttgatctgatttctgatgctttgcgtgaagcaggtttccctccganggaatag

SEQ ID NO: 215 - DNA, 1152 bp, Enterobacter cloacae
ccgccatctgttcagggagcgttggcaggtggaccatcagccagattcagggggacgggtaaccgttgcgggcattgcctccgggccacatttttaccttcaccaacgcgccgtttttcagcgataacggccgagtatttggtgacggcggcgggttaccatttcgaggagaaccgctacgcgatcggtgagggggagaccattcaccgcaccgatttcagcgtcattccggcgtcggtgtcctaccgtccggcgcagagcacggcgtggccgcgcacatacggcccgcagacggcgaaagtggtggggccgcagggggagagtatctggacggacaaatatggccgcgtgaaggtgaagttccactgggaccgcctggcgaagggcgatgacaccagctcctgctgggtgcgcgtgtcgagcgcctgggcgggccagggctacggcggggtgcaaatcccgcgcgtcggcgatgaggtggtggtggactttatcaacggcgacccggaccgtccgattatcaccggtcgcgtgtataacgacgcgagcatgccgccgtgggcactgccggctgcggcgacgcagatgggttttatgagccgcagtaaggatggccacaaagataatgccaatgccctacgattcgaggataaggctgggcaagagcagatctggattcatgctgaaaaaaacatggacaccgagatcgagaactgcgagacacatgacgtaggggtagaccgtaaaaaaattatcggccgggatgagcacgtaacggttaagcgtaaccgggacgtgaacgtgggggcgaattcaaccagcaacacgggtaatcagcacaaattcaatgtaggtaaaaaccaaaccgtattgactatggataaagagggaaatgctctgctggaagcgacaacctcgattaagttaaaggtgaatgataactacattcttatcacgccatcgacaattgaaattatcgtttccgaagggacactcaaggctgagagtattactgtggcatccttcaaagggacggagttgacgaagttaggcggcggaataaatgccgagatgaaagctaatgatactcttcatctcaatggtacaaacctgacagatattaaaggcgctgttgttaaaattaacagctaa

SEQ ID NO: 216 - DNA, 1092 bp, Enterobacter cloacae
tatgtagaaggatttttgaacatgggacagcctgccgccagagcgaccatagatgtcagcgcacattcggggccaatacagtccggaagcccggacgtcatcatcggtggttttcccgccgctcgaaagggtgatacgttatcctgctcgacgcacggcagcggtattattgtggggggctccggtactgtcttcgttaacggtatgccacttgcacgtcaaggagacaagacgaagtgtgatgttagcggctcaccggcacctgccataccgaaagcagcagcacctcaatattgggggggcacgctggcgaaaaatgccggcgaagatgggatgatgcacggcgaacattttgatgctcgtgttctgggtgcgtacgccagcctcgaagataaaaacctcaacggtgattttgataccgcttcagctggttttgcgttggcagatattacaattgggaatatgaaaagtaaggatctgctacgggcagaaatgcgtaataaactcgccgtcgccaatgcgacggggtctctgtatggtggcggcaacgatatttatggcttgaatgcgaatgccgctgcgacaggtgaacaatacggtggttcggttgctgcgggtaaagaaggaacgttgtatggtggagtatcaggggatgtaactattggtacagcagaagctaaagccgtattagaagtctataccggcaatgatgggaagtatggtttgactgctgacgccggtgcggaagccaaaggaatgaaaggcgaagtttcgggtaaccttgatattctgggcatcgtttccggagaagcaaaaattgacggtagctttgggtctgctggtctcgcgggaggtggaagcgctttctgggacactaaagattattccgttaacgtcagggtgactggtggggctgcagggcttgtatggcttaagggtgatgcaagtctgaaagtggcatttaagcctatactggatttctttgactatttgtatggcgaagaggatgagccagccgtcacctctgttctgacagaaagcggggatgggacaattattaccgggtgtgttactgttttgataggcgattaa

SEQ ID NO: 217 - DNA, 390 bp, Enterobacter cloacae
aagcgcgatactatttattcaacgcaggagatcctaatgtcaccattttcaacactacaactcttcaaaaatctgtcagatgaaacccgtctaggcatcgtgttaatgctcaaagagatgggagagctatgcgtatgtgatctctgcacggcgctagagcagtcgcagcctaagatctcccgtcatctggcgatgctacgtgaaagcggattgttgctggatcgcaagaatgggaaatgggttcactaccgcttatctccgcatattccttcatgggctgctcaggttattgagcaggcctggttaagccaacaggacgacgtacaggccatcgcccgtaagctggcatcagctaactgctctggtagcggcaaagctgtttgtatctaa

SEQ ID NO: 218 - DNA, 393 bp, Enterobacter cloacae
catctaaaagctgctgcggtggtaatacttcttgttgctgaaatgtcaggaggacatatgaaattcttacagaatatcccaccttacctgttttttaccggtaaagggggcgtcggtaaaacctctatttcctgtgccaccgctatcagcctggcggaacaaggcaagcgggttttgcttgtcagcaccgatccggcttcaaacgtaggccaggtgttcagccagactattggcaataccattctgccggtggcctctgtaccgggtctttcagcgctggaaattgatcctcaggccgccgcccaggaatatcgggccagaatcgttgatcctatcaaaggcattctgccggagtcttcaccacggggctggcaggacccgagcttagcgaag

SEQ ID NO: 219 - DNA, 333 bp, Enterobacter cloacae
gctttcattcggagaactatcatggaaaacattgcgctcattggtatcgatctgggtaaaaactctttccatattcattgccaggatcgtcgcggcaaggctgtttaccgtaaaaaatttacacggccaaagttaatcgaatttttggcgacatgccccgctacaaccatcgcaatggaagcctgtggtggctctcactttatggcacgcaagttggaagagttggggcattttcctaagctgatatcaccacaatttgtccgtccattcgttaaaagtaacaaaaacgagttcgtcgacgccgtctttaccaacggggcaggaagcaccata

SEQ ID NO: 220 - DNA, 954 bp, Enterobacter cloacae
tttatgaacatcaaaagattggtactcagtgctctggttgtaggtacatcctcatatcttacggggtgctccatcggtagttccgaatccgaatgtccaggcattgaaaagggcgttatctgtaaaggtcctcgcgaagttatggagttaactaataatcgagatgatctgtctgcactggcgggggaagagtcggaatcgggaaaggagaaatcggctgtcaatgacagccgttatccaactgaaattagccctccaggggaagtcaaatatccacagtctactacccttaaaaatcagcctgtggcttattcaaaaaccgaaattaagccagttggtcagttacctgtcatgtacgataaaactttaaaaatgggtgcccctacttcatccattggaccacggcctatttctggtgtaccggttaattcaaacgtaaggatgactatcagttatagcactgcctcttcaactggtaaccctttcgttcatccggctgcggaagtcgttaaacaaacaagctatccggtttctgctggaaatgccccacgctacgttgcacctaattctgatatcagccctggtaaggatatgtactctctttacaatggccagcccgttaacccgactctcaaccctgggcagatccagcaataccgttcgcaaggttataaacaagctgtagtggctcctgaaccacttgctgttctgcaacaggggaaagtaatgagaattacttttgcaccttataccgatgataacgatgcgcttaatcttcccggctacgtttatgtcaacgtaaaaccgcaaacatggattgctggcaagaattcgacctcaaacccagctcgcatagttcctttagaagtacaggatgcggcccgggaaaatatgcagcagcaacaaaaagcaactaaagctgtctcttcgaacggcattgttagacaactgtaa

SEQ ID NO: 221 - DNA, 1770 bp, Enterobacter cloacae
accccgcgaaagaactcccggtgggctgaaggtttcatagacgttaacactatgaaaaggcttaatgaacaagttaacgttcccggccgtaagtatacagtcacagaaaatcatttctcatcagtcacacaaagtgacgacgaatctgagcatcgttacttcaaacaactttccgttgtaaagtttcctgaatacgtcaatttcggttgtatgtatgagttagtagttaactggatgcatggacgtaagacaattttcagcccatttatgatcactcagactgttcagtttgccgatccgctcaagttgtcaaaagaaaacgtccgctacaaagcaatcactaataaacaggcaagtataccttcagttgtcacattctgccctcgcctgcgggatatggataatgactacatggccgtaactcgcgagcttgaggatggcgcaaagcttttaagagggtatcttactttcactgttatgggtagtaatgccaattctgtgcagacagcagctaacgatctcaaatccttttacctcgaaagccgggtcaaagtagcagatgattcctttatcgttttcccgtcatttatgtcatgtctgccaatgtgcaatgacccaaagacaattttcgaccttgaccgttccgaagtagtgagcaacaccggagcggctcatatgacaccgatctttgggccctggaaaggtaatacagatagaccagtactgagtttagtttctcgtgaaggtcaactcatgggacttgatattttcaagacttctgcaagctataacatggttattggtgcaacgtcaggtgcagggaagtcattctggacagcatatctaatcaataactatcttggagctggaccgcgatctaataacctcgttcattatcgctcaacatttaagcattttttagaaaacgaatacccagatgatgatcctgacggtgctcaagtatttgttgtggacgtgggccgttcttaccaggggattgcggaacaatatacaaacagtcaatttattgatttcggtaaaacccctgacttcaccctaaatccctttgccttcctaactgacatcactgttaacgacgatgtatttaacgaagcacctgaatttaccggtgaatcaacttcaaacgatgcagaaaaagacaaagttgctcagaccataatggttttgaatcagctaaaaattatggcttcagagaaaggccttatcgatgattatcaacaatcagtgatgcttcagcttattgcagaagagtaccaagaatccagaaaatcaggtcggaccggttcaataaccggctttgctctgcgttgcaagaagcatgaagacaaacgtataaaggatattggggagcaactcggagcatggtgcgaaggtggaatttatgggcaccggtttaccgatacgttgcctccaatcaacttcgacagcagatttattgttttggaactggaggagctaaaaggcaccccccaccttcagacagttgtattaatgtctatcattcaggctgctcagcatgcaatgttcatcaaaaaagatgggcgtcgtcgcttgttcatccttgatgaagcatgggagtacattcgtcctgataattcatcaggtgccggaaatcaatcaaaccaattcttctcttccttcctcgaagcggcatggcgtatgttcaggataacaaactgcgctggcatctgtatcacacattcctttgaaaaattatttacttcttctgttgggccggcccctgaatgc

SEQ ID NO: 222 - DNA, 1548 bp, Enterobacter cloacae
tcttacacgcatagcggcggaccttccggccccgtggtgaagactcagtcgtccggtgaatacttgttggaaatgaccggtgtcaataagtcattccccggtgttaaggcgctcgataatgttaatttaaaagttcgtcctcactctattcatgcattaatgggtgaaaacggtgcgggtaaatcaacattattaaaatgcctttttgggatctatcaaaaagattctggcagcattctttttcagggaaaagagatcgacttccattcagcgaaagaagcgctggagaacggtatctcgatggtacaccaggaattaaacctggtcctgcaacgttcagttatggataatatgtggttgggtcgttatccaaccaaaggtgtctttgtcgatcaggataaaatgtatcgcgacaccaaagccatttttgatgagctggatattgatatcgacccgcgcgcccgcgtcgggacattatccgtttcccagatgcagatgatcgaaattgccaaagcgttctcctatgatgcgaaaattgtgatcatggatgaaccgacatcgtcattaacggaaaaagaggttaaccacctttttaccattattcgtaagctgaaagatcgcggctgtggcattgtctatatctcacataaaatggaagagatcttccagctgtgcgatgaaatcaccatcctgcgcgacggtcagtggattgccacccagccgctggaagggctggacatggacaagatcatcgccatgatggttggccgttctctgaaccagcgcttcccggataaagaaaacaagccaggcgaagtgattctggaggtgcgtaacctgacctcgctgcgtcagccgtctatccgcgatgtctctttcgatctgcacaagggggagatccttggcatcgcagggctggtgggcgctaagcgcaccgatatcgtggaaaccctgtttggtatccgtgagaaagccgaaggcaccattacgctgcacggtaagaagatcaacaaccacaacgccaacgaagccattaataatggctttgcgctggtgacggaagagcgtcgttccaccggtatttacgcttatctggatattaactttaactcgttaatttctaatattcgcaattacaaaaacaaggtcgggctgctggataattcccgcatgaagagcgatacccagtgggtgattgactccatgcgcgtgaaaacgccgggccaccgcacgcaaattggctcactttcgggaggaaaccagcagaaagtcattattggtcgctggctattaacccagcctgaaattctgatgctggatgaacctacgcgcggtatcgacgtgggtgcaaaattcgagatttatcagcttatcgcagagctggcgaaaaaagataaagggatcattattatttcttccgaaatgccggaattgttagggatcacagaccgtattctggttatgagcaatggtctcgttgccggtattgttgaaaccaaaacgacaacgcaaaacgaaattttgcgtcttgcgtctttgcacctttaa

SEQ ID NO: 223 - DNA, 1026 bp, Enterobacter cloacae
gatcaggggctcctcatgagtgcgttaaataaaaaaagttttctcacttatctgaaagaaggcggtatttacgttgttcttttagtcttgctggcgattattattttccaggaccctacgttcttaagtctgctgaacttgagtaacattctgacccagtcttccgtacgtattattatcgcgcttggcgtggcgggacttatcgttacccaggggactgacctttcggcagggcgccaggtgggtctggcggcggtcattgcggcgaccctgttgcagtcgatggaaaacgccaacaaggtattcccggagatggcgaccatgccgattttcgtggtgatcctgatcgtgtgtgccatcggcgcggtaattggcctgattaacggcatcatcattgcttacctgaacgtgacgccattcatcactacgcttggcacgatgatcatcgtttatggtatcaactccctgtactacgatttcgtcggcgcgtctccaatctctggcttcgacagcggcttctcgaccttcacgcaggggtttgttgcgctcggcagcttccgtctctcctatatcaccttctatgcgctgattgcggtggcattcgtctggatcctgtggaacaaaacccgcttcggtaaaaacatctttgctatcggcggtaacccggaagcggcgaaggtctccggggtcaacgtggctctgaacctgctgatgatttatgccctgtccggggtcttctacgccttcggcgggatgctggaagcaggccgtatcggctctgcaaccaacaacctcggctttatgtacgaactggatgcgattgcggcctgcgtggttggcggcgtctccttcagcggcggcgtgggtaccgtgctgggcgtggtgaccggtgtgatcatcttcaccgttatcaactacggcctgacctacatcggtgtgaacccgtactggcagtacattatcaagggtgcgatcatcatcttcgcggttgccctggattcactgaagtacgcgcgtaagaaataa

SEQ ID NO: 224 - DNA, 876 bp, Enterobacter cloacae
ttacttttgattaaaaccaggagtcaaacgatgagtaaagtgaaaaccatcacccgtgaatcatggattctaagtacctttccggagtggggtagctggctgaacgaagagatcgagcaggaacaggttgctcctggcacatttgcgatgtggtggctgggctgcaccgggatctggctgaaatcagaaggcggcgccaacatttgtgttgatttctggtgcggcaccggcaaacagagccacggcaatccactgatgaaaaaaggccaccagatgcagcgtatggccggcgttgaaaagctccagccgaacctgcgcaccacgccttttgtgcttgatccttttgccattcgccagatcgacgccgttctctctacccacgatcacaacgatcatatcgacgtgaacgtggcggcagcggtaatgcaaaactgcgcggacgacgtaccgtttatcgggccgcagacctgcgtggatttgtggattggctggggcgtgccaaaagagcgctgcatcgtgatgaagccgggcgacgtggtgaaaatcaaagacattgagattcacgcgctggatgcctttgaccgcaccgcgctgatcaccctgcctgccgatcagaaagccgcaggcgtactgccagacgggatggacgagcgcgcagtgaactatctgttcaaaacgcctggcggttccctgtatcacagcggtgactcccactactccaactactacgcgaagcacggtaacgagcaccagattgacgtggcgcttggctcttacggtgaaaacccgcgcgggatcaccgacaaaatgaccagcgcggatatgctgcgtatggccgaagcgctgaaaacccaaatggtgaatcccgtccaacaa

SEQ ID NO: 225 - DNA, 804 bp, Enterobacter cloacae
caccaaccacacagggattgccccttgtgttctcattttctggagagagttatggagatcctctacaacgtctttaccgttttctttaatcaggtaatgaccaacgccccgctgttgctgggtatcgtgacgtgcctggggtacatcctgctgcgcaaaagcgtcagcgtgattatcaaaggcaccatcaaaaccatcattggttttatgctgttgcaggcggggtctggcattctgaccagcacgtttaagccggttgttgccaaaatgtcagaggtgtacggcattaacggcgccatctctgacacttacgcgtccatgatggccaccatcgatcgcatgggagatgcatacagctgggttgggtatgcggtactgctcgcgctggcgctgaacatcatttacgtgctcctgcgccgtatcaccggtattcgcaccatcatgctcaccgggcacatcatgttccagcaggcgggtctgattgccgtttctctctatatcttcggctacccaatgtggaccacggtcatctgcacggcagtgctggtctcactttactggggcatcacctccaacatgatgtataagccaacgcaggacgttacggacggctgcggtttctccatcggtcaccagcagcagttcgcctcctggattgcttacaaagtcgcgccgtacctgggcaaaaaagaggagagtgttgaagatctcaaattgcctggctggctgaatatcttccacgacaacatcgtctccacggcaattgtgatgaccattttcttcggcgccatgtcttcacacacg

SEQ ID NO: 226 - DNA, 388 bp, Enterobacter cloacae
acccgccgctccagcctgccgcgaggccatgacatgcgaggtgactgtcggcggtgccagcctgcgtctgtccggggatttatcacctgcacttctgaaaacgctgatccgcgagctgaccgggaggagccgatgatacccttaccgtcaggcactcgtatctggctggttgccggggtcaccgatatgcgtaagtccttcaatggtctgggcgaactggtccagcatgttcttgatgacaatccgttctccggccacctgtttatcttccgtggtcgtaaaggtgacaccgtgaggatcctctgggctgatgctgacggtctgtgtctgtttaccagacctctggaagagggactgtctacacgccgcgatggaagagagaaagtgg

SEQ ID NO: 227 - DNA, 420 bp, Enterobacter cloacae
tggactctatcaatgtcaaacactcttcagccccgcagggcgcgggcgtcctactcaatggactttaagctggctctcgtcgaaaagtcatatcagcctggagcctgtgttgcccggttggcgcgggataatggaattaatgacaatctgctgtttacctggcgccagcgttacagacatcttctgcccgatgaaatacaacggtcaatcagagagcaagactctgttatccccgttgtcctgcctgatatggccctgtcacaccatgctgagccgcactatgaacccgccgctccagcctgccgcgaggccatgacatgcgaggtgactgtcggcggtgccagcctgcgtctgtccggggatttatcacctgcacttctgaaaacgctgatccgcgagctgaccgggaggagccgatga

SEQ ID NO: 228 - DNA, 633 bp, Enterobacter cloacae
tctggagccgttatgatgaacaagctacaggaacgatatgctcgcataattgcgataatgaacaataaaggtggtcctggtaagaccagttcggctaccaatctggctgttcactatgccagatcagggaagcggacgctgttgattgactcggaccagcaggccaatacgacagaagtcaccgcaaatggtaaaaagtactattccatgtatggtccaactatttgcgatctctacagcaattctcgatttgatatccgcgatgtcatcatccccgcgatggccggtgatgctcctatccctaacctggatctgattccgtctgacccgacgttcgaaaaaattattgaacagacccttacccgcagtcaccgcgaaaaaatcctgggccgtcatctcgagaaagttcgcactgaatatgattacatcattattgactgtgcacctgggctcaatatcgcaaccggcaatgcaatttttatcgccgatcatgttctggtacctgtcgatggcgggagtttttctctgagtggtcttgaaatcatgctggactatatggatgagatctctgaggaagattatgcacgcttcagtgtcttcaccacagagcgcgacggatccgcgctagaatat

SEQ ID NO: 229 - DNA, 1212 bp, Enterobacter cloacae
  unsure (82)
acctgcttcatattgggagcaaatatggaccgcgtctctcattttgtcctggcacttgttgtcgttactgcacttgcattgntggtcagcacagaccgcaaaaaaattcgtatgcgctatgttgtccagctgctggtcattgaagttttacttgcgtggttcttcctgaactccaacgtaggcctcggcttcgtgaaaggcttctccgaaatgttcgaaaaactgctcggatttgccaacgaagggaccaacttcgtctttggcagcatgaacgatcagggcctggccttcttcttcctgaaggtactctgccctatcgtcttcatctctgccctgatcggtatccttcagcacatccgcgttctgccggtggttatccgtgcgatcggcttcctgttatcgaaagttaacggcatgggtaaactggaatcctttaacgcagtcagctcactgatcctcggtcagtctgagaacttcattgcgtataaagatatcctcggcaagatgtcccgtaaccgcatgtacaccatggcggcaaccgcaatgtctaccgtttccatgtctatcgtgggcgcgtatatgactatgctggaacctaaatacgtggttgcggccctggttctgaatatgttcagcacctttatcgttctttcgctgattaacccgtaccgcgtggatgccagcgaagagaacattcagatgtctaacctgcacgagggacagagcttcttcgaaatgctgggtgaatacattctggcgggtttcaaggttgcaattatcgttgccgcgatgctgattggctttatcgcgctgatcgctgcgctgaacgccctgtttgcggccgtactcggtatctccttccagggcattctgggctatatcttctacccggttgcctgggtgatgggtgtaccggctcacgaagcgttgcaggtgggcagcatcatggcaacgaaactggtatccaacgaattcgtggcgatgatggatctccagaagattgccagcacactctccccacgtgcggaagggatcctgtccgtcttcctggtctccttcgcgaacttctcttccatcggtatcatcgctggcgcgattaaaggcctgaacgaagagcagggtaacgtggtttctcgctttggcctgaagctggtttacggttcaacgctggtgagcgtcctgtctgcctctattgcagcactggttctgtaa

SEQ ID NO: 230 - DNA, 651 bp, Enterobacter cloacae
  unsure (249)
aatttggaaatccctattccaggttggaaaagcgattggcgagatcatccacccctgacggttttatttccggtgattggtcatttaaacttgagcaaccggttgaacttgaagttgttggaaaaattgttgatgtggatgcgcagcaatcggtccggacgtgcaggaacgcgtttctccgtcaatctgatgccgctgacgctgatgcaaaatgagattgcggctgagatcattgccctttttgaacgntacgccattgcgccgcaaaatatcatcattgagatcaccgaggaacaggctttctcagactcgggaagcagcatcaaaaatattcagcagctgcgtgattacggcttccgcattgccatagacgactttggtaccggctatgccaactttgagcgcctgaagcggctggaggccgatatcattaagatcgatggttgcttcgtgaaagatatctgcaccgacagcatggatgcgatgatcgtgcagtccatttgcaacatggcaaaaacgaaatcgctgtgtgtggtggctgaatatgtggaaacggctgaacaacgcgagatgttgttgcgatttggcgtagattatttgcagggctatttgattggtaaaccccagcctctgacggcgctggaagcataa

SEQ ID NO: 231 - DNA, 873 bp, Enterobacter cloacae
tatatggatcaggctggaattattcgcgacctgctcacctggctggaaggtcatctcgaccagccattgtcactggataatgtggcggcaaaagcaggctattccaagtggcatctgcaaaggatgttcaaggatgtcaccggtcatgctatcggtgcctatattcgcgcacgtcgtttatcaaagtctgctgttgcgttgcgcctgaccgcgcgaccaatccttgatattgccctgcaatatcgtttcgattcacagcaaactttcacccgcgcctttaaaaagcagttctcgttaacgccagcgctttatcgccgctcgccggactggagctcctttggtatgcgtccgccgctgcgtctgggcgagtttgcgatgccaaaatatgaaatcatcaccctgccagaaacgcacctggtcggcaccacgcagagctactcctgttcccttgagcagatctccgagttccgccatcagatgcgcgttcagttctggcgcgaatttttaagccatgctccggcgatcccgccgattctgtatggtttgaacgaaacgcatccaagccaggaaaaagatgacgagcaggaggtgttctataccacggcgctgacgcctgatatggcgaacggttacattcatggctcgaagcctgtcgtgctggaaggcggcgagtatgtgatgttctcatacgaaggtttaggaacgggcgttcaggagttcatcctgaccgtttacgggacctgcatgccgatgctgaatctgaatcgccgtaaaggtcaggacattgagcgctactatccggcgcaagatgctaaaccggaagaaggccctatcaatctgcgtatggaattcctgattccggtacgtcgttaa

SEQ ID NO: 232 - DNA, 201 bp, Enterobacter cloacae
ctcatggagagcgaagcgcgccgcttcatcgcgctggtagatgagttttacgagcgccacgttaagctggtggtcagcgccgaggtgcctttatatgagatctatcagggcgagcgcctgaagtctgagttccagcgctgcctgtcgcgcctgcaagagatgcagagcgaagagtacctcaagcgtgagcatatgccgtaa

SEQ ID NO: 233 - DNA, 432 bp, Enterobacter cloacae
ggtccgcctaccaggccggttaagagaccaaagttggacgaagatgagattggacagcgcttgctgagcattccctgcgtcggaacactgacagcgagtactatttcaactgagattggcgacgggaagcagtacgccagcagtcgtgactttgcggcggcaacagggctagtgcctcgacagtacagcacgggaggtcggacgacattgctgggaattagtaagcgaggtaacaaaaagatccgaactttgttggttcaatgtgccagggtattcatacaaaaactggaacaccagtctggcaaattggccgattgggtcagggatctactgtgtaggaaaagcaactttgtcgtcacttgtgctctggcaaacaagctggccagaattgcctgggccctaacggcacgacagcaaacttatgtagcataa

SEQ ID NO: 234 - DNA, 882 bp, Enterobacter cloacae
aaaggacttctagttatgcaagaacaagagatatggacgcctcaaaaagcagctattcggctaacaaaaatttgcgatactttcagtgagattcacggcacagaacgatttcctgttaatgttgaggaattgtctctggaggcggcagagttgttcaaatgggctgaccctatagtaaaaatagaacccgttgacatcaaaggatttgatggtgcattaatggccaatgaatctcgcagccgttggatgctactttacaataacggtttaacatcccctggtagaattcgattcactcaggcacatgaactgggacattacatacttcatcgtctaattcgtgatgagttcagatgtagcagtgatgatatgttatcctgggaagataaaaatattgaatcagaagcagatttatttgcttcttatttactgatgccattcaatgacttccgaaaacagttgacgccagacgttgatattgacgtattaagtcagtatgcgattcgttatggagtatcgctgacagcagctgcattaaaatggcttgaatgcactgaagaaaatgccgtattcattttatctcgtgacgggtacatgaaatgggccttttccagtcccgcagctcgccataacggagccttctttcgcacacaacgcaatgtggtaagtattccagaaggatcgattgctgcaaaccagaacatttcaatggaaagagcaggaatgaagatccctgcatcaatttggttccctcatgcagataaagacgcttcagtgcgtgaaatgaaaatacattcagaacagtatgaatatgtcatcacccttctaatcctttcccgaaaaacaactgtatggcctccttttcatggggaagatgagtaa

SEQ ID NO: 235 - DNA, 294 bp, Enterobacter cloacae
tgtcttcataagccacatgaggacatccccatgaagaagcgtttttccgacgaacagatcatcagtattctccgcgaagccgaagctggggtacccgcccgtgaactctgccgcaagcatgccatttccgatgccacgttttacatctggcgtaagaagtatggcggtatggaggtgcctgaagttaagcgcctgaagtcgcttgaggaagagaacgccagactcaagaagctgcttgccgaagccatgctggataaagaggcgcttcaggtggctcttgggcgaaagtactga

SEQ ID NO: 236 - DNA, 185 bp, Enterobacter cloacae
  unsure (171)
agaggcgcttcaggtggctcttgggcgaaagtactgacgacagaccaaaagcgggaaaccgtgatgttgatgtgtgatgcgaacggtctgtcgcaacgtcgtgcctgcaggcttacaggttttatcctgtcgacctgccgctatgaggctcaacgtccggctgctgatgcncatttatcagggcg

SEQ ID NO: 237 - DNA, 513 bp, Enterobacter cloacae
aacctcaatttttgccacatcagcctaactgtcctatctgcaatgaacataactgagttagtttttatagatgatgattacaatcatgtcgtcatcatgagtgatgttgtgcagcggttacatttatatcgtcaattacattatgccagtaccgaggcaggaggaacccttattggagaacgtcgagggaaacatattgtcatcactcacatatcagaacctggatcaggtgatgtaagatcgcgaacacgaatagaaagaaaaggagaacatcatcagcaaaaagtggatgacttatttcagcaatcagatggttctctagtctatttgggcgaatggcatacgcatcccgaagatttcccacagccatcaagtactgatatgaggtcttggcgaaccggactgaaagcgaccgagccaatggttttgcttattatgggtaggaaacaagcatggtgtggtaaaaagcatgggaatgtcataaaaaaattagaagaaaaaaacaatcattga

SEQ ID NO: 238 - DNA, 1122 bp, Enterobacter cloacae
ataatggtctgtcatatgaccccccctgttgctctatttaaagggtgtgtgatgcaagatcttcacagtaaagactcagtaatcaatcattatgccgatcgttatcaatgttatatgccaattgatgtccgtaatggattaagaagcaatagtatagatgcgtcgaattcatctctcccatgggatgtaacattacctttagtcacgactgaagatgtttcacgtgataaagcgcttggggcgtttgtgggattggctgttggggacgccgtcggcaccactcttgagtttaagaaaagagacagtgaacatgtagcagatatgattggtgggggaccttttcaattaaaacctggtgaatggacagatgatacgtccatggcattatgtctggcagagacttatctttcagaaaacagaatgcacaccgatgtgcttagaaaatatctcctgaaatggtatcttgacggagagaatagcagtaatggtcggtgcttcgatatcggcaatacgacgcggttcgcgcttgaacagtatatgcgtgtcggaccttcctggtatggtaatacagagaaacacactgctggtaatgctggggttattcgtcaagcaccggtatctatctttcgtcgaaaatcactgcgtgcgatttacttcgaatcacaggctcagagtcgagcaacgcatggcgcggtagaatcaattaacgcatgccaatttctcggattggtattgcactatttaatcaacggttatcaaaaagaaggagctttttcgcctcatgttttcccactgtgcgcgcgtgtaatgatcataaacgcgggtgagtataagcaaaaaactcgcgaccagattcgttcaagtggttatgttatcgatacgcttgaggctgcgatgtggtccgtatggaatacggataatttccgtgatgccattctgctggcagccaaccttgccgatgatgctgacagcgttgcggcgacggcgggacaaatagcgggggcgttgtatggttattccgctatcccgcaggactggaaagataaactcgtacaacacgaacgtattgccacaatggcgggtaaactattcgatagagcacctgaggataattttttatag

SEQ ID NO: 239 - DNA, 249 bp, Enterobacter cloacae
tttgatacgagccaggtgaggatgagaacgatgaaaaaatgggcagtaattatctcagcagtcggtttagcgtttgcggtatcgggttgtagcagcgactatgtcatgtcaacgaaagatggtcgtatgatcctgaccgatggcaaacccgaagtcgacgacgataccggtctggtgagttaccgcgatcgcgaaggcaatcaaatgcagattaatcgcgacgaagtctcccagatcatcgagcgctaa

SEQ ID NO: 240 - DNA, 459 bp, Enterobacter cloacae
aaaaggaaaccggctatgcattatcatcgtatcccccacagcgctctggagatcagccaactggggttgggcaccatgacatttggtgaacaaaacagcgaagccgatgcccatgcacaactcgattacgccgtcagccagggcattaacctgattgacgtggcggagatgtaccccgttcctccccgcccggaaacacaaggtcttactgaaacgtatgtcggcaactggctggcgaaacgcggcaatcgcgaaaagctggtcatcgcctccaaagtcagcggaccttcccgtaataacgatgccgggatccgccctaatcagatcctcgatcgcaagaatatccgtgcggcgctggatgcaagcctcaagcgcctgcaaaccgactatctcgatctttatcatgtgcactggccgcagcgtccgacgaactgcttcggtaagcttggctacacctga

SEQ ID NO: 241 - DNA, 324 bp, Enterobacter cloacae
aacgaaagtgctccggccgttaccctgctggaaacgctggaaacgctcacggagtgccagcgggcgggtaagatccgctacatcggcgtttccaacgagacggcgtttggcgtgatgcgctatctgcatctggccgataaacacgatctgccgcgcatcgtgaccattcagaacccgtacagcctgttgaaacgcagttatgaagtgggtctggcggaggtgacgcagtacgaagaggtggagctgctcccccaactcctgtctgggcttcggtaccctgacgggcaaatacctgaacggcgcgaaaccggctggcgcgcgtaa

SEQ ID NO: 242 - DNA, 729 bp, Enterobacter cloacae
aatatcagctcattttttaatcaaaaggttgttagtatgcattctctcgccccactgctctcccctcccgtcagtgaagcccagttgctccagcaggcgcaacgtctggcaggctattcactgggcgagctggccgtgatggcggggttgacgatacccaacgatctgaagcgtgataaaggctggatcggcgtgttgctggaacgctggctgggcgcaagcgcgggcagtaaacccgagcaagattttgcggcgctgggggtggaactgaagacgatccccatcgatagccaggggcggccgctggaaaccacctttgtctgcgttgcgccgctcacgggtaacagcggagtgacctgggaaaccagccacgtcaggcataagctgaagcgggtgttgtgggtacccgttgagggcgacaggcagatcccgctggcagagcgtcgcgttggcgccccgctgctctggagtccgaatgatgaagaggagagactgctttcccaggactgggaagagctgatggacatgattgtgctgggacaggttgagcggatcaccgcccggcatggcgaaatgctgcaacttcgtcctaaagccgccaatagcaaagcgctcactgaagcggtatgcgcacagggcgaaccgatcctgacgctgccgcgcggtttctatcttaaaaagaatttcaccggggcactgctggcacgccacttcctgttgaaaacatag

SEQ ID NO: 243 - DNA, 375 bp, Enterobacter cloacae
cgcagtacgaagaggtggagctgctcccccaactcctgtctgggcttcggtaccctgacgggcaaatacctgaacggcgcgaaaccggctggcgcgcgtaacacgcttttcagccgcttcacccgctatagcggcgagcagacgcaaaaagccgttgcggcctacgtggatatcgcgaaacgccacggactcgatccggcgcagatggcgctggccttcgtgcgtcgtcagccatttgtggcgagtaccctgctcggcgcaacgacgatggatcagttgaaaaccaatattgagagtttcaatctgaacctgagtgaagaggtattagcggagatagaagcggtgcatcaggtttatacctacccggcaccgtaa

SEQ ID NO: 244 - DNA, 354 bp, Enterobacter cloacae
accgtcgcgcgctgcatgcctgcggggatcgtgattggcgtcggcgttctgttcttctccctgcaacatgccctattgcctgcctatgccctgctgttgctgatcggcatgttaggcggtttctttgtggtgccgctaaacgcgctgttgcaggagcgcggcaagcagaccgttggggcgggtaacgccattgcggtgcaaaaccttggtgaaaacatggcgatgttgctgatgctggggatttactcgctggcggtaaaagcaggtgcgccggtcgtggcaatcggggtaggattcggcgcgctgttcgcgctggcgattagcgggctgtgggtctggcagcgtcgtcgttga

SEQ ID NO: 245 - DNA, 915 bp, Enterobacter cloacae
agtccgggtggaggaatgatgcgaatgaagagaaatttgaaggccatacctgttctggtcgccggtttgtttacctcacagctttctattgcggcgggctccgtctctgcagatccccacgccgggcacgacatgtctgccatgcagatgccagcagatgagaatttcactgagatgacgtcaatggagcccattgtaactgagagcagaacgccaattccgcctgttaccgatgccgaccggaaggctgcattcggcaatttacaggggcatgcgattcacgacagtgcgattaattatctggttctgctggatcaactggaatggcaacggtcggataacaccaacaatttcagctggagtgttaacagctggattggaggcgacacagatcggatttggctaaagagtgaaggtgaacgaagcaatggggaaacggaggcggctgaagcgcagttactctggggacatgcggttggcccatggtgggatttggttgcgggtgtcaggcaggatttcagacctgcttctgcccggacctgggctgctgtcggttttcaggggctggcactctataattttgagtctgaaattacgggttttgtcagtaatggcggaaaagcagcccttcgtctgggaggagaatacgacgttttactgactaaccggctcatactccagccatcctatgaggtgaatttctacagtcaggatgatgaatcgcggggtcgcggcaggggactgactgacacagagctggggctccggctgcgctatgaaatacgccgtgagtttgcaccctatataggcgtttcctggaatcaactttacgggaaaacatccgatatggcgaaaagagaaggtgagaaagaccatcaggtagtattcctggcgggagccagaatctggttttaa

SEQ ID NO: 246 - DNA, 420 bp, Enterobacter cloacae
cgcactgatataaaacactcaactaaacaggtaaataaaatgtcgattttaaataaagccattcttacaggtggcctcgttatgggcgttgctttctctgctatggcccatccggaattaaaaagctctgtgccacaggctgattcagccgtagcggccccggaaaagattcagcttaatttctcggaaaatctgaccgtgaaattctcaggtgcaaaattaacgatgacgggtatgaaaggcatgtcatcacattctccgatgccggtcgcggcaaaagtggcgccaggcgctgaccctaaatcgatggtcattattccgcgagagcctttacccgctggcacttatcgtgttgactggcgcgcggtttcttcagatacgcaccctattaccggtaattacacctttacagtgaagtaa

SEQ ID NO: 247 - DNA, 1473 bp, Enterobacter cloacae
  unsure (2)
anacattttatgggcgtacagcctgatgatacctacgtttacacctttaaggttaagcagaacgggacttactggtaccacagccattccggtctgcaggaacaggagggggtatacggtgccattatcatcgatgccggggagccagaaccgtttacttacgatcgtgagcatgtggtcatgttgtctgactggaccgatgaaaatcctcacagcctgctgaaaaaattaaaaaaacagtcggattactacaatttcaataaaccaaccgttggctcttttttccgcgacgtgaataccagggggctgtcagccaccattgccgatcggaaaatgtgggctgaaatgaaaatgaatccgactgacctcgcggatgtcagtggctacacctacacctatctcatgaacgggcaggccccgctgaaaaactggaccggactgttccgtcccggtgaaaagatacgcttacggtttatcaacggctcggcaatgacctatttcgatatccgtatccccgggctgaaaatgacggtcgtggctgcagatggccagtatgtaaacccggttaccgttgacgaattcaggattgccgttgccgaaacctatgatgtcattgtggagcctcagggtgaggcctataccatcttcgcacaatccatggacaggaccggttacgctcgagggacactggccacgagagaggggttaagtgctgccgttccccccctcgatccccgtcctctgttgaccatggaagatatgggtatggggggaatgggacatgatatggcaggaatggaccacagccagatgggaggcatggataacagcggagagatgatgtctatggacggtgctgaccttccggatagcgggacatcctccgcgcccatggatcacagcagcatggccggtatggatcattcccggatggccggaatgccgggtatgcaaagtcatcctgcgtcagaaacggataacccactggttgatatgcaggcgatgagcgtctctccgaaattaaatgatccgggtattggtcttcgaaataacggaagaaaggttctcacgtacgcggatttgaaaagccgctttgaggatcctgacggacgtgaacctggccgtaccatagaactgcatttaaccggccacatggaaaagtttgcctggtcatttaacggaatcaagttttcagatgccgcaccggtgctgctgaaatacggtgagcggctcaggatcacgctgatcaacgataccatgatgactcaccccattcacctgcatggtatgtggagcgatctggaagatgaaaacggtaatttcatggttcgtaaacacacaatagatgttccccctggtacaaaacgcagttacagagtgacagcagatgcgcttggccgctgggcgtatcactgccatttgctctatcacatggaaatgggaatgtttcgtgaagtccgggtggaggaatga

SEQ ID NO: 248 - DNA, 273 bp, Enterobacter cloacae
agtaatattatgaacgacctgattatgattgttattcgttttcttctttatctggatttgatggtaatatttggattgccattttttcagatatatggaataagcggtgtcagacatgaaacctataacctgactaatttcaggtcgtttataacttttgctgttgttacaggcatcattcttactggcattaatatgctcctggtatctaatgccatgagtggagtaactgacctcagagaattatccatccatgttatcgagatggtgata

SEQ ID NO: 249 - DNA, 1362 bp, Enterobacter cloacae
acaaactcaaacagctcgcaggttaatttttactatatacagggcagtcatgctgccctgtcaggaggttttatgttactggcaggagcaattttcatcctgaccatcgtgttggttatctggcagccgaaggggttagggattggctggagcgccatatttggcgcaatactggcactcatatctggtgtagtacacattaccgacattctggtggtatggaatatcgtctggaacgccacagcaacctttattgccgtgattatcatcagtttgctgctggatgagtctggcttttttgaatgggcagcattgcatgtttcccgctggggaaatggccggggtcgcctgctgtttacttatatcgttctgctcggtgctgcggtagcagcgctatttgccaatgatggtgcagctctcatcctgacgccgatcgttattgccatgttgctggctctgggattcagtaaaagcgctacgctggcatttgtaatggctgcagggtttattgccgataccgccagcctgccgctgattgtgtcgaacctggtcaatattgtttctgctgacttcttccatctgggattcacggaatatgcctccgtgatggtgcctgtggatattgccgccattattgccacgctggtgatgctgcatctgtttttccgcaaagatatcccaccgacctatgatctgaaccgactgaaagaaccggctcttgctatcaaagacccggcgacgttcagaactggctggattgtattaatccttctgctggtaggtttttttgtgcttgagccgctgggtattcctgtcagcgctattgcggctgtgggtgctgctatcctctttttcgtggctaaaaaaggtcatgccattaacaccggtaaagtcctgcgtggtgcaccgtggcagattgtgattttctcactgggaatgtatctggttgtttatgggttgcgtaatgccgggctgacagaatacctctctggcgtattgaatttatttgcagacaaaggactttgggctgccacatttggcacgggattcctgacagcattcctgtcatccatcatgaacaacatgcctactgtattgattggcgcattgtcgatcgatggcagcaccgcatcgggtgtcatcaaagaagcaatgatttatgccaatgtcatcggttgcgatctgggacctaaaattacgcctattggtagcctggcaacgctactctggctgcatgtactttcacagaagaacatgacaatcacctggggatactatttccgcaccgggattatcatgactctgcctgtgctgtttgtaacgctggccgcgctggcgctacgtctctctttcactttgtaa

SEQ ID NO: 250 - DNA, 279 bp, Enterobacter cloacae
gatactgatatgagcaacattaccatttatcacaacccagcctgcggcacctctcgcaacacgcttgagatgatccgtaacagcggtacagagccgaccgttattcattatcttgagacaccaccatcacgcgatgaactggttaaacttattgcggatatggggatcacagtacgagcgctgctgcgtaagaatgtcgaaccttttgaagcgttagggctggcggaagaccgttttactgatgatcagttaatcgactttatggtaagcgttaagtga

SEQ ID NO: 251 - DNA, 336 bp, Enterobacter cloacae
aaacagaaaggccatgtctctacgccaatgatgcagcttcaggatccggaaagaacaaaagtattactggtcactctgccggaaacgacccccgttcttgaggctgcaaatttacaagccgatcttgaacgtgccgggattcatccatggggctggattatcaataacagtctttccatcgctgaaacccgttcaccgctgcttcgtcagcgctcgcagcaggaactgcctcaaatcgaggctgtaaagaaccagcatgctacccgtgttgcactggttcctgttcttgcggcagagccaaccggtatagacaaactcaaacagctcgcaggttaa

SEQ ID NO: 252 - DNA, 639 bp, Enterobacter cloacae
gatagcattgcgtggatgcctcgccccgctgtggtgaaaacgttgttcagcgcagagcgtgaaggtggcccgttgacagaagcggcatgctgggctcatgcgcggcgcaaaatccatgacgtctatatcagcacccggacggccacagcagaggaggctctgaagcgcatcagtgagttatacgcgatagaagaggaaatacgcggccttccggcatctcagcggctggccgccagacggtcccgaagtaaaccgttgctgatatccctgcatgactggttggtggagaaaagagccactctgtcgaaaaaatcccggttaggcgaggcgttcgcttatgcactgaaccagtgggatgccctgtgttactactgcgatgatggtctggcagagccggataataacgctgctgagcgcgcgctacgagcggtctgtctgggcaagaaaaactacatcttcttcggcagtgatcatggtggtgaacgtggtgccctgctgtatggtctgatcggaacgtgcaggctgaacggtatcgatccagagggttaccttcgccatatcctgagcgtattgccggagtggcccatcaacaaagtggccgaactgctgccatggaacgtagatctcaccaataaatag

SEQ ID NO: 253 - DNA, 426 bp, Enterobacter cloacae
agacagccgcagcctggttcacagccgatgcagacgcagctggtcacaccgtctaacgatccgggccaggttgcgccggttgaacctgaaccggttcaggaagatcaggagcaggccgccaccccttcagagccacaggcgcaacagcccaccggcattgagcagcagtggcgttcgtatcgcgtagagcctgggaaaactcttgcccagctgttccgcgaccacaatttgccagcaacggatgtgtatgccatggcgcaagtcgagggggcaggcaagccgctcagcaacctgcaaaatggtcagatggtgcagatccgtcagaacgccagcggcgtggtgaccgggttaacgatcgataccggcaacgggcagcaggtactgtttacccgccagccggacggcagtttcatcagagcacgttaa

SEQ ID NO: 254 - DNA, 462 bp, Enterobacter cloacae
gaggataaggtaatgcaagttattctgcttgataaagtagcaaacctgggcagcctgggtgatcaggtaaacgttaaagcgggttacgctcgtaacttcctggttccacagggtaaagctgttccagctactaagaaaaacgtagagtttttcgaagcacgtcgtgctgaactggaagccaaactggctgacgttctggcggctgctaacgctcgcgctgaagcaatcaacgcactgggcaccgttaccatcgcgtccaaagctggcgacgaaggtaaactgttcggttccatcggtacccgcgatatcgctgatgcagttactgcggcaggcgttaaagtggctaagagcgaagttcgtctgccgaacggcgttctgcgtaccactggtgagcacgaagttgacttccaggttcacagcgaagtgttcgctaaactggttgttaacgtagtagctgagtaa

SEQ ID NO: 255 - DNA, 246 bp, Enterobacter cloacae
attctggagactagccatatggcacgttatttccgtcgtcgcaagttctgccgtttcaccgcggaaggcgttcaagagatcgactataaagatatcgcaacgctgaaaaactacatcaccgaaagcggtaagattgtcccaagccgtatcaccggtactcgtgcaaaatatcagcgtcagctggctcgcgctatcaaacgcgctcgctacctgtctctgctgccgtacactgatcgtcatcagtaa

SEQ ID NO: 256 - DNA, 957 bp, Enterobacter cloacae
aacgcaattttatttatgagatttgtcatggatactgctctgcccacgcccgtctttgcccgtcgaaatgtggcctatgcctgcgccacgctctgctgtctgctttggggaagctcgtacccggccattaaaagtggctacgaactctttcagatcgcgaccgatgatatcccctccaaagtcgtctttgccggataccgttttctgtttgccggcgcgttgctgctgctttttgccctggcccagcgaaaaccgattggcaggctcacgcccacgcagtttggccagctcacgatcctcggactgacccagacctccctccagtacaccttcttttatatcggcctggcctacacgaccggggtgaacggctccatcatgaatgccaccgggaccttcttcagcgtgctgctggcgcactttatctaccacaacgacaaactcagctataacaaaacgctggggtgtgttctgggctttgccggggtgatgctggtgaacttccacagcgggttaagtgagttccagtttgtgtggaaaggtgacggatttgtggtgctggccgcctttattctctctgcggccacgctttacgggaaacgcatttcccagaccgttgacccgacggtaatgacgggatggcagctggggataggcggggcggcactggttgcgggaggctatgccacgggcgggacgctggaggtgcacagcatgaaagccgtcgccgtgctggggtatctgacgctgctctcatccgtggcgttcgccctgtggagcgcgctgctgaaagtaaaccgcgtgagtatgattgccccgttcaactttgtcatacctgtagcagggacggtgctctccgccattttcctcggcgataacattatggacattaaatacgcgattgcgctggtgttggtctgctcggggatctggtgggtgaataaacggcgtgcctga

SEQ ID NO: 257 - DNA, 287 bp, Enterobacter cloacae
  unsure (61)
cggaacggctgcaatggctggccgcactgctgctggatgcgctcaaaatccagcagggggntacgcttctgactcaccctgaggtgtgggcgttggtcaccacacttgcgaatcgcctgtcagggcagtcgctgcacgctatccttcatgatatctgccagagtcgtgaacaacttttgacggtaaccggggggggtctcaatcgcgagcttttactgaccgaccagttactgcgtatcgaacactacctgcaaccgggtgtcataccgccggtttcccacctctga

SEQ ID NO: 258 - DNA, 873 bp, Enterobacter cloacae
ccgaccagttactgcgtatcgaacactacctgcaaccgggtgtcataccgccggtttcccacctctgagagagacattatgtttttagtcgactcacactgccatctcgatggcctggattatcaatccctgcataaaaatgtggacgacgtgctggcgaaagccgccgcgcgcgatgtgaaattttgcctggccgtggcgaccacgttgccgggttaccgctccatgcgtgaactggtaggcgagcgcgataatgtcgtcttctcctgcggtgtgcatccgctgaatcaggatgaagcttacgacgttgaggatttacgccgtcttgccgcagaagagggcgtagtggcgatgggcgagaccggtctggactatttatacacccccgaaacaaaacctcgccagcaggaatccttccgcaaccacatccgtattggccgtgagctgaataagccggttatcgttcatacccgcgatgcgcgcgccgacacgctggcgatcctgcgggaagaaaaggtgacggattgcggtggcgtactacactgtttcacagaagacagagaaacggcgggtaagctgcttgatttaggcttttatatttcattctcggggattgtcacgttccgcaatgctgagcaactgcgtgatgcggcgcgctatgttccgctggatcgtattctggtggaaaccgattccccgtacctggcaccggtgcctcatcgcggcaaagagaatcagccagcgatgacccgggatgtcgctgagtatatggccgttctgaaaggtgtcagtattgaagagctggctcgcgtgacaacggaaaacttcgccagcctgttccatatcgaccccgcccgcctgcaatctgtctga

SEQ ID NO: 259 - DNA, 1467 bp, Enterobacter cloacae
  unsure (726)
  unsure (1401)
aaaaagcacaaatactcaggagcactctcaattatgtttaagaatgcatttgctaacctgcaaaaggtcggtaaatcgctgatgctgccagtatccgtactacctatcgcaggtatcctgctgggtgtcggttctgcaaacttcagctggctgccagccgtagtttcccacgtgatggccgaagcaggcggttctgtttttgctaacatgccgctgatcttcgctatcggtgttgctctgggcttcaccaataacgacggtgtatctgctctggcgtccgttgttgcttacggcatcatggtgaaaaccatggctgtggttgcgccgctggtactgcatttacctgctgaagagattgccgctaagcatctggcggacaccggtgttctcggtggtatcatctccggtgcgattgcagcgtatatgtttaaccgcttctatcgcatcaagctgcctgagtatctgggcttcttcgcgggtaaacgttttgtgccgatcatttctggtctggccgcgattttcaccggtgtggttctgtctttcatctggccaccaatcggtacggcaatccagaccttctctcagtgggcggcttaccacaacccggttgtggcgttcggtatctacggcttcattgagcgctgcctggtaccatttggtctgcaccacatctggaacgttccattccagatgcagattggtgaatacaccaacgcagcaggccangtgttccacggcgacatcccacgctacatggcgggtgacccaacggcaggtaaactgtctggtggcttcctgttcaaaatgtacggtctgccagctgccgcaattgcgatttggcactctgctaaaccagagaaccgtgcaaaagtgggcggtattatgatctccgcagcgctgacctcgttcctgaccggtatcaccgagccgatcgagttctccttcatgttcgttgcgccgatcctgtacatcatccacgcggtactggcaggtctggcattcccaatctgtatcctgctgggtatgcgtgacggtacgtccttctctcacggtctgatcgacttcatcgttctgtccggtaacagcagcaagctgtggctgttcccaatcgtgggtgcaggctacgcagtggtgtactacaccgtcttccgcgtgctgatcaaagcactggacctgaaaacgccgggtcgtgaagatgcaacggaagacagcaaagccggtgcgaccagcgaaatggcgcctgctctggtagctgctttcggcggtaaagagaacatcactaacctggacgcgtgtatcactcgtctgcgtgtgagcgttgccgacgttgcgaaagtagaccagccgggtctgaaaaaactgggcgcagcgggcgtcgttgttgcaggttctggtgttcangcaatcttcggtactaaatccgataacctgaaaactgaaatggatgagtacatccgcaacaactaa

SEQ ID NO: 260 - DNA, 531 bp, Enterobacter cloacae
gacagtaatgccctgatcggttctatcggtgtgcgtatggaccactggaatctgtcagagatcatgagcacagtaggcgtcaagaatgagccccttacggccggtgagttcaaagatgctcttgaccccttccacccattgtccgattcaacgagggagttcatgcagaaggagatcctgaacacgatgcatgaaaaatttataactgatgttgaacttggacggggtaaaaagcttctctcgcgtcatgatgccgatgctgtttctctctattcaggccgtgtatggccaacacctcaggcagttaagtacggcctggtggatggagatcttacgtcagtagagatccgtacacgtctttcaaaaatgtactccactgacacgttcaaaaactacaatgagcctcatcgtaatctccgttctgcactcggcatgctgatgagcctgtcttcaaatattgagagccttaccggtaccactacccgcttagtagaatctgttaatgccaccagctacccctctgtgaggtaa

SEQ ID NO: 261 - DNA, 738 bp, Enterobacter cloacae
ggtaacatggatgctttcaatctgctgtggagcattacgggggtagctttcattatccttattttcgtcgtgttgctgtgtctgttgggatttatgacctctgccatagcggaacggcggactgcaaaggcaattgaatctgggcttcctgaagaagctcaggggctacttagtgatctcacctttcagttgtcggctcatagcactacgcaggttgatcacattctcgtagccccacatggtatatacgtcatagagcagaaaaactacgtaggcaagctctacggtactctggaggaaagccactggcggaaatggactcagtcccgaaccctcaagttgcagaacccgtttaagcaaaaccaggggcacatcagggctattcagtctgctcttaaggctagagaactggaatgtatcaatgtcgtcatcataaacggacgttgtaagtttgatggcatcaagccggaatggttatgtatggggatggacgattttatccataaagtcaaacaacgacgagggctacggttgttcacaccggagtctgttcagcacatctgttcggtgttgaagtcaacaaggaagtcgccagggctctatacggaccttactcatattcataacataacgacaaagtacaaagccccgatgaaattcgagcaacgagtaacatacattctgctcaactttatccattatctgtgggcaagtctgttcactaagcagaagccttag

SEQ ID NO: 262 - DNA, 825 bp, Enterobacter cloacae
cggggcatgccagccagggtgtctcgtccagggatcacgggtaggagccaccttatgagtcagaatacgctgaaagttcatgatttaaatgaagacgcggaatttgatgagaacggagcagaggcttttgacgaaaaagccttagtagaagaggaacccagtgataacgatttggctgaagaagagctgttatcgcagggtgccacacagcgtgtgctggacgcgactcagctttaccttggggaaattggttactccccactgctaacggccgaagaagaagtctatttcgcacgtcgtgctttgcgtggtgatgttgcctcgcgtcgtcgcatgatcgaaagtaacctgcgactggtcgtgaaaattgcccgccgttacggcaatcgtggtctggctctgctggatctgattgaagagggcaacttaggtctcatccgcgcagttgagaagtttgacccggaacgcgggttccgtttctcaacctacgcgacctggtggattcgtcagaccatcgaacgggctattatgaaccagacccgtacgattcgactgccgatccacatcgtcaaagagttgaatgtttatctgcgtaccgcgcgcgagttgtcccataaactggaccacgagccaagtgcggaagagatcgcagagcaactcgacaaaccggttgatgacgtaagccgtatgctgcgtctcaacgagcgcattacctcggttgacaccccgctgggtggcgactccgaaaaagcgctgctggacatcctggccgatgaaaaagacaacggcccggaagacaccacgcaggacgatgacatgaaacag

SEQ ID NO: 263 - DNA, 1095 bp, Enterobacter cloacae
agacgtgttgcggcattatcactggtttcgctctggctggcaggctgtacaagttcaaataacgcgcctgcgcccgtcagttccgttaatggaaccagcggctcgggtaacacgtccagcggaatgttgatcacccctccgcctaaaatgggcacctcaacggcgcagcaaacgccgcagatccagccggttcagcgtccagttacgcagcccacgcagatacagccagtggaacagcctgttcagactgaaaatggccgcatagtgtataaccgtaagtatgggaacattccgaaaggtagctataccggcggcagcacctataccgtgaagcgcggcgatacgctgttctatattgcctggatcaccgggaacgatttccgcgatctggcacagcgaaacaacgtccaggccccgtatgctctggaagtcgggcaaacgcttcaggttggcaacgcgacggggacaccgcttacgccaggcaacaccgtttcagcagccgacgtaactgcgcaaaataacagcgtcacccctgcacaaaaaaccaccacggtggttgcttcacaacctgtaattacgtattctgaggattcaggtgatcagagtgctaacaaaatgttgccgaataataaaggtactgcgactgttgtcacagcaccgactacggcacctgtggttagctctactgtaccgactgcaagcagtcagaatgccagctcgtcaattaccacctggcgttggccaactgacggcaagatcatcgagaacttcgctacctctgaggggggcaacaaagggatcgatatcgcaggcagtaaaggacaggcaatcatcgcgaccgcagacggacgcgttgtctatgccggtaacgcactgcgcggttacggtaatcttattatcatcaaacataatgatgattacctgagtgcctacgcccataacgacacaatgctggtccgggaacaacaagaagttaaggcggggcaaaaaatcgctaccatgggtagcaccggaaccagttctacacgcttgcattttgaaattcgttacaaggggaaatccgtaaacccgctgcaatatttaccgcagcgataa

SEQ ID NO: 264 - DNA, 390 bp, Enterobacter cloacae
tcactgctgaattttcttatcccaaagaataagggggcaatcagcccccaaatcaaatttcatcaagtcaccagaacaaagaaattccaaagagaccaaagaatccaaacatccgcaagaggtaattatggaagagaacaaacagaagaagaaccaccgaaaggcacagcaccagaaaagccccaagcagcgcaacgcagagagaagaggaaaacagaaaaaggccaccagaacagaggagaaaagctcatctcagaacaaaacaggagtcccaatgaaaaaagaaatatcagcgcagagaaaaaacgcgaatccgctcaactggtcctagatcagaatcacaccgttgcagctgtcttacaccgacggggcaggaaggaaacgcgattc

SEQ ID NO: 265 - DNA, 1815 bp, Enterobacter cloacae
gtttctccttccgaaaggactctggaggggaaggaatggtgtgctggcaatacgaacggtgactcaggcaaaagcctcaaggtcaatatcggcggtaaaaaatcatgggctgactttgccagcggtgacagcggtgacctgctggatctctgggtgttggttcgtaactgccagctgcatgatgcaatgcgagaggcgaaagagtttcttggcctgaaagatgacgaccaccacttcgaagcgaagaaaaaactgttctctcgtccgacgaaaaagggcgttaaatcggccagcaaatgctatgactaccttgcttcacgtggaattacccgtgaaacagccgatcgctttaaggtaacagacgcggtggtctggtatcacgacgaaagccgcgaggtaccagcagtggcattcccgtacatccggaatggtgaactgctacaggtaaaacgtattggaaccgaaaggccaaacggcaaaaaactgattatggctgaagctgattgcgaaccatgtctgtttggctggcaggctctggataaaaacacccgcctggtagttctgtgcgaaggtgagattgattgcatgacctttacgcagcttggctatgatgccctgtctgttccctttggcggtggcaaaggggccaaacagcagtggattgaatatgaataccataacctcgatcgcttccaggaaatttggctgtgcctggacaacgacaatgtaggccgtgaagctgcaaaagaaatcgccagacgtcttggggaacatcgttgccgcatggttgaacttccccacaaagatatcaacgattgcctgatgaacggcatggacagcgactccattctggaatacatggagcgcgccaaattcttcgatcccgatgagctttgctcagcaggggacttgcttcaggaaactatcgaggcattcgaacatcgggataccggtctgtttacaagcccatgggcttcgctgaacaacaactttaagttccgtgccggtgaactgaccctcgttaatggcgttaatgggcatggaaaaacagagctcgttggacatatcgcgattgatgcgatgagtcagggcgtcaggacgtgtattgcttctctggagcttaaaccaggcaaaatgcttgcccgactcacgcggcaaaccatctgcacttcctcaccgaaacgtgaagaaatcattatgaccaacgaatggttttctgaccgcctttgggtattcaaacttaccggaactgccaaagcagaccggcttcttgagatttttgcctatgcccggcgtcgctatggcattgagctgttcgtcatagataacctggctaaatgtggcttagacgaagaagactacacaggtcagaaggacttcatcgatacgctgtgcgacttcaagaacgagcataactgtcacgtcctgctggttacccacgccagaaaaacaaacgactccgctccaacaggaaagatggacgtaaaaggcactggcgccttaaccgacatgcccgacaacgttatggccgtctggcgcaacattccccgtgagctggcgcagagaaaagcggatcgtatgggttatgagagcctcgacaaagacgaacaggccgcgatcaatctccccgcttcaatgattcgtttgttgaagcaacgagaaggggaagggtggatcggtgacatcggagctaatttcgactctcgctctcaccagttcctggaaggcgagaaaaaaccatttaactacctggtcggtaagccgcaaagcgagcttgatctcgagtgggaagccagcaacgtaacgagggtttga

SEQ ID NO: 266 - DNA, 1029 bp, Enterobacter cloacae
gccagctcgcggctacacaatcacgccagttcaggagtttgtgtgagtagcaaaattctcggtaacgtctgggacgcgtgcgcagcgcatgacattaagggagccaaacttgtgattatggcacgcctcgctgactactcgaatgatgatggtgtctgctatccgagtgttgaaactatttgccgccagctggggctcggggaaagtacggtcaggaccgccattgcagaactggagtcttccggttggctgcgtcgtgaagcgcgccgtaaaggtaatcgcaacacgtccaatctttatcatttgaatgccgagcgtctcgaggctctggcacgcattgaggaggacaaagtggcagcgctgaaacagcagcgcaggactaacggttttcacccttcagattctgacccttcaaaaactgaaccgtcagattctggattttcaaacggttttcacccttcagattctgacaaaaatggcgttttcacccgtcagaatctgaccccagatccacaagtaaattcaaaacatgatccacaagtaaattcaaaacatgatccacaagtaaattcaaaacaagaatcacaagatattggcgtgtgtggtaaagcctcttctgaaaatcgctcttccaaagagaactattccaacgagttcgagaaggcatggcaggcataccctaaacgtgctggcggtaattctaaagctgccgcatggaaagcctggaaagctcgaatcaaagacggtgttaacactgaggcaatgctggctggtgtaaaccgttatgcaggttatgtccgtgctacaggtagcgccggaacgcagtacgtgaaacaggcggcgacgttcttcgggccggataaacatttcgatgaaccgtggctggtagagacccaggaaaacaaagtccctacccgacaagaccagtctcgctacgagtggtacgcaaagtctgatgacggctctgccgaggtgtttatcaatcagtcagcgatcgatcgcatgaaccgtggcgggtatcgcccatga

SEQ ID NO: 267 - DNA, 546 bp, Enterobacter cloacae
tctccgtgtccccgcgcggcggccgaccgtctgaacacctcaaacaatactaaagtgcgtatcgacccaattatcgtggcgcaggatggttcgctgtgtggcccgggcacggcctgtaccacggtcgcgaaacagacctatgccctgcccgctcgcccggatctgagcggtggtatggggggcgtttcaacgccggcagtgcccgcgcagccgcagggtgaagtgcgcgccatcagcaacgatacgctgcaaagtgaagacgcgacaggcgccccggtgaaaagcagtggtttctttggcgcacccaccacgttagcgccgggcgtgattgaatcaaatgaacctgccccagcgcttgcgcccgtcgttgctgcacccgctgcacaacccgccccggtgaccgcgccctgctgctacgcagactgcggcgcctgcgacggcgagcggcagctacgtggttcaggttggcgctgtcagcgatcggacccgtgcagagcaatatcagcagcgtttaagcaaacagtttggcgtgccaggccgcgttga

SEQ ID NO: 268 - DNA, 318 bp, Enterobacter cloacae
aactcccgccccgtggcgggagttattattttttacacacacgccggagctgacatgaaaaccaaacttaacgaactgcttgaattccctaccccttttacttacaaagtaatgggtctggcgaaacctgagctggttgatcaggtggttgaagtggtacagcgccatgcgccgggcgactactctccatcagtcaaaccgagcagcaaaggtaattaccactcggtctcaatcaccatcactgcgacacacattgagcaggttgagacgctgtacgaagagctcggcaatatcgaaattgttcgtatggtgctgtag

SEQ ID NO: 269 - DNA, 270 bp, Enterobacter cloacae
ccgcgccctgctgctacgcagactgcggcgcctgcgacggcgagcggcagctacgtggttcaggttggcgctgtcagcgatcggacccgtgcagagcaatatcagcagcgtttaagcaaacagtttggcgtgccaggccgcgttgagcaaaacggtgcggtatggcgtatccagatgggtccgtttgccagtaaatcgcaggcagcatccctgcaacagcgtttgcagagcgaggcgcagctccagtcgtttatcgctgttgcaaaataa

SEQ ID NO: 270 - DNA, 1305 bp, Enterobacter cloacae
cactctcatgatgaaagtcggatgcctgcccgtatagcatttgctatagtaaggcacttttttaattccatcacggatgtcgtagttctgaccatgaagaccactttttctgctcgttttgtgcagcgcatggcgctgaccacggccctttgcgctgctgcgttctccgcagctcacgcggatgacctgaacatcaagaccatgatccctggcgttccgcagatcgacgcggaatcctacatcctgattgattacaactccggcaaagttctggcagaacagaacgccgatgcccgccgcgatccggccagcctgaccaaaatgatgaccagctatgttatcggccaggctatgaaagcaggcaaattcaaagaaaccgacctggtgactatcggtaacgatgcgtgggcaaccggcaaccccgtgttcaaaggttcatcgctgatgttcctgaaacctggcatgcaggttccggtctctcagcttatccgtggcatcaacttgcagtccggtaacgacgcctgcgtggccatggctgattttgccgcgggcagccaggacgcgtttgtgggcctgatgaacagctacgtctccgcgctgggtctgaaaaacagccacttccagaccgttcacggcctggacgccgagggtcagtacagctccgcgcgtgacatggcgctgatcggtcaggcgctgatccgcgacgtgccaaacgagtactctatctacaaagagaaagagttcaccttcaacggcattcgtcagaccaaccgtaacggcctgctgtgggacaacagcctgaacgtcgacggtatcaaaaccggccacaccgacaaagctggctataacctggtggcctccgccactgaaggccagatgcgtctgatctctgccgtgatgggggggcgtacgtttaaaggacgcgaaacggaaagcaaaaaactgctgacctggggcttccgcttcttcgaaaccgtgaacccgctgaaagccggtaaagaatttgcctctgaacctgtctggtttggcgataacgaccgcgcttccctgggcgtggacaaagatctctatctgactatcccacgcggtcgtatgaaagatctgaaagccagctacgtgctgaataccaccgagctgcacgccccgctgcaaaagaatcaggtcgtgggtactatcaacttccagctggatggcaaaaccatcgatcaacgcccgctggtggtgctggaggagattcctgaaggcaatttcttcggcaaaatcattgattacattaagctgatgttccatcactggtttggttaa

SEQ ID NO: 271 - DNA, 687 bp, Enterobacter cloacae
tatactccgcgttacctattctcccttgtcttcggagacgtccttttgtaccaggataaaattcttgttcgccatcttgggatacagccttacgagccagtctctcaggctatgcatgactttaccgatatgcgcgatgacaccacccctgatgaaatctggctggttgaacacatgccggtgtttactcagggccaggcaggaaaagccgaacatttattgatgacgggtgatatcccggtgatccagagcgatcgcggtggacaggtaacctaccacggcccgggccagcaggtaatgtatgtcctgcttaacctgaaacgcagaaagctgggcgtacgtgagctcgtgaccttactggaacagaccgtggtgaacacgctcgctgagtacggtatcgacgctcatcctcgcgccgatgccccgggcgtctacgtgggagagaagaaaatctgttcgctggggctgcgtatccgtaaaggctgctcgttccacgggctggcgctgaatatcaatatggatctgacccctttccagcgcatcaacccatgcgggtatgcgggtatggaaatgacgcaaatgcgccagtgggtcgctaccgccacgcctgagaatatccgccccgtgcttctgaagaagtttttagcgctgcttaacaatcctgaccacgaatatattgctgcttaa

SEQ ID NO: 272 - DNA, 1161 bp, Enterobacter cloacae
ccgggggtcgatatgtacgctttaacccacggtcggatttataccggccatgaaattctggatgaccatgcgattgtaatcgccaatggcctgattgaacgtgtttgcccgctggcggaactgccgccggagatcgaacagcgttcactcaatggagctgtaatctcccccggtttcatcgacgtacagcttaacggctgcggcggtgtccagtttaacgataccgcagaggcggtgacggttgaaacgctggaaatcatgcagaaagccaacgagaaatcgggctgcaccagctatctgccaacgctgatcaccagcagcgatgacctgatgaaacagggtatccgcgtcatgcgcgaatacctggcaaaacatccgaatcaggcgctggggctgcacctggaagggccctggctgaatatggtcaagaaaggcacccataacccaaactacgtgcgcaaaccggatgccgagctggtggattacatgtgcgccaatgccgatgtgatcaccaaagtgacgctggccccagaaatgaccggcacggacgttatcagcaaactggccgccgccgggattgtggtatctgcgggccattcgaacgcgacgctgaaagaggcgaaggccggtttccgcgcaggcattacatttgccacacacctttataacgcgatgccctatattactggccgcgaaccgggactggttggcgcaattctggatgaaccagacgtctactgcggcattatcgccgacggcttgcatgtcgattacaccaacatccgcaacgcccaacgcctgaaaggcgacaagctctgcctggtgacggatgctaccgctccggcaggagcgaatattgaccagttcatttgtgctggtaaaacaatatactaccggaatggactgtgtgtggatgagaacggcacgctgagcggttcttctctgacgatgatcgaaggggtacgtaacctcgttgaacattgcggcatcgcgcttgaggaagtgctgcgcatggccacgctttatccggcgcgcgccattggcgtcgataaacagctcggtggtattgcgccaggtatggttgcaaacctgacggcgttcacacacgattataaaattattaagaccatcgttaatggtaacgaggtcgtcactgagtaa

SEQ ID NO: 273 - DNA, 804 bp, Enterobacter cloacae
ataatgagactgattcccctggcaacagctgaacaagtcggaaaatgggctgctcgtcatatcgttaatcgcatcaacgcgttcaaaccaacagccgatcgtcctttcgttctcggtcttccaaccggcggcacgcccctgaccgcgtataaagctctggttgaaatgcacaaagcgggccaggttagctttaaacacgttgtgaccttcaacatggacgaatatgtcggcctgccaaaggaacatccggaaagttaccacagctttatgcaccgtaatttcttcgatcacgttgatattccggctgaaaacattaacctgctgaatggaaacgcgcctgatattgacgcagaatgccgtcagtatgaagaaaaaatccgttcctacggtaaaatccacctgtttatgggcggcgtaggcaacgatggtcatatcgcgttcaacgaaccggcatcttcactggcttcccgtacccgtattaaaacgctgacccatgatacgcgcgtggctaactcccgcttctttgacggcgacgtcaatcaggtgcctaaatacgcgctgaccgtgggcgtgggcacgctgctggatgccgaagaagtgatgattctggtgctgggcgcggtgaaagcgcaagcgcttcaggctgccgttgaaggcaacgtgaaccatatgtggacgatcagctgcttacagctgcatccaaaagcggttgtcgtgtgtgacgaaccgtccaccatggagctgaaagtgaaaacgctgaaatacttcaacgagctggaagctgagaacatcaaaggtctgtaa

SEQ ID NO: 274 - DNA, 1197 bp, Enterobacter cloacae
gtaagtaaaagtatgacaccaggcggacaagctcaaatcggtaatgtcgatctcgttaaacaacttaacagcgcggcagtttatcgcctgattgaccagcacgggccaatctcacgcattcagatagccgaacaaagccagcttgctcccgccagcgtgacaaaaattacacgtcagcttattgagcgcggcctgatcaaagaagtcgatcagcaggcctccaccgggggccgccgcgcgatttccatcgtcacggaaacccgcaattttcaggccattggcgttcgcttaggacgtcatgacaccacgcttacgctttacgacctgagcagcaaggccattgccgaagagcattacccccttcctgagcgcacgcaggagacgcttgaacatgcgttactgaataccattgcgcagtttatcgaaagctgtcagcgcaagatccgtgaactcatcgccatctcggtgattttgcccggcctggttgacccggaaagcggcgttattcgctacatgccgcatattaaggtagagaactgggggctggttgaggcgctggaaaagcgcttcaagctgacctgctttgttggtcacgatattcgctcgctggcgctggcggagcactactttggtgcgagccaggactgcgaagactctattctggtgcgcgttcaccgtggtacaggtgcgggcatcatctcgaatggccgcatttttattggtcgtaacggtaacgtaggcgagattggtcatatccaggtggaaccgcttggcgagcgttgccactgcggtaattttggctgtcttgaaaccgttgccgccaacgccgccattgaacatcgcgttcgccatctgctggagcagggttaccagagccgcgtcacgctggacgattgtaagatcggcgccatctgcaaagcggcaaacaaaggcgatgcgctggcctgcgaagtgatcgaacaggtaggacgccacctgggtaagaccatcgccattgccatcaacctgtttaatccgcaaaaggtggtgattgccggcgagatcgttgaagccgaaaaagtgttactgcccgccattgaaggctgcatcaatacccaggcgctgaaggcatttcgccagaatttgccggtggtgcgatctacgctcgatcaccgctcggcaattgtcttcatccacgaggggcgcgaacggcgataa

SEQ ID NO: 275 - DNA, 345 bp, Enterobacter cloacae
atgagaagagatatgtatgaagttatggatcgctggggagcctgggcggcagctgatagcagtggagtcgactggcaaccaatcgctgccggttttaaggggttacttccgcacggtaaaaagtctcgtctacagtgcgatgatgatgaagggattatgattgacggttgtatagcgcgtttacgcaaatttaagtccgatgaatatgaactgttaatcgctcattttgttattggtatctctctgagaacaattgcaaagaaaaagaaatgctcggatggtactgtaagaaaagatctgcaaaccgcactcgggttcgtagagggggtgatgtcaatgctataa

SEQ ID NO: 276 - DNA, 636 bp, Enterobacter cloacae
gacgtaatgggtataatgtgtgacatgagctatagattatacccactgaagaacacagtagccttcaggaaaactaccgaaaaatggggtggtctttccaacatggctaaaggttacccattgttaatcaatgggttgccaatccaatcgagtgaaatactgtatcaagcatgccggtacccagactacccggagatccaaaaagccatcattactcaaggcaacccctacgaagctaagcagaccgccagatcgtttgaagcgaagacccgttcaggctgggaaaagaatcgggtttcgattatgaagtggtgcgtttgcgttaagctttgccagaactgggaaacatttttcgctcttttggatagcactggtgaacatgacatcgttgaacactcagagaaagatcaattttggggggcgagtaaagactccgaagggaacttttatggcatgaacgtgttaggccgtatccttatggatgtgagagacgttgccagaaagaggggaccgacagggtttgctagcataccgccgctccccttggagaagtttcttctgctcggggatcacattcgcgacgtcactttcactccaccaccagtggacactgggcatagcttatcgcttttttaa

SEQ ID NO: 277 - DNA, 651 bp, Enterobacter cloacae
tcatcgcgtataaggtgtaatatgttatttcacactaataactctatttatttatctcataatgatggtcagcaggtgagccacacgccgtcgatgcattgctatggttgtgtgaaaaaatgcctgtttggtgacgctgaagcgtgcgctcgtaaaacctgcacaggacttgaatgctatatttggcctgataacaattcttaccttgtagaaggtatccggcactattttgaatgtgtgagcgacaaatatatttctcagccagtcgtgattattgattttagccataaaaatatcacatattttctgaacgatagctggctcgaacaattcaaaaatatgcgccttatcctcgtcactgacaaaaagatgacggcgattgcccattactggttctataacgatacgttagagaccaccatcagctctattatcttttatgatgattccgctgaggaggttgccacgaaactgaagaaaacgttcctggcaaaaacgatcaaaccatccgggagtaggccaaaactgagccagaatgaattcagcctgttttcgttcttgttcaatggatggacacctaaaaaaatcgcgtatcagaacggtactagcgtcaaaaacacctatgccatgaaaaatcttcaccacgagtag

SEQ ID NO: 278 - DNA, 2436 bp, Enterobacter cloacae
ttcatgaggatatgctgtctcggcaggattaagacattgttctatcacggtctcagtttatacctgagtagcctgattcttctggcctggacggctgcacttggcgtcgctggcctgtggaatatctgggttcttgttcccctggccatcattttactgccgtttaacctgacgccgatgcgtaagtcgatgatctctgtgccggtgttcaggggattccgtaaagtgatgccgccgatgtcgcgtacagagaaagaagcgattgacgccggtacgacctggtgggaaggcgatctgttccagggcaacccggactggaaaaagcttcacaactatccacagccgcgtctgaccgccgaagaacaggcctttattgatggtccggtagaagaagcgtgccgcatggcaaacgactttgccatcactcacgaaatggccgacctgccgcctgagctgtgggcatacctgaaagagcatcgcttcttcgcgatgatcattaagaaagagtatggcggtctggaattctccgcttacgctcaggctcgcgtgctgcaaaaactggcgggtgtctccgggatcctggcgattaccgttggcgtgccaaactccttaggcccgggcgagctgttacagcattacggtacagaagagcagaaagatcactacctgccgcgtctggcgcgtggccaggaaattccgtgcttcgcgctgaccagcccggaggcgggctctgatgccggcgcgatccccgataccggcgtggtttgcatgggcgagtggcagggccagcaggtgctgggcatgcgcctgacctggaacaaacgttatatcaccctcgcgcctatcgccacggtgctgggcctggcgttcaaactctctgacccggaaaaactgctgggcggtgaagaagatctgggcattacctgtgcgctgatcccaacctcgaccccaggtgttgagattggtcgccgtcacttcccgctgaacgtaccgttccagaacggtcctacccgcggtcaggatatctttgtcccgattgattacatcatcggtggcccgaaaatggccggtcagggctggcgtatgctggtagaatgtctgtctgtgggccgcggcattaccctgccgtcgaactcaaccggcggtctgaaatcggtggcgatggggattggggcttacgcgcatattcgccgtcagttcaaaatctccatcggcaagatggaaggtatcgaagagccgctggcgcgtattgcgggcaatgcctacgtgatggacgccgcagcctcgctgattacctacggaattatgctgggcgaaaaacccgccgtgctgtcggcaattgtgaaataccactgtacccaccgtgcacagcagtcaattattgatgcaatggatatcgcaagcggtaaagggatcatgctcggtgaaggcaacttcctggcacgcaactatcagggcgctccgattgccatcaccgttgaaggggcaaacatcctgacccgcagcatgatgatcttcggtcagggcgccattcgctgccatccgtacgtgctggaagagatggccgccgcgcagaataacgacgtggatgcctttgacaagctgctgttcaaacatatcggtcacgtgggcagcaatgaagtgcgcagcttctggctcggcctgacgcgcggcctgaccagcgcgacgccaaccggcgatgcgaccaaacgttactaccagcaccttaaccgtctgagcgccaacctggctctgctgtctgacgtctcgatggccgttcttggcggaagcctgaagcgtcgcgagcgcatctctgcccgtctgggcgacgtgctgagccagatcttcctggcctctgcggttctaaaacgttacgacgacgaaggccgtcaggaagcggatctgccgctggtgcactggggtgtacaggatgcgctgtatcaggcagaacaggctattgacgacctgctggcgaacttcccgaaccgcttcgtggcaggtgccctgcgcgtcgtgatcttcccgaccggtcgtcatcacctggcgccgtccgacaagctggatcacaaggtagcgaagatcctccaggtaccgagcgcaacccgctctcgtattggtcggggtcaatatctggcacctaccccgcataacccggtaggtttgctggaagaggcgctgcttgacgtgatggccgccgacccgattcaccagaagatctgcaaacagctgggcaaaaatctgccgtttacacgactggatgagctggcaaaacaggcgctggcgggtggcatcatcgacaacagcgaagctgcgattctggtgaaagccgaagagagccgtctgcgcagtattaacgtggatgatttcgaaccagaagagctggcgacacagccggtaaagctgccggagaagcaccgcaaacctgaagccgcataa

SEQ ID NO: 279 - DNA, 789 bp, Enterobacter cloacae
ggagtcggtatcgtgcctggtttgaagatttctgttttgcagcagcctttagtttggatggacggtccagccaaccttcgccatttcgatcgccagctcgaagagattagcggtcgcgatgtgattgtcctgccggagatgttcaccacgggttttgcgatggaggctgcaaaacagtcgatgccgcaggacgaggttgtggcctggatgcacgccaaagcgcaggagacaaacgcgctgattgccggtagcgtcgccctccagaccgaacgcgggccggttaaccgcttcctgctggtcgagccagagggaaaggtgcatttctacgataagcgccacctgttccgcatggcggatgagcatcaacattatgtagccggaaacgaacgcgtggtgtttgaatggcgcggctggcgtattttgccgctggtctgttatgacctgcgcttccccgtctggtcccgcaaccgcaacgattacgacctggcgctgtatgttgccaactggcctgcgccacgttcacttcactggcaggcgttattaacggcgcgggcaattgaaaaccaggcttatattgtgggatgtaaccgcgtaggcacggatggtaacggacaccattatcgcggcgacagccgggtaataagcccgcagggagaaattattgctacagccgagccgcatcaggccacgcgaattgacgccgagctttcgttaactgcgctaacggaatatcgcgagaagtttccggcctggcaggatgccgatcgttttagcatagaaaataaataa

SEQ ID NO: 280 - DNA, 498 bp, Enterobacter cloacae
gaagatattcactggatattccttgtctcgcgtcctctttatccgcttgcagtagagcttcttatgcgtccggaaagcacgctgctttcagatatggagcctattgaaggcgtcattaacgctattcgcgcgggcagtgaacgtgccgagcgaataagccagacgttattaataccggaaacgcccgatattgaagaggagagtgagcaaatgattgcactcactcactctgaacgcaaggtgttgcgtttactcggtaaaggttggggaatcaaccaaattgccacactactgaataaaagtaataaaacgatcagcgcacagaaaaacagtgcaatgcgtcgcttatcacttcgcagtaatgccgatatgtacgcgtggataagcagtacccagggaatgcgagaactcagtttaatgtcggcttatggagagtttgaggaatggaaaagaccactgcaacaagacatatcgccgtcatcgaaagctgctcaatga

SEQ ID NO: 281 - DNA, 1149 bp, Enterobacter cloacae
  unsure (980)
gaacgtccgaaacgaacgtatgacaggagatctgctatgtctgccaaccatgctgcatttaatctgattttccgcttcgttgaaaattatgttagccctattgccgggcgcatctcttcccagcgtcacgttatggctattcgtgacgggtttatctcagcgatgccgtttatgattgtgggctcgtttctgttagtgttcgcttacccacctttttcgcctgataccacctggggttttgctcgcgcctggctggatatggcgaagcagtttgaaggccaaattctgacgccgtttgatatgacaatgggggtgatgtccctttatatctgtgcggctattgcctacaacctgggcaaacattacgttaaaacccatcagctggatccgttcatgtgcgcgatgctgtcgctgatggcgttcctgctggtcgccgcccctaaaaccaaaggcgctttgccggtcgatagcctgggagggaccggtattttcaccgcgattctggtggcgatctattgcgttgagatgatgcgtttcctgaaagcacacaatatcgggatccgcctgccagaccaggttccgccgatgatcaaaaactcgtttgatctgctgatcccggtgctggtggtggtgctgacgctctatccgctgagtctgctgatccagtcgcagttcggtatgctgatcccacaggccatcatgtcgatattcaaaccgctggtctctgcggctgactcgctgcctgcgatcctgctggcggtgctgattggccacctgctgtggtttgccgggatccacggcgcggcgattgtctccgggatgctgcaaatgttctggctgactaacctgggggcgaaccataccgcgctggcggcaaaccaacctttgccacacatctttatggaagccttctggacgttctttatcgttatcggcggatcgggggcgacgatgggtctggtgttctgctatctgcgtanccgctccgcgcacctgcgctctattggacgtctgaacgtggtgccaagcattttcaatatcaatgagccggtgattttcgtaacgcccgattgtgatgaacccggtgttctttattcctttccatgctggcgccgatggttaatcccgtgctggcatggccagcgatga

SEQ ID NO: 282 - DNA, 213 bp, Enterobacter cloacae
tttccgtcgtgccgtggacggcacccggctccggttggtgccgcctgggcgctgggctgggatttccgtgcagccattctggtgctggttttggcctgcgtttccgcgattatctatttcccgttcttcaaggtgtacgagaaacagttgcttcagcaggaagcggaagaagcacagcgtaatggagaagaggaaaatcagcaggtcgcttag

SEQ ID NO: 283 - DNA, 690 bp, Enterobacter cloacae
ggaatggaaaagaccactgcaacaagacatatcgccgtcatcgaaagctgctcaatgagcgctgtggggttgaagcatctctttgcgatgcccagcctgagccattaccaggtgcacctgtttagcagattcgccagctttaaagcggcgctctcggatatctcattctatgcggttatctattcactgtctgatgagcgtgaggagcggagaaactgtcttgcctgtttacgggatctcaccttcacccacagcgacgtccagcgtattgtgctggcctctgacgaaatggaggcgaggctggtcagccatctttcgccttctcgcttgcatggaatcatcagtaaatcggttccgctaaagcagctaatggagggcctgaagacattactcagcgaaacgcatcaggtgaacgacaacatgtacaatcactggtgtgttagccagaatcgtatgttaagcccaaccgaaagggcgattctgcgttatatgtcatcgggtttttcgatccctgaaattgcagcacagcttgaacgcaatattaaaactatccgggcgcataagtttaacgccatggtaaagctgggcgtcaattctgacgtgggattactggatgcggcggatatcctggcgcatctccctgcccgggaagttcgtcgttccgctctcaccgttccttcattctcttag

SEQ ID NO: 284 - DNA, 801 bp, Enterobacter cloacae
agactccacactatggcgactcgtaccgcacacatcgttgagcccctgctctggcgagctccactctccgccggggaaacgacgcttgcggatgccattcgggaaaaaattgccgtaacgcgcgcccatctgctggatttcatcaaactggatgaagcaccgccgcatcatgcgctgacgctgactgagtggcaacgtcctgccgagctgcggtcgctgctggcaacctattccgaccatatttatcgtaaccaacctaccctgacgcgggaaaataaaccgctgttatccctctgggcacagtggtatatcgggctgatggtgccgcctgtcatgctagccctgctgacccaggaaacgatgctcgatctctcgtcggaacatttccatgttgaatttcatgaaaccgggcgcgctgcctgtttctggattgatgtacatgaagatccgagcgcgagacacctgtcagcgcaggcgcgtatggaacggctgattacaagagcgctggttccggtcattgatgcgctggaagcgacgggagagattaacggcaaactgatctggagtaataccgggtatcttatccactggtatttaacggaaatgaagccgctgctcggcgacgagaaagtggatgcactgcgtcagagctgtttctttgccagacagctgtcggatggacgggataaccctctttaccgcaccgtggttccgcgtgagggacttctggtacgtcgtacctgctgtcagcgctaccgtctgccggacgtccagcagtgcggcgattgcacgcttaagtag

SEQ ID NO: 285 - DNA, 492 bp, Enterobacter cloacae
cagattacgcaggatatttgtcaggaggaatcaatgagtttgcagtctgtacaacagttttttgccgaacacgctccggatatagagatcattgagcttaaccaaagcacagcgactgttgcccttgctgctgccgcgcacaacgttgaacccggccaaattgccaaaacgctgtcactaaaaattaaaaatgacgtgattctggtggttgcaaaaggcgatgcgcgtctggataacaaaaagcttaaagagacattcggcgcaaaagcccgcatgctcagcagcgatgaggtagtcaccctgacaggtcatcctgttggcggcgtctgccctttcggactggaaaacccgctttctgtttactgtgacatcacattaaaacaatacgcggaagtgttacccgcagcgggcgccatccacagtgcggtgcgtatatcgcccgacagaatggcggaactgaccgcagcaaaatgggtagatgtgtgcatttga

SEQ ID NO: 286 - DNA, 1005 bp, Enterobacter cloacae
atcgcaatccttccaggtccgtgctgttatactcaggcgcccagcacctgcacagccggctgctcaattacagctaactatctgaaaaaattcatcatgtcgagaatactcgctgcgataacattattgttaagcgtcattttaactatactggttactatcgcctgttctgtgccaatcatcgttgccggaataattaagctcctgttgcctgtccctccggtatggcgcgcggtgtctgctttttgtaattttatgatgtactgctggtgtgaaggcctggcgatcctgctgcatctgaacccctggctgaagtgggacgttcagggtctggagaagctgaacaaaaagaactggtatctgctgatctgcaatcaccacagctgggccgacattgttgtattgtgcgtactgtttcgcaaacacattccgatgaataaatactttctgaaacagcagctggcctgggtgcctttcattggtctggcctgctgggcgctggatatgccgtttatgaaacgctattcacgcagctatttgattcgtcatccggaacgccgcggtaaggacgtggaaaccacgcgccgttcttgcgagaagtttcgcgcgcatcccaccaccattgttaacttcgtcgaaggatcgcgctttaccgaagagaagcgccaacaaactcgctctccttatcagaacctgttgccgccaaaggctgcgggcatcgcaatggcgctcaacgtgctgggggagcagttcgataaattgttgaacgtaacgctctgctatccggaaaacgacaggacgccattctacgacttgctcagcggcaggctgacgcgtatcgttgtccgcgttgatctggtgcccgtcaatactgaactgcacggggattacgtcaacgataaaaacttcaaacgtcgtttccagctttggcttaatacactctggaaagagaaagacgagcagatagcgaagattaaatcttcatacaaaaacgccggtcagtga

SEQ ID NO: 287 - DNA, 555 bp, Enterobacter cloacae
  unsure (408)
tgctcctttcatttagagagacacgttagcagggtcaatcccacaataaaagaggcgatattcgtgaatcaatgccaggaaatcatcggggttgttctggccgggggcagggcaacgcgaatgggtggaaaggataagggacttcagctcctgaacaacacaccattatggcagcatgttgctgatacgcttgcagatcaggtgtcatcgatggcgatcagcgctaaccgacatgttgatatctatcagcgcagcgggtatccggtttatcaggataacctggcggactaccccggtccgctggcgggaatgctttctgttatgcagcagtcgtacggagagtggtttctcttttgtccatgtgatacgcccttcatcccgtcctgtctggttgaacgtctggtgcancggcgcggtggtgctcccgtcgtctgggtacacgacggtgaacgcgaacatccaacgatcgcattgattaatcgctcgttaatatccgcgctgggagtattactggccgcaggagatcgacgcgttctggtatttatgcccccattc

SEQ ID NO: 288 - DNA, 300 bp, Enterobacter cloacae
cgtgtctctctaaatgaaaggagcactaccatgaaatgtaaacgtcttaatgaagtcattgaacttctccagccggcctggcaaaaagagccagagctgaatctgatgcaatttttacagaaactggcgaaagagtcaggttttgatggtgaactggcggacctttctgacgacatcctgatctaccacctgaaaatgcgtgactcggctaaagatgctgttattccgggcattcagaaagattatgaagaggattttaaaaccgcattactgcgcgcccgaggcgtaattaaagagtaa

SEQ ID NO: 289 - DNA, 1002 bp, Enterobacter cloacae
tttccggatgatcggatgaacgaccaggcttttactttccagacactacacccggataccattatggatgcgctgttcgagcagggtattcgggtggattccgggttaaccgctttaaacagctatgaaaaccgtgtctaccaatttcaggacgaagagcgccagcgctttgtcgtaaagttttaccgtccacagcgctggtccgcagaacaaattcaggaagaacatcagtttgcccacgatctactggatgacgatgttcccgttgcggcaccgattaaattcaataaccaaacgctgctgacccatcagggcttttactacgcggtatttccgagcctgggcggaagacagtttgaggcagataatatcgatcagatggaatgggttgcccgctatctggggcgcattcatcagacgggacgtaaaaaaccgtttgttgcccgtccgacgattggtgttaaggaatatcttattgagccgcgacaggtattcgaaacatcggcgctgatcccgaatgcactaaaggataatttcctcacggcgaccgataagcttattgatgctgtaaaagccagctggcgggatgatattactactctgcgcctgcacggtgactgccacgccgggaatattctctggcgcgatggtccgctatttgtcgatcttgatgacgcacgtatgggacccgcggtgcaggatctgtggatgctactcaacggtgataaagccgagcagcgcatgcagcttgagaccataattgaagcttatgaagaatttatcccctttaattcagacgaaattgccttgatagagcctttacgtgcgatgcgatttgtttattatctcgcgtggttaatcaggcgttgggaagacccggcttttccccgaaatttcccctggcttaccggggaggattactggcgcaaccagatatccacatttaccgagcaggttaaggttctacaggaaccccctttgcaattaacgccgatgtattaa

SEQ ID NO: 290 - DNA, 651 bp, Enterobacter cloacae
ttggacacacccaggagagagttgatcatgaaaaaaatttggctggcgctggctggtatgattctggcttttagcgcaactgctgcgcagtttaccgacggcaagcagtacattacgctggacaagcctgttgctggcgagcctcaggtgctggagttcttctccttctactgcccgcactgctacgagtttgagcaggtacttcatgtttctgacaacgtgaagaaaaagctgccggaaggcaccaaaatgacgaaataccacgttgagttccttggcccactgggcaaagatctgactcaggcatgggcggtcgcgattgcgctgggtgtggaagataagatcaccgcgcctatgtttgaagctgtacagaaaacccagaccgtacaaactacggcagatatccgtaaagtgttcgtagatgccggtgtgaaaggtgaagactacgacgctgcctggaacagttttgtggtgaaatctctcgtggcacagcaggaaaaagctgccgctgacttccagttgcagggcgtgccggcgatgtatgttaacggcaaataccaggtcaatatgcgtggtatggacacgaccagcatggatatcttcgtacaacagtacgctgataccgtgaaatacctggttgagaaaaagtaa

SEQ ID NO: 291 - DNA, 264 bp, Enterobacter cloacae
gatgctcagcctgcaaacctacttcaccgcgggcgtaaaagaagtgcgtggaccatccctgagggtgcgactgcgcctcaggcggccgataaaatccacaccgatttcgtgaaaggctttattcgtacacagactatcgtgtttgaagactttatcacctacaagggagagcaaggcgcgaaagaaacaggcaagatgcgtgcggaaggcaaagattacatcattaaagatggcgatgtgatgaacttcttgtttaacctttga

SEQ ID NO: 292 - DNA, 249 bp, Enterobacter cloacae
tgccagcgaatgacgttcagctgcgtcagacggttgtgcgtgaccttctcagcagagtcttcaagcggtaaaggttctgtagaggtagcggtttacgccgcggttgaatccgatatcgctgaaatcatcgacggcgaccataaagagttcatggccgagcgggggctgaaccgcgtgatccgcgcgggctatgagctgctcagcctgcaaacctacttcaccgcgggcgtgaaagaagtgaacgcgtga

SEQ ID NO: 293 - DNA, 306 bp, Enterobacter cloacae
cgccagcgaatgccgttcagctgcgtcaggcggttgtgcgtgactttctcagcagactcttcaagcgataaaggttctgtagtggtagcgttttggaacgcggttgaatccgatatcgctgaaatgaacgacgccgatcgtgaagatttcatggccgagcagggtctgaaccgcgtgatccgcgcgggccatgagatgctcagcctgcaaacctacttcaccgcgggcgtaaaagaagtgcgtggaccatccctgagggtgcgactgcgcctcaggcggccgataaaatccacaccgatttcgtga

SEQ ID NO: 294 - DNA, 1332 bp, Enterobacter cloacae
gtttgcaggctgagcatctcatggcccgcgcggatcacgcggttcagaccctgctcggccatgaaatcttcacgatcggcgtcgttcatttcagcgatatcggattcaaccgcgttccaaaacgctaccactacagaacctttatcgcttgaagagtctgctgagaaagtcacgcacaaccgcctgacgcagctgaacggcattcgctggcgctatgacatccacggccgcaccgttgagaaggataacggccagacccgctggcactaccgctacgacggtgagcaccgcctgacggaggtgatcagccagccgcgggaccgcaacaggccgcagacgctggtcagcttccgctacgatccgctcgggcgacgcatcagcaaaacgcgccgccagatgctgggcggccagccaaccggtaagccagtcaccacgcggtttgtctgggaagggttccggctgttgcaggaagtgcacggggatgtgccactgacctacgtctacagcgatcaggacagctacgacccgctggcgcgtatcgacggcgttgatgcccaggaaatcttctggttccactgtcagccgaacggcacgccggaacggatgacggatagcgaaggacaggtgcgctgggaaggggtaaacagcgcctggggcaagctgttgcgggaaagcgagacgcaggtatcaggatattttcagaacctgcggatgcaggggcaatacctggatcgtgagacagggctgcactacaatctgttccggtattatgacccggactgcggaaggtttacgcagcaggacccgatagggctggcgggggggataaacctttaccagtatgcgccgaatgcgctggggtgggtggatccgtgggggttgagccgcgagtgtagcggtaaaacaaaacctgatttctatgttggtccaaatggccctagttcgactatgccttctacagcatatcgttatatggatagcaaatatgctccacagacaatagaaaataaatcagccccgttaagttattttgggtatacgaaatataaatctgcacatgaagccagggacgcctatcaaattttttatgagaaaggtaatcctgattcatggagtgatgcacgtttattaggtgagtttgatacattacaactgtataaaaatggagtgcctcaggtgcaagtacctcttgcaaatggtggtcgagggcctggatatgagcttttcaccagtgcatatcctgagtatggtaaaggtggggcattacagttgctaccaatcgaacgtaattaccctgttatttttgaacgtgttactataattccggagtaa

SEQ ID NO: 295 - DNA, 804 bp, Enterobacter cloacae
acacaaaagatctcgttgtctctaaaagaattgttaaaagtgggaggagttgtggttgaggtgaaaatatattataaaggaagtgttgattttattgcaggtgaagggactattctcaatgagttcataggagaagtagccacgcgacaaataaatattatagatggaaattattatgcttcttcctctttgctagataaaaaagaaaaagttggcttcctgctgtatgatggtaagaaaagcgacctgaacttaagtgacgccgaagaaatttcaaatgaggaatttgaagttttctggcaaacatcaacgggttcattgcaagaaaaaaagcgaataaaatacttgtctggagatgctgtggaacctttgaaaaaatccacagttattgctcatattgtgaataataaagggaagtggggtaaaggttttgttctgtccctttcaaataaatatcctgcggcaaaaaaaagctatcttagttgcttcaaagaaaataacttcccagaattaggggtggttgattttgttatggttgatgctcaggagaagatatttattgcgaatatgtatgcgcaggatggtataaagaaaaatatcaacgacaaaaaacaatacgtatgttatgactctctgaaagtttgtcttgaaaaattatctgactttgctttagttaatcgcctttctatacaaatgccaaggataggagctggcctcggtggtggtgattggaatgttatagagtccttaatactaaaaaatatttgctataaaatgattgattgcaatgtaataactttataa

SEQ ID NO: 296 - DNA, 204 bp, Enterobacter cloacae
tctttcaaggagcaaagaatgctgattctgactcgtcgagttggtgagaccctcatgattggggatgaggtcaccgtgacagttttaggggtaaagggtaaccaggtacgtattggtgttaacgctcctaaagaagtatctgtccaccgtgaagagatctaccagcgtatccaggctgaaaaatcccagcagtccagttactga

SEQ ID NO: 297 - DNA, 267 bp, Enterobacter cloacae
  unsure (48)
  unsure (119)
atccaattcggaaacaccaagggcgcccataagcgttttgataatttnggcaggtgggggaccccggcccttgcggtacgtgccaccgagatttttctacgatcatggcgaccacattntggggcggccctcccgggaagcgcggaagaagatggcgatcgctatattgagatctggaacattgtcttcatgcagttcaaccgtcaggcggacggcaccatggagccgttgcccaaaaccgtccgtagataccggtatgggccttga

SEQ ID NO: 298 - DNA, 2121 bp, Enterobacter cloacae
  unsure (70)
gcaggtgggggaccccggcccttgcggtacgtgccaccgagatttttctacgatcatggcgaccacattntggggcggccctcccgggaagcgcggaagaagatggcgatcgctatattgagatctggaacattgtcttcatgcagttcaaccgtcaggcggacggcaccatggagccgttgcccaaaaccgtccgtagataccggtatgggccttgagcgtatcgcggccgttctgcaacacgttaactccaactatgagattgacctgttcagcaccctgatcaaagccgttgctgaggtaacgggcgcaaccgatctgagcaacaaatcactgcgcgttatcgcagaccatattcgttcctgtgcgttcctgattgctgacggcgttatcccgtcaaatgaaaaccgtggctatgtgctgcgtcgtatcattcgtcgtgcgatccgccatggcaacatgctgggcgcgaaggacaccttcttctataaactcgttgggccactgattggcgtgatgggctctgccggcgacgagctgaaacgccagcaggcgcaggttgaacaggttctgaaaaccgaagaagagcagtttgcccgtacgctggagcgcggtctggcgctgctggacgacgagctggcgaaactcaagggcgacacgctggatggcgaaaccgctttccgcctgtacgacacctacggcttcccggttgacctgacggcggacgtttgccgcgagcgcaacatcaaagttgacgaagcaggctttgaagccgcaatggaagagcagcgtcgtcgtgcgcgtgaatccagcggttttggcgcagactacaacgcgatgatccgcgttgatagcgcgtctgaatttaaaggctacgaagagctggccctgaccagcaacgtaaccgcgctgtttgttgacggtaaagccgtagacagcattagcgcgggtcaggacgcggttgttatcctggataaaacgccgttctatgcggaatcgggcggtcaggttggcgataaaggcgaactgaaaggcaatggcttcagcttcagcgtaagcgatacccagaaatacggtcaggcgattggtcaccagggcaaactggtttccggttctctgaaagtgggcgagggcgttcaggccaacgttgacgaagctcgccgcgcgcgcattcgtctgaaccactcggcaacccacctgatgcacgcagccctgcgcgaagtgctgggtacgcacgttgcacagaaaggttctctggttaatgacaaagtgctgcgtttcgacttctcacattttgaagcgatgaagccatctgaaattcgtgcggtggaagacctggtgaatgcccagatccgccgtaacctgccaatcgaaacccacatcatggatctcgaggcagcgaagaagaaaggtgcgatggcgctgtttggcgagaaatatgacgaccgcgttcgcgtgctgagcatgggcgacttctctaccgaactgtgtggcggtactcacgcatcccgcaccggtgacatcggcttgttccgcatcgtttccgagtcggggacggcggcaggcgtgcgtcgtattgaggcggtgaccggggaaggcgcaattgccagcctgcatgcgcagagcgaccagctacacgagatcgcgcagctgctgaaaggcgatagccagaacctgggcgaaaaagtgcgtgtcgcgctggatcgtacccgtcagctggaaaaagaactccagcagctgaaagaacaggctgcggcgcaggagagcgcaaacctctccagcaaagcggtagacattaagggcgtcaaactgctggtcagcgatctggcgggcgttgagcctaagatgctgcgtaccatggtcgacgatctgaagaaccagcttggttcgacggttatcgtgctggcaacggtcgcagagggtaaggtttctctgattgcgggcgtctctaaggatgtgacggatcgtgtcaaagcaggggaactgattggcatggtcgcccagcaggtgggtggcaaaggtggcggtcgtccggacatggcgcaagccggtggtacggatgcggcggcacttcccgcggcattagccagcgttgaaagctgggtaagcgcgaaactgtaa

SEQ ID NO: 299 - DNA, 897 bp, Enterobacter cloacae
gtgagcccgctgattcaactacttgatcgcccgatcgcttaccagcccgcctttgcgcagctcagggcgggaaaggtgaagtctggccctgcggctgccgtgctgctgtctcagctcgtctactggcacaaccgcatggacggtgaatggttgtacaagacgcgggaagacatcaaaaaagagaccggcctgagccgagacgagcaggaaacagcacgcaaaagactcgttgccctgggcgttctgcaggaagacctgcgcggtgtgccagcgactgtgcattaccggattaataccgagcgtctggaggcacttttactggctccaggtcaggcagaatcacagttgggtgcaaccccgccaaccagacggcggcaaccccgccaacaagatggcggcaacgcacccaacaagatggtggaaaccccgccaacaagaagggtggaacccacccaacaagttggttgggttcccgccaactttcctacaggagattacacagagattacacaggagagtacgcaggagatcactcaaaaggccggtgagaaaaattctgtggataacttttcggagatctaccccgaggcggaaatcttcgatgctgagaaaaaaacgtggggcaccgccgaggatctggaatttgcgcagtggttttttgcccgcatcgtcgagctacacgaaaaagccgccgagtacgacggtatgctatcgcggccaaaggaacctgactggaccggctgggccgacgaagttcgacagctgcgggaggggcaacgttgtgatcaccaggcagatgcgaaacctggtcgagcgtattcagcgcgacccgtgggtggtgcccgaagattcagactgccgaagtgctgcacgccaaatggccagaactggtcctaa

SEQ ID NO: 300 - DNA, 657 bp, Enterobacter cloacae
atggaaaccgtattagacgttttaaaagccatgggcaaaaccacttaccgtgatgttgccgcgcgtcttgatatcgaaccagtggtagccctgaacatgctgcgcgagcagaaagagcaggggttgtgtgattatgcagacggcggctggttcctcggtaccgcggcaaagcaaaagccaaagcgtatccgacccaaacaggaatcggagctggttggccggatccttgccgtgatgcaggggcagggtgctataagcgcggagaaaatcgcaaaactgctcggtaaaacctcccgggctctaaatgcctcgctgggtgccttgggcaaggaagggcgagtggtacgccatgtggatgggaaaaacattacctggagcttgaaaaacgacgatgcgccagcaccggcaaccgcagccccgatcgctaacgccaggcaggcggaatccgcgctggcagagaaaagcacggcccaaattattgaagaaatcccggcattcacagcgcgaccgaatgacctggcaatcccatcgtcccgtttcatctcaagtgaaattcgccgcacaaaagcgaagctggccagcctgcaaaaactgcagtgcgccgcgcgccagctgcgccgccataaacatctgctggtggggctggacaatgaatga

SEQ ID NO: 301 - DNA, 417 bp, Enterobacter cloacae
ttaatggaaatcaaacacgaacacatccagtgcgtgctgctggcctgggcggcggaagtagggcaggcgcatgccgcggaggcgatcaccgcagaatacacccgccagggcggcgccgagctgccgctggtggctggcaacacctggaacaaccagcagaacatcttccaccgctggctggatggcagcacgccgcagcgccgcgcaaaaatccgcgagctgctgcctgccattctggccgtcctgccgcggtccatccgccaccgcctgagcatctacgacacgatcgagcgccgcgcgctgctggctgcccaggacgcgctgggcgcggctattgatgcccatgatgacgcggtggaagcgctatttcagaaagtcatgcagcacgccgctgctgattcaccgaagtttcactaa

SEQ ID NO: 302 - DNA, 378 bp, Enterobacter cloacae
gttcacagaggtgatgtcgtgagcgtgaagtgttgtggctgccaggaactgctggaggaagatgaagtttttaagcttgccgattcatgcggtgtcgatatttgcgatcgttgcgcgagcagggtggtgcatagctataacgagtggcacggcggtttcagctacgcacctgtaaagcagaaaaatccaaggaaaagcatttcagccgcagtgaagttgaagatatttcagcgggatggttttcgttgcaagcactgcgggaccagtgaggcattaaccatcgatcacatccaaccggtttcaaaaggtggcagcaaccaagatgaaaacttgcagaccttgtgtgcctcatgcaatagcaggaagggggttaagtga

SEQ ID NO: 303 - DNA, 615 bp, Enterobacter cloacae
agaaagaacggactagcttatatcaatgcagtttacccgtttaattttattattcccctcggaatttctgcttgcctggcatacattctccctattattaatgaaaaaatcacttatcttcagtcgaggccaatatcaagaacagcaatcttattatctataagagccaaaaaagcattagttgcggatatcagcctagaaaaatatcgagctaagcgtgatgtaacttacgagcggcacgttgccggagctgagaaagagatacaagacatgcgtgaagagattgtgaattctaaggaaagagttggcgaaatgaatgctgcattgcttgaattaaaccaaaaaaatgatgaaattaacgcattactgcaagactccaacattagaaataaaaaactctctgatgaaatagaacgccataaaatagcagaaacaagattttttggagagattgaagatttaaataaagaacttgatcgattatattctttactaaaaatggagcccactcgaggtgttggcttaggcataagaaagatcaccactataaatggtgaagaaaattcagatacggatgacacccaatatcgcccaggttccaatgaagataaatag

SEQ ID NO: 304 - DNA, 726 bp, Enterobacter cloacae
gtagcaaacatgcagaccccgcacattcttatcgttgaagacgagttggtaacacgcaacacgttaaagagcattttcgaagcagaaggctacgatgtctttgaagcgaccgatggcgcagagatgcatcagatcctttctgaaaatgatatcaacctggtgattatggatatcaacctgccgggcaaaaacgggcttcttctggcgcgcgaactgcgtgaacaggcgaacgtcgcgttgatgttcctgacaggccgtgacaacgaggttgataaaattcttggtctggaaatcggcgcggatgactacatcaccaagccgttcaaccctcgcgagttaaccattcgtgcacgcaacctgctgtcccgcaccatgaatctgggtacggtcagtgaagagcgtcgtagcgtcgacagctacaaattcaacggctgggaacttgatatcaacagccgttcgctgattagcccgaacggtgagcagtacaaactgccgcgcagtgaattccgcgcgatgctgcacttctgcgagaacccgggcaagattcagtctcgtgcagaactgctgaagaaaatgaccggtcgtgagttgaagccacacgatcgtaccgttgacgtaaccatccgtcgtattcgtaaacatttcgaatctacgcctgatacgccggaaatcatcgccacgatccatggtgaaggctatcgtttctgcggtgacctccaggagtaa

SEQ ID NO: 305 - DNA, 687 bp, Enterobacter cloacae
atgcatctgtcgattgtgctggtggcaccagcaagagctgaaaatattggcgctgcggcgcgtgccatgaagactatgggttttaccgatttgcgtattgtggacagcacggcgcatctggagcctgctgcgcgctgggtggcgcacggttcgggtgatattctcgataatataaccacttacgctacgctcgccgacgcactccacgatatttcatttaccgtcgcgacgaccgcgcgcagccgggcgaagtttcactattacgccacgcctgctgaactggtgccgatgctggaagagaaaagccagtggctggagaaagccgcgctggtgtttgggcgagaagattccgggctgactaacgaagagctggcgctggctgacgtgctgacgggcgcgccgatggtggcggattacccgtcactcaatctggggcaggcggtgatggtctattgctatcaattagcatccttaatacaaatttctcagccaccggtgacagtttcggatgaaaaccagctggcggcactgcgtgttcgtgcagataagcttcttgcgcagttgggcgtcgctgacgatcaaaaaatggtggactggttacagcagcgcctggggcgtcttgaacagcgtgacacggtaatgttgcaccgattgcttcatgatattgaaaaaaaattagcggagtaa

SEQ ID NO: 306 - DNA, 480 bp, Enterobacter cloacae
ggtaacaatatgaaatacaaggttttagtctttgcagcactggcactgatggcagggcgcgtggcgcaggcggagcaaattggctccgtggataccgtgtttaaaatgtttgggccggaccacaaaattgtggtggaggcgtttgacgatccggacgttaaaaacgtcacctgctatgtcagccgggcaaagaccggcgggattaaaggcggcctggggctggctgaagacacgtctgacgcggccatctcctgccagcaggttggaccggtggaattgagtgacaaaattaaaaacggcaaagcgcagggcgacgttgtattccagaaacggacctcgctggtgttcaaaaagctacaggtggtccgtttttatgatgcgaagcgtaacaccctggcttatctggcctactcggacaaagtcgtggaaggctcaccgaaaaacgcgattagcgcggtgccgattatgccgtggcattga

SEQ ID NO: 307 - DNA, 864 bp, Enterobacter cloacae
aagaagtgtttgtcggccttgcgccagatattggaaaagagcacgaggctgattatgtccgggtcttcccaagatgacttcaccggcgcggatatgttccgccggttacgtgacatcataaagcgcggtgtcgtcaaagaagtacagatgcagcccccgcgcgtccgggtgactttcggcggagagcatcagtcgggctggctgcaatggtttacccttgcaacatcagaacgcgtcgactggagcgcgccgaaagtgggtgacccggtaccccccaattccacagcggcagaacgggcgctggaagccgttctgtcacacgtcggcgaccttcctggcgatatccggatcatcaaaaaccccgatttatgccccgtcgatttgctcccctggcttgcatgggagtatgcagtcacatactggaactcgggctggagcgagcagcaaaaacggcaggtcatcaaagcggcagcgtggcaaaacaagcaccgcggtacgcgcggtgctgtagaacgtgcgttgttgacggtcggctatgaaagccagttgcaggaatggtttgaaaaagtgccgaagggcgacccctacacatttggcatcaaaatttacctgctaaagcaaatggggatggatttagacctgctcaacacttttattgcgcagatattcgatgcgaaaaactgccgctcgttgctcgaatctatcaattttgaagcagaaatcgacggtgaattttatatcgccgggaccacggctgccgacgtcgtggtagaaatcccggcagaggatgaggggggagtaaaagtaaacggctccctgtttatttcgggtgtaccgacagctcatatcacagtggaaatatag

SEQ ID NO: 308 - DNA, 840 bp, Enterobacter cloacae
ggggggagtaaaagtaaacggctccctgtttatttcgggtgtaccgacagctcatatcacagtggaaatatagaaatggtacaaaagagaacagcgcttaaaagcgccacatctactccagacgataagatatacgcaatcctgactgaccggggcgcggagctggaagccgcagcgctcgctaccggcgtgccggttaaattaacaaagtttgttattggggacgcgaacgggcaggaagaagtcacacctgacccggccagaactgcccttatccatgaggtttatcgcggtgatatcaacggtgctgaaagcaagggcaaccaggtaacgtttactctcgatgtccccccggagacgggcggttatacgatccgtgaagttgggattttaacagaagcaggggaattatattccgttgcacgttctcctgatattttaaaacccacggaaagtaacggggcagtaatttcaataacgtttaaatatattcttgctgtgtcgagcacatcgacggtaacagtagttgtttataatgattatttaaccccggatgctgctgatgcccgatatttaaaagttaatgcgaatctaaaagaaatcgcagataacggtgcatcaagccagcaattagcaagaaaaaatattggcattgatggggatatagcgtacagagataaagaaaatatattcactaaaaagaatacgtttggtgaaatactatatgtcaataaatcaatagttttatcgggagattgggccgtatcatggtcactagctggcgcttatattgaggcctatctggttcactcgaaactgccggaccggctattctccaca

SEQ ID NO: 309 - DNA, 357 bp, Enterobacter cloacae
cgttgtcgagccgcgttactacaggcgattctggatggcgtggcgcagcatggcccttactttgtgattgcgccaggcctggcgatgccgcatggccgcccggaagagggcgtcaagaaaaccggcttcgcgctggtgacgctgaaaaccccgctggtgttcaaccacgaagataacgacccggtcgacatccttatcactatggcggctgtcgatgccaatacccaccaggaggtgggcatcatgcagatcgtcaatctgtttgatgatgaagctaattttgaccgtttacgcgcctgccgtaccgcgcaggacgtgctggatttaattgataacgccactgcggcggccgtttaa

SEQ ID NO: 310 - DNA, 663 bp, Enterobacter cloacae
gaggaattgaaaatgtcattaccaatgttgcaggtcgcgctggataaccagactctgtctcacgcttacgaaaccacccgtctgattgcggaagaagtggacatcatcgaagtcggcaccattctgtgcgtgggcgaaggcgttcgtgcggttcgtgacctgaaggcgctctatccgcataaaatcgtgctggcggatgccaaaatcgccgatgcgggcaaaattctctctcgcatgtgctttgaagccaacgccgactgggtcaccgtgatctgctgtgcggatatcaacactgcgaaaggcgcgctggacgtggcgaaggagttcaatggcgacgtgcagattgaactgaccggtttctggacctgggagcaggcgcaggagtggcgcgaagcaggtatccagcaggtggtttatcaccgcagccgtgatgcgcaggccgcaggcgtggcgtggggtgaagccgatatcagcgcgatcaaacgtctggccgatatgggcttcaaagtgaccgtaaccggtggcctggcgctggaagatctgccgctgttcaaggggattccaattcacgtctttattgccggtcgtagcattcgcgatgcggaatctccggtggaagctgcgcgtcagtttaaacgctcaatcgctcagctttggggttaa

SEQ ID NO: 311 - DNA, 870 bp, Enterobacter cloacae
ggagcgggtatgttgtcaaaacaggtcccgcttggcatctatgaaaaggcactccctgcgggggagtgctggctggagcggttacagctggcgaagcagctgggtttcgattttgtcgaaatgtcgctggatgagacggacgagcgtcttgctcgcctggactggagccgcgaccagcgtctggcgctggtgagcgccattgccgaaaccggcgtgcgcgtgccatccatgtgcctgagcgctcatcgtcgttttccgcttggcagcgaagatgatgccgtacgcgccgaagggctggagatcatgcgtaaagctattcgcttcgcacaggatgtcggcatccgcgtgatccaactggcgggttatgatgtttactatcaggaagccaatgatgaaacgcgccgtcgtttccgtgacggcctgaaagagagcgttgagatggcaagccgtgcgcaggtgacgctggcgatggagatcatggattatccgttgatgaactccatcagcaaggcgctgggctacgcgcactatctgaataacccgtggttccagctttatccggatatcggcaacctgtcggcatgggataacgacgtacagatggagcttcaggcgggcatcgggcatatcgtggcggtgcacgttaaagatacccgtcccggcgtgtttaaaaacgtaccgttcggcaccggggtggtggatttcgaacggtgcttccagacgctcaaacagacaggttattgcgggccttacctgattgagatgtggagcgaaaccgcggacgatccggcggcagaagtggcgaaagcccgggactgggtgtgcgagcgcatggcgcgggcaggactgatggaggcggaacatgcttaa

SEQ ID NO: 312 - DNA, 654 bp, Enterobacter cloacae
acgtggtgccaggcggatggccgggtaaaaccccaattggccgtgttatatccatgcaaacccggtttatcccttagccggtggccatttgtcatcattcaccccaggggcgtgcgtatgttcgtcgccgaactgtcggaagcgtttaatggcatctcccagcgcctgatccctggcgcggtgctggcgattgactgtgcggctatctatagctttgcgccaaacgccgttgtctggggctttatgtggggcaccatcggccagctgattgcggtcggcattctggtgggctgtggctcctcaatcctgattattcctggctttatcccgatgttcttctccaacgccactatcggcgtgtttgctaaccacttcggcggatggcgcgcagcgctcaagatctgcctggtgatgggcatggttgaaatcttcgggtgcgtgtgggcggtcaagctcaccggcatgagcgcctggatgggcatggcggactggtcaattctggcgccgccgatgatgcagggctttgcgtccgtcgggctggtctttatggccgtcatcatcctgattgccctggcttatatgttcttcgctggccgttcgctgcgggctgaagaagatgcggaaaaacaaacagcagaagtgtctgctcattaa

SEQ ID NO: 313 - DNA, 318 bp, Enterobacter cloacae
ggagtttcgattatgaccgtacgtatcctggctgtgtgtggcaatgggcaaggtagctccatgatcatgaagatgaaagtggaccagtttttaacccagtcaaacattgaccacacggtgaacagctgcgcagtgggtgaatacaaaagtgaactgaacggcgcggacatcatcatcgcctcaacgcacattgccggcgagattagcgtgtcgggcaacaaatacgtggtaggcgtacgcaacatgctgtcgcctgcggatttcggaccaaagctgctggaagtgatcaaagaacacttcccacaagacgtgaagtaa

SEQ ID NO: 314 - DNA, 186 bp, Enterobacter cloacae
ggatgccacatgaaactacgtgattcgctggcagagaataactccatccttttacaggccgaagcaagcacctggcaggaagcggtgaagctgagcgtggatctgctggttaaggctgacgttgtcgagccgcgttactacaggcgattctggatggcgtggcgcagcatggcccttactttgtga

SEQ ID NO: 315 - DNA, 570 bp, Enterobacter cloacae
tggaggcggaacatgcttaagctgaaacagcaggtctttgaagccaatatggatctcccgcgctatggactggtgacgtttacgtggggcaacgtaagcgccatcgatcgcgagcaggggctggtggtgattaagccgagcggcgtggcctatgacgccatgaaagcggacgatatggtggtggttgacctggaaggactggtcgttgaaggcaaatggcgtccttcttctgatacggcaacccatctggcgctgtaccagcgttacccgtccttgggggggattgtacatacccattccacgcacgccaccgcctgggcacaggccgggctggcgatccctgctttgggtacaacgcacgcggactacttcttcggtgatattccctgcacgcgggcgttaacgcagactgaggtcgaaggcgagtacgaacttaacaccggcagggtcattatcgaaacgctgggtgagacggaaccactgcatacgccgggtattgtggtgtaccagcatggtccattctccgggcgtaatcttcacctcggacctggcggacccgagcttaggtaa

SEQ ID NO: 316 - DNA, 708 bp, Enterobacter cloacae
aaaagtgctcgctattcttttaataagagagtgcgaaccgccattttctcttatatggactgtttactcagcgaaaggagaatgccaatgcaaaataaaaaaacaattcacgtggccgttgttgacagctgcgaattcacgatgattggcctgcaatcacttggaaagcgtgagcctgatgaaaaacacgacgttattttccatgggtttacccatatcgaagaacttgctatgagtgaacaactctttgatatcatcatttatgatccgttgaatacgcgtcatttccgggtgacgacaaatgacgacattctctgcattaaacagaaacaagtgacggcgaagatctatatctattcgttatccgccggctatttgaaatttaaacatgttgatggggtaatcagtaaaagagtctccctgggggatatcaaagcgctgtggcaaatactgatgagccagacgccgcaagagtctggccgttacaatgtaggcatgacgacccgcttacgcaccccggcgaggctgtccagcgaggaggccagcgtattgcgcggctattcctgtaatctcaaaaccaagcaaatcgcccgtcagctggggtgtaacgtcaggctggtttacttttataagaacaacgccatgaacaagcttaaagccgtgcgtggcccctcgttttaccagagcattcgctggatcctgaattaa

SEQ ID NO: 317 - DNA, 762 bp, Enterobacter cloacae
attaagaatttgaccgtgtgtcgtttgccttttgttcccgtgtccgcgggaacctttttttcattttctgaaggctgttccatgtataccgttcttccctctcccctgttgcaacgtatctcagggctgcgcttccagccgcttgtcgatcttcattcgggccaggtgttcgcgcatgaagtgcttgtggagatccgtaacgtcaatcttgaggtgctgtttgcctcgctgccctcgcgcagcgcgctgcaaatcttcttctggcaggccaacactctcttacagatacccgcccgggacggttactggctaaaccttccggcagagcaccttctcgacgaacgcgctatccggttgttgctggcgttacgccatcagcagcggttaacgattgaaattcaggatcccctgaccatcacacggctgagcgaggctgagcaacgtcatcttcatgccacgcttgttcggttaaaagaggcgggatggcaaatctggctggacgatttaacccgggagttggctgaggccttcgcgcggcttgcgctaccgctggatggggtaaaaattgaccgttcagcactgcgcgagcgcgcgccgcttgccccgtttgtgcaggaggtcaggacaggtatcgcgcaatcaattcttatcgaaggcatcgaaaactcgcgggatctggcgcgcgcccgcacgtccggcgcacagtctggccagggttttctgtggcccgaaagccgaaccgatgcccgcgtaacgctttga

SEQ ID NO: 318 - DNA, 186 bp, Enterobacter cloacae
ggcggcaatgatgccagacacattaaagtcggcgtgatcaatggcgctgagcaggacgtggcggaagtcgccaaaaaggtggcaaaggagaaatacggtctggatgttgagctggtgggctttagcggctcgctgctgcccaacgatgccaccaaccagggcgaactggacgccaacgtcttctag

SEQ ID NO: 319 - DNA, 555 bp, Enterobacter cloacae
catcgcccgttcctcgcagaagataacaaggcgcacaattacaagctggtcgccgtggccaataccttcgtcttcccgatggcgggttactcccgaaagattaaatcggtctctgagctgaaggacggcgcaaccattgcgattccaaacgatcccaccaaccttggccgcgcgctgttgctgctgcaaaaagagaagctgattacccttaaaccggatgttggcctgctgccaacggcgctggatattaccgcgaacccgaaaaacttacagattatggagctggaaggggcgcagctgccgcgcgtgctggacgatccgaaagtggatgtggccatcatcagtaccacctatctccagcaaacggggctgtctccggtacacgacagcgtctttattgaagacaaaaactcaccctatgtgaatattgtggtcacgcgtgaagacaacaaagacgctgaaaacgtgaaggaatttatccagtcctatcagtcgccggaagtggcgaaagcggcagagaccctttttaacggtggcgcggtgccgggctggtaa

SEQ ID NO: 320 - DNA, 240 bp, Enterobacter cloacae
acgccccacggagttaccgggtgcttaccaaagttacgaccttcaccaccaccatgtgggtggtcgactgggttcatcgcagtaccgcgaacggtaggacgaacaccacgccagcgtgcagcaccagctttacccagaacgcgcagcatatgctcagcattgccaacttcgcccagagtagcgcggcagtctgcttcgactttacgcatttcaccagaacgcagacgcagggtgacataa

SEQ ID NO: 321 - DNA, 237 bp, Enterobacter cloacae
ttttccagccgcctggtgaagactaagctgctggcacagaaactgaaagacatggctctggaagatgtgctgatcatcaccggtgagctggacgagaacctgttcctggccgcgcgtaacctgcacaaggttgacgtacgcgacgcgactggtatcgacccggttagcctgatcgccttcgacaaagtcgtaatgactgctgatgctgttaagcaagttgaggagatgctggcatga

SEQ ID NO: 322 - DNA, 819 bp, Enterobacter cloacae
aggcccaagcatgaagcgcattatgccgcgtgcgaaaggtcgtgcagatcgcatcctgaagcgcaccagccacattactgtggttgtgtccgatcgctgagactctggagactagcaatgggtcagaaagtacatcctaatggtattcgcctgggtattgtaaaaccatggaactctacctggtttgcgaacaccaaagaattcgctgacaacctggacagcgattttaaagtacgtcagtacctgactaaggaactggctaaagcgtctgtatctcgtatcgttatcgagcgtccagctaagagcatccgtgtgactattcacactgctcgccctggcatcgttatcggtaagaaaggcgaagacgtagaaaaactgcgcaaggtcgtagcggatatcgctggcgttcctgcacagatcaatatcgctgaagttcgtaagcctgaactggacgctaaattggttgctgacagcatcacttctcagctggaacgtcgtgttatgttccgtcgtgctatgaagcgtgctgtacagaacgcaatgcgtctgggcgctaaaggtatcaaagttgaagttagcggccgtctgggcggcgcggaaatcgcacgtaccgaatggtaccgcgaaggtcgcgtaccgctgcacactctgcgtgctgacatcgactacaacacctctgaagcgcacaccacttacggtgtaatcggcgttaaggtatggatcttcaaaggtgagatcctgggtggtatggctgctgttgaacaaccggaaaaaccggctgctcaacctaaaaagcagcagcgtaaaggccgtaaataa

SEQ ID NO: 323 - DNA, 423 bp, Enterobacter cloacae
ggagcgtcgctgatgttacaaccaaagcgtacaaaattccgtaaagtgcacaaaggccgcaaccgtggtctggcgcagggtacggatgttagcttcggcactttcggtctgaaagctgttggccgtggtcgtctgactgcacgtcagatcgaagcagcacgtcgtgcaatgacccgtgcagttaagcgtcaaggtaagatctggatccgtgtattcccggacaaaccgatcaccgagaagccactggaagttcgtatgggtaaaggtaaaggtaacgtggagtactgggttgccttgatccaaccgggcaaagtcctttatgaaatggacggtgttccggaagagctggcccgtgaagccttcggcctggcagcagcgaaactgcctatcaaaaccacctttgtaactaagacggtgatgtaa

SEQ ID NO: 324 - DNA, 843 bp, Enterobacter cloacae
gtaagtcggaggagtaatacaatggcagttgttaaatgtaaaccgacatctccgggtcgtcgccacgtagttaaagtggttaaccctgagctgcacaagggcaaaccttttgctccgttgctggaaaaaaacagcaaatccggtggtcgtaacaacaatggccgtatcaccactcgtcacatcggtggtggccacaagcaggcttatcgtattgttgacttcaaacgcaacaaagacggtatcccagcagttgttgagcgtcttgagtacgatccgaaccgttccgcgaacatcgcgctggttctgtacaaagatggcgaacgccgttacatcctggcccctaaaggcctgaaagctggcgaccagattcagtctggcgttgatgctgcaatcaaagcaggcaacaccctgccgatgcgcaatatcccggttggttctaccgttcataacgtagaaatgaaaccaggtaaaggcggtcagctggcgcgttccgcgggtacttacgttcagatcgttgcgcgtgacggtgcttatgtcaccctgcgtctgcgttctggtgaaatgcgtaaagtcgaagcagactgccgcgctactctgggcgaagttggcaatgctgagcatatgctgcgcgttctgggtaaagctggtgctgcacgctggcgtggtgttcgtcctaccgttcgcggtactgcgatgaacccagtcgaccacccacatggtggtggtgaaggtcgtaactttggtaagcacccggtaactccgtggggcgttcagaccaaaggtaagaagacccgcagcaacaagcgtactgataaatttatcgtacgtcgccgtagcaaataa

SEQ ID NO: 325 - DNA, 342 bp, Enterobacter cloacae
gaggaagagatggaaactttagctcaacatcgccatgctcgttcttctgcacagaaggttcgccttgttgctgacctgattcgcggtaagaaagtgtcgcaggccctggacatcctgacctataccaacaagaaagctgcggtattggtcaagaaagtactggaatctgccattgctaacgctgaacacaacgatggcgctgacatcgacgatctgaaagtcgcgaaaattttcgtagatgaaggcccaagcatgaagcgcattatgccgcgtgcgaaaggtcgtgcagatcgcatcctgaagcgcaccagccacattactgtggttgtgtccgatcgctga

SEQ ID NO: 326 - DNA, 270 bp, Enterobacter cloacae
gactttactgactcagaaggcgggtgcgtaatgaccgataaaatccgtactctgcaaggtcgtgttgttagcgataaaatggagaaatccattgttgtagctatcgaacgttttgtgaaacacccgatctacggtaaattcatcaagcgtacgaccaaactgcacgtacatgacgagaacaacgaatgtggtatcggcgacaaggttgaaatccgtgatgctgtccaggtcgacgactactcctggacgctgttcgcgtgtaaaaaaaag

SEQ ID NO: 327 - DNA, 315 bp, Enterobacter cloacae
ggagatgctggcatgattcgtgaagaacgtctgctgaaggtgctgcgcgcaccgcacgtttctgaaaaagcgtctactgcgatggaaaaaacaaacaccatcgttctcaaagttgctaaagacgcgaccaaagcagagatcaaagctgctgtgcagaaactgtttgaagtcgaagtcgaagtcgttaacaccctggtagttaaagggaaagttaaacgtcacggacagcgtatcggtcgtcgtagcgactggaaaaaagcttacgtcaccctgaaagaaggccagaacctggacttcgttggcggcgctgagtaa

SEQ ID NO: 328 - DNA, 282 bp, Enterobacter cloacae
gccatgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccagtctttgttaccgacgaaatggttggtcacaaactgggtgaattcgcaccgactcgtacttatcgcggccacgctgctgataaaaaagcgaagaagaaataa

SEQ ID NO: 329 - DNA, 204 bp, Enterobacter cloacae
gacggtgatgtaatgaaagcaaaagagctgcgtgaaaaaagcgttgaagagctgaacgctgagctgctgaacctgctgcgtgagcagttcaacctgcgtatgcaggctgcaagtggccagctgcaacagactcacctgctgaagcaagtgcgtcgcaatgttgcgcgcgttaagactttactgactcagaaggcgggtgcgtaa

SEQ ID NO: 330 - DNA, 1308 bp, Enterobacter cloacae
acgcttttgcttccaacccggcggttaaaactctacggtgaatcattttcagatgcacaccttaacgtgttattaactaagcttgaaaaagcggcgactaatattacggaaaagcgtaagtcaggctgggatgaaaaagacgttgtgctgattacctatgccgatcagttctccacaaaaggggagcaagcgttgccggtatttacccggttctataatgaatggctttctcgtacgttttcccatgtccatctgttacctttttatccgtggtcttcggatgatggattttccgttattgattatcacgaggttgctcctgaaacaggaacctggcgagatgtcgcggaattaaaacattcagccagcttaatgtttgacttcgtttgcaatcatatgtcagcgaaaagcgaatggtttgctaattatcttgcgcagaagccgggctacgaagatttctttatttctgtcgaccccgaaaccgatttatccgcggtgacgcgtccacgcgcattaccgctgctgacgccgttcacgcttcatgatggcagcgttcgtcatctgtggaccacattcagcgatgaccagatcgatctcaatttcgcctcgccgcaggtgctgattgccatggttgacgttctgctccattacctcatggaaggggcgcgttatatccgtctggatgcggtcgggtttatgtggaagatcccgggaaccacctgtatccatctggaacaaacccattgccttatccagctgttccgcgccattacggacgctgtggcgcctggaacggtgatcatcactgagacaaatgttccccacaaagacaatgtctcttacttcggtgatggtgaaaatgaagcccacatggtctatcagttttccttacctccgctggtgctgcatgctgttcatcgtcaggatgttaaaaccctatgccagtgggcggggtcactggcgctgccttcaactcataccacctggtttaatttcctggcctcgcatgatggtatcggtttgaacccgttacgcggcatccttccggaatcagagatcctctcgctggttgaaaagcttcagcatgaatgcgcgctggtcaactggaaaaataatcctgacggtacgcgaagcccctatgaaattaatgtcacctatcttgatgcgttgagtttgcgagacagctcatatgatgagcgcattgcgcggttcatcctgtcgcatgctgtgttgttaagttttcctggcgtaccggctgtatatattcaaagcattctcggttcgcgtaacgattatgaaggtgtctaa

SEQ ID NO: 331 - DNA, 375 bp, Enterobacter cloacae
  unsure (96)
cgtcttggatataaccgcgcaataaacaggaagaaatacaccgcacgtcacgttgatctggaactcaataataagaagagtatacgttatcaaatntattctcgtttgagtgagtttattgctattcgtcgcggcgagagtgcgttccatccggatagccaggctatttttgacgcaatcggcgaacatatccttaaaattgttcgtgttgctgaaaatggcgagcgaatgacagcattatttaattttagcaataaaatgcagaccatttatggacaaacgctctttggtagggaattactatcaggacacgatattagcggtacggaactgaacctcaatccatggcaggtaatgtggattaaagaaaactaa

SEQ ID NO: 332 - DNA, 1326 bp, Enterobacter cloacae
tgtggattaaagaaaactaaaaaggaccctaaaatgaaaatgcccaaaattgtgctgttatcagcactggtttcgtgcgccctgttatcaggctgtaaggacgataaagcatctcaggtcaccattgagtttatgcactcgtcggtagaacaggagcgtcaggcagttattacgaaactgatcgaaaaattcgagaaagagaacccgactattacggtgaaacaggtacccgttgaggaagatgcctataacaccaaggtcattacgttggcccgtaccggcgcgctgccggaagtgattgaagtcagccatgactacgccaaagtcatggataaagagcaactgctggaccgtgacgcgatcggcaacgcgattaaagccgtcggtgaagataccttttatgacggcattttacgcgttgttcgcactgaagacggcaaggcatggacgggggtgccggttagcgcctggctgtccggcgtctggtatcacaaagatgcgctcgcggcagcaggaatcgaagagccgcacaactgggagcaactgctgaaggccagtcaggcgctcaacgatccggcgaaaaaacattacggtatcgcgctgccaaccgcagaaagcgtcatgaccgagcaggctttctcgcagtttgcgttgtcaggcggagccaacgtctttgatgcaaacggcaacgtgaaaatcgatacccctgaaatgtcgaaagcgctggcgttttatcgggcactggccgcgaacaccatgccgggctcgaatgatgtcatggagatcaaagacgccttcatgaacggctgtgcgccgatggccgtttactccacctatatcctgcccgcggtctacaaagatggcaatccggccaacctggggttcgtggtcccgacggaaaaatcatcagccgtgtacggcatgatcacctcgttgacgatcacgaccggccagaccgaagaggaaacgcaggcggcagaaaaatttgtgacctggatggagcaggctcaaaacgcgtctgactgggtgatgatgtcccctggtgcggcgctgccgttgaacaaactcgtggtgggcactgagagctggaaaaacaacgacgtgatcaaagcctttggtcaactgccttacgagctgattgcgcagttcccgaacgtccaggtatttggcgccgtaggcgacaaaaactttacccgcatgggagatgttaccgggtccggcattatcagttccatggtgcataacgtaacggtgggacaaaaagatctcaatgcgacgttaagcaacagccagaagaaactgactgacctgatctcacaacgatag

SEQ ID NO: 333 - DNA, 903 bp, Enterobacter cloacae
gagcgctttgcgaagggaattatgaagacgttgttttctggtcgttcagatatgcctttcgccatgctgctgttggcccccagcctgattttgctggggggcctggtggcctggccaatgatttccaacattgaaatcagttttttacgtttaccgctgaacccgcgtattgatgcggtgttcgtcggcctggataactacattcgcattctgggcgatgctgcgttctggcactccctgtggatgacgttctggtatacggccctggtcgtgctcggcagcaccgggttgggactggccgtagcgatcttctttaaccgtgaattccgcatgcggaaaacggcacgttcactggtgattctgtcctacgtgacgccgtctatttcactggtatttgcctggaaatacatgttcaacaacggctacgggattgtgaactacctgggcgttgatctgctgcatctctacgatcaggcgccgctgtggttcgataatcctggcagcagttttgtcctggttgtgctgttcgccatctggcgttacttcccgtacgcctttatctcgttcctcgcaattttgcagaccattgataaatcattgtacgaagcggcagagatggacggggcgaatgcctggcagcgttttcgtatcgtgacgttgcccgccatcatgccggtgctggccacggtggtcacgctgcgaaccatctggatgttctacatgtttgcggatgtgtatctgctcaccaccaaggtcgacattctgggcgtatatctctacaaaaccgcctttgcgttcaatgacctgggtaaagcagccgccatttccgttgtgctgtttgtgatcatcttcgcggtcattctgctgaccagaaaaagggtaaacctcaatggcaacaaataa

SEQ ID NO: 334 - DNA, 645 bp, Enterobacter cloacae
  unsure (525)
  unsure (526)
  unsure (544)
  unsure (546)
  unsure (609)
acctcaatggcaacaaataaacgcgttctgggccgtatcggtttttatctgggactggcggtattcctgattatcacgctgtttccgttttttgtgatgttgatgacgtcattcaaaagcgcgaaagaggcgatctcgctgcacccgaccattctgccgcaggagtggacgctacagcactacatcgacatctttaacccgctgattttcccgtttgtggattacttccgtaacagcatggtggtgtcgctgacctcctcggtcattgcggtgtttctcggcacgctgggcgcatatgcgttatccaaactgcgctttaaagggcgtacgacgatcaatgcgagcttctacaccgtctatatgttctccgggatcctgctggtggtgccgctgttcaaaatcatcaccgcgctcggcatttatgacaccgaactggcgctgatcatcaccatggtgacgcagacgttgcctaccgcggtctttatgctgcgcaactatttcgacaccatcccggacgaaatcgannaagccccgatgaaggacngnctgaaacgcctgcaaatcatcttccgcatcaccctcccgctgggcaattccggtctggtgttngtctttgttcactgcttcatggttggcgtggaatga

SEQ ID NO: 335 - DNA, 459 bp, Enterobacter cloacae
agcttcgaggcgctgaaagagtactatccgcaggcgaagaaagaagactggcgtctgtggcaggcaggtcagcgtgtgcagatcatcaaacgcgatccgaaagagggcggcgtgttgcgtatgagtaccgaagtggtaagcgataaggatggcaccattgccgtgctgctgggggcatctccgggggcgtctaccgctgcgccaatcatgctgcacctgatggaaaaagtgtttaaggacaaagtatccagcccggaatggcaggcgaagctgaaaaccattattccatcttacggtacgaagctgaacggtaacgttgaggccacggaacaagagctggaatacaccagccgcgttctgcaactgcaatacgtcaaaccgcaggctgcggatgctgcgccaaaggcagagctgaagcctcaggcggaaagcaagccggtagcggatatcgcgctgtaa

SEQ ID NO: 336 - DNA, 372 bp, Enterobacter cloacae
tgcactgcttttgtgttcttttattggtgtttaatgctgtggtggagtcgatgcggcgatcgtgttattttacgcgttaattattgttatttatctgtaaagggaggagatatggtacgggaaaaactgaagacacctgaaggccgcaagttcctgctggcgttactggttgtgtttatgattgctgctgcatgcgtggggcgagcaaccattgtcggtgtgattgagcagtacaacatcccgctatctgcctggacaaccagcatgtttgtcctgcaatcggcgatgatctttgtttacagcctggtgttcaccgtgctgctggcgattccgctggggattttctttctcggtgggcgtgaaaaacactaa

SEQ ID NO: 337 - DNA, 410 bp, Enterobacter cloacae
  unsure (372)
ataccgcccggtctaaaaggagagtttatcatgagtctggaaatcaaccagattgccttgcaccagcttatcaagcgtgatgagcaaacccttgaagtggtgctgcgcgattcgttactggaaccaacgcctaccgttgtcgagatgatggcggagttgcatcgcgtctacagcgcgaaaaataaagcctatggcttgttcagcgaagagagcgaactggcggatagcctgcgcctgcaacgtcagggcgaagaggatttcctggcattcagccgcgctgctactggccgtctgcgtgacgagctggcgaaatatcccttcgccgatggcggtatcgtcctgttctgccactaccgctgtccggcggtagtntttccacaagagctggcaatccgcgaggtcaataggga

SEQ ID NO: 338 - DNA, 1875 bp, Enterobacter cloacae
tcaataccagcgttgctccggctcagcgtcaggcgatcgccaaatctttcgcccaggctttgcagtcctccgttagcgacgaccaggcacactaagggaaacgaacaacagtttatggtgacgaatcgtcagcgctaccgtgaaaaagtctcccagatggtcagctgggggcactggtttgccctgttcaacattctgttggcgatggtgctcggctgccgttatctgtttgtggcggactggccaaccacattaaccgggcgcgtctactcgtggatgagccttgtgggtcactttagctttctggtcttcgccacctatctgctgatcctgttcccactgacgtttatcgtcatgtcgcagcggctgatgcgcttcctgtctgccattcttgcaacggcgggcatgacgctgttgctgatcgacagcgaagtctttacccgattccacctgcacctgaatcctgtcgtctgggagctggtgattaacccggatcagaacgagaccgcgcgcgactggcagctgatgtttatcagcgtgccgattatcctgctgatcgaaatgctgttcgccacgtggagctggcaaaaactccgcagtctgacccgacgccgccattatgcgaagcccgtcgcggcgctctttttcgcctcatttatcggttcgcacctgatgtatatctgggcagatgcgaacttctaccgcccgattaccatgcagcgcgcaaacctgccgctctcctatccgatgacggcgcgtcgtttcctcgaaaaacacggcctgctggacgcgcaggagtatcagcgtcgtctggtcgaacagggtaatccggaagcggtcagcgtgcagtatcccctgagcgatctgaaatatcgcgacatggggcgcggtcagaacgtgctgctgattaccgtcgatggcctgaactattcccgctatgagaagcagatgccagcgctggctgaattcgctgagaacaatatcgtattcactcagcatatgagctccggtaattcgaccgacgcgggtattttcggcctgttctatggcatttcaccgagctatatggacggcgtgctgtcggcccgtattccggcggcattgattaccgggcttaatcagcagggctaccagctggggctgttcgcctctgatggtttcaacagctcgctgtaccgccaggcgctgctgtctgatttctcactgcccgccgcgcagagccagtctgacgatcggaccgctgaccagtggatagactggctgaagcgctatgcgcaggaagataaccgctggttctcctgggttgcgtttaacggcacaacgcttgatgacagcaatcagaaaggcttcgcgcgccgctatagccgtgcggcgggcgatgttgatgcgcagatcggccgcgtgctgaccgccctgcgcgacgcgggcaagctggataatacggtcgtgattatcacggcggggcatggcgtgccgctcggcgacgaggcgaagggcatggagtggtcgcgtccgaacctgcatgttcccctggtgatccactggccgggcactcccgcgcagcgcatcaacatgctgaccgaccataaagacgtcatgaccacgttaatgcagcggctgctgcacgtcagcacaccggcaattgagtactcgcagggccaagacctctttagcgccacgcggcgtcataactgggtcacggctgctggcggaaacacgctggtggtgaccacaccgacgttgtccctggtgttgaacagcaacggcaattaccagacgtatagcctcgaaggtgagaagctgaaagaccagaaaccgcagctcagtttgctgttgcaggtgctgacagacgagaagcgctttatcgctaactga

SEQ ID NO: 339 - DNA, 519 bp, Enterobacter cloacae
caaaaaggaatgacagtgaaaaacgcacctaaatttgccatcgccctcatcgccgctgcgtgcgccagcagcagtgctttcgccagcgaaacccagaaagagcagccgctggaaaaagttgctccgtatccgcaagcggacaaagggatgaagcgccaggttattcagctcccggctcagcaggatgaagcaaatttcaaagttgagctgttaatcggccagacgctggaagtggactgcaaccagcatcgtctgggcggccaactggaaagcaaaacgctggaaggctggggctatgactactatgtcttcgacaaagtaacctcgccagtctccaccatgatggcgtgcccggacggcaagaaagagaagaaatttattaccgcgtatctgggtgataacagtctgctgcgctataacagcaagctgccgatcgtcgtatatacgccggaaaacgtggatgtgaaatatcgcgtatggaaggcggatgagacggtaggacaagcggtagttcgttaa

SEQ ID NO: 340 - DNA, 231 bp, Enterobacter cloacae
tttatgccacaacattcccgctacagtgacgaacacgttgaacaactgctcagtgagctggtcaacgtactggaaaaacataaaacgccaaccgatctctccctgatggttttgggaaatatggttaccaacctgatcaataccagcgttgctccggctcagcgtcaggcgatcgccaaatctttcgcccaggctttgcagtcctccgttagcgacgaccaggcacactaa

SEQ ID NO: 341 - DNA, 1458 bp, Enterobacter cloacae
gccaaaactgatccataccgttcgcggtgccggatatgtcctggagatcagagaagagtgaggttcaaaatttccctgaccacacgcctgagcctgattttttctgcggtgatgcttacggtatggtggttatcaagttttatcctgattagcacccttaatggctatttcgataatcaggaccgcgattttctgacaggtaaacttcagctcaccgaagagtttcttaaaacagagacgttcaggaacaaaacggatattaagtcattatcagaaaaaataaacgatgcgatggtggggcacaatggcttattcatttctataaaaaacatggaaaatgaaaaaattgttgaactctatgccaaaaattctgttgttccagcggtcctgcttaataagtcgggtgatattctcgactatatgatccagacggaagaaaataacaccgtgtaccgcagtatctcgcggcgggttgccgtgacgccggaacagggtaaaagcaaacatgtcatcattacggttgccacggatactgggtatcacaccctgtttatggacaaactcagtacctggctgttctggttcaatatcggtctggtctttatttctgtttttctgggctggctgaccacacgtattggtctgaaaccgctacgggaaatgaccagtctggcttcctccatgaccgtacacagcctggatcagcgtctaaatcccgatctggctccgccggaaatctctgagaccatgcaggagttcaataatatgtttgatcgcctggagggggcattccggaaactgtcagatttctcgtctgacatcgcgcatgagctgcgcacaccagtcagtaatctgatgatgcagacgcagtttgcactggctaaggaaagggatgtttcgcattaccgcgaaattttattcgctaacctggaagaactgaaaaggttgtcacgaatgaccagtgacatgctttttctggcacgttcagagcatggtctgctgcggctggataaacatgatgtggatctggcagccgaactgaatgaattacgtgagttgttcgagcccctggcagacgaaacaggaaagacaatcacggttgaaggagagggcgttgttgccggagacagcgatatgctccgacgtgctttcagtaacctgctttccaatgcaatcaagtattctcccgataacacctgtacagcgatacaccttgagcgtgacagggactgtgtgaacgtgatgattacgaatacgatgtccggccaggttcccgctaatctggaacgtttgtttgaccggttctatcgcgcagactcatcaaggttctacaacacggaaggcgcggggctgggattatcaattacaaggtcgatcattcatgctcacggcggcgagctgtcagcagaacagcaggggcgtgaaattgtgttcaaagtgcgcctgttaatggattaa

SEQ ID NO: 342 - DNA, 732 bp, Enterobacter cloacae
  unsure (297)
  unsure (306)
cgtaagcgcggatccggcactcccgaggtgaagaccatccatgttatcgagatggtgatagaagaaactgatgtgggtattagctggattgtcaggctctgtgccctgtttaccacactcggtgctttgttcctttacactaataagagagtattgtcctgcctgctgatgacgatgagtgggggcgtggcgctggctacacttgcctggggaggacacgccgttatgcatgacggtctgcattactatctccatttactgagcgatctgacccatctcggcgctgcaggtgcctgngacaggggntttgctctggttgcatttgctatcctgctgatgcgcagaaacgagcataatgcacagagcgtcattgtgatatctgactccctggcaaaatttgccacggcaggaacggtgattgttgtagccctgatcctgactgcgctggtcaactatctgtatattgctgagggtaacttaactcccttattcaacagttcctgggggaggatattgcttgccaagacggctctgtttgttctgatgcttcttctggctgcagcaaaccggtttcacctgggtccccggcttgaagttatggtcagggaagggaattatgatcgcagcgttgccctgatgcgaaacagcatcctgacagaattcgttgttgcgattatcattctgggcgccgtagcgtggctcggaatgcttgctccgtctcaggtcagctag

SEQ ID NO: 343 - DNA, 711 bp, Enterobacter cloacae
gatttttactttcatatcagcgagttgaccatgcagcgtattttaatcgttgaagacgaacaaaaaacaggtcgttacctgcagcagggactggttgaggaaggctatcaggccgatctctttaataatggccgcgatggtctcggggccgcgtcgaagggacagtatgatttgataatactggacgtgatgctgcctttcctcgacgggtggcaaatcatcagcgcactgagggagtccgggcacgaagaaccggtcctgtttttaaccgcaaaggacaacgtgcgggacaaagtgaaaggactggagcttggcgcagatgactacctgattaagccctttgattttacggagctggttgcacgtgtaagaaccctactgcgccgggcacgctcgcaggccgcaacagtctgcaccatcgccgatatgaccgttgatatggtgcgccggaccgtgatccgttcggggaagaagatccatctcaccggtaaagaatacgttctgcttgagttgctgctgcaacgcaccggagaagtgttacccaggagtcttatctcgtccctggtctggaacatgaattttgacagtgatacgaatgtgattgatgtcgccgtgagacgtctgagaagtaaaattgatgatgactttgagccaaaactgatccataccgttcgcggtgccggatatgtcctggagatcagagaagagtga

SEQ ID NO: 344 - DNA, 413 bp, Enterobacter cloacae
tggactctatcaatgtcaaacactcttcagccccgcagggcgcgggcgtcctactcaatggactttaagctggctctcgtcgaaaagtcatatcagcctggagcctgtgttgcccggttggcgcgggataatggaattaatgacaatctgctgtttacctggcgccagcgttacagacatcttctgcccgatgaaatacaacggtcaatcagagagcaagactctgttatccccgttgtcctgcctgatatggccctgtcacaccatgctgagccgcactatgaacccgccgctccagcctgccgcgaggccatgacatgcgaagtgactgtcggcggtgccagcctgcgtctgtccggggatttatcacctgcacttctgaaaacgctgatccgcgaaactttggaaaaacc

SEQ ID NO: 345 - DNA, 1230 bp, Enterobacter cloacae
aggaggtacccccaagtgaaactaaacgcccggcaggtggatgccgccaaacctaaagataagccttacaagctggctgatggtggtggtttgtatctcctgattaaacctaatggcggcaaatactggcggctcaagtatcgtgtagccggcaaagagaagctgttagcgcttggtgtgtatcctgaagtcacattggccgatgctcgggcaaaacgtgaagaagcgaaaaggggtatcgctgggggtatcgatcctatggaagcgaaacgggaggagaagattgcccgtgaaattcagttaaacaacaccttcaaagatattgcccttgaatggcacagcagcaaactaaaaaaatggtctgctggttatgcttcagacatcctcgaagccttcaataaagatgtgttcccatacattggcaaaaaaccaatagccgaaatcaaaccgcttgaactgttgaatgtgctacggcgcattgaggggcgcggcgctaccgaaaaggcaagaaaagttaggcagcgctgtggggaagttttccgttacgcaatagtcaccggtcgagctgagtataaccccgccccggatctcaccagcgcgatgcaagggcacgagtccaatcattttcctttcctcacacctaaacaattgcctgatttcttcaatgcgttgtcaggatattcaggaagcgagttagtagttttggctgctcgtttgctgattatcaccggattgcgtcccggcgaactccgtggggcattttgggatgaaatcaatatcagtaaggcggtctgggaaatacccgcctcacgcatgaaaatgcgccgccctcatgtggtgccattgtccaggcaagctcttacgcttattggtcagatccaagagctaacaggcaattacccgcttgtgttcccaggccgtaacgatccgcgaaaaacaatgagtgaagccagcataaaccaagtctttaagcggattggctataacggaaaagtcaccgggcacggtttccggcacaccatgagtaccatcctgcacgaacagggctacaacaccgcgtggattgaaacgcagctggcacacgtcgacaaaaactctatacgaggaacgtacaaccacgcccagtatctggatggccgccgcgaaatgctccagtggtatgccgactatatggaggcgttggaaaacggcgaaaatgtagtgcacggaacgtttgggaaaagtgcttaa

SEQ ID NO: 346 - DNA, 1227 bp, Enterobacter cloacae
acccgcttcggattaaagtggcggtcttttccatgcggggagaaaaacgggttgatgaaaaaattgggggattatgtggaatatcattcgcaggaaattttgctcgccaacgagcaggatctgctggaagcgcgtcgcaacggcttgagcgaagcgatgctcgaccgtctggcgctgaccccggcgcgtttgaaaggtattgccgacgacgtccgtcaggtgtgcaacctcgccgacccggtagggcaggtgattgacggtggggtgctcgacagcgggttacgccttgaacgtcgtcgcgtgccgcttggcgtcattggggtgatttacgaagcgcgtccaaacgtgacggtggatgtcgcctccctgtgcctgaagaccggtaacgccgcgatcctgcgtggcgggaaagagacctggcgcaccaacgccgcgacggtaaatgtcattcagcaggcgctggaggagtgtggtttaccggcgggtgccgtgcaggcgattgaaagccccgaccgtgctctggttaacgagatgctgcgcatggacaaatacatcgacatgctcatcccacgcggcggtgcgggcctgcacaagctgtgccgcgagcaatctaccattccggtgatcaccggtggtattggcgtatgccatatcgtggtggatgacaccgcggaggtagaacctgcgctgaagattatcgtcaacgctaaaacccagcgtccaagcacctgtaatacggtagaaacgctgctggtgcatcagggcatcgccagtaccttcctgccagcgctgagcaagcagatggcggaaagtggcgtcacgctgcatgcggacgagaaggctttcgccctgctgaaagacggtccggcgaaggtcgttccggttaacgcggagcagtacgacgatgagtatttgtcgctggatctgaacgtgaaggtagttgcggatctcgatgacgctattgcgcacattcgtgaacacggaacccagcattctgacgcgatcctgacgcgcaccctgcgcaatgccgatcggtttgtgaatgaagtggattcgtctgcggtttacgtcaatgcctcgacgcgctttaccgatggcggccagtttggtctgggcgcggaggtggcggtgagcacacagaagctgcacgcccgcggtccgatggggctggaagcgctgaccacctacaagtggatcggctttggtgatgataccattcgtgcgtaa

SEQ ID NO: 347 - DNA, 399 bp, Enterobacter cloacae
agacagatgagcatgcaagatccgatcgcggatatgctgacccgtatccgtaacggtcaggccgcgaacaaagttgcggtcaccatgccttccgccaagctgaaagtggcaattgccaacgtgctgaaggaagaaggttttatcgaagattttaaagttgaaggcgacaccaagccggaactggaacttactctcaagtatttccagggtaaagctgttgtagaaagcattcagcgtgtcagccgcccaggcctgcgcatctataagaaaaaagatgagctgccaaaagtaatggctggtcttggtatcgcagttgtttctacctctaaaggtgttatgactgatcgtgcagcgcgccaggctggtcttggtggcgaaattatctgctacgtagcctaa

SEQ ID NO: 348 - DNA, 546 bp, Enterobacter cloacae
tcggaggaaagaatgtctcgtgttgctaaagcaccggtcgttattcctgccggcgttgatgtaaaaatcgacggtcaggttattacgatcaaaggtaaaaacggcgagctgactcgtaccctcaacaaagctgttgaagttaaacatgcagataacgctctgaccttcggtccacgtgatggtttcgtggatggatgggctcaggctggtaccgcgcgtgccctgctgaactcaatggttgttggtgttaccgaaggcttcactaaaaagcttcagctggttggtgtaggttatcgtgcagctatcaaagggaatgcagtaggcctgtctctgggcttctcacaccctgttgagcatccgctgccggccggtatcactgcagaatgcccgactcagactgaaatcgtgctgaaaggcgctgataaacagctgatcggtcaggttgcagcagatctgcgcgcctaccgtcgtcctgagccttataaaggcaagggtgttcgttacgccgacgaagtcgtgcgtaccaaagaggctaagaagaagtaa

SEQ ID NO: 349 - DNA, 363 bp, Enterobacter cloacae
ggtaacactatggataagaaatctgctcgtatccgtcgtgcgacccgcgcacgccgcaagctcaaagagctgggtgcaactcgcctggtggtacatcgtaccccgcgtcatatttacgcacaggtaattgcaccgaacggttctgaagttctggtagctgcttctactgtagaaaaagctatctcagaacaattgaagtataccggtaacaaagacgccgcagcagctgtaggtaaagctgtcgctgaacgcgctctggaaaaaggcatcagcaatgtttcctttgaccgttccgggttccaatatcatggtcgtgtccaggcactggcagatgctgcccgtgaagctggccttcagttctaa

SEQ ID NO: 350 - DNA, 927 bp, Enterobacter cloacae
cagatggctaagcaaccgggattagattttcaaagtgccaaaggtggatttggcgagctgaaacgcagactgctgtttgtaatcggcgcgctgattgtgttccgtattggctcttttattccgatccctggtattgatgccgctgtacttgccaaactgcttgagcaacagcgaggcaccatcattgaaatgttcaacatgttctctggtggtgctctcagccgtgcttctattttcgcactgggtattatgccgtacatttcggcatcaattattatccagctgctgacggtcgttcatccggccctggcagagttgaagaaagaaggggagtctggacgtcgtaagattagccagtacacccgttacggcactctggtgctggcaatattccagtcgatcggtattgctaccggtcttccgaatatgcctggtatgcagggcctggtattaaacccaggctttgcattctatttcaccgctgttgtaagtctggtcacagggaccatgttcctgatgtggctcggcgaacagattactgaacgaggtatcggtaacggtatctcaatcattatcttcgccggtatcgttgcgggtctcccgccggccatcgcccatactatcgagcaagcgcgtcaaggcgacctgcacttcctcctgttgctgttggttgcagtattagtatttgcagtgacgttctttgttgtcttcgttgaacgtggtcaacgccgcattgtggtgaactacgctaaacgtcagcagggtcgtcgtgtctatgctgcacagagcacacatttaccgctgaaagtgaatatggcgggggttatcccggctatcttcgcttccagtattattctgttcccggcaaccatcgcgtcatggttcgggggcggtcttcaccacacgggccgaaaatccgacgcatag

SEQ ID NO: 351 - DNA, 510 bp, Enterobacter cloacae
aggtgtaagatggctcacatcgaaaaacaggctggcgaactgcaggaaaagctgatcgcggtaaaccgcgtatctaaaaccgttaaaggtggtcgtattttctccttcacagctctgactgtagtgggtgatggcaacggtcgcgttggttttggttacggtaaagcgcgtgaagttccagcagcgatccagaaagcgatggaaaaagcccgtcgcaatatgattaacgtcgcgctgaacaacggtaccctgcaacacccagttaaaggtgttcacacgggttctcgtgtattcatgcagccagcttccgaaggtaccggtatcatcgccggtggtgcaatgcgcgccgttctggaagttgctggagttcataacgttctggctaaagcatatggttccaccaacccgatcaacgtggttcgtgcaactattgatggcctggaaaatatgaattctccagaaatggtcgctgccaagcgtggtaaatccgttgaagaaattctggggtaa

SEQ ID NO: 352 - DNA, 186 bp, Enterobacter cloacae
ttgaccatggcaaagactattaaaattactcaaacccgcagtgcaatcggtcgtctgccgaaacacaaggcaacgctgcttggcctgggtctgcgtcgtattggtcataccgttgagcgcgaggatactcctgctgttcgtggtatggtcaacgcggtttacttcatggttaaagttgaggagtaa

SEQ ID NO: 353 - DNA, 438 bp, Enterobacter cloacae
gagatgcgtttaaatactctgtctccggccgaaggctctaaaaaggcgggtaaacgcctgggtcgtggtatcggttctggcctcggcaaaaccggtggtcgtggtcacaaaggtcagaactctcgttctggcggtggcgtacgtcgcggtttcgagggtggccagatgccactgtaccgtcgtctgccgaagttcggcttcacctctcgcaaagcagcgatcacagcggaaatccgtctgtctgacctggcgaaagttgaaggcggcgttgtagacctgaacacgctgaaagcggctaacattatcggtatccagatcgagttcgcgaaagtgatcctggctggtgaagtttctactccggtaactgttcgtggcctgcgtgttactaaaggtgctcgtgctgctatcgaagctgctggcggtaaaattgaggaataa

SEQ ID NO: 354 - DNA, 273 bp, Enterobacter cloacae
tttcagttaatcaacaaactttctgccgccgcggtatcgtggcggcgtcatggagtcatcatggcgcaaatcatatttaatagagaatgggttgttgaggcagaactgactgcacttacgggcctgagcgagcgacaaataaaagctctccgcagtggcccctggcttgaaggtatacacttcaaacgccagtcaatgaaaggcggagaaaccaaacgcggtctcctctggtacaactaccctcgcataaatcagttagtgcaggagctgtaa

SEQ ID NO: 355 - DNA, 1389 bp, Enterobacter cloacae
cggatgcttccagcgcgaaatggcggaggcattcacgagagagccgcgcgtgttggcgctcagcgcagaacgccaaaaagaatgctggcgtggatccgtaaaaccatgctggtttcgactcaatggccagagattaaaaagcagctcaccaaatggctggatactcctccagcgaagcgtgagccggtagatatcaatactgagacaaaaaccgacagcggcgccacgcttggcggcggaaatcagacagaccgcagccctgatctggtccacaacttggcaaccctccgcattgaaaccgcacttggcatcattgcggccgccatggactttgatatttattccatcccggtagaaatcatgcgccgcgcaaaagagttggagagcagcggcggggatccccgtttttcagcgtggtggactaaattacgcgtcacgcctggtattctcgattattcccgcgccgctatcatcgctctgatcaagagcgcgccggaagacctttatctgcgtccagtagacctgcgcgcttacatcaatcgtgaactggtcgagtcagatcacgctaagccagatccaaaaaccgttgctaccgcatgcggtaccgcaactacagagcaaaatgatgatcagacccaacctgctgaaaaggacaaagctgatttaccagcagtgtgcccgggccgcgctgcgcagctcgacaaagaactcaatgaagcattcgaaaaacgcccttcagtggaaccgcaggccagcgatcaaccccagatagagaacctgggcggcggggtcttctctgttgaagctctgataaatcccccctcctcaaatgaagtcgaaaaacaggaagtgccaccagcattaaccgatcgcgaaatcgaaattgctcatgcactgaatgatttgatcgctggccggacccgcatcatggataaagaggaggccgaaggcgtagtgaccaccaccggccactctgtttctcatgtcattcccctgctgcttgccgatatcagcacagccgaattctgcctgtcgccagatttctccgacgaggagatccacgacgtcgcgacaacgatactggatagctggtcagacgatctctgcgttcgccagaaaatcgccttggacgcgatagttgagtaccgccgccctgctccaccgaaagcggtcgtgcttgatcctccattcattacggccaaaccgaaaaaagcagcagaaccagttcctgaaacccacaccgcggcaccactgaactaccgccagcagctcatccttgccgctatgcagggtatgtgtgccaacccttcctatcgctgtgattttgaggatttacccgccatggcgatcgaactggcggatagcttgatcaatcaggatggtatctga

SEQ ID NO: 356 - DNA, 1392 bp, Enterobacter cloacae
aggtatacacttcaaacgccagtcaatgaaaggcggagaaaccaaacgcggtctcctctggtacaactaccctcgcataaatcagttagtgcaggagctgtaatgtcttttcccacgggcgttgaaatccataacggcaaaatccgaatctctttcacctaccgcggcaagcgttgccgcgaagtgttgaaaggttgggtgaacacccctgcaaacatcataaaggccggaaacctgcgagcgctgatcgtcagcgaaattcagatgggagagtttgattattcccggcggttccctgagtcgaaagccgttcagaaatttacctctacccgcgtggcgtatacctggggcgatctcaacgaactatggctggccgccaaagaggaggacgtttcaaggaatactatgacgcgcctgcttgcccagctcagaacgataaatcgaattgtcggggagaatacgctgattgtagacataacccacagcgacatgctgcggtacaggaaagaactattgcggggagagagcttttacgcggaaggaaacaaacggaaaaaaacgggccgcagcgtgaacaccgttaacgactatatatcggttgtctgccagatgctgcgcttcgctcaccgcagccggttcattaccgagaagcctttcgagcacatcaccaaactgcacaaagaccggaaaaagcctgacccgttgcagcgggatgaatacgccaccatgatgctggcgatcaacggccaggatagaaatttatggcaattcgcgatgaacgccgggccgcgccacggcgagcttgctgctctcgcttgggatgacgtcgatcttgaatcaggcaaagttcatatccagcgcaaccgaaccgcccagggcgattttgtcccaccaaaaaccaaagccggtgaccgggtgatcaccctgctcgccccggcgctcgatgctctacgtgcgcaatatgcactgactggccatctgccagaaacggagatcgttcagcatttcagggagtacggcaaaacggagattcagaaacatcgatttgtttttttacccgggttgaagacaaaaaatcccggcaggtatttttccacgcagtctatatcagatcgatgggatgtgtgcgttgagaaagcaggtattcgccgccgggcaccatatcagtccaggcatacttttgcatgctggtctctggccgcaggcgcgaacccgtcgttcatcgccagccagctcgggcacgaagatgcggaaatggtgtaccgggtgtactcagcatggatcaaagagttcgatggggaacaggtagagctgcttaaccagagattagggtttgcccccaatacgccccctgaagggaaaatcataaaaataaatgagttgaatcagtaa

SEQ ID NO: 357 - DNA, 522 bp, Enterobacter cloacae
catttcgattggtttgcctcgcactcgcggggtgaaaatgtttgtagaatacttctgacaggttggtttatgagtgcgaataccgaagctcaagggagcgggcgcggcctggaagcgatgaaatgggtagttgtagccgtgctgctgattgtggcgattgtcggcaactatctttatcgtgacatgatgctgccgctacgcgcgcttgcagtggtaattctgattgctgcggcgggtggtgtcgcgctgttgacgacgaaaggcaaagcgaccgttgcgtttgcccgcgaagcgcgtaccgaagtccgcaaggtcatttggccgactcgccaggaaacattgcacaccacgctgattgtagcggcggtgaaccgctgtaatgtcactgatcctgtggggactggatggtattctggttcgcctggtatcctttatcactggcctgaggttctgagatgtctgaagcccctaaaaagcgctggtacgtcgttcaggcgttttccggttttgaaggccgcgtag

SEQ ID NO: 358 - DNA, 1221 bp, Enterobacter cloacae
tatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgtgctttcgatcagatcgataacgcaccagaagaaaaagctcgtggtatcaccatcaacacttctcacgttgagtatgacaccccgactcgccactacgcacacgtagactgcccaggccacgccgactatgttaaaaacatgatcaccggtgctgcgcagatggacggcgcgatcctggttgttgctgcgactgacggccctatgcctcagactcgtgagcacatcctgctgggtcgtcaggtaggcgttccttacatcatcgtgttcctgaacaagtgcgacatggttgatgacgaagagctgctggaactggtagagatggaagttcgtgaactgctgtctcagtacaatttcccaggcgacgacactccaatcgttcgtggttccgcgctgaaagcgctggaaggcgaagcagagtgggaagagaaaatcatcgaactggctggctacctggattcttacatcccagaaccagagcgtgcgattgacaagccattcctgctgccaatcgaagacgtattctccatctccggtcgtggtaccgttgttaccggtcgtgtagagcgcggtatcatcaaagttggtgaagaagttgaaatcgttggtatcaaagagactgcgaagtctacctgtactggcgttgaaatgttccgcaaactgctggatgaaggccgtgctggtgagaacgttggtgttctgctgcgtggtatcaaacgtgaagaaatcgaacgtggtcaggttctggcgaagccaggctcaatcaagccacacaccaagttcgaatctgaagtgtacattctgtccaaagacgaaggcggccgtcatactccgttcttcaaaggctaccgaccacagttctacttccgtacaactgacgtgaccggtaccatcgaactgccagaaggcgtagagatggtaatgccaggcgacaacatcaagatggttgtgactctgatccacccaatcgcgatggacgacggtctgcgtttcgcaatccgtgaaggcggccgtaccgttggcgcgggcgttgttgctaaagttctcggctaa

SEQ ID NO: 359 - DNA, 555 bp, Enterobacter cloacae
ggttctgagatgtctgaagcccctaaaaagcgctggtacgtcgttcaggcgttttccggttttgaaggccgcgtagctacgtcgctgcgtgagcatatcaaattacacaatatggaagagttatttggcgaagttatggttccgaccgaagaagtggttgagatccgtggcggccaacgtcgcaaaagcgaacgtaaattcttcccgggttacgtgctggttcagatggtgatgaacgacgcgagctggcacctggtgcgcagcgtaccacgcgtgatgggctttatcggcggcacatctgaccgtccggcgccaatcagcgacaaagaagttgatgcgattatgaaccgcctccagcaggtgggtgacaaaccgcgtccgaaaacgctgtttgaaccgggtgagatggttcgtgttaacgacggtccgtttgctgactttaatggcgtcgtcgaagaagtggactacgagaagtcccgcctgaaagtttccgtttctatctttggtcgtgcgaccccggtagagctggactttgctcaggtagaaaaagcctaa

SEQ ID NO: 360 - DNA, 309 bp, Enterobacter cloacae
accccggggctccgttcctccaatgggggcccggttgttttattcacacaagaggatgttatggtaactattcgtttagcacgtcacggcgctaaaaagcgtccgttctaccaggttgttgtgactgacagccgtaatgcacgcaacggtcgcttcatcgagcgcgttggttttttcaacccactggccgctggcgcagaagaagaaacccgtctggatctggatcgtatcgctcactgggttggccagggcgttactgtttccgatcgcgttgctacgctgatcaaagcagcaaacaaagcagcttaa

SEQ ID NO: 361 - DNA, 555 bp, Enterobacter cloacae
tctgtcacggtggtcatgatgagcaataaagcacctgttgaaccgatcgtattgggaaaaatgggttcttgctacggtatccgtggttggctcagagtgttttcctccactgaagacgctgatagcatttttgattaccagccctggtttatccagaaagccggtaagtgggaagaggtcgagctggaaagctggcgtcaccacaatcaggacatcatcatcaagctgaaaggcattgacgatcgtgatgccgcgaatgcgctgactaattgtgagattgtcgtggattcgtcgcagttgccgcagctggaagagggtgactactactggaaagaccttatgggttgccaggtagtgaccactgaaggctacagcctggggaaagtcatcgacatgatggaaaccgggtcaaatgacgttctcgtcattaaggcaaacctgaaagatgcatttggcatcaaggagcggttggttccgttcctcgatggacaggttatcaagaaagtcgatctcactactcaaaccattgaagtagattgggatcctggtttttaa

SEQ ID NO: 362 - DNA, 441 bp, Enterobacter cloacae
gtagaagcgcagaatcgcgaacgcgatggcgtactgcgtatcaaagcggaaatggaaaacctgcgccgtcgtaccgagctggacgttgaaaaggcgcacaaatttgcgctggagaaattcgtcaacgaactgcttccggtgatcgacagcctggatcgcgcgctggaagtggcggataaagctaacccggataacgcggcgatgattgaaggcattgagctgacgctgaaatccatgctggatgtggtgcgtaagttcggtgttgaagtgattgccgatacggatgtaccgctggatccaaacgttcaccaggccattgcgatggtggaatccgaagacgttgccgcgggtaacgtgctgggcgtgatgcagaaagggtataccctgaacggtcgtactattcgcgctgcgatggtgaccgtggcgaaagcgaaagcgtaa

SEQ ID NO: 363 - DNA, 1389 bp, Enterobacter cloacae
  unsure (301)
  unsure (314)
cgtttctaccccaggcgagagacaatgtttgataatttaaccgatcgtttgtcgcgcacgctgcgcaacatcagcggccgtggacgcctcaccgaagagaacatcaaggaaacgctgcgcgaagtgcgcatggcgctgctggaagcagacgtcgcgttgccggtcgtgcgtgactttatcaaccgcgtgaaagagaaagcggttggccatgaagtgaacaagagcctgactccgggtcaggagttcgtcaaaatcgtccggaacgagctgttttcggcgatgggcgaagagaaccaggtgnttaacctggcggntcagccgccagccgtcgtgctgatggcgggtctgcaaggtgcgggtaaaaccaccagcgtcggtaagctggggaaattcctgcgcgaaaagcacaagaaaaaggtgctggtggtgtcggcggacgtgtatcgcccggcggcgatcaaacagctggaaacgctggccgagcaggttggcgtggacttcttcccgtccgacgtggcccagaagcctgtcgacatcgttaacgcggcgctgaaagaggcgaagctgaaattctacgacgtgctgctggtggataccgccggtcgactgcacgttgacgaagcgatgatggacgaaatcaagcaggttcatgcctctatcaatccagtagagaccctgtttgttgttgacgccatgaccggtcaggatgcggcaaacaccgcaaaagcgtttaacgaagccctgccgttaaccggcgtggtgctgaccaaagtcgacggcgatgcccgcggcggtgcggcgctatctattcgtcatattaccggtaagccaattaagttcctcggcgtgggcgagaaaaccgaagcgctggagccgttccatccggatcgtattgcctcccgtatcctcggcatgggcgacgtgctgtcgctgatcgaagatattgaaagcaaggttgaccgcgcccaggcggaaaaactcgccagcaagctgaaaaaaggtgacggtttcgatctgaccgacttccttgagcagctgcgtcagatgaaaaacatgggcggcatggcaagcctgatgggcaaactgcctggcatgggccagatcccggacaacgtcaaatcccagatggatgacaaagtgctggtgcgtatggaggccatcatcaactcgatgacgctgaaagagcgcgcgaagccagaaatcatcaaaggttcccgtaaacgccgtatcgctgccggttgcggcatgcatgtgcaggacgtaaaccgccttctgaaacagttcgacgacatgcagcgcatgatgaggaaaatgaagaaagccggcatggccgaagatgatgcgcggcatgaaaagcatgatgccgccccgttttccctgggcgaataa

SEQ ID NO: 364 - DNA, 786 bp, Enterobacter cloacae
acggtaaaagacggcgctatgtggattggcataattagcctgtttcctgaaatgttccgcgcgattaccgattacggggtaactggccgggcagtaaagaatggcctgctgagcatccagagctggagtcctcgtgacttcacgcacgaccggcaccgtaccgtggacgatcgtccttacggcggcggaccggggatgttgatgatggtgcaacccttacgggacgccattcacacagcaaaagccgcggcaggtgaaggcgcgaaggtgatttatctgtcacctcagggacgcaagcttgatcaagcgggcgtgagcgaactggcgacgaatcaaaaactgattctggtctgtggtcgctacgaaggaatagatgagcgcgtaattcaaaccgagattgacgaagaatggtctatcggcgattacgttctcagcggtggtgagttaccggcaatgacgctgattgactccgtcgcccggtttattccgggggttctgggccatgaagcttcggcaacggaagattcctttgccgatggggtgctggactgtccacactatactcgtcctgaagtgttagaagggatggaagtcccggcagtgttactgtctggaaaccatgccgatatacgtcgctggcgtttgaagcagtcgctgggccgaacctggcttagaagacctgaacttctggaaaacctggctctgactgaagagcaagcaaagttgctggccgagttcaaaactgaacacgcgcaccagcagcatgaacatgatgggaaagcgtaa

SEQ ID NO: 365 - DNA, 888 bp, Enterobacter cloacae
catgaaggcgcctttgttgttatgcaacggttggagcaggcgtcacgtaacgttatactgcttctctttcttattaagacaactgtcgacgcctatatgcctgttttcgcactgatcgcccttgttgcctactctgtcagcctcgcgctgatcattcctggcctgctgcaaaaaaacagcggctggcggcgcatggctattctttcggcagtgatcgcactgattagccacgcctttgcgctggaatcacgcattatccccggcgacggcagcgtgcaaaatctgagcgtactgaacgtcggctcgctggtcagcctgatgatctgtacggtcatgaccattgtcgcgtctaaaaaccgtggctggctgctgctgccgatagtctacgcctttgcgctgatcaatctggcgttagccacgttcatgcccaatgagtttattactcacctggaagccacgccggggatgctggtgcatatcggcctgtcgctctttgcctacgcgacgctgatcatcgccgccctttacgccatgcagctcgcctggattgactaccagctgaaaaataaaaagctggcgtttaaccacgaaatgccgccgctgatggtgattgagcgtaagatgttccacatcacccaggtcggcgtggtgctgctgacgctcacgctctgcaccgggctgttttacatgaagaacctgttcagcgtggagaatatcgataaagcggtgctctccatcatcgcgtggtttgtctatattgtcctgttatggggccattatcatgaaggctggcgcggtcgccgcgtggtctggttcaacgttgcgggtgcgggcattctcacgcttgcctattttggtagccgcttcatacagcaatttgctggctaa

SEQ ID NO: 366 - DNA, 1302 bp, Enterobacter cloacae
caaaaggagttccccctggaacacatctctaccaccacgctgatcgtcattctggtcatcatggtggtcatctccgcttatttctctggctctgaaaccggcatgatgacgctgaaccgctaccggttacgtcatcgcgccaagcagggtaaccgtgccgcgcgtcgtgtcgaaaagcttctgcgtaagccggaccgtctgattagcctggtgcttatcggtaacaacctggtcaatattctcgcctctgcactgggcaccatcgtcgggatgcgtctgtacggcaacgcaggcgtggcgattgccacaggtgtgctcacgtttgtggtactggtgtttgcggaagtgttgcccaaaaccatcgcggcgctttacccggaaaaagtcgcctacccgagcagcttcctgttagcaccgctgcttattctgatgatgccgctggtctggctgctgaatatggtgacacgggtgctgatgcgcatggtcggtataaaggcagacgtcaccatcagtagcgcgctcagcaaagacgaactgcgtaccatcgtgaacgaatcccgctcgcagatctcccgccgcaatcaggacatgctcctgtcggtgctggatctggaaaaggtcagcgttgacgacatcatggtgccgcgcaatgaaatcgtcgggattgatatcaacgacgactggaaggccattgtccgccagctgacgcactccccgcacgggcgtatcgtcctctatcgcgattctctcgacgatgccatcagcatgctgcgcgtgcgcgaggcctatcgtctgatgaccgagaaaaacgagttcaccaaagaggtgatgctgcgcgccgccgacgaaatttactacgtgccggaaggcaccccactcagcacgcagctggtgaagttccagcgaaacaagaagaaagtcggcctggtggtggatgaatacggcgacatacaggggctggtgacggtcgaagatattctggaagagattgtcggggactttaccacctcgatgtcgccttcccttgcggaagaagtcaccccgcaaaacgacgggtcagtgcttatcgacggcagcgctaacattcgtgaaatcaataaagcgttcaactggcatttgccggaagacgaagcgcggacgatgaacggaatgatcctggaagcgctggaagagatcccggcgacaggcacgcgcgtgcgtattgagcagtatgatattgatattctggacgttcaggacaacatgattaagcaggttaaggtcctgcccgttaaacctttacgcgaaagtatcgccgagtaa

SEQ ID NO: 367 - DNA, 1095 bp, Enterobacter cloacae
cgacctcgatggggcgagaagataaaacgttttagcgatctcattatcaaggagtcacgccaccacatggctgtagcgaaaaagatcaccatcaacgatgtcgcgctggcggcgggggtttccgtcagcaccgtttcgctggtattaagcgggaaggggcgcatctctcctgcaacgggtcagcgcgtcaacgaggccgttgagcagttgggctttgtgcgtaatcgccaggcgtcggcgctgcgcggtgggcaaagcggggtgatagggctgatcgttcgcgatctcgcgtcgccgttttatgcagaactgaccgccgggctgaccgaggcgcttgaagcgcaggggcgaatggttttcctgctccacggtgggcgcgaaccggagcaactgctctccaggctagatttgctgctgacgcaaggggtggatggggtgatcgtggccggcgcgtccggcgtgggcagtgaattgtgtgagcgcgcggcgcagaaaggcgtaccgctggtgtttgcgtcgcgcgccagctatctcgacgaagccgatacccttcggccagataacatgcaggccgcgcaaatgctgaccgagcatcttattcatcgcggccatcagcgcatcgcctggctcggcggtaaaagctcgtccctgacgcgtgccgagcgggtgggcggttactgctccacgctcatcaaatatggcctgccgtttcacagcgaatgggtggtggagtgtgaatccagccagaaaaaagccgcggaagccatcggcacgctgcttcgcaacagcccgacgatcagcgcggtgatttgctataacgacgttattgcgatgggggcgtggttcggtttgatccgcgccggacgccagagcggtgagggcggggtagaaacgttcttcggccatcaggtggcgctgggggcgtttgcagatgtcggtgaaaatgcgttagacgatctccccatcgtctgggcgacgacgccggctcgtgaaatggggtacaccctggcagaacgaattatgcagcgcattgaaaatactgacgtgcaggccgggcatcaaattgtggctgcgcgcttattgaccgtgaaataa

SEQ ID NO: 368 - DNA, 693 bp, Enterobacter cloacae
atctctttctaccctttaaggagtcgttttatgacgacgaaagcagcacaaaaaatatcgctgtgggagtttttccagcaactgggtaaaacctttatgctgcccgtggcgcttctctctttttgcgggattatgctggggatcggcagctcgttaagcagtcatgacgtcattaccctgatccctttcctgggaaatccggtacttcaggcgatcttcatctggatgagcaaggtcggatcgtttgcctttagcttcctgccggtaatgttctgtatcgccattcctctgggtctggcgcgcgaaaacaaaggcgtggcggcgtttgcgggcttcgttggctatgcggtcatgaaccttgcggttaacttctggctgaccgccaaagggatcctgccgacgaccgacgcggcggtagtgaaagccaataacattcagagcgtgattggtattcagtccatcgataccgggatccttggagccgtgatcgcgggggtgattatctggatgctgcacgagcgcttccacaacatccgcctgcccgatgcgctggccttcttcggcgggacccgctttgtgccaatcattacgctggttgtgatgggtctgtttggtctgatcatccctctgatttggccgatttttgccatgggggatcaccgggattggccgcattatcaacggcgcgggtga

SEQ ID NO: 369 - DNA, 603 bp, Enterobacter cloacae
  unsure (493)
gggggttttactttacggagcaccgtcatgtttgatttttcaaccgtcgtggatcgacacggcacctggtgtacccagtgggattatgtcgctgaccgttttggcgctgccgacctgctgcccttcaccatctctgatatggatttcgccaccgccccctgcattaccgatgcgctgcaccagcgaataaaccacggggtgtttggttacagtcgctggaaaaatgacgaatttctggccgccgtggcgcactggttccggcaacgctttaacagtcagattgataccgaaaccgtggtgtatgggccgtcggtcatttatatggtctcggagctgatccgcctctggtcctcgcctggcgacggcgtggtggtccatactccggcttacgatgccttttataaagccatcgaaggcaaccagcgtaccgttgtttccgtgccgatgcaaaaaacagcgcatggctgggaaggggatatggcctcgctggaancggcgctatcaaaaccggaaaacaaggtgttgctgctgtgttacccccaaaacccgaccggaaaaatctggactcgggaggcgctgaacacaatggggggccctgtttga

SEQ ID NO: 370 - DNA, 993 bp, Enterobacter cloacae
tttggccgatttttgccatgggggatcaccgggattggccgcattatcaacggcgcgggtgatttcggcccgatgattttcggtacgggtgaacgtctgctgctaccgtttggtttacagcacatcctggttgccctgatccgctttacggaagcaggcggcaccatggacgtttgcggtcattccgttagcggcgcgctgaccatcttccaggcccagctgagctgcccgaccactcacggcttctctgaaagtgcgacgcgtttcctttctcagggtaaaatgcctgccttcctcggcggcctgccgggtgctgcgctggcgatgtaccactgtgcccgtccggaaaatcgtcataaaattaaaggtctgctgatctccggcgttattgcctgcgtggtgggcggtacgacagaacctatcgagttcctgttcctgttcgtggcaccggtactgtacctcatccacgccgtactgacgggcctgggctttaccgtgatggctgtgctcggtgtgaccatcggtaacaccgacggtaacgtgattgacttcgtggtattcggtatcctgcacggcctgtccaccaagtggtatctggtgccggttgtggccgccatctggttcgcggtttactacgggatcttccgcttcgccatcacccgcttcaacctgaaaacgcctggccgcgataccgatacggccaccagcgttgaacaggcggtggccggtaccgttgggaaatccggatataacacgccggctattctggcggcgctgggcggtgcggataatattacctctctggataactgcatcacccgcctgcgtttgtcggtggcggacatgtccaaagtggataccaacgcacttaaagctaaccgggctattggcgtagtacagttaaatcagcacaatttgcaggtcgtcattggcccgcaggtacagtcagtgaaggatgagctggcaaccctgatgcgaaccgtcgaagcctga

SEQ ID NO: 371 - DNA, 1035 bp, Enterobacter cloacae
ctgtcagccaggggaggaaccatgacacagccattggccggaaaacatattttgatagtagaagacgagcccgttttccgatcgctactggattcgtggttatcctcactgggtgcaaccacgtcccttgccgaagatggcgtcgaggcactggaaaaaatggccagcatggcgccggatctgatgatctgcgatctcgagatgccgcgcatggacggattaatgctggtagaaaacctgcgtaatgaaggttatcagacaccgatactggtgatctcggccaccgaaaatatggcggatattgctaaggcgttgcgtttaggtgtgcaggatattctgctcaaaccggttaaagatttgaaccgtctgcgtgaaacggtgttggcctgcctgtatcccaatatgtttaattcccgggtggaagaagaagaacgtcttttccaggactgggatgctttagtcagtaatcctctcgcggccgcgaagctgcttcaggaacttcagccgccggtgcagcaaaatatctctcattgcagagtaaattatcgccagctggtagcggctgaccagcctggactggtgctggatattgcgccgctctcggattccgacctcgctttttattgcctggatgttacccgagcgggagataacggcgttctggcggccttattactccgggcgctgtttaatggattgctacaggaacaattatcccatcaggggcaacgacttcctgagctaggcagtttactaaaacaggtcaaccaactttttcgccaggccaatttaccggggcagttcccgcttctggttggctattatcacagcgggttgaataaccttattctggtgtctgcgggattaaatgccacactgaatactggcgaacaccatattcaggtgagtaacggcgtgccgttgggtacgctgggaaatacttaccttaatcaaattagccatcgctgcacctcctggcagtgccaaatttggggtgccggagggcggttacgcttaatgttgtccacggagtaa

SEQ ID NO: 372 - DNA, 954 bp, Enterobacter cloacae
gcaggtgcgttgacgctatgtcgggaatccaggggaagtaaaacagggctaatgagaaaggtaaaaattggactggcgttgggctcaggtgctgcccggggttggtcacatattggcgttatcaataccttaaaccagatggggattgacgttgatattgttgcaggatgttctatcgggtcgctggtcggatctgcgtacgcctgcggtaagctcccggagcttgaaagctgggtgcgctccttcagttactgggatgtgctgcgcctgatggatctctcctggcagcgtggcggcctgctgcgcggcgaacgcgtgttcaatcagtttcgcaagataatgcccctcgctgacttcagccactgccaaatgcctttcggggccgttgcaaccaacctcagtacgggcagggagttatggctcaccgaaggggatattcatctcgccgttcgtgcatcctgtagtatgcctgggttaatggcgcctgtgcctcacaacggctactggctcgttgacggtggcgtagtgaatcctgtccctgtctctctgacgcgcgccatgggggcggatatcgttattgccgtggatttacagcacgatgctcacctcatgcagcaagatttgatgccggttaatcttcagagcgatgatgcggaagaagagaaacttgcctggcatgctcgattacgcggcagaatagggcgcctggctgcccgtcgcgcggtgaccgcaccgaacgccattgaaatcatgacgacctctattcaaattcttgagaatcgcctcaagcgaaaccgtatggctggcgatcctccggatattcttattcaaccctattgtccacaaatctctacccttgatttccaccgggctgaggccgccatagcagcgggctcgttagccgtcgaaaagaaaatagatgaactgttgccttttgtgcgtacagcacgttga

SEQ ID NO: 373 - DNA, 840 bp, Enterobacter cloacae
tgttgtccacggagtaagcagtcagattttatttttcagattgctttacctgtgtttttgctggcagtgctactatcgctgcaagtttcatgcgtatttgtattaattgatcggcaacgcgttcttttcagacccgtattagtggctgagactgtatactcaacgcgttattcaatgcataaaagttcaaaacttgaacagttcaggagaatttcaatggctgcccttaattcgaaagtcagaaaggccgttatcccggtggcgggattgggtaccaggatgttgccagcgacgaaggcaatcccaaaagagatgctgcctctggttgataagccattaatccagtatgtcgtgaatgaatgtattgcagcaggtatcaccgaaattgtgctggtgacgcattcatctaaaaactctatcgaaaaccatttcgataccagtttcgaactcgaagcaatgctggaaaaacgcgttaagcgccagctgctggaggaagtgcagtctatttgtcctccacacgttaccattatgcaggttcgtcagggcctggcgaagggcctggggcatgcagtattgtgcgcacatcctgtagtgggtgatgagccggtcgcggttattctgcctgatgtgatccttgatgagtacgagtccgatctttcccaggaaaacctggcggaaatgattaaacgcttcgacgaaaccggcagcagccagattatggttgagccagtcgacgacgtgaccgcttacggcgtggttgactgcaaaggcgttgacctgcaacctggcgaaagcgtaccgatcgttgtcttcaccacgggagctgacggagccggataa

SEQ ID NO: 374 - DNA, 891 bp, Enterobacter cloacae
tgcctgacaactcagacttcgcaaatacataaacaggatttcccggcgatgcaatcattacaacgtaaagttctgcgcactatctgtcccgatcaaaaagggctgatcgcacgaattaccaacatttgctacaagcatgaactgaatatcgtgcagaacaacgagttcgttgaccaccgtaccggtcgcttctttatgcgtaccgaactggaaggcattttcaacgacacaaccctgcttgccgatctggacagcgccctgccggaaggctcggtgcgcgagctgaacccggcgggccgtcgccgtattgtcattctggtcaccaaagaggcgcactgcctgggcgatctgctgatgaaagccaactacggtggcttggacgtcgaaattgccgccgtcattggcaaccacgagacgctgcgtacgctggtagaacgtttcgacattccgtttgagctggtcagtcacgaaggccatacccgtgaagagcacgacaacctgatggctgctgcgattgaagcgcataacccggactacgtggtgctggcgaaatatatgcgcgtgctgacgccatccttcgtggcgcgcttcccgaacaagattatcaacatccaccactccttcctgccagcctttattggcgcgcgtccgtatcaccaggcatacgagcgtggggtgaaaatcattggcgcaaccgcgcactacgtgaatgataatctggatgaaggcccaatcatcatgcaggacgtgattcacgtggatcacacctacacggcagaagatatgatgcgtgccggccgtgacgttgagaagaacgtactaagccgtgcgctgtatcaggtacttgcccagcgcgtctttgtgtacggcaacagaacgattattctttaa

SEQ ID NO: 375 - DNA, 495 bp, Enterobacter cloacae
cgccttattttttgttccaggaagagaatcgtgtctcaactctgcccctgtggtagcgctctggagtatagcctatgttgccagcgatatctttctggcaagcaggttgcaccagacccgtcacaccttatgcgctcgcggtatactgcttttgtgatcaaaaacgcagactacctgattaagacctggcatccgtcctgccatgctgccgattttcgccaagagattgaagccggatttgccaacaccgtctggcagggcctcaccgtctttgaagccgctcccggccgcgatgccaacgagggctatgtcagttttgtcgcccgctttagcgaacaaaacaaacccggcgccatcattgaacgctcacggttcttaaaggacagcgggcaatggtattatattgacggcacacgtccgcaattcggtcgtaacgatccctgcccctgtggttcaggaaaaaaatttaaaaagtgttgcggcagtaatgcctga

SEQ ID NO: 376 - DNA, 222 bp, Enterobacter cloacae
ggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtag

SEQ ID NO: 377 - DNA, 189 bp, Enterobacter cloacae
gagtctggaccgtgtctcagttccagtgtggctggtcatcctctcagaccagctagggatcgtcgcctaggtgagccgttaccccacctactagctaatcccatctgggcacatccgatggcaagaggcccgaaggtccccctctttggtcttgcgacgttatgcggtattagctaccgtttccagtag

SEQ ID NO: 378 - DNA, 645 bp, Enterobacter cloacae
gtttctcaacaggtatccaccgtgctcaataaactctctcgtctgctggaacaggcaggtatttcgctcaccgatcaccagaaaaatcagctggtggcctatgtcgatatgctgaacaaatggaataaagcgtacaacctcacctccgtacgcgatcccaacgagatgctgattcgccatattctcgatagcatcgtcgtggcgccgtatctgaacggtgaacgttttatcgatgtgggcaccggtccgggcttgccgggcgttccgttgtctattgttcgaccggagagtcatttcacgctgctggacagcctgggcaagcgcgtacgctttttacgccaggttcagcatgagctgaagctggaaaacattacgcccgtacagagcagggtagaggagttcccggcagagccaccgtttgacggtgttatcagccgcgcgtttgcctcactcaatgacatggtgagctggtgcaaacacctgccagcggagaaggggcgtttttatgcgctgaaagggcaacttccgggggacgaaatcgagcagcttccggacggttttgctgtcgaatccattgagaaactccagatccctcagctcgaaggtgagcgtcatctggtgataattaagccaaacactttttaa

SEQ ID NO: 379 - DNA, 411 bp, Enterobacter cloacae
caaagggtaaaaggcatcatggcttcagaaaatatgacgccgcaggattacataggtcaccatctgaataaccttcagctggacctgcgtacattctcgctggtggatccacataaccccccggccaccttctggacgatcaacatcgactccatgttcttctcggtggttttgggtcttctgttcctggccatgttccgtagcgttgctaaaaaggcgaccagcggtgttccagggaaattccagacgttcatcgagatgatcatcggcttcgtccatggcagcgtgaaagaactttaccatggtaagagcaaactgattgctccgctggccctgaacgtgttcgtttgggtcttcctgatgaccctgatggacctcctgcctatccatttcttaccttgggatcggtga

SEQ ID NO: 380 - DNA, 1947 bp, Enterobacter cloacae
aatccacggcccgggcttcaatccattttcataccgctttacgcgaggcagaccaccatgttttatcaggatccttttgacgtcatcatcattggcgggggtcacgcaggcactgaggccgcaatggccgcagcgcgaatgggtcagcagaccctgcttttgacacacaatatcgacacgctgggacaaatgtcctgtaatccggcgattggcggcattgggaaaggacacctggtaaaagaagtggatgcacttggcggcctgatggcgaaagcgatcgatcatgcgggtattcagtttaggatactaaacgcgagtaaaggtccggctgttcgcgccacccgtgcacaggcagaccgtgtgctttaccgtcaggctgtgcgcaccgcgctggaaaaccaaccgaacctgatgatcttccagcaggcggtagaagatcttatcgtggagaacgatcgtgttgttggcgccgtgacccaaatgggtctcaaattccgcgcaaaagcggtggtgctgacggtcgggacattcctggacggtaaaatccatattggtctggacaattacagcggtggtcgtgctggcgatccgccgtcaattccgttatctcgtcgtctgcgtgagctgccgctgcgcgtaagccgcctgaaaaccggcacgccgccgcgtattgatgcgcgcaccattgatttcagcgtgctggcacagcagcacggcgataacccgatgccggtgttctcgttcatgggcaatgcggcgcaacatccgcagcaggtgccgtgctacatcacgcacaccaatgaaaaaacccatgacgtgatccgcaataatctcgatcgcagcccaatgtatgctggtgtgatcgaagggatcggtccgcgttattgcccgtcgatcgaagacaaagtgatgcgctttgccgatcgtaatcagcaccagatcttcctcgaaccggaagggctgacctctaacgaaatttacccgaacggcatctccaccagcctgccgttcgacgtgcagatgcagattgtgcgttcaatgcagggcatggaaaacgcgaagatcgttcgtcctggctacgctattgagtacgatttcttcgatccgcgtgacctgaagccgacgctggaaagcaaattcattcagggtctgttcttcgcaggccagattaacggcaccaccgggtacgaagaagctgccgcgcaagggctgctggccggtctgaacgccgctcgcttctctgccgagaaagagggctgggcaccggcgcgttctcaggcttacctgggcgttctggtcgacgatctctgcacgctggggaccaaagaaccgtaccgcatgtttacttctcgtgcggaatatcgcctgatgctgcgcgaagacaatgccgatctgcgtctgaccgaggtgggccgcgagctgggtctggtggatgacgagcgctgggcgcgcttcaacgagaagctggagcgcattgaacaggaacgtcagcgcctgaaaaccacctgggtgaatccgcaggcggaaactgctgctgaagtgaatgctcacttaacagcaccgctgtcgcgcgaagccagtggggaagatctgctgcgccgtcctgaagtcacctacgagaatctggtcaaactgacggcgttcgcaccgggccttgaagacgctgaagctgccgagcaggtcgaaattcaggtgaagtacgaaggctacatcgcgcgtcagcaggatgagatcgaaaaacagcagcgcaacgaaaacacgctgctgccggaaatgctggactaccgtcaggtgacgggcctttccaacgaagtgatcgctaagctgaacgatcacaaacctgtgtcgattggccaggcctcacgtatctctggcgtcacacctgccgcgatttcgattctgctggtgtggctgaaaaagcagggcatgctgcgccgtagcgcgtaa

SEQ ID NO: 381 - DNA, 456 bp, Enterobacter cloacae
tgcttgactctgagccttaaaggacgttttatacgacacgcggcatacctcgaagggagcaggagtaaaaacgtgatgtctgtgtcgctcttgagtagaaacgttgctcgtaagcttctgttcattcagtttctggctgtgatagcaagtggactgctgtttagcctcaaagaccccttctggggcatctccgccgcgtgcggaggtttggcggtggttctgccaaacgtgttgtttatgatttttgcctggcgtcatcaggcgcatacacctgccaaaggccgcgtggcctggtccttcgctctcggcgaagtgtgtaaggtgttgctgacctttgctctactggtgatggcgctggcggttttgaaagtggtattcatgccgctgatagcaacgtgggttttggtgctggtggtacaagttctggctccagctgtaatcaataacaaagggtaa

SEQ ID NO: 382 - DNA, 768 bp, Enterobacter cloacae
cgtataccatttcctacctgtaataatgattattcaggctctgttttcgcagagcctgtatttaaggttgcaatcatgctcaacgcaattttgctggcaggcttactgctaagcaccggtcactcatgggccaatattgtcattaatggcacccgtgtcctttatcctgaaaataacaaagaggtgatcgtccagttaatgaatacgggcgatgcgcccgctctggtgcaatcctggatagatgacggtgatattaattccacgccggaaacagccaatgtgccgtttttgctgtcgccgccagtgataaaggttaacgaacataatggccaacagcttcgtattaaaaagctgccgtccagcttgcctgcggatcgcgaatccgtctttttcctgaatgttctcgacattccgcccagacctgaaaatctgcaaaaccagaataccgttcagctggcgattaaatcccgtatcaaacttttttaccggcccgctgcgctgaaaggcacgctggatgacgcggtggcgaaactgacgctcgccgccgaaggcgatcgctttcgcattacgaataacagtccgttccatattacggtcgccaatatttcgctgggtaaaacgaaattgctccaggagtcccctatggtttccccgtttgggcaactgacggtcgccgcaaaaaatacggttaagcgcggacagaccttccagctgatgtatgtggacgatcttggcgcgtataaaacccggactttcaccagtcagtga

SEQ ID NO: 383 - DNA, 2508 bp, Enterobacter cloacae
tcggaaagactcaccatgaaaatgaaacaaaacagactctgtctgctggcagtctgcacgcttctgctttcgcataaatcaggggccgtctcgtttgatccctccctgcttgctggcgcatccggtgagtccgatctgtctcgcttttccgaaaacaacgccatgcctgccggcagtcaggagatggatatctacgtaaacggcagctggaagggacgttataccgtcatctacggcgagcagcgtgacgacatccgcattgcctggaaagatgcccggtcgcttggcatcaacaccacgtccgtgcctgcgcccgccattgcgcacgggcaggttcagctgcgcgatctggttcagggcggtgaagtcaaaaccgataccagcactctgagtctggcgcttaccgttccgcaggcggccgtgctgcgtactgaagaaggttacattgcccgccagttctgggacgaggggataccggcgctgatgctctcgtggaacacgacctggtacaacacccgcgcgaaaggcgctgcgaaagacacaaatgatgatttttatgccgggctggattccggcgccaacctgttcggctggcagtttcgcgacagcagcgcctggcggaaaacggccagcggagagagtagctggcagaataatacccgctacctgcgccgtcccctggcctcgctgaaatccaacctgacgctgggtgacttttatattcctggcgatctgtttgattccctgcgcgtgcgcggcgtgtcgctggcgtcggacatgaagatgcgcccaaattcacagcagggtttttcaccggtggttcacggcgtggcacggacgaacgccctggtgaaagttatccagaatggcaacgtgatctatcaggagaatgtgccgccgggccagtttaccctcgacagcattcagcctaccggctccgcgggcgatttgctggtggtggtgcgtgaagcggacggttcacagcagtccttcacggtgccgttttccgccgtacccgggatgctaaaagaaggggtgagtcagtacagcgtggtggcgggtaaagtgcatcagaacacgctcgatgccgaacccgcattcatgcaggccacgctgcgctacgggtttaataacctcatcaccgggtataccgggacgattattagcgataactaccaggccgggcttgtcggtaccgggtggaaccttccctttggcgcggtctcgtttgatgtcacccacgccaaaaccaccctacaagatcgcaccagcagcggtcagagttatcgcgtgtcgtacagcaaatttatcgataccaccgccaccaacttcaccctggcggcctatcgctattccactaaaggctattacagcttcagcgacgcgctctattcgcgcgaagggtatcagcgcctgagagcgcagtacgacgactatgaagatcggtttggcgttgcgcccgacatgtcgctaagcacctgggacgccatgcgcgcggcgcagcccaagaatacctttacgcttaaccttaatcagcgcctgctcaataactggggcacggtgtttgtctccggcacacagcgcgattactggaactcacagcaaaccacgcgcgaataccagatgggctattccaacgccatcggccgcgccagctataccctgtcggccagccgggtacggaacagggacagtgaagaagagacgcgcctttacctctccctcagcctgccgttctcgctgtttgataataatgcgtggatcacctccagcctgacggccagcgattcgcattacgagcagagcaatatcagcatgagcgggaacgcgctggcgtcgaaccgactgagctacaccctctccggcagtaatgcgcgggggggtaaaaatgcggcaagcgttaacgccgcgtaccgttcgaacttcgcaacactcggtggctcttacagcgaatcctccgactaccgccagaccgggctcagcggacgcggcagcctggtggcctacccgtggcacgttctcgcctcaaacgaaaccggcacaaccatgactatcgtcgatgcgccaaaggcggaggggctgatggtgaacggcgatgaaagcattatgacgaaccgcgatggcgtggcgttggttcataacgccacccgtatttgcaaaaacgccattacgttaactgaaactgaaaacagcgctggcgcggaagtgatcggcaatatggctaacgtggctccttacgacggggcggtgagctatatccgctttgaaaccgacaagcgccagtcatgggtacttcatgcgacgcgcgccgacggcaaaccgctgccctttggcaccgaagtgctggatgaacatggtgaatctgtcgggtatgtcggacaggccagcgtactgtatatccgtgctgaacggccgccacgcgcgctcaacgtgcatctccgcggcggaaagtgcgaaatctcctccccggcctgggggctgaacagcccctcatcggtttgccattaa

SEQ ID NO: 384 - DNA, 1080 bp, Enterobacter cloacae
ttacggattatcaaaatgttacgatcattcatgttcctgctcctcaccagcgttagcgggatgagctatgccacctgctccggcagcagcatcgtttatggcacaccgattaccattgatttatcggataagctgagcccggccacgcccacatggaccggcagcttcaccacccagtacagcggctcgttcaactgtacgacgggtaatagcgaattttcttacacgccgatcctctcgaccgacagcaaatacgccaccatcctcggattcagcaacaacaagtatatggtgcgggcggagatcaccaatcccccggccaataaaaccctgtctgccagcggtagccatacggcgtctgagctgaatacaccgtttacggttcgcttcaccctcgttaaccagagcggcaccaccctgacgggggatacggcgaacatgagcgacgttctgttcgtcagcgacatgagcgggttatctatctgggaaatcatcacctggccaatcaatcaggtcatcaagatagcgcagtggttattcagcgggttcaagtggccttacgacaaccgcgatatgtttggtcagccgatgatcatcaaatacgcgccgaaactgactacctgttcctttgataatgcggggctgaccgtggcgctgccgacgctcggcattccccagctcagtgcatcctcacagccggggctgacgcctttttcactgaacatgagctgtcagaacgtcggggttaatggcaattccgatcgggcaattgagatgtttctgtccagcacgcagctgctttcgaccgacagctcggtgctgatcgacagcagcagtagcgcggcgcagggcgtggggctccgcctgataaaacgtgacgccccgcaaacgccggtgaccttctctaactcgaccaccagccgtggcaacgccacaatgatcttcagcgtggcggctggcgcggcgctggacgaacatttcacccttccgatggcggcgtactattacgtgtgggcacccgcccaggtgagccagggtaagatcaatacatcggctacgctgaatattatctacccctga

SEQ ID NO: 385 - DNA, 498 bp, Enterobacter cloacae
gatttgtctttcaatgaattaaataatctgcttaatcataaaggaatggagcgcggaggtccgcaccgttttacatctttatgtaaaaccctcaacgtcaggcgtgttctgttgtgccccgagctgcattacgggctgttaaaaaaagttctggagatgaaatttgaattaaccatcagtcagcaggatgaattgactgaactgaaaaaggaattacccgcgttgctcatggcggacgggcaaaaaccgtcgatctattcgtggctcaggcgggtaatgcggtccggctcccgggcgcgctccatcctctcggccagagagtgggaggtgcttcatcttattgtggaaggattttcaacgacggagattgcccgtcatcgaaaccgttcggtcagtaccattgcgacgcagaagcataatgcgatgaaaaagctgaatctttccaaccacagcgaactgattaagtatgtgcagacggttggaaagatggaggaatag

SEQ ID NO: 386 - DNA, 1545 bp, Enterobacter cloacae
aactgcgtggcgataacattcccgcccggctggaattgcgcggggaagtgttccttccgcaggcgggcttcgagaagatcaacgaagaagcgcgtcgtaccggcggggaaagtgtttgctaacccgcgtaacgcggcggcaggttcgctgcgtcagctcgatccgcgtatcaccgcgaagcgaccgcttactttcttctgctacggcgtcgggatcctggaaggcggtgacctgccagatacccacctggggcgtttaatgcagttcaaagagtggggattaccggtaagcaaccgcgtgcagctctgcgactctccggaggcggtgctggcgttctatcacaaggttgaagaagatcgtcccacgctcgggtttgatattgacggcgtggtgatcaaggttaattcgctggcgttgcaggaacagttgggatttgtggcccgtgcgccacgctgggcggtggcctttaagtttccggcgcaagagcagatgaccttcgttcgcgacgtggagtttcaggtcggacgtacgggggccattacgcctgtggcgcgtctggagcctgtgcaggtggctggcgtgctggtaagtaacgccacgctgcataacgccgatgaaattgcgcgtctggggctgcgaattggtgacaaagtggtgattcgccgcgcgggtgatgtgatcccacaggtggttaacgttgtggagtctgaacgtcctgccgacacccgtgccatcgagtttccagcccactgtccggtatgtggttctgacgttgagcgcgtggaaggtgaagcggtaacgcgctgtacgggcgggttaatctgcggcgcgcagcgtaaagagtccctgaagcacttcgtctcccgccgggcgatggacgtggacggaatgggtgacaagattatcgaccagttagttgagaaagagtacgtccatacgcctgcggacctctttaccctgacggcaggtaagctgaccggtcttgatcgtatgggaccgaaatctgcccagaacattgttaacgcgctcgaggcggccaaaaacaccacctttgcccgtttcctttacgcgctcggcattcgtgaagtcggagaggcgacggcggcagggctggcggcgtatttcggcacgctggacgcgctggagaaagccaccatcgacgagctacagaaagtccctgatgtcggcattgtggtcgccacccacgttttcaacttcttcgccgaagagagcaaccgtgaagtgatcggtaaattactggaacagggcattcactggcccgcaccggtagtggttaatgccgaagagatcgacagtccgtttgccggtaaaacggtggtgctgaccggcagcctgagtcagctttcacgcgatgacgcgaaagcgcgcctggtggcgctgggggcaaaagtggcgggcagcgtatcgaagaaaaccgacctggtgattgccggggaagcggccggttcgaagctggcaaaagcgcaggagcttggcatcgagataatcgacgaagcggaaatgatgcgcctgttaggagagtga

SEQ ID NO: 387 - DNA, 603 bp, Enterobacter cloacae
tggtgcgatatggactcaatcgaacaacaacttactgaactgcgaaccacgcttcgccatcatgaatatctctatcatgttatggacgcaccggaagtgccggatgcggagtatgaccgcctgatgcgtgaactgcgcgagctggaagcgcagcaccccgaactgattacgcccgattctccaacgcagcgcgtcggtgcggaaccgctgggagctttcagccaggtgcgccacgaagtgccgatgctgtcgctggataacgtgtttgatgaagagagttttctggctttcaacaagcgcgtgcaggatcgcctgaagagcgtcgacaatctgagctggtgctgcgagctaaagctggatggtctggccgtcagtattctttatgagaacggcgtgatggtgcgtgccgcaacgcgcggcgacggcactaccggggaagacatcaccaccaatgtgcgcactattcgtgcgatcccgctgaaactgcgtggcgataacattcccgcccggctggaattgcgcggggaagtgttccttccgcaggcgggcttcgagaagatcaacgaagaagcgcgtcgtaccggcggggaaagtgtttgctaa

SEQ ID NO: 388 - DNA, 951 bp, Enterobacter cloacae
attaaacagatgaattattcgttacgtcagcttcgcgttttcgtcaccgtcgcgcaggcccgcagctttagccgggcaggggagatcattggcctcagccagtcggcggtgagccatagcgttaaggagcttgaaacgcaaacgggcgtgaagctgctcgaccgcacgacgcgagaagtggtgctcaccgaagcgggacagcagctggcaatgcgtctggagaggctgctggatgaactgaacagtacgctcagggatgtcggccggctcggacaacagctttccggcaccgtgagagtggcggcgagccagacgatttcggcgcatcttattccccagtgcatcgctgaaagtaatcaccgctatccggatattgattttgttttgcatgacaggccgcagcagtgggtactggagagtatccgtcagggggatgtggattttggcatcgttattgatcccggagcggtaagcgacctggaatgtgaagtggtgctctcggagccctttttattgctctgccgcgatgatgatcctctggcatcgctgccgcaggtggcctggcaggccttgcagggggcaaacctggtgttacaggattatgcatcaggcagccgcccgctgatagatgccgcactgaccgcgcagggtgttaaggcaaccattgtgcaggagatcgggcatcctgccacgctgttccccatggtcgaagcggggattggcatcagcgttctgccggcgctggcgctgccactgccgcaggggagtcgtttaacggtgaagcgtttcgtaccctgtgtcgaacgccagctgatgctggtacgccgtaaaaacaggtctctttccggcgcggcgcatgcctgctgggatgtggtgcgtatgcaggccgaacgtttgatggaggcccgcacacgtgatccactttttaacgaaaccaataatcagacgtag

SEQ ID NO: 389 - DNA, 1020 bp, Enterobacter cloacae
cggcatctgttttcaggagtgattatgaaactttttcgtatccttgatccgtttacgctgaccctgattggtgtcgtcttgctggcctcgttcttcccggcgcggggcagtttcgttccggttattgaaggactgaccacggcagctattgccctgctgttctttatgcatggcgccaaactctcccgggaagccattattgcaggcggtagccactggcgactgcatctgtgggtaatgtgcagcacttttatcctcttcccggttctgggcgtgctgttcgcctggtgggcgccggtgaatgtcgatccggcgctgtataccggtttcctttatctgtgcattttgccggccaccgtgcagtctgcaattgcctttacctcgctggcgggcggtaacgtcgcggcggcggtttgttctgcttccgcttccagcctgctcgggatctttgtttcaccgctgctggtcggtctgctgatgaacatgcacggggcggaaggcaatctggagcaggtgggtaaaatttgtctgcaactgctgctgccgtttgtgctcggacacttatcccgtccctggattggggagtttgtggcgaaacataaaaaatggatcgggaaaacggaccaaagctcaattttgctggtggtttacacggccttcagcgaagccgtggtgaacggcatctggcacagggtgggcgctggatcgctgctgtttattgtggtggtaagcatcgttctgctggccattgtcatcgcggttaacgtctttgtggcccgcaaatgcggcttcaataaggccgatgaaatcaccattgtattttgcggatcgaaaaagagcctggccaacgggatcccaatggccaatattcttttcccgacgtccgtcattgggatgatggtgttgccgctgatgattttccatcagatccagctgatggtgtgtgcggtactggcgcggcgttacaaggcgcagacggaaaagctggcgcaggaagagacccacgccgcgaaagtttaa

SEQ ID NO: 390 - DNA, 1587 bp, Enterobacter cloacae
ctatccagcggcatttcaggaatcacgacatctatgttaacccgctacttctccagcaaccgcaagatactgtttatcagtttccttacagggttattcactgccctgcttctgggagcattacagttttactggagttatcacaagcgagacgtcagattcgatactctcattaccgatttaagcgtttacatggagagctatttcgatgagctcaaaatgtcgattgatacgctccagccactcacgctgaacagctgcgaggaagtgagtgccgccctgacctcccgggcggcctttagcatcaacgtgcgcgcctttttgctggtcagggataaacaggccttctgctcctcggcaacaggcccgatgaataccccgatggaaaagcttatccctcagctacatatcagcaaacctgttgatatcgcgctcctgccgggcacgccaatgctgccggataagcccgcgatcgccatctggtatcgcaatccgctggtgaaagacggcggcgtgtttacgtccgtcaacctcaacctgtcgccttatcttctctatacgtcacgtcaggatgaatttgccgggatatcgatcgtcattggcgattccgcgttatctacacagtccggaatgctgatccaggcgcgggatttgcctgacgtccctgcccgtagcgccacgctgaaaaatattccattgaccgttaacgtttatgcgcaagcctggacaaccgatgaactgctctacgcggtgtttttcggcctggtctgcggtatcgcggcgggcctgttgaatttctatattcttactatccgtctcaatccggggaaagagatcctcacggccatcaagcacgaccagttttacgtggtctatcaacccgtcgtggatgcgcagtcgctcagaatgaccgggctggaagtcctgatgcgctggaagcatccggtgatgggcgaaattccaccggatgcctttattaacttcgctgaagcgcagaagctgattgtcccgctgacgctgcatctttttgacctgattatccgcgatgcccctgtcctgcaaacggtgctcccgcctggggccaagtttgggatcaacatcgcgcccgggcatctgcatgcggaaagctttaaagaggatatgcgcgcgtttctcgccgcccttccgcccgatcacttccagattgtgctggaaataaccgagcgcgacatgattaaccaccgcgaggcaaatcagttgttcgaatgggtgcacaatgagggctttgaaatcaccatcgatgattttggcactggccacagcgcgctgatctatctggaacgcttcacgatggattacctgaaaattgaccgtggcttcgtgaatgccatcgggactgaaaccgtcacctcgccagtgcttgacgcggtgctgacgctggcagaacgtctgaatatgataaccgtcgccgagggtgttgaaacgcccgagcaggcggcgtggctgcgcgagcatggcgtaaactatcttcagggctactggattggccgcccgatgccgctggagcagttcaggacgtggcaacccgatatcacgctcggggaataa

SEQ ID NO: 391 - DNA, 1881 bp, Enterobacter cloacae
tttcacaatcacggcgctgtcccttattattctgttcaaccgagcctgtctgtgaacaaagggatccgccgcactatgattatgcgcgttgtgttgacgctgttggcgctggtgagcctgtcgagccaggcgcagaccatcaaagagagcacggcctttgccgtcattggcgagccgaagtacgcggttaactttaaccactacgattacgtcaacccagccgccccgaaaggcggaaacgtgacgctttccgccacgggaacatttgacaactttaaccgctttgccctgcgcggcgtagcggcagcgcgtaccgaatccctctatgacacgctgttcgtcacctccgacgacgagcccggcagctattatcccctggtcgccgagaacgtacgttacgccgaagatttcagctgggtagaaatcgcgattaatccgcgggcgcgttttcacgacggtacgccggttagcgcccgcgacgtggcgttcacctttcataaatttatgaccgaaggcgtgccgcagtttcgtctggtgtacaagggcaccacggtgaaagccatcgccccgctgaccgtgcgaatcgaactccctgaggcgaacaaagagaatatgctgagcctgttctccctgcccgtcatgcccgaatccttctggaaaaaccataagctgagcgatcccctctctaccccgccgctggccggagggccgtatcgcattaccgactggcgaatgggccagtatgtgatctattcccgtgtgaaagattactgggcagccacgctgccggtaaaccggggccgctggaacttcgatacaatccgctacgactactacctggatgataacgtggccttcgaggcatttaaggcaggcgcatttgatttacgtgtcgagaacagcgccaaaaactgggcgacccgctatatcggaaaaaatttcgcgaaaggctatatcgttaaagacgaacacaaaaacgaatccgcgcaggacacgcgctggctggcgtttaatattcagcgcccggttttttccgatcgtcgggtgcgtgaagccattactctggcgtttgatttcgaatggatgaacaaagcgctgttttacggagcctacagccgggcgaacagctatttccagaatactgaatatgccgcccgtgattatccccacgcggacgagctggttttgctggcgccattgaaagcggagctaccgccggaggtgttcacccgcatatttgaaccgcccaaatccgacggaaacgggttcgaccgggacaacctgctgaaagccagcagcctgctggatgacgctggctgggtgctgaaaaatcggcaacgggttaatgcgcaaaccggtaaaccgctcagcttcgaactgctgattgcctctggcgcaaacgatcagtgggtgctgccgtttaagaagaaccttgcccggcttggcgtcactatgaatatccgccaggtcgatatggcccagttgactaaccgcaagcgcagtcgcgattacgatatgatgcagaccctgtgggccgcccagccgtggccgagttcagatctgcaaatctcctgggcatcggggtatatcgactcctcctacaacgccccgggcgtaaagagcccggtgattgatgcgctgattgcaaaaattgtggccgctcagggcgataagaacaagcttctgccgcttggccgcgcgctcgatcgggtattaacctggaactattacatgctgccgatgtggtatatgggcgaagatcgcgtggcccgctgggataaattctccctgcctgccgttcgcccggtttacaccctcggctttgacacctggtggtatgacgtgaataaagccgtaaaattgcccgcagagcggcgttaa

SEQ ID NO: 392 - DNA, 834 bp, Enterobacter cloacae
ggagtgacgatgggcgcttatcttatccgccggctgctgttagtgatcccgacgctgtgggccatcattaccattaacttttttatcgtccagatcgcccccggcggtccggtggaccaggcgattgcggcaatagaatttggtcacgctggcggcatgccgggcggcggcggcgaaggaatgggggccagccatgcccggacgggcgtgggcaacatcagcgaaagccactaccggggcggtcggggactggatccggaggtgatcgccgagatcacccatcgctatggttttgacaagccgctgcacgagcgctattgcaggatgctatgggattatgtccgtttcgattttggcgacagcctgtttcgcagcgcctcggtgttaaccctgatcaaacaaagcctgccggtttccatcacgctcggactgtgggggacgctgattatttatctggtctccattccgctggggataaggaaagcggtctacaacggtagccgtttcgatatctggagcagtacgtttattatcatcggctacgctatcccggcgtttctgtttgccgtgctgttgattgtgtttttcgcaggcggcagttatttcgacctcttcccgctgcgcgggctggtctccgcggatttcagcacgctgccgtggtatcagaaaatcaccgattacttctggcacatcacgctgccggtgctggcgacggtcatcggcggttttgcggcgcttacgatgctgaccaaaaacgcctttcttgatgagatccgcaaacagtacgtcgtcaccgcgcgcgccaaaggcgtcggtgaaaagcaaatcggttga

SEQ ID NO: 393 - DNA, 294 bp, Enterobacter cloacae
catatttgcggatcggcgcccctgagtaaaagacgtgggccgtccgggttaaaccttccgcgttctacctatgaacagcaggaaatgggcaagtccatttcgcgtactaaactacgcacgggcgatttagtcctgttcagagcaggttcaaccggtcgacacgttggcatctatatcggtaacgatcagtttgtccatgcttccaccagcagcggtgtgacgatttccagcatgaacgaaccttactggaagaaacgctacaacgaagctcgccgcgttctgagccgtagttaa

SEQ ID NO: 394 - DNA, 1512 bp, Enterobacter cloacae
cctggacgtacatcaacgattatggagctgaacgttccgcaagtggccgcctgcataattaattcacaggactgggatgttatgaaaaagggattatcggtatggcctgcgctatcaaccgtggcttatggggttttctctgcactgttttacgctttcggagttcatgctgacgatgacatacagtttgacagtaattttttgcgcatctcccatcctgaaaacgttgatctctcggcttatatgaataatgcgctgcctgccggcaggtaccgggctgatatctatctgaacgataagcttgtcatgatcgatgatattcgcatcagcggaaaagatgcccgctctcagcgcattttgctgtcgcaggcgaccgtcacaggattgcagttaaaaaaaagcaggctgtgcgccactaatgccgggcagtggtgcgatctccaggccgtcctgccagaaagccggctgaaatttaacgggggcagacagcgccttgatgtcagtatcccccaggccatgttgcagcatgtcgcacgcggcagcgtaaacccggtgctctgggatgccgggatccccgcgctgatgctggggtataacgtgaatggttatcgcagcgaaaatagcagcggggaatataacaacctctacgcggcgctgaacggcgggctgaatatcggtgcctggtattttcgacataacgggacgttaagctggcagcagcagaatggtacgcagcagaaaaaatatacggtgcttaacagctacgtccagcatccgctggcggggattgaagggaacctgattctgggtgaatcaaacacctccggacagttatttgactccgtgtcatttaccggcgcatcggtagccagtgacgatcggatgctgcccgcttcgcgtagaggctatgcgccggagatccgcggggtcgcgcaaaccaacgcgaaagtgacgatccgtcagaacggaaaagttatctatgaaacaacagtctcgcccggggcatttgttatcaacgatctctatccgagcgggtatggcggcgatctgaacgttacggtacgggaggctgacggttcacagcatttttttgacgtcccctatgcatcggttgcacagctgctacgcccgggcgcaagccgttacagcgcgacggcgggcaggctgaggggagactatctcagcgagcgcccggcatttagtgaagtgacgtatcagcgggggctgacaaacagcctcaccggttctggaggcattcaggccacgtcattttatcaagctatgcacgctggccttgctgtggggacggctgtcggaacagtgtcactcgataccacatggtcgcaaacccaggtaagagaaaaaacaacccgggggagaaagcatcaggttgagctacagcaaatatattcccgcaagccggacgcagttttcactggccacctggcgatattcgacggggaattatctttctctgatggatgccaccctgttacatcagcagcggcctga

SEQ ID NO: 395 - DNA, 600 bp, Enterobacter cloacae
ttaatacgacgtaataacgtcaggaagctaatgaaagttttagtctgtgtatttactgataatgaatttttcttttcagccatgatggagttgctctcctcgcatacgcttttggcagaaaaatatacgctttgcaaaatacgctcagatgaaataggcgcatggatgcatacagcagataataatatgatgattatggctggtccggatatggagtctctggtcaggtttttttgcctggaaaaaagatgggattatttaacgacaaggttcagtgccagtgagatgcaggattttctggcgcagaaaataaacaggcaacatgaagtaaagaaaaacctgattcgaacaagaacacatctgaaactttcaaagcaggagttaaacgtgctttcgtggtttatgcatgggctatctccttatagtatgtccagatattatggtctgtcagttaaaacaatcagcacctttaagagacgcctgatggataagctttatatcaaatcggacgctgaactatttagggttggctggacttataagatgtatcaaaacagtggtcatttaagagggcgagatgaaaatttcaggatggattag

SEQ ID NO: 396 - DNA, 1209 bp, Enterobacter cloacae
gagaaaaaacaacccgggggagaaagcatcaggttgagctacagcaaatatattcccgcaagccggacgcagttttcactggccacctggcgatattcgacggggaattatctttctctgatggatgccaccctgttacatcagcagcggcctgatgagacagcagacggtcacaccggcagaacccgtaaccgcgtgacgctgaccctcaaccaggggttgcctgataagtggggacagctttatgtgacgggcattcttcaggattactggggacggaaaggctatgaccagcagtatcaggctggctataccctgacaacgggaagggtgaactggagcctgggcgtcaaccgaagccgctcgtcggggggagaatttcagaatatctggacgttgagttttaacatgcctttgggtagcgccagcacgccgctgctcaccgggcaggtgtcgcgagacggccaaggacatttcagcgagcaggttgcgctttccggcagcgccggcgagcggcagcagttcagctggaatgccggggcgtcgcatcagtaccactcaggggattccgggcaaataggcgggagctggaccgggccggtttctacccttacagcaaactatgcccaggggaaagcatggaaaagtggctcggtgggggtgagcggtacggccgtcgcgcattctgacggggtcactttctcaccctggacaggcaacacctttgcgctggttgaggcaaagggtgcggaaggcgctgaaattcccggctatgccggaacacgcgtggatggctcgggctatgcgttagtaccaaacctgatgccctaccagaaaaatgccatatcgatagataccacttcggtggaggatgatctcgatctcgacagcaccagccagcaggtgatcccctacgctggcgcggttgtgaaagtgaaatatcgcgccacggcgggcgtaccggtactgataaaagtaaccaggagtaacggtgaaggtgtgcctttttctgctcgtgcgacagatgccaacaaaaatatcgtgggttacgtgggacaggggagccgcctgtatgcccgtctggcgcagcaaaatggggtagtggaactacgctgggctgaaggtgaaggcgcacgctgcaaaatgaagtattcacttccgtccacagcgggaaaaaaattgctcatcttcaatgcaatctgtaattaa

SEQ ID NO: 397 - DNA, 1161 bp, Enterobacter cloacae
gagggcgagatgaaaatttcaggatggattagcgttgctacatttttttgtctgcttattttctcaaacgcagcaatggccgaaacgtgttcacttgacagtgcgtccgtatttaaaacggccagtaatgtgagtatgccgcttaatatatcatcgatagcggtaagtaatgatataccagatggaacaatcatatatcaacaaaaatatataccaggttattcaagtattagcgttaactgcgatgagagtagatcatggtactatgtcatgtctctgacaaacacgcccatgccgctttcctcctggaccgggaccattatttctcatgagagttgggttgctgaatattcctgggacggatatatatacgaaacgggtataccggggattgggattacaatttcaatgatgagtgttcgcagaccggcaccaggtattgttggtacaaactgcttcgcaagtaaaagctgcacggataccgggatgaaagccagagcaattatagccttggttaaaacggggccgattagtgcgggtgttatcaatgccggcaacttccccacgatgaaggttgcactggggagggaggcgactaatattacactttatacactaagttttaccggttctctcaatgtgacgttgcccacatgtacaacgcctgactttaacgtatcattgggtaaatggaccacagaacattttaccggtaaaggtagttcgacgccctgggttgcagcgaatattgtacttagtaattgtggtgattttattggtagtaatgtcagtggcgatatgagtgatgggaattactggtcagataatggaagttcattctcctcaacgatgcagtggaatacatggtcaataacactgtctcccgtctcttcggttctggattcagccagcggcattatgtctgtcgatacgagtgtgccctccgccgctacgggtattggtatacagattagttctggtgatacaacatcggcagattcacacattattgattttggcaatgctttaaccggcacctttaattcggacggtagtagcagcgttacgattcctctctcggcaaggtatattcagacggaagacagcgtgacggcgggcatggcgaacggcaagctagtttatacaataagttattattaa

SEQ ID NO: 398 - DNA, 1214 bp, Enterobacter cloacae
caagtgatgattaaaaaaaagggcttaggcttcaacgcaattacagcattgatcatgctcacgacttcgaactgcgtaatcgctgaagaataccaattgccagcaacaattaataacccggttgtaatgccagttggtgctgacggatttcagaatggagctgcaaaagccattattccgggtcaagctggttctgaacagtcaggtgcacaaacaaaccttagtgaagccggtaatgcgcagggacaaaaacctacaactgatctccctaccgtgcaactttccccagccagcaatgcttcgcctgcggtaagcgctattactggagcattatcaaataatcctagtctccccggatttgacgcacagacccgatctggtgcaattgatagctatgggagaccaacaggtacctcttcccagcagaatgcaaccaatgcgaccgccacgtcaaaagccgatgaactttatgtcgaagctcgtaaccgatataaagaagttcagcgtgtaaatgtgccgcctggtgggaatgtggtactgccagtttcacgaggacttcaaaacagaatatcgaccagcttcaagaatgcttctgtcagtacttctacccctgctgaagaggcaagcatatttgttaatggtggcgatgtctttatttcaactaataccgataaaccaatcgggattatgttgtctgaagatcaggtacctgaatcgacctataacctgaccctggtaccgcttgatgttcccggtgcgatgatttcagttactacatctttaagcccatctatgcaagccaaacgtgaaacctcattggataagcaaaactatgaggaaatgttggcccgctcccagtcagaagaactggctccaacggatccaaaacaagacgatcataaacaaagaatcattgatttattgactcctgtggctcttggtgaggtcccttcaggattcagtttacaacaggaccgactttctcgtattcctgcgccagagcagtcaccatgtaactttaatatgtatgcaaagctcggtcagagactggttggctcacgtgaacttattgatgtaattcttgtgaaaaacgataaaccatacggtcaaatcgttgctgatcagcagtgtatggcagaaggcgttattgcaagtgctttatttgataaagcatacctgcaaccgggagaagaaacagagctttacatagtccg

SEQ ID NO: 399 - DNA, 903 bp, Enterobacter cloacae
aaatcttatcaccgacgagttaagttaatgattaaaaacaacgagttaatccatccttttgacgtaaccagtaatgaatcaggtaagacttatcaactgacgcctaactcgtccaagtcggttcagcccgtggccctgctgagattgagtgtatttacccctgtcggcacaaaagaaaaccgcgaccgaaactttgaagttgatgcctctgatgagctttcgtgtatggaaattgcaagatcggagggttatgacgacatcaagataactggtgtcaaactatctatgtctaccgactttaagtgctggctcgggatcatcatggctttcagtaaatatggttttacttccgagaagattagcctgacttttaacgagtttgcgaagatgtgtggtatcagttcaacaaacatcaacaaacgaactcgtgcgcgctttaaagagtcattaatgaaccttgcatcggtagtgcttgccttctcagactctcgtagtggtcggttcacagtaacgcatctggtgcagaaggctatgattgatccaaaaagcgatactgttgagctggttggggatccttctatgtgggaactgtatcgttacgaccataagacattgttaagccttcaggttctatacattttggctaaaaaagaagctgcgcaatctctctatatttattttgaagcaatgccagctggtacgttgttcgttaatatgaaacggttgagggaaaggttgcttcttacaacccctattcgtacgcaaaaccagataattcgtaaagcaatgcgggaacttgaatctatcggatatctcgattatcaagaagttaagaaaggtcgcgacatacaatttcagatcttcaaaagaagccctaagctggcccttgccaaacaaggttga

SEQ ID NO: 400 - DNA, 789 bp, Enterobacter cloacae
atgaaaatgctaagtggcattaacatcccttttttcaaaaaatctaaaaaggatgaaaacggtgatcttgaacagtcatacgtaaagaaagatgaaagtgctaagggacgttttttggacattaaaaaacgatttagcccacaagctgaagcgtcaggtgctggaattacatacagcgccctgattaatcgtgatacaaaacttatccgcattaatactgtttcaatagccgtcattgggttattggttgcaaagattctttttttcactgacccagtgacgattgttacccctccaaacatgaatgaagagatcacggttgttggtaacaaagcatcggaatcttataaaacacaatgggctctcttttttagtacccttttagggaatattaatccaactaatatttcctttgtgacggcctatgtcctcgatgccctttcacctgaactacaggctaaaacgagtgagtctttacaggagcagataaatatcatgcaggctcgtggtgttgagcagacctttaagcctaatgatatttactttgatccaaaaaatgacatggtctatgtctggggtaccaaaacgactcgacttgtaaatgttccggacaaaactgaatcatcgaaatggacttatgaatgggttctcgggatgaaaaatggtcgcccaagaattgcatatgtaaatcaatattccggaacaccgaatattaaaaaaattacgataaacggcaaagagcaactggcaacgctggataatccgccaccgtctacaggtaacaagtga

SEQ ID NO: 401 - DNA, 642 bp, Enterobacter cloacae
caggagttgagaatgatagatctctattatgcccccacccctaatggccataagatcacactctttcttgaagaagccgaagtggactaccggatcattcgcgtggatatcagtaaaggcgaccagttccgccccgtttttctggccatctcgcccaacaataaaattccggccatcattgataacctgccctcggacggcggcaaaccgttaagcctgtttgagtccggagagattttgctctatctggcagagaaaaccggcaagctcctgagcggtgagttgcgtgagcgtcatcacacgctgcaatggttattctggcagtcgagcggcctcgggccgatgctggggcagaatcaccactttacggcctatgcgccgcagacgatcccttacgccattgagcgatatcaggtcgaaacccagcgcctgtacggggtactgaaccgtcggctggaaaaatcaccgtggctgggaggtgagcattacagcatcgcagatatcgcctgctggccgtggatcaacacccatgaacgccaccggatcgacctggccacttatccggcggtgaacaactggtttgagcgcatccggacccgcccggccaccgaacgcgccatgcaaaaaatccatcagatttga

SEQ ID NO: 402 - DNA, 444 bp, Enterobacter cloacae
tcctgcgccccgttgggtgcaggtgttctcctcatgtatgatgaggtgaaaatactgacacggagaagacctgtaatgtcccagcatgacgctattattcgtataaaaaacttacgcttacgcactttcattggtatcaaagaggaggagatcgcgaatcgccaggatatcgtggtgaatgtagtgatccactatccggcagacaaggcgcgcgccagcgaagacatcaatgacgcgttgaactatcgcacgatcaccaaaagcatcatccagtacgttgagaacaaccgttttgcgctactggaaaaattaactcaggatgtgctcgacatcgcacgcgaacaccactgggtcacttatgctgaagtggagatcgataaacttcacgccctgcgctacgccgactccgtctccatgacgttaagctggcagcgccaggcgtaa

SEQ ID NO: 403 - DNA, 513 bp, Enterobacter cloacae
tatggcgtaactatggcaaccatcaccacaacccggcttaacctcacccctttcgaaccttctgactgggcattcttccgctctctgcgcgaagaccccgccatcatgcgctatatggccgctattacaccggaaaaagagacgcgccgcgtatttgccgcacgcctgatggcggagcatgtctttgtaatccgtctgcataacgacgttaagccgctcggggatatcggcctgcaaatcagtgcggcgaaccgtgaagaggcggatattggctacacggttgtgcctgccgcgcagggaaaaggcattgccagcgaagcgctgcgcgcggtgtgtgagtatgcatttaaccagacgggcgtgaaggcgataaacgcgtacgtgctggcggataacgtcgggtcggtgcgggtccttgagaaagcgggttttgtgcgcacgcaggtgctggagaaggcgtacgagattaacggcgtacggtatgacgactgggtgtatcggctcgagtgttga

SEQ ID NO: 404 - DNA, 927 bp, Enterobacter cloacae
gctggcagcgccaggcgtaaacctggaggttgtatgaagatcttgctcaccggcggtacgggcctgattggtcgccatctcattccacgtttgcaggcgttgcatcacgacattaccgtggtcacgcgcagcccggagaaagcgcgccaggtgctgggcaccggcgttgagatctggaaaggcctggcggaaaggcaggatctgaacggctttgacgccgtcatcaaccttgcaggcgaaccaatcgccgataaacgctggaccgaagagcaaaaacagcgtttatgcagcagtcgctggaatatgaccgaaaggctggttgagctgattcgcaacagcgagacgccgccctcggtgctgatttcaggctctgctacaggctactatggcgatcttggtgaagtggtggtgaccgaagaagagccgccgcacaacgagtttacccataaactctgcgcccaatgggagcgtatcgcctgcggggcgcagagcgataacacccgcgtctgcctgctgcgcaccggcgtggtgcttgctccgaaaggcggtattctcggtaaaatgttgccgccgtttaaaatggggcttggcgggcccatcggaaacggtcgtcagtatctggcgtggatccatatcgacgatatggtcaacggtattctctggctgctggataacgacctgcgcgggccgtttaacatggtgtctccgtatccggtacgtaatgagcaatttgctcatgccctgggtcatgccctgcatcgcccggcggtgctgcgcgtgcctgcgacggcgattcgcctgctgatgggtgagtcttcggtgctggtactgggcgggcagcgcgcgctgccaaaacggctggaagcggccgggtttacgttccgctggtatgacctggaagaggcgctgggggatgtggtgcagtga

SEQ ID NO: 405 - DNA, 504 bp, Enterobacter cloacae
cgttgtggtccgatgcgaacttttttttctccttatgtcatgagcgtttatgtggcgctggcagaaaaggggcttacttttactctgaaaaccgttgacctggacagcggcgaacacctgaagcctcagtggcagggctacgcgctcactcgccgagtccctgtgctggagatcgacggttttgagttgagtgaatcttcggcgattgacgagtaccttgaggaccgctttgccccgcctgagtgggaacgcatctatcctcacgatctgcaaaagcgcgcccgcgcccgccagatccaggcgtggctgcgtagcgacctggtgccgattcgcacagaacgctctacggacgtggtgttcgctggcgtcaaaaagcccgccctcagtgaggaaggcttatccagcgcccggaagctgatcgaaactgcgtcatcgctgctggcgcagggtaaccccagttttcaccgacgacggcacgaaggaaagacgtacaaaccggggggg

SEQ ID NO: 406 - DNA, 720 bp, Enterobacter cloacae
gaagtgctgaaaggggtgtcgctggaggctaacgcgggcgacgtgatcagtattatcggctcatcaggttcgggtaaaagtaccttcctgcgctgcatcaacttcctcgaaaagccgagcgaagggtcgattgtggtgagcggacagaacatcaacatggtccgtgataaagacggccagcttaaagtggcggataaaaatcagctacgcctgctgcgtacgcgtctgacaatggtgtttcagcacttcaatctctggagccacatgacggtgctggagaacgtgatggaagcgccggttcaggtgctcggcttaagcaagcaggaagcccgcgagcgtgcggtcaaatacctggcgaaagtgggtatcgacgagcggcagcagatcaaatatccggtgcacctgtcaggggggcagcagcagcgtgtttctatcgcccgtgcgctggcgatggagccggaagtgttgctgtttgacgaaccgacttccgcgctggatcctgaactcgttggcgaagtgctgcgcatcatgcagaagctggcggaagagggcaaaacaatggtggtggtgacgcacgagatgggcttcgcccgtaacgtttctaaccacgttatcttcctgcatcagggcaagattgaagagcagggtcatccggacgaggtgctggcgaacccgcaaagcccgcgtttgcagcagttcctgaaaggctcgttgaagtag

SEQ ID NO: 407 - DNA, 1050 bp, Enterobacter cloacae
  unsure (1008)
cataacctgctttttcagactcgccaggataagcagacaaatctgatagatatcaacttccttgccctgccgatgaatttgcgcgacgatcgtagaatcgatatgaggaattccatgaacgctttcagtcctgcgcagtttcgcgcacagtttcccgcgctggccgatgccggcatttatcttgatagcgctgccacggcccttaaaccgcaggcggtgattgaggcaacccgccagttttacagcctgagcgccgggaacgtgcaccgcagccagtatgccgacgcgcagcgcttaacggcgcaatacgaagccgcacgggatcaggtcgcgcgcctgatcaatgctgacagcggtaagaacatcgtctggacgcggggcaccaccgaggccattaacatggtggcgcaatgttacgcgcgtccgctgttgcagcccggggatgagatcatcgtcagcgaggcggaacaccacgccaacctggtgccctggctgatggtggccgaacaaaccggggcacaggttgtaaagctcccgttgggtgcggacttcctgcctgacgtggcgcgtctgcctgagctgattacgccgcgcagccgtattctggcgctggggcagatgtccaacgtcaccggcggctgtccggatctggctcgcgccattgagattgcccatgccagcggcgtggtggtgatggtcgacggtgcgcagggtgtggtgcattttccggctgatgtgcaggcgctggatatcgacttctatgccttctcagggcacaaattgtacgggccaaccggtatcggcgcgctgtacggcaaacctgaactgctggcccggatgacgccgtggctcggcggcggcaagatgattaccgaagtcaccttcgacggttttaaaacgcaggatgtgccctaccgcctggaagccggtacaccgaacgtggccggggttattggcctgagcgcggcgctcgaatggctggcaaaaacggacgtggttcaggctganagctggaaccggggtctggcgacgctggtggaaaaagactga

SEQ ID NO: 408 - DNA, 501 bp, Enterobacter cloacae
cgtcgatgcgctggtttccgccgtcgaccgcgccctggaattactggtggattaatgacaagttcagctttagccggacacccgttcggcaccgttattactgaagagacgttaaaacagacctttgtcccgctcacgcagtgggaagataaatatcgtcagctgatcctgctgggcaaacagttgcctgcactgtcagacgagctgaaattacaggcgaaggagatcgcaggctgcgagaaccgcgtctggcttgggtttagcgtatccggtgagaaactgcatttcttcggcgacagcgagggacgcattgttcgcggtctgctggcggtgctgttgaccgcaatcgaagggaaaagcgccgcagagctgctggcgcattctccgctggcgctgtttgatgagctgggacttcgcacgcagcttagcgcctcgcgcggtcagggactgattgcgctaaacgacgcggtgctggatgccgcccgtcaggctcaggcctga

SEQ ID NO: 409 - DNA, 210 bp, Enterobacter cloacae
tttcgcgggcgtgcacatagcgacatggtaacgctacttgccggatacggcattgccctgcgtgccggacagcactgcgcccagccgctgctggcggctattggcgtgagcggtaccctgcgcgcctcgtttgcaccgtacaatacaaaaagtgacgtcgatgcgctggtttccgccgtcgaccgcgccctggaattactggtggattaa

SEQ ID NO: 410 - DNA, 1134 bp, Enterobacter cloacae
gggggggggacgactacttcagcccctggtgaagataatgaaaggagttgggcgaagtatctgatgacaggcgcaatggtggcgattcttgcggcctgctcttccaaaccgaccgatcgcggtcaacagtataaagacgggaaattatcccagcctttctctttagttaaccagcccgatgccgtgggtgctccaatcaatgccggggatttctccgagcaggtgtaccagatccgcaaagcgtcgccgcgcctgtatggcgcacagaacaacgtttatagtgccgtgcaggactggctgcgtgcaggcggtgatacccgcaatatgcgccagtttggtatcgatgcctggcagatggagggggcggataactacggtaacgtccagtttaccggttactacaccccggttgtccaggcgcgacacacgcgccagggcgagttccagtatcccatttaccgtatgccgccgaaacgcggtcgtctgccgtcccgcgccgagatctacgccggcgcgctgagcgaaaattatgttctggcctacagcaactcgctgatggacaacttcattatggacgtgcagggcagcggctatattgattttggcgacggctcgccgctgaatttctttagctatgccggtaaaaatggccatgcctatcgcagcatcggtaaggtgctgatcgaccgtggcgaagtgaaacgagaagatatgtcgatgcaggctatccgcgaatggggcgaaaagcacagcgaagcggaagtgcgtgagctgcttgagcagaacccatcgtttgttttcttcaaaccgcagaactttgcgccggtgaaaggggcgagcgccgtcccgctgattggccgcgcttctgtggcatcggatcgttcgattattccggcgggtaccactctgctggcggaagttccactcctcgacaacaacggcaaattcaacggcaagtatgaattacgcctgatggtggcgctggacgtgggtggggcgattaaaggccagcacttcgacatttatcagggcatcggcccggatgccggccatcgtgcaggctggtataaccactacggacgcgtgtgggtgctgaagacagcgccgggtaccggaaacgtattcagcggctga

SEQ ID NO: 411 - DNA, 813 bp, Enterobacter cloacae
ggttttatgtctgtggtaatcagcgatgcctggcgccagcgtttcggcggcacggcacggttatatggtgaaaaagccctgcaactgttcgcggatgcgcatgtctgcgtggtgggcattggtggcgtgggttcgtgggcggcagaagcgctggcgagaaccggcattggcgcaattacgttgattgatatggatgatgtctgcgtgactaacactaaccgtcagatccacgccctgcgtgataacgtcggtctggcgaagtccgaggtgatggcggagcgtattcgtctcatcaacccggagtgccgggtgacggtgatcgacgactttgtgacggcagataacgtcgcggagtacatgagcaaaggctacagctatgtgattgacgccatcgacagcgtgcggccaaaagcggcgctgatcgcttactgtcgtcgttacaaggtgccgctggtcacgaccggcggcgcgggcgggcaaatcgatccgacgcagatccaggtggcggatctggcgaaaaccattcaggatccgctggctgccaagctgcgcgagcgcttaaaaagcgacttcaacgtggtgaagaacagtaaaggtaagctgggcgtggactgtgtgttctcgacagaagcgctggtttatccgcaggcggatggttcggtctgtgcaatgaaaagcacggcggaagggccaaagcggatggattgtgcctcagggtttggagcggccaccatggtgaccgcctccttcggctttgtggcggtctctcacgccctgaagaagatgatggcgaaggcggaacgtcaggcctga

SEQ ID NO: 412 - DNA, 207 bp, Enterobacter cloacae
ttgctaaaggagataatcatgaaaaagacagctgcaatcatttctgcctgtgcgttgacctttgccctgagcgcctgttctggaaataactacgtaatgcataccaacgatggtcgatctatcgtctctgaagggaaaccgacaaccgataatgataccgggatgatttgtcttcacacacgccgctggaagatccgatattgcgtt

SEQ ID NO: 413 - DNA, 462 bp, Enterobacter cloacae
  unsure (278)
  unsure (403)
  unsure (424)
caccttttatgtattgatagcaaaacccacgaattccgcttgcctgaaaggccgcgcgcgagtaatttggcgcgatattttttacctcccgtaaacaggattactgcaatgccaagagcgaacgaaattaagaaaggtatggtactgaattacaacggcaaactgctgattgtgaaagatatcgacattcaggcacccagcgcccgtggcgcagcaacgctgtacaaaatgcgtttctccgatgtccgcaccggcctgaaagtggaagaacgttttanaggcgacgatatcgtcgataccgtaaccctgacccgtcgctacgttgatttttcctacattgacggcaacgaatacgtgttcatggataaagaaaattacccccgtatatcttcaccaaagatcngatcgaagaagagctgctgtntattcctgaaggtgggatgccggacatgcaggtgctga

SEQ ID NO: 414 - DNA, 1272 bp, Enterobacter cloacae
ttttttgtagcaatcttgactttaccctctgtttatttaatgacgggcggcgtaaactccgcctctctctgttactcgcaaagactgaacatgcataacacccccgctgccgcctcaccaaagccctttgatttgacgtcaacggcgtttttgatcgttgctttcctcaccggtattgccggtgcgttacaaacgcgtacgctgagcctctttctgaccaacgaagtccacgcccgcccggcgatggttggcttcttctttaccgggagcgccatcattggcatttttgtcagccagtttcttgccggtcgttcagaccgcaaaggcgatcgcaaaagcctgatcgttttttgctgcctgctcggggtatttgcctgcctgctgtttgcctggaaccgtaactacttcattctgctgttcgtgggcgtcttcctgagcagcttcggctcgaccgccaacccgcagatgttcgcccttgcccgcgagcatgccgaccacaccgggcgggaagcggtgatgttcagctcgatactgcgcgcgcaggtgtcgctggcgtgggtgattggccccccgcttgcctacgcgctggcgatgggttttggctttacggtgatgtacctcagcgcagccgtggccttcgtggtatgcggcgcgatggtctggttcttcctgccctccatgcgtaaagagccgaaagtggcgactggtacgctggaagctccgcgacgcaaccgccgcgacgcgctgctgttattcattatctgtacgctgatgtggggaacgaacagcctctatatcattaatatgccgctgtttattattgatgagctgcatctgccggagaagctggccgggatcatgatgggaaccgctgcggggcttgagatccccaccatgctgattgcgggctattacgcgaagcgcttcggcaagcgctttttgatgcgcgtcgccgccgtagccgggctgctgttttatgtcggtatgctgacggttcatacgccagccctgcttctggctttacagctgctgaacgccatttacatcggtattctggccggtatcggcatgctctactttcaggacctgatgccgggtcaggcaggctctgccaccaccctttatacgaataccacccgcgtgggctggattattgcaggctcactggcgggcgttgtggctgaaatctggaactatcatacggtgttctggattgcgctggtgatgtgcgtcatgacgctgagctgcctgacgcgaatcaaagacgtttaa

SEQ ID NO: 415 - DNA, 996 bp, Enterobacter cloacae
acaggcgctgaaagcgattggcgacgccatcgcggccggtctgggggagggcgcataatgagcagacgtgttgcgaccattacgctgaacccggcttacgatctggtgggcttctgcccggaaattgagcgtggcgaagttaacctggtgcggacgaccggcctgcatgccgcaggaaaagggattaacgtggcgaaggtgctgaaagatctcggcatcgacgtcaccgttggcggtttcctcggtaaagacaaccaggacggttttcagcagctgttcagcgagttgggcatcgccaaccgttttcaggttgtgcagggccgtacccgcattaacgttaagctgaccgagaaagacggtgaagtgaccgatctgaacttctccggcttcgaagtgaccccggctgactgggagcgctttgttgccgattccctgagctggctgggccagtttgacatggtgtgcgtcagcggcagtctgccctccggcgtcagcccggaagcgttcaccgactggatgacgcgcctgcgcagccagtgcccgtgcattattttcgacagcagccgcgacgcgctggtcgccggtctgaaagcctctccgtggctggttaagcctaatcgccgcgaactggagatatgggcgggccgtaagctgccagaattaaaggatgtgattgacgctgcccatgcgctgcgcgagcagggtatcgctcacgtggtgatttcgctgggtgcagaaggtgccctgtgggttaacgcctccggggaatggattgccaaaccgccttcaatggaggtggtcagcaccgtgggtgccggggattcgatggttggcggtctgatctacggtctgctgatgcgcgaatccagtgaacataccttacgtcttgctaccgccgttgcggccctggccgtgagccagagcaatgtcggtattaccgatcgtacccagttagccgcgatgatggcgcgcgttgacttaaaaccttttaactaa

SEQ ID NO: 416 - DNA, 1167 bp, Enterobacter cloacae
gctgaaacgattcaatttcagcaggagaggagaatcatgttccagttatctgttcaggatattcacccgggcgaacaggccgggaataaagaagaggctattcgccaggtcgccgctgcgctcgtgcaggctggcaacgtggctgacggctacgtcaacggcatgctggcgcgtgaacagcagacctccaccttcctcggtaacggtattgcaattccgcacggcaccacggacacccgcgatcaggtgctgaaaaccggtgtgcaggtcttccagttcccgcagggcgtgctgtggggcgagggtcaggtggcttatgtggcgatcggcatcgcggccagcggtgacgaacacctgggcctgctgcgtcagctgacgcacgtactgagtgatgatgccgtcgcggaacagcttaaatccgccaccactgctgaagaactgcgtgccctgctgatgggcgaaaaacagagcgaagcgctgaagctggataatgaaaccctgacgctggacgtcgttgcgtccgatctggtaacgctccaggcgctgaatgcggctcgcctgaaagaggtcggtgcggcagattccgcttttgtgacgcgcgcaatcaatgataagccattaaacctgggtcagggcatctggctgaacgacagtgctgaaggtaacctgcgtagcgctatcgcggtcagccgtgctgcggttgcctttgagacagacggcgaacgcgccgcgatgctggtaacggttgccatgactgacgatcagccggtttccgtgctgaagcgtctgggcgatctgctgctgaacaataaagctgaaaaactgctgaacgcagacgcggcgacggtgctggctctgctgaccagcgacgatgcgctgacggatgacctgctgagcgcagagtacgtggtgcgtaacgaacatggcctgcatgcccgtccgggcaccatgctggtgaataccattaaacaatttgaaagtgagatcaccgtgaccaatctggacggttcgggtaaaccagccaacgggcgcagcctgatgaaagttgtcgcgctgggcgtgaagaaaggccatcgtctgcgctttaccgcgcagggtgcggatgctgaacaggcgctgaaagcgattggcgacgccatcgcggccggtctgggggagggcgcataa

SEQ ID NO: 417 - DNA, 1755 bp, Enterobacter cloacae
aaccttttaactaacagcaggagaggaataatgaaaacgctgctgatcattgactccggtctcggacaggctcgtgcctatatggcgaagaccctgctgggcgcggcggcacaaaaagcgcacctggatatcattgataacccgggtgatgctgaaatggcgattgttctgggcgacaaaatccccgctgacagcgccctgaacggcaaaaaagtgtggctgggtgatattaatcgcgcggtggcacatcctgaactgtttctgagcgaagcaaaaggtcatgcgacggtttacagcgcacctgttgaggcggcgccggttgccgccgttgggccgaaacgcattgttgcggtaacggcctgcccgacaggtgtggcgcacacctttatggcggctgaagccattgaaaccgaagcgaaaaaacgtggctggtgggtgaaggttgaaactcgcggctctgttggcgcgggcaatgccatcacgcctgaagaggtggcggaagccgatctggtgattgtggcagcggatatcgaagtggatctggcgaagtttgccggcaagccgatgtaccgtacctctaccggcctggcgctgaagaagaccgcgcaggagtttgataaggcgctggcagaagccaaaccgtatcaggcaaccggtgcggctaaaactgcgactgaagggaaaaaagagtctgcgggtgcgtatcgtcacctgctgaccggcgtgtcctacatgctgccgatggtggtggcgggcggcctgtgtattgcgctctccttcgcctttggtatcgaggcgtttaaagagccgggcacgctggcggccgcgttgatgcagattggcggcggctccgcgtttgcgctgatggtgccagtgctggcgggctttatcgccttctccattgctgaccgtccgggtctgacgccgggtcttatcggcggtatgctggccgtgagcaccggttctggctttatcggcggtatcattgccggtttcctcgccggttatgtggcgaagctgatcagctcgaagctgaagctgccgcagagcatggaagcgctgaagcctatcctgatcatcccgctgatttccagcctggtggtcggtctggcgatgatttacctgatcggtaagccggtcgcgggcattctggaaggtctgacccactggctgcaaaccatggggacggcgaacgcggtgctgctgggcgcaatcctcggcggtatgatgtgtaccgacatgggtggtccggtgaacaaagcggcatatgcgtttggcgttggcctgctgagtacccagacctacgcgccgatggcggcgatcatggcggcaggtatggtgccaccgctggcgcttggcctggcgacgatcattgcccgtcgtaagttcgataaagcgcagcaggaaggcggtaaagctgcgctggtgctgggcctgtgcttcatcaccgaaggcgcaattccgtttgcggcgcgcgatccaatgcgtgttctgccgtgctgtatcgtgggtggtgcggtgacgggggctatttccatggccgtaggtgcgaaactgatggcgccgcacggcggtctgtttgtcctgctgatccctggcgccatcacgccggtgctgggttatctgctggcgattgttgccggtacgctggtggcaggcctctcttacgcggtgctgaaacgtccggaagcggaagttgtggcgaaagcaccgtcagtcttctccacgaggcgacgaggctccgcgctaagccaa

SEQ ID NO: 418 - DNA, 2496 bp, Enterobacter cloacae
aagcgatggggctgccactgctggcggtctctggtgttgaagctgacgacgttattggtaccctggcgcgcgaagcggaaaaaagcaagccgcccggttctgatcagtaccggtgataaagacatggcgcagctggtaacgcctgggattacgctgatcaacaccatgacaaacaccattcttggcccggaagaagtggtcgccaaatatggtgtgccgccagagctcattattgatttcctcgccctgatgggcgattcctcggataacattcctggcgtgccgggcgtgggtgaaaaaacagctcaggcgctgctgcaagggctgggcgggctggatacgctgtatgcagagtccgacaaaattgccggtcttaccttccgtggcgcaaaaaccatggccggaaaactcgccgataacaaagaggtggcttatctctcctatcagttggccactatcaaaactgacgtaaagctggagcttacctgcgagcagctggaagtgcaggaacccgccgccgacgaactgcttggtctgttcagaaaatacgaatttaaacgctggaccgcggatgttgaagccgggaaatggcttcaggcgaaaggggctaaacctgcggcgaagccgaaagagaccatcgttgtcgatgccgaagagcaggcagaagaagaggcgatagcgctctccttcgacaactatgaaaccatcctggaagagtcacggctcgtcgcctggattgaaaagctgaaaaaagcgccagtatttgctttcgataccgaaacggacagccttgataacattacggctaatatggtgggtctgtcattcgcgacggagccgggtgttgccgcctatgttccggttgctcacgactatctggatgcgccggagcaaatctcccgcgagcgcgccttagaactactgaagccgattctggaatacgagaaagcgctgaaggtcgggcaaaacctgaagtatgaccgcggtattctgcaaaactacggcattgagctgcgtggtatcgcttttgacaccatgcttgaatcttacattctggacagcgtggcgggccgccatgatatggattccttatccgatcgttggctgaaacacaaaaccatcacctttgaagaaattgccggtaagggtaaaaatcagctgacctttaaccagatcgcgctggaagaggcaggccgttacgccgcggaagacgctgacgtcacgctacagctgcatctcaaaatgtggccgaaattgcagaagcacgaagggccgctgaatgtgttccggaacattgagatgccgctggtgcctgtgctgtcccgcattgagcgcaatggcgttaaaatcgacccaacggtgctgcataaccattctggtgagctggcgcagcgcctgaccgagcttgaacagaaagcgcatgagcttgctggcgaggcatttaacctgtcttcaccgaaacagctgcaaaccatcctgtttgaaaaacagggtatcaagccgctgaagaaaaccccgggcggcgctccttcaacgtctgaagaggtgctggaagagctggcgctagactatccgctgccaaaagttattctgcaataccgcggtctggctaagctgaaatcgacctataccgacaaactgccgttgatgattaacccgaaaacgggccgcgtgcacacctcctatcaccaggctgtggcggcgaccgggcgactttcgtcaaccgatcctaaccttcagaacattccggtgcgtaatgaagagggccgccgtattcgccaggctttcattgcgccagaggattatctgattgtctccgcggactactcgcaaatcgaactgcgtattatggcgcacctgtcacgcgacaaaggcctgctgacggcctttgccgaagggaaggacattcaccgggcaaccgctgccgaagtgtttgggctgccgctggagagcgtgacaaatgagcagcgtcgtagcgcaaaagcgatcaacttcggtctgatttacggcatgagtgcctttggtctttcacgccagctcaatattccgcgtaaagagtcgcagaagtatatggatctctacttcgagcggtatccgggcgtgctggaatatatggaacgtacccgcgcgcaggcgaaagagaaaggctacgttgaaacgctggatggccgtcgtctctaccttccggacatcaaatccagcaacgccgcgcgccgcgcgggtgctgaacgtgctgcgattaacgcccctatgcagggcactgcggcggacatcattaaacgtgcaatgatcgccgtcgatgcctggttggaaaaagagaagccgcgcgtgaaaatgatcatgcaggtacatgatgaactggtctttgaagttcataaagacgatctggagacggtctctcagaagatccatgaactgatggaaaacagcatgaagctggacgttccgttgctggtggaagtgggtagcggcgaaaactgggatcaggctcactaa

SEQ ID NO: 419 - DNA, 258 bp, Enterobacter cloacae
aacatcatgaaaaaaccgacctccgctgcgggcgcgaaacgccctgcaaaagcacgccgcaaaacgcgcgaagaactgaatcaggaagcgcgcgatcgcaaacgcgataaaaaacatcgtggccatgctgcgggtagccgtgctaacggtggcggtgccccaagcgcttctggcaaaaggcaaccggcagaaaagatcctcgtatcggcaattaaaactcccattcaactggggcgtgaaagacacccgggtcactaa

SEQ ID NO: 420 - DNA, 471 bp, Enterobacter cloacae
tgttttcatccttctgtggcatcctttacccataaattcataacaggcacggacattatggttcagatcccagaaaacccacttatactcgtcgatggctcttcttacctgtatcgggcgtatcatgcgtttcctcctctgaccaacagcgcaggggaacctaccggcgcaatgtacggcgtgctgaatatgcttcgcagcctgattctgcaataccacccaacccatgcggccgtggtgtttgatgcgaagggtaaaaccttccgcgatgaattatttgagcattacaaatcacaccgtccccctatgcctgacgatctgcgtgcgcagattgaaccgctgcacgctatggtgaaagcgatggggctgccactgctggcggtctctggtgttgaagctgacgacgttattggtaccctggcgcgcgaagcggaaaaaagcaagccgcccggttctgatcagtaccggtga

SEQ ID NO: 421 - DNA, 663 bp, Enterobacter cloacae
tccccgcagattacgatttttggagacgaccacgtgactacctggaactaccaacagacgcattttgtcaccagtgcgcccgatattcgccacctgccctcagacacagggattgaagtggcatttgctggccgctccaatgcgggaaaatccagtgccctgaatacgctgaccaatcagaaaaacctggcgcgtacctcaaaaacacctggccgtacacaactgattaacctgtttgaagtggctgaaggcaaacgcctggtcgatttaccgggctacggttacgcgcaggtaccggaagagatgaagatcaaatggcagcgtgcgctgggtgaatacctggaaaaacgcatgtgtctgaaaggcctggtggtgctgatggatattcgtcatccgctgaaagatctcgaccagcagatgattgactgggcggtggcaagcgatattgcggtgctggtactgctgacaaaagcggataagctggcgagcggcgcgcgcaaggcacaggtgaataaggttcgtgaagcggtgctggcattcaacggtgatgtacaggttgaaccgttctcctcgctgaaaaagcagggcgtggataaactgcgtcagaagctcgacagctggtttaacgatctggaaccggcgacagaagcggaagcagagtaa

SEQ ID NO: 422 - DNA, 650 bp, Enterobacter cloacae
ctaggtggatcttcgccggcgtggtgaagactggtgaaacgctggataatgagctgctcgatgagttgtctcattctcccgaaatgcaacagacctgggagagctatcatcttatccgcgacacgctgcgcggtgataccagtgaggttctccatttcgatatctcagcacgcgttatggcggccattgagaacgaacctgttcatcagaccacgccgctgattcctgaagcgcagcctgcacctcaccagtggcagaaaatgccgttctggcacaaggtgcgtccatgggccagccagctcacccagatgggggtcgctgcgtgcgtatcgcttgcagttatcgttggggtccagcactataacactcagtctgaagccaatcagcaacctgaagcgccagtgtttaatacgctgccgatgatgggtaaagccagcccggttagcctgggcgtaccggcagatgcctccgcaagcggcggacagcaacagcaggtacaggagcagcgccgtcgcattaatgcgatgttgcaggattacgagttgcagcgccgtctgcactccgagcagcttcagtttgagcaggcccaaacccagcaggctgctgtgcaggtgccaggaaaccaaactttaggaacgcaatcgcagtaa

SEQ ID NO: 423 - DNA, 1632 bp, Enterobacter cloacae
ttatttaactatatgaagaacatacgtaacttttcgatcattgctcacattgaccacggtaagtcgacgctgtctgaccgtattatccagatttgcggtggcctgtctgatcgtgaaatggcagcccaggttctggactccatggacctggaacgcgaacgcggtattaccatcaaagcgcagagcgtgacgctcgactataaagcttccgatggtgaaacctatcagctgaactttatcgacaccccagggcacgttgacttctcttatgaagtgtcacgctcgctggcggcctgcgaaggcgcgctgctggtggtggatgccggacagggcgtagaggcccagacgctggcaaactgctacaccgccatggaaatggatctcgaagtggtgccggttctgaataaaatcgacctgccagccgccgatcctgagcgcgtagcggaagagattgaagacatcgtcggtattgatgcgaccgatgcagtgcgctgctcggcgaaaaccggcgtcggtgttccggatgtactggaacgtctggtgcgtgatattccgccgccggaaggtgacccggatgcgccgctacaggcgctgatcatcgactcctggtttgataactacctcggcgttgtttcgctggtgcgtattaaaaacggcaccatgcgtaaaggcgacaaaatcaaggtcatgagcaccggccaggtctacaacgctgaccgtctgggcatcttcacgccaaaacaggttgaccgtaccgagctgaaatgcggcgaagtgggctggctggtctgtgccattaaagatatcctcggcgcgccggtgggtgataccctgaccggtgcacgtaacccggcagataaagcgctgccaggcttcaaaaaggtgaaaccgcaggtttatgcgggtctgttcccggtcagctctgacgattacgaaaacttccgcgatgcgctcggaaagctgagcctcaacgatgcctccctgttctacgagccagaaagctcaacggcgctgggcttcggcttccgctgtggcttcctcggtctgctgcacatggagatcattcaggaacgtctggagcgtgaatacgatctggatctgatcaccaccgccccgacggttgtctacgaagtagaaaccacgtcgaaagaggtgatctacgtcgacagcccgtccaagctcccgccgctgaataatattcaggaactgcgcgagcctatcgcagagtgtcacatgctgctgccgcaggagttcctcggcaacgtgatcaccctgtgtattgagaagcgtggcgtgcagaccaacatggtttaccacggtaaccaggtggcgctgacctatgaaattccgatggcggaagtagtgctcgacttcttcgaccgtctgaagtctacctcccgtggctatgcgtcgctggactacaacttcaaacgcttccaggcctcgaacatggttcgcgtggatgtactgatcaacggcgagcgtgttgatgccctggcgctgatcacccacaacgataacgcaccgtaccgtggtcgtgagctggttgagaagatgaaagatctcatcccgcgtcagcagtttgacattgcgagtcttcacacgaggctggcaggatccgcgcttaggtat

SEQ ID NO: 424 - DNA, 492 bp, Enterobacter cloacae
attcagggctgcgcaatgattaaagagtgggccacggtcgtatcctggcaggatggcgtagcgcttgttagctgtgacgttaaagcatcatgcagcagctgcgcttcacgagccggttgcggcagccgcgtgttgaataagctggggccgcaaacgtcgcacactattactgtgccgagcgctcagccgctggtggcagggcaaaaagtggagctcggcatcgctgaaggtagcctgctcacttccgccatgctggtttacctttctccgctcgcaggcctgttcgtgatgggcggggttttccagatgctgttcggcacagatttggccgccatgtgcggggccgcgttgggcggcgtgggcgggttctggcttgctaaaggcgtttccccaaggcttgccgcccgggaagcgtggcagcccgttatcctcagcgttgcactggcacccgaccaacttcgtgttgagacgctctcttctaaggcccggtga

SEQ ID NO: 425 - DNA, 1023 bp, Enterobacter cloacae
gcaggcccaaacccagcaggctgctgtgcaggtgccaggaaaccaaactttaggaacgcaatcgcagtaatgaagcaactttggttcgccatgtctttgatggcgggtagcctgttcttctctgctaacgcctcggctgatgtttcatccggggcgttgttgcagcaaatgaatctggccagccagtcactcaattacgagttggcatttatcagcatcaataagcagggtgtcgaatcgttacgctatcgccacgcccgccttgataaccagccgctcgcccagcttttacagatggatggcccgcgtcgggaagtggtccagcgtgggaacgaaatcagctatttcgagcctggccttgagccgtttacgctcaatggtgactacatcgttgactccctgccgtcgctcatttacaccgattttaaacgtctcgccccctactatgattttatctcggtggggcgaacgcgtattgccgacaggctgtgcgaagtgatccgcgttgttgcgcgggatgggacgcgttacagctatatcgtctggattgacgcagagacgaagctgccgatgcgcgttgatctgctcgatcgcgacggtgaaacgctggagcagttccgtgtgatctcctttgacgtaaacagtcaggtcggcaacagcatgcagtatctggccaaagccagcctgccgcctttgctttccgtgcctgccggcgattctgtcaattttaactgggtaccatcctggatcccgcaagggttcagcgaagtttccagcagtcgtcgccagctgcctactatcgaaactccggttgagtcgcgactctattccgatgggctgtttagcttctcggtgaatattaatcgcgctacggcgaacagttccgaacagatgctccgtaccggtcgccggacggtcagcacgacggtgcgcgataatgcggaaattaccattgtcggtgaattaccgccgccaacggcaaaacgtatttcagacagcattaaattcagggctgcgcaatga

SEQ ID NO: 426 - DNA, 243 bp, Enterobacter cloacae
cggttatccctgcttgttggcaggcatttgaaaatatattttgtattcaggttgcagcaaaacgctttcttacacacaggacttcatatgcggctcagaaaattaaaactgaaaaacttcagaggctacagaaactctactgaaatcattattgatgaaagcatgacgggtattgtcggtcgtaatgactttgggaaatcaacgcttctggaagcgctggctattttttttgaaacagaatga

SEQ ID NO: 427 - DNA, 816 bp, Enterobacter cloacae
gacatcacctccgagaatcttgatgcgcgactggaacggacacgcgttcccattgagctggagcaactggttatctcgttcaatcatatgattggaaagattgaggatgtctttacccgccaggccaatttctctgccgatatcgcgcatgagatcagaacgcccatcaccaatctggtgacgcagactgatatcgcactgagtcaggatcgaacacagagggaacttgaggatgtcctctattccagtcttgaagagtataaccggatgaccaaaatggtcagcgatatgctgttcctggcacaggcagataataatcagctgatacctgacagggtcatgtttgacctcagagcggaagtcatgaaagtcttcgagtttttcgaagcctgggccgaagaacgcaatatcacgctcaaatttaacgggatgccctgcctggttgagggagatccacaaatgttcagaagggcgatcaataatctgttatccaatgccctgcgttataccccggagggacaggcaatcaccgtctcaataagagagcaggagagcttttttgaccttgtgattgaaaatccggggaaaccaatccctgaagagcatttatcaaggttgtttgaccgtttttatcgggtggatccgtccagacaacgaaaaggagaaggcagcggcatcggccttgcgattgtgaagtcaatcgtggaagcacatcacggaagagtgcaggtggaatcggacgtacactcaacgcgttttatcttatccgtgcccagactggagaaaatgattccggacacccagtgctgggaataa

SEQ ID NO: 428 - DNA, 444 bp, Enterobacter cloacae
ccggatatatggcaacatctttgccccctacaggggcatttttatcagattctgctacagttaacgggcatcaacgctaaaaggatattttttatgaaagccagaaacactttatttgcagtattaatgttatccctgccagcgatttcagcagaacattcagaaatgaaaatgactgatatgtctacctcggcttcgtcacaggaatatatggctggcatgaaagacatgcatgacaaaatgatggctgccgtaaatgagtccgatcccgacaaggcttttgcgaaaggcatggtagcgcaccatgaaggggcaatagcaatggctgagaccgagctcaaatacggaaaagatccgaaaatgagaaagctcgcgcaggacatcattaaagctcaaaaaggtgaaattgagcagatgaataaatggcttgatagtcaaaagtaa

SEQ ID NO: 429 - DNA, 702 bp, Enterobacter cloacae
ttccggacacccagtgctgggaataaagatttaaatgacaaagatgtcattagcctgtcatgcagcaaacagaagccattcgatataattagtgcaacttatcaggaaggctggattgctttatcaatatccggcgtcagtggacgccaggaaatgaatatccagtcccctcccggagaaataaacacttccgaacctgtttcagttatggaactgaaaacaccggttgtactcccccggacatcactaattaagaaatggagagttatcatgaaaaatatcgtattagcatccttgctgggctttggcttaatttcttcggcctgggccactgaaaccgtgaatatccatgagcgggtcaacaatgcacaggcacctgctcaccagatgcagtctgctgcggctcctgtcgggatccaggggactgcacctcgtatggccggtatggaccagcatgaacaggccattattgctcatgaaaccatgacgaacgggtcggcggatgcgcaccagaaaatggtggaaagtcatcagaggatgatgggaagtcagaccgtttcccctaccgggccgtcgaagtcattagcggcaatgaatgagcatgaaagagctgcagttgcccatgaatttatgaataacggtcagtctggcccacatcaggccatggccgaagcgcatcgtcgcatgctcagtgcaggctga

SEQ ID NO: 430 - DNA, 396 bp, Enterobacter cloacae
ttggggcgcgtcgcctgcggccttcttctgctcgctggttgtcgctgttgtgttggttttcctggtggcgctgctctgcgtctcgctgttcgtgtccggttttgtcgttgtttcgctggccgccttctccgggcgctccttcctctccttccttccctttccgttggggcgggcggtggccttgcgccttttttcttctccgcctgtgcgctcccgttttttctgccctcctcctccttcccgtcgctgccctactcggtctacaccatcgacgagcacctggacatgctgatggtttgccatcacctcgacccggatatcgccgaggacgtggcgtttgccgaatcccgcattcgccgggagaccatcgccgccgaagacgtgctgcacgatatc

SEQ ID NO: 431 - DNA, 768 bp, Enterobacter cloacae
  unsure (135)
  unsure (136)
  unsure (137)
  unsure (138)
  unsure (139)
  unsure (140)
  unsure (141)
  unsure (142)
  unsure (143)
  unsure (144)
  unsure (145)
  unsure (146)
  unsure (147)
  unsure (148)
  unsure (149)
  unsure (150)
  unsure (151)
  unsure (152)
  unsure (153)
  unsure (154)
  unsure (155)
  unsure (156)
  unsure (157)
  unsure (158)
  unsure (159)
  unsure (160)
  unsure (161)
  unsure (162)
  unsure (163)
  unsure (164)
  unsure (165)
  unsure (166)
  unsure (167)
  unsure (168)
  unsure (169)
  unsure (170)
  unsure (171)
  unsure (172)
agatatcgcacgcctctccccgctttgccacggacatatcaatatgctcggccattattccttcacgctggcagaactggtgaccaaaggacatctgagaccattaaaagaggcgtcagaggcagaaaacgttgnnnnnnnnnnnnnnnnnnnnnnnnnnnnnnnnnnnnnntactagcggccccaggcagcaggtcgatgcaagaatggcggccagcccgccggcgaagagcgcaccgcgcccgttttgtggttcagacatacgttggcccttttgaatttggattggatagcgtaaccttacttccgtactcatgtacggagtcaagcgatatggaaaataatttggaaaacctgaccattggcgtttttgccaaggcggccggggtcaacgtggagacaatccgcttctatcagcgcaagggcctgttgcgggaaccggacaagccttacggcagcatccgccgctatggggaggcggacgtggttcgggtgaaattcgtgaaatcggcacagcggctggggttcagtctggacgagattgccgagctgttgcggctcgacgatggcacccactgcgaggaggccagcagcctggccgaacacaagctcaaggacgtgcgcgagaagatggccgacttggcgcgcatggaaaccgtgctgtctgaactcgtgtgcgcctgccatgcacgaaaggggaatgtttcctgcccgttgatcgcgtcactacagggcgaagcaggcctggcaaggtcagctatgccttag

SEQ ID NO: 432 - DNA, 351 bp, Enterobacter cloacae
gctttcattcggagaactatcatggaaaacattgcgctcattggtatcgatctgggtaaaaactctttccatattcattgccaagatcgtcgcggcaaggctgtttaccgtaaaaaatttacacggccaaagttaatcgaatttttggcgacatgccccgctacaaccatcgcaatggaagcctgtggtggctctcactttatggcacgcaagttggaagagttggggcattttcctaagctgatatcaccacaatttgtccgtccattcgttaactatatcaaaaacgactttgtcgacgccgaagctatttgtgaagctgcatcgcgtccgtctatgcgttttgtacac

SEQ ID NO: 433 - DNA, 3222 bp, Enterobacter cloacae
  unsure (3179)
  unsure (3180)
  unsure (3181)
  unsure (3182)
  unsure (3183)
  unsure (3184)
  unsure (3185)
  unsure (3186)
  unsure (3187)
  unsure (3188)
  unsure (3189)
  unsure (3190)
  unsure (3191)
  unsure (3192)
  unsure (3193)
  unsure (3194)
  unsure (3195)
  unsure (3196)
  unsure (3197)
  unsure (3198)
  unsure (3199)
  unsure (3200)
  unsure (3201)
  unsure (3202)
  unsure (3203)
  unsure (3204)
  unsure (3205)
  unsure (3206)
  unsure (3207)
  unsure (3208)
  unsure (3209)
  unsure (3210)
  unsure (3211)
  unsure (3212)
  unsure (3213)
  unsure (3214)
  unsure (3215)
  unsure (3216)
ccaaaaagtcgcataaaaatgtaccttaaatcgaatatcggacaactcatgtctattattacaaatttacgatttaatagacatattaatgtaacagttttacgatgtccgataatttataacatttcgtacggttggaaaaatgttactaaatgcccgtcaggcagggaggccgatatgcccgttgactttctgaccactgagcagactgaaagctatggcagattcaccggtgaaccggatgagcttcagctggcacgatattttcaccttgatgaagcagacaaggaatttatcggaaaaagcagaggtgatcacaaccgtctgggcattgccctgcaaattggatgtgtccgttttctgggcaccttcctcaccgatatgaatcatattccttccggcgtccggcattttaccgccagacagctcgggattcgtgatatcaccgttcttgcagaatacggtcagagggaaaatacccgccgtgagcatgcagcgctgatacgtcagcactatcagtatcgtgaatttgcctggccctggacatttcgccttacccgtcttttatatacccggagctggataagcaacgaacgtcctggcctgcttttcgatctggcgacagggtggcttatgcaacatcgtattattctccccggagccactacgctgacccggttgatttcagaggtaagggaaaaggcgacgttgcgcctgtggaacaaactggcactgataccgtcagccgaacagcgttcacagctggagatgctgctggggccaactgattgcagccgcctgtctttactggaatcactgaaaaagggccctgtgaccatcagtggtccggcgtttaatgaagcaattgaacgctggaaaactctgaacgattttggcctgcatgctgaaaacctgagtacactcccggctgtgcgcctgaaaaatctcgcacgttatgctggtatgacttcggtgttcaatattgccaggatgtcaccgcagaaaaggatggcggttctggttgcctttgtccttgcatgggaaacgctggcgctggatgatgcattggacgttctggacgccatgctggccgttatcatccgtgacgccagaaagattgggcagaaaaaacggctccgctcgctgaaggatctggataaatctgcattggcgctcgccagcgcatgttcgtacctgctgaaagaagaaacaccggacgaatcgattcgtgctgaggtgttcagctacatcccaaggcaaaagctggctgaaatcatcacgcttgtccgtgaaattgcccggccctcagacgataattttcatgaagaaatggtggagcagtacgggcgcgttcgtcgtttcctgccccatctgctgaataccgttaaattttcatccgcacctgccggggttaccactctgaatgcctgtgactacctcagccgggagttcagctcacggcggcagttttttgacgacgcaccaacggaaattatcagtcggtcatggaaacggctggtgattaacaaggaaaaacatatcacccgcaggggatacacgctctgctttctcagtaaactgcaggatagtctgaggcggagggatgtctacgttaccggcagtaaccggtggggagatcctcgtgcaagattactacagggtgctgactggcaggcaaaccggattaaggtttatcgttctttggggcacccgacagacccgcaggaagcaataaaatctctgggtcatcagcttgatagtcgttacagacaggttgctgcacgtctttgcgaaaatgaggctgtcgaactcgatgtttctggcccgaagccccggttgacaatttctcccctcgccagtcttgatgagccggacagtctgaaacgactgagcaaaatgatcagtgatctactccctccggtggatttaacggagttgctgctcgaaattaacgcccataccggatttgctgatgagtttttccatgctagtgaagccagtgccagagttgatgatctgcccgtcagcatcagcgccgtgctgatggctgaagcctgcaatatcggtctggaaccactgatcagatcaaatgttcctgcactgacccgacaccggctgaactggacaaaagcgaactatctgcgggctgaaactatcaccagcgctaatgccagactggttgattttcaggcaacgctgccactggcacagatatggggtggaggagaagtggcatctgcagatggaatgcgctttgttacgccagtcagaacaatcaatgccggaccgaaccgcaaatactttggtaataacagagggatcacctggtacaactttgtgtccgatcagtattccggctttcatggcatcgttataccggggacgctgagggactctatctttgtgctggaaggtcttctggaacaggagaccgggctgaatccaaccgaaattatgaccgatacagcaggtgccagcgaacttgtctttggccttttctggctgctgggataccagttttctccacgcctggctgatgccggtgcttcggttttctggcgaatggaccatgatgccgactatggcgtgctgaatgatattgccagagggcaatcagatccccgaaaaatagtccttcagtgggacgaaatgatccggaccgctggctccctgaagctgggcaaagtacaggtttcagtgctggtccgttcattgctgaaaagtgaacgtccttccggactgactcaggcaatcattgaagtggggcgcatcaacaaaacgctgtatctgcttaattatattgatgatgaagattaccgccggcgcattctgacccagcttaatcggggagaaagtcgccatgccgttgccagagccatctgtcacggtcaaaaaggtgagataagaaaacgatataccgacggtcaggaagatcaactgggcacactggggctggtcactaacgccgtcgtgttatggaacactatttatatgcaggcagccctggatcatctccgggcgcagggtgaaacactgaatgatgaagatatcgcacgcctctccccgctttgccacggacatatcaatatgctcggccattattccttcacgctggcagaactggtgaccaaaggacatctgagaccattaaaagaggcgtcagaggcagaaaacgttgnnnnnnnnnnnnnnnnnnnnnnnnnnnnnnnnnnnnnntactag

SEQ ID NO: 434 - DNA, 399 bp, Enterobacter cloacae
cgcgatcaacgggcaggaaacattcccctttcgtgcatggcaggcgcacacgagttcagacagcacggtttccatgcgcgccaagtcggccatcttctcgcgcacgtccttgagcttgtgttcggccaggctgctggcctcctcgcagtgggtgccatcgtcgagccgcaacagctcggcaatctcgtccagactgaaccccagccgctgtgccgatttcacgaatttcacccgaaccacgtccgcctccccatagcggcggatgctgccgtaaggcttgtccggttcccgcaacaggcccttgcgctgatagaagcggattgtctccacgttgaccccggccgccttggcaaaaacgccaatggtcaggttttccaaattattttccatatcgcttga

SEQ ID NO: 435 - DNA, 438 bp, Enterobacter cloacae
cgtgcgagatttttcaggcgcacagccgggagtgtactcaggttttcagcatgcaggccaaaatcgttcagagttttccagcgttcaattgcttcattaaacgccggaccactgatggtcacagggccctttttcagtgattccagtaaagacaggcggctgcaatcagttggccccagcagcatctccagctgtgaacgctgttcggctgacggtatcagtgccagtttgttccacaggcgcaacgtcgccttttcccttacctctgaaatcaaccgggtcagcgtagtggctccggggagaataatacgatgttgcataagccaccctgtcgccagatcgaaaagcaggccaggacgttcgttgcttatccagctccgggtatataaaagacgggtaaggcgaaatgtccagggccaggcaaattcacgatactga

SEQ ID NO: 436 - DNA, 639 bp, Enterobacter cloacae
attatcggacatcgtaaaactgttacattaatatgtctattaaatcgtaaatttgtaataatagacatgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttgggcgcgacactgccgatatgatccaactgataaaggaatttgacgctcagggcgtggcagtccggttcattgatgacgggatcagtaccgacggtgatatggggcaaatggtggtcaccatcctgtcggctgtggcacaggctgaacgccggaggatcctagaacgcacgaatgagggccgacaggaagcaaagctgaaaggaatcaaatttggggggccccggcaggcgtaccgtggacaggaacgtcgtgctgacgcttcatcagaagggcactggtgcaacggaaattgctcatcagctcagtattgcccgctccacggtttataa

SEQ ID NO: 437 - DNA, 297 bp, Enterobacter cloacae; identical to SEQ ID NO: 159

SEQ ID NO: 438 - DNA, 702 bp, Enterobacter cloacae
ttgagactggctgataatccgtccataaggttacaatcagtacagcaggtgttttcaattttgaaccaggagacggaaatgtcatacagtggcgaacgagataactttgcaccccatatggcgctggtgccaatggttattgaacagacctcacgcggtgagcgttctttcgatatctattcccgtctgctcaaggaacgcgttatctttctgaccggccaggtggaagaccatatggctaacctgatcgtggcgcagatgctgttcctggaagcggaaaacccggaaaaagacatttacctgtatatcaactcgccgggcggtgtgattacggcgggcatgtctatttatgacaccatgcaattcatcaagccggatgtcagcaccatctgtatggggcaggcggcgtccatgggggctttcctgttaaccgcaggggcgaaaggtaagcgtttctgcctgcctaactcccgcgtgatgattcaccagccgctgggtggttaccagggccaggcgacggatattgaaatccacgcccgagaaattctgaaagtaaaagcgcgcatgaatgaacttatggcgcagcatacgggtcaacctctcgagcagatcgagcgcgataccgagcgcgatcgcttcctctctgcgccagaggcagttgagtacggcttagtcgactccattttgacccatcgtaattga

SEQ ID NO: 439 - DNA, 1332 bp, Enterobacter cloacae
gaatggcatttgcgtcgtcatgtgcggcacatagaacttaaaaagaggtttggactcatgacagataaacgcaaagatggttcgggcaaactgctgtactgctctttttgcggcaaaagccagcatgaagtgcgtaaactgattgccgggccgtccgtgtatatctgcgacgaatgcgtcgatttatgtaacgacatcattcgcgaagagattaaagaagtcgcgccgcaccgtgagcgcagcgcgttaccaacgccacacgagattcgccaccacctggatgactatgtcattggtcaggagcaggcgaaaaaagtgctggcggtggcggtatacaaccactacaaacgtctgcgtaacggcgataccagcaatggcgtagaactgggcaaaagtaacattctgctgatcgggcctaccggttccggtaaaaccctgctggcagaaacgctggcgcgcctgctggatgttccgttcactatggcggatgccaccaccctgaccgaagccggttatgtgggtgaagacgttgaaaatattatccagaagctgctccagaagtgcgattacgacgtacagaaagcccagcgcgggatcgtctatatcgatgagatcgacaaaatctctcgtaaatcagacaacccgtccatcacccgtgacgtctcgggcgagggcgtgcagcaggcgctcctgaagctgattgaaggtacggttgcggctgttccaccgcagggtgggcgtaaacatccgcagcaggaattcttgcaggttgatacctctaagatcctgtttatctgtggtggtgcgtttgcaggcctggataaagtgatctctcaccgtgtggaaaccggctccggcattggttttggcgcaacggtgaaagccacgtctgaaaaaccaaacgaaggccagctgctggcgcaggttgagccggaagatctgatcaaattcggtttgattccggaatttatcggccgtctgccggttgtggcgaccctgaacgaactgagcgaagacgcgttgattcagatcctgaaagagccgaaaaacgcgctgaccaagcagtatcaggcgctgtttaatctggaaggcgttgagctggaattccgtgacgaagcgttggacgcgattgccaagaaagcgatggcgcgtaaaaccggtgcccgtggcctgcgttctatcgtggaagcagcattgctcgacacgatgtacgatcttccttctatggaagacgtcgaaaaagtcgtgatcgacgagtccgtcattggtggccagaccaagccgttactgatttacggtaaaccggaagcgcagcaggcatctggcgaataa

SEQ ID NO: 440 - DNA, 1695 bp, Enterobacter cloacae
ccagtttacctggcggacactaaactaagagagagctctatgaatcctgagcgttctgaacgcattgaaatccccgtattgccgttgcgcgatgtggtggtttatccgcacatggtcatacccttatttgtagggcgggaaaaatctatccgttgcctcgaagccgccatggatcatgataaaaaaatcatgttggtcgcgcagaaagaagcatcaacggatgagccgggtgtaaacgatcttttcaccgtcgggaccgtggcctctattttgcagatgctgaagctgccagacggcaccgtgaaggtgctggtggaaggcttacagcgtgcgcgtattaccactctgtcagacgatggcgagcacttctctgcgaaggcagagtaccttgattcaccggaacttgatgagcgcgagcaggaagtgctggtacgcaccgcgatcagccagttcgaaggctacatcaagctgaataagaaaatcccacctgaagtgctgacgtcgctgaacagcatcgacgatcctgcacgtctggcggataccatcgctgcgcatatgccgctgaagctggctgacaaacagtccgtgctggaaatgtccgacgttaacgaacgtctggaatacctgatggcgatgatggagtctgagatcgatctgctccaggttgagaagcgcattcgcaaccgcgtcaaaaagcagatggaaaaatctcagcgtgagtactatctgaacgagcaaatgaaagccattcagaaagagctcggcgagatggacgatgcgccggatgaaaacgaagcgctgaagcgtaagatcgacgcggcgaagatgccgaaagaggcgaaagagaaagccgaagctgagttgcagaagctgaaaatgatgtctccgatgtcggcggaagcgaccgttgtacgcggctacattgagtggatggtgcaggttccgtggaatgcccgcagcaaggtcaaaaaagacctgcgtcaggcccaggagatcctggataccgaccactacggcctggaacgtgtgaaagaccgcattcttgagtacctcgcggtacagagccgagtgaacaaaatcaaaggcccaatcctgtgcctggtagggcctccaggggtgggtaaaacctctctgggccagtccatcgccaaagcgacagggcgtaagtacatccgtatggcgctgggcggcgtgcgtgatgaagcggaaatccgcggtcaccgccgtacctacatcggttccatgccgggcaagcttatccagaaaatggcgaaagtgggcgtcaaaaacccgctgttcctgctcgatgagatcgacaaaatgtcttcagacatgcgtggcgatccggcgtcggcgctgctggaagtgcttgatccagagcagaacgtggcgtttagcgatcactacctggaagtggattacgacctgagcgatgtgatgttcgtggcgacgtcgaactccatgaacattccggcaccgctgctggaccgtatggaagtgatccgtctgtccggttataccgaagacgagaagctgaacattgccaaacagcacctgctgccgaagcagattgagcgtaacgcgcttaaagccaacgagctgaccgttgaggacagcgccattgtcggcattattcgttactacacccgtgaagcgggtggtcttcaccacggggctggcaggatccgcccttag

SEQ ID NO: 441 - DNA, 225 bp, Enterobacter cloacae
atcagtaacggcttggtctggccaccaatgacggactcgtcgatcacgactttttcgacgtcttccatagaaggaagatcgtacatcgtgtcgagcaatgctgcttccacgatagaacgcaggccacgggcaccggttttacgcgccatcgctttcttggcaatcgcgtccaacgcttcgtcacggaattccagctcaacgccttccagattaaacagcgcctga

SEQ ID NO: 442 - DNA, 192 bp, Enterobacter cloacae
atcaacgcgtcttcgctcagttcgttcagggtcgccacaaccggcagacggccgataaattccggaatcaaaccgaatttgatcagatcttccggctcaacctgcgccagcagctggccttcgtttggtttttcagacgtggctttcaccgttgcgccaaaaccaatgccggagccggtttccacacggtga

SEQ ID NO: 443 - DNA, 483 bp, Enterobacter cloacae
gatgataggggtggtccgcttcacaaaagaggactgcgtccgctcggcgctctgccagcgcacgctacaagcgtattattgaatatgctgttgtgttcaaggcccgggaaaccgggctttgttttttgtgcattttatcccctcttccctggggagagggttagggtgaggggctcaggccgcaccgagctgcatatagcaccgggggggattgactcgctgcgctcgccctgcgggcagcctgttcgctacgctctcagtctgtccaactggctgcgccagttgtcgaaccccggtcgggggttctcattccccgcaaaggcgtacaacatgcgaaaaaaaagcccgcattttcatgcgagctcttcttcaaatatggcggtgagggggggattcgaacccccgatacgttgccgtatacacactttccaggcgtgctccttcagccactcggacacctcaccatattgttttgctgcctga

SEQ ID NO: 444 - DNA, 1119 bp, Enterobacter cloacae
gagaagacagcggtagttcccggcagtgatgttaactcactatggagatcgcgaatggttgcgtcctgtactggacaaggtaaacacatcaaccgcagtacccggcgcggaggctcagactccggcagcgatttcttcaccaccaaattctctccttcacctcaacaacctttttctaccgacgtgcataacggtgcgcgtagccgttgtatatcgtcatccggtaatgcaagcaatggcttacaaggaagccaaccctctgatgttcgtgcgcataatcgtgccgatgctggcgcgtgtgatgaataccaacaactcaaggtgctatccatgggaagacagaaagcagtgatcaaagctcgtcgcgaagcaaaacgtgtgctgagacgggattcacgtagtcataaacagcgtgaagaagaatcggtcacctcgcttgtgcagatgagcggcgtagaatcgattggcatggcgcgggacagccgcgatgcatcgccaattgtggcgcgaaatgaagctcaggcgcactacctgaatgctatcgagagtaaacagctcatctttgcaaccggggaagccggatgcgggaaaacctggatcagcgccgccaaagcggcggaggcgctgattcataaggacgtggaaaggatcatcgttacccgtccggtactgcaagcggatgaagatctgggcttcttgcccggcgatatttccgagaagtttgccccgtacttcaggcccgtctatgacgtgctggtgaagcggttgggcgcttcctttatgcagtactgcctgcgaccagagattggcaaggtggaaatcgcgccgttcgcctatatgcgcggacgtacatttgaaaatgcggtcgttattcttgacgaggctcagaacgtgaccgctgcgcaaatgaagatgtttttaacgcgcctcggggagaacgtgacggtgatcgtcaatggcgatattacccagtgtgacctgccgtcgggcgttaagtctggcctgagcgatgccatgtcacgttttgaggaagatgagatgataggggtggtccgcttcacaaaagaggactgcgtccgctcggcgctctgccagcgcacgctacaagcgtattattga

SEQ ID NO: 445 - DNA, 186 bp, Enterobacter cloacae
caccgggggggattgactcgctgcgctcgccctgcgggcagcctgttcgctacgctctcagtctgtccaactggctgcgccagttgtcgaaccccggtcgggggttctcattccccgcaaaggcgtacaacatgcgaaaaaaaagcccgcattttcatgcgagctcttcttcaaatatggcggtga

SEQ ID NO: 446 - DNA, 270 bp, Enterobacter cloacae
agactggtggccgcgggactggcggcaggggcgatccgcgccttccacgaagcgggcctgtggaaccacttccaggacgtggcgttcgatctcagcaacgtcctgtcgacccattcactgaccggtaccctgcttgaagggatcttcggctaccaggaaacgccgagcgtcagcgaagtggcgatgtactttatctatctggttccggcgctgatcctgttcgctatgccgccgcgtaccggctcgcagacgtcgcgcgttgcgccgtaa

SEQ ID NO: 447 - DNA, 1155 bp, Enterobacter cloacae
ttacaacatactttaaaggggagagtcatggccattcagttccgtcgtagtgcgttatgcgcaggcatcgccgcgctgttcgtgtctgccttcgccgctcaggcagcagatattccgcaggtcaaagtcaccgtcaacgataaacagtgtgagccgatgaccatcacggttaacagcggtaaaacccagtttattattcagaaccacagccagaaggcgctggagtgggaaatcctgaaaggcgtgatggtggtggaagagcgcgagaatatcgcgccgggcttcagccagaagatgaccgcaaatcttcagcccggggaatatgacatgacctgcggcctgctgactaacccgaaaggtaagctgatcgtcaaaggcgcagcgacggcggacgcggccaaaggcacggcgctgctgagtctcggcgacgctattaccgcctataaagcctacgtcaccaaagagacggcggacctggtggcaggcaccaaagcctttaccgacgcggtgaaagcgggcgatatcgaaaaagcgaaatccctgtatgcgcctacacgtcagcactacgagcgcatcgagccgattgccgagctgttctctgacctcgatggcagcattgacgcccgtgaagacgactacgagcagaaggccgccgatccgaaattcaccggcttccaccgtctggaaaaagccctgtttggcgataactccaccagggggatggagaaatacgccgagcagctcaacagcgacgtgctggagctgcaaaaacgcatcagcgagctggcattcccaccgtcgaaagtggtgggtggcgcagcgggtctgattgaagaagtagccgccagcaaaatcagcggtgaagaagatcgttacagccacaccgacctgtgggacttccaggcaaacgtcgacggcgcacagaaaattgtcgatctgctgcggccacagttgcaaaaagagaacggcgaactgctggcgaaagtggatgccaattttaagaaagttgacgctatcctggcgaaataccgcaccaaagacgggttcgaaacctacgacaagctgaccgatgctgatcgtaacgcgctgaaaggcccgattacgacgctggcggaagatctctccctgctgcgtggcgtactgggtctggattaa

SEQ ID NO: 448 - DNA, 1287 bp, Enterobacter cloacae
gcgatgaacgagcatgacgagtacgacgtggcggaaccttcccgacgtcggttgttaaaaggggtaggggcgctgggcggcgcgtttgccctggcgggcggctgtccggtggcgcatgcggcaaaaccgcaaagcgcccccggcacgctctccccggacgcgcgtatggaaacgcagccgttttatggtgagcaccaggcggggatcctgacgccgcagcaggcctcgatgatgctggtggctttcgattcgttggcgagtgataaggccgaccttgagcgtctgttcaggctattaaccacgcgcattgccttcctcacagccggcggtccggcaccggaaacaccgaatccgcgcctgccgccgatggattccgggatcctcggggcgtttatcgctcccgataatctgaccatcaccgtgtcggtgggggaatcactatttgatgatcgctacggtctggcgaagcagaagccgaaagcgctgcaaaaaatgacgcgattcccgaatgattctctcgacgcggcgctgtgccacggcgatctgctgttgcagatctgcgctaatacccaggatacggtgatccacgccctgcgcgatattatcaagcacaccccggatctgctgagcgtgcgctggaagcgggaaggttttatctctgaccacgccgcgcgcagtaaagggaaagagacgccggtcaacctgctgggcttcaaagacggtaccgccaacccggacagcagcaataccgcgttgatgaacaaggtggtctgggttacggcggatcagggcgaaccggcctgggcggtgggcggcagctatcaggcggtgcgtatcattcagtttcacgtggagttctgggaccgcacgccgctgaaagagcagcagactatcttcggccgcgataagcaaaccggcgcaccgctcggcatgaagctcgagcacgatgaacccgactacgcccgcgatccgaacggggatgtcatcgcgctggacagccatattcgcctcgccaatcctcgcaccaaagagacgcaatccagcctgatgatgcgcaggggttacagctactcgctgggggtgaccaactccgggcagcttgatatgggactgctgtttgtctgctatcagcacgatctggagaagggattcctcaccgtgcagaagcggctcaacggcgaagcgctggaagagtacattaagcccatcggcggcggctatttctttgccctgcccggcgcgcgtgacgcgaacgcctggctcgctcagggtctcatagaagcctga

SEQ ID NO: 449 - DNA, 312 bp, Enterobacter cloacae
ctcgctgcgctcgccctgcgggcagcctgttcgctacgctctcagtctgtccaactggctgcgccagttgtcgaaccccggtcgggggttctcattccccgcaaaggcgtacaacatgcgaaaaaaaagcccgcattttcatgcgagctcttcttcaaatatggcggtgagggggggattcgaacccccgatacgttgccgtatacacactttccaggcgtgctccttcagccactcggacacctcaccatattgttttgctgcctgaccgcttggggggcaacggggcgctactatagggagttgcgctaa

SEQ ID NO: 450 - DNA, 1809 bp, Enterobacter cloacae
cggcgggggatatcctccgccgcttttttttgcagcaattgcccccattattttcttccgggacgttttaagggttgtcactacgtccggcttataagatcatatgccgttatacgttgtttacgctttgaggaatccacgatgagtgaggcagaagcccgcccgagtaactttattcgtcagatcatcgatgaagatctggccagtggtaagcacaccacagtccacacgcgtttcccgccggagccaaatggctacctgcacattggtcacgccaaatcgatctgcctgaactttggtattgcgcaagattaccaggggcagtgcaacctgcgtttcgatgacaccaacccagtaaaagaagacatcgaatacgttgagtcgataaaaaacgacgtgcaatggctgggcttcaactggtctggcgatatctgctactcctcagactatttcgatcagctgtatgcctacgcggttgaactgattaacaaaggtctggcatacgtcgacgaattgtcagctgacgaaatccgtgaataccgcggtacgctgactcagcctggtaaaaacagcccgttccgcgatcgtagcgtggaagagaacctggcgctgtttgaaaaaatgcgtgccggtggcttcgaagaaggtaaagcgtgtctgcgtgccaaaatcgatatggcgtctccgttcatcgtgatgcgcgatccggtgctgtaccgcattaagttcgctgaacaccaccagaccggtaacaagtggtgcatctacccgatgtacgacttcacccactgcatcagcgatgcgctggaaggcattacgcactctctgtgcacgctggaattccaggacaaccgtcgtctgtacgactgggtgctggataacatcaccattcctgtgcatccgcgtcagtacgagttctctcgtctgaacctggaatacaccgtgatgtccaagcgtaagctgaacctgctggtcaccgacaagcacgttgaaggttgggacgacccgcgtatgccgaccatctctggcctgcgtcgtcgtggctacacctcggcgtccattcgtgagttctgcaaacgtattggcgtcaccaagcaggacaacaccatcgaaatggcgtctctggaatcctgcattcgtgaagacctgaacgaaaacgcgccgcgcgcgatggcagtgatcgatccagtgaaactggttatcgaaaactatccgcagggcggaagcgaacaggtctcgatgcctaaccatccgaacaaaccggaaatgggcacccgcgacgtgccgttcagcggtgaaatctggatcgatcgcgccgacttccgcgaagaagcgaacaagcagtacaagcgtctggtgctgggcaaagaagtgcgtctgcgtaacgcctatgtgatcaaagcagagcgagtagagaaagatgcggaaggtaacatcacgaccatcttctgtacgtacgacgcagagacgctgagtaaagatccggcggatggccgtaaagtgaaaggtgtaatccactgggtgagcgcgcagcatgcgcttccggttgagatccgtctctacgatcgtctgttcagcgtgcctaatccaggcgctgcggaggacttcctggcggtcattaaccctgagtctctgattatcaagcaggggtatgccgagccgtctctgaaagccgctgaagccggtaaagcgttccagtttgaacgtgagggttacttctgcctggacagccgttacagcacggcagaaaaaccggtatttaaccgtaccgtcggtctgcgtgatacctggactaagatcggcgaataa

SEQ ID NO: 451 - DNA, 615 bp, Enterobacter cloacae
  unsure (527)
  unsure (554)
tctatgcgtacgttcagtggcaaacgtagtgcgctggcgctggctatcgccggtgtgacagcaatgtcgggcctggtggttgcgccacaggcaaaagcagcaggtttcatcgaagattccaccctcacgggcggtatttattactggcagcgtgagcgtgaccgtaaagacgtcactgaagataaatacaaaaccaacctttctcactcgacctggaacgccaaccttgatttccagtcgggatatgccgccgatatgttcgggatcgatattgcagcgttcaccgcaattgaaatggccgaaaatggcgacagcggccatccgaacgaaattgcgttctcctccagcaataaagcctacgacgaagactggtccggcgataaaagcggaatcagcctgtataaagcggctgcaaaattcaaatatggtccggtctgggcgcgcggaagttatatccagccaaccggtcagacgctgttagcgccgcactggagctttatgccaggcacctatcagggggcggaaancggtgctaattttgactacggcgaatncgggggcgtgagcttctcctatatgtggaacaacgaagttacaagcgccgtggcacattga

SEQ ID NO: 452 - DNA, 2001 bp, Enterobacter cloacae
aaacatagtttatgcgcgagtcttaacaaagggtctcgtagggggaataggatgaatattttaggttttttccagcgcctcggtagggctttgcagctccctatcgccgtgctaccggttgcagcattgctgctgcgattcgggcaacccgatcttcttaacgtgccgtttattgcccaggcaggcggcgcaatttttgacaacctggcgctgattttcgccatcggtgtggcgtcaagctggtcaaaagacagcgcgggtgccgcggcactggcaggggctgtcggttacttcatcctcacgaaagcgatggtaaccatcaatcctgaaatcaacatgggtgtgctggcaggtatcattactggcctggtgggtggcgccgtatacaaccgttgggcaggtatcaaacttcctgacttcctgagcttcttcggcggtaaacgttttgtgccgattgcgacgggctttttctgtctgatcctcgccgccatctttggctacgtttggccaccggtgcagcatgctatccatgcggatggcgagtggatcgtgtctgcgggcgcaatgggtgcgggcatcttcggtttcattaaccgtctgctgatcccaaccggtctgcatcaggtactgaacaccatcgcctggttccagattggtgagttcaccaacgcggccggcgcggtattccacggtgatatcaaccgcttctacgcaggcgacggcaccgcgggcatgttcatgtctggcttcttcccaatcatgatgtttggtctgcctggcgcggcgctggcaatgtacctggctgcgccgaaagcgcgtcgcccaatggttggcgggatgttgctgtccgttgcgatcaccgccttcctgaccggcgtgaccgagccactggaattcctgttcatgttcctggctccgctgctgtatctgatgcacgcgatcctgaccggtatcagcctgttcgtcgccacccttctgggtatccatgctggcttctccttctccgcaggcgccatcgactatgtgtggatgtacaacctgccggcggcaagcatcagcgtctggatcctgatggtgatgggcctgatcttctgcgttatctacttcgttctgttcagcgcggttgttcgtatgtttaacctgaagacgcctggtcgcgaagatgctaaagatgatgttgtgaccagtgaagccaacagcaataccgaagagggtttaacccaactggcaaccacctacattgccgctgtgggtggcaccgacaacctgaaagcgatcgatgcctgtattacccgtctgcgtctgaccgtaggcgactccgcgcgcgtgagcgatgcaatgtgcaaacgcctgggtgcgtctggtgtggtgaaactgaacaaacaaaccatccaggttatcgtgggtgcgaaggccgaatctatcggcgatgaaatgaaaaaagtggttgcccgtgggccggtcgctgccgcctcaacggataacgcaccggtggctgacgcgccggttgcaaaaccgcaggctgtgccaaacgcggtgaccatcgctgcgctggtttctccggtgacaggtgacgttgttgcgcttgaacaggtgcctgacgaagcgttcgccagcaaagcggtcggtgacggcgtggcggtaaaaccaacggacaaaaccgtggtctctccggctgccggtactatcgtgaaaatcttcaacaccaaccatgcgttctgcctggaaacggaaaaaggcgcggagatcgttgtccatatgggtatcgataccgttgcgctgaacggccagggctttactcgcctggtggaagagggtgctgaagtggcggcaggccagccgattctggaaatggatctggacttcctgaatgctaacgcgcgctccatgataagcccggtcgtgtgcagcaacatcgacgacttcagcggtctggtgatccaggcgcaggggcaggtagttgcaggccagacgccactgtatgagattaaaggcaagtaa

SEQ ID NO: 453 - DNA, 861 bp, Enterobacter cloacae
aacgtcccggaagaaaataatgggggcaattgctgcaaaaaaaagcggcggaggatatcccccgccgctaaaggcataactctactcaggagcgattacttgcctttaatctcatacagtggcgtctggcctgcaactacctgcccctgcgcctggatcaccagaccgctgaagtcgtcgatgttgctgcacacgaccgggcttatcatggagcgcgcgttagcattcaggaagtccagatccatttccagaatcggctggcctgccgccacttcagcaccctcttccaccaggcgagtaaagccctggccgttcagcgcaacggtatcgatacccatatggacaacgatctccgcgcctttttccgtttccaggcagaacgcatggttggtgttgaagattttcacgatagtaccggcagccggagagaccacggttttgtccgttggttttaccgccacgccgtcaccgaccgctttgctggcgaacgcttcgtcaggcacctgttcaagcgcaacaacgtcacctgtcaccggagaaaccagcgcagcgatggtcaccgcgtttggcacagcctgcggttttgcaaccggcgcgtcagccaccggtgcgttatccgttgaggcggcagcgaccggcccacgggcaaccacttttttcatttcatcgccgatagattcggccttcgcacccacgataacctggatggtttgtttgttcagtttcaccacaccagacgcacccaggcgtttgcacattgcatcgctcacgcgcgcggagtcgcctacggtcagacgcagacgggtaatacaggcatcgatcgctttcaggttgtcggtgccacccacagcggcaatgtag

SEQ ID NO: 454 - DNA, 1101 bp, Enterobacter cloacae
gctggtgacgggggagaccaccccggatcagcgggctgtgcggatggcggaagtcggccatttactgcgctcttatctaaaataaatccacacacctcacaacaagggaaagacatcatgaaatctcgcgcagctgtcgcgttcggcccaggccagccgctgaaaatcgttgaaattgatgttgctccgccgaagaaaggcgaagtgctgatcaaaattacccacaccggcgtttgccataccgatgcgtttaccctgtccggtgacgatccggaaggcgtattccctgcggtgctcggccacgaagggggcggtgtggtggtggaagtgggtgaaggcgtcaccagcctgaagcccggcgaccatgtgatcccgctctacaccgcagagtgcggtgagtgtaagttctgcaaatccggcaaaactaacctctgccaggccgtgcgcgccacgcagggtaaaggccttatgccggacggcaccacccgtttctcctataacggcgagcccatttatcactacatggggaccagcaccttcagcgaatacacggtgtgcgccgagatctcactggcgaaagtgaatccgcaggccccgctggataaagtctgtctgctcggctgcggtgtcaccaccggtatcggcgcggtgcataacacggcgaaagtgaaagagggtgacaccgtggcggtgttcggcctcggcgggatcggtctggcagtcatccagggcgcggtacaggcgaaagctggccgcatcattgctgtggataccaacccggaaaaatttaagctcgcaggtgagatgggcgcgaccgatttcatcaacccgaaagactacgacaaaccggttcaggaggtgatcgttgagctgaccgacggcggcgtggacttcagcttcgaatgtatcggcaacgtctatgtgatgcgctcagcgcttgagtgctgccacaaaggctggggcgagagcatcattatcggtgtggccggccgcgggtcaggagatcaaaacccgtccctaccatctggtgacagggggcgtatggcgcgggtcggcatttggcggcgtgaaaggccgtacccagctgccgggcatggttga

SEQ ID NO: 455 - DNA, 312 bp, Enterobacter cloacae
aagatacaatacccccctatagtatcaggagggcgtatgccgcattcacccgaagataaaaaacgtattctgacccgcgtccgccgcattcggggccaggttgatgcccttgaacgcgccctggaatcgggcgatccctgtctcgccattttgcagcaaatcgccgccgtgcgcggcgctgccaatggcctgatgggggaaatggttgaaattcacctcaaagatgagctggtgacgggggagaccaccccggatcagcgggctgtgcggatggcggaagtcggccatttactgcgctcttatctaaaataa

SEQ ID NO: 456 - DNA, 312 bp, Enterobacter cloacae
tgcgctcagcgcttgagtgctgccacaaaggctggggcgagagcatcattatcggtgtggccggccgcgggtcaggagatcaaaacccgtccctaccatctggtgacagggggcgtatggcgcgggtcggcatttggcggcgtgaaaggccgtacccagctgccgggcatggttgaagatgcgatggtcggtaaaattcagctcgacccgttcattacgcaccgcctgccgctggagcagatcaacgaagccttcgatttgatgcacgaaggaaaatctattcgtaccgttatccatttcggcgacaactga

SEQ ID NO: 457 - DNA, 1551 bp, Enterobacter cloacae
tcttttctaaagtgtgacctgtctggcgcttttaaccgtaatctaattctacgccgtgccgatgactcttttacaggcgtgtttttacgcatcttacctataagagagtcgacggtcatggacaacacaacatcgatgcaggcgcagcataagctgagtttcttgcatcacatccggctggttccgctgttttcctccattctcggtggcattattctcctgtttgcattgagctcgggtctggcaggctatttcctgctccaggccgataacgatcagcaggatgttacggcagaaatccaggtgcgcaccgggctgtcaaacagttccaaccatttacgcaccgcccgtatcaacatgatccacgcgggggcggcgagccgtatcgcggagatggaggcgatgaaacaaaacatcgctgaggctgagacccgcatcaggcagtcgcaggatggatttgccgcctatatgaagcgcactattcgcacaccggctgatgaagcgctggacggcgatctgaaagcccgctatgacgcctacatcgccggtatgcagccgatgctgaaatatgccaaaaacggcatgtttgaagccattatcaaccacgaaaatgagaccgcgcgtccgctggacgatgcctataacgcggtgctgttgaaggcgataaaaatccgcaccgaacgcgccaacgcgctgacggcgcaggctcacacccgcacccggctggggctgatgtttatgttcggcgcgtttggcctggcgctggcgctggcggtgatcacttttgtggtgctgcgccgtacggtgataaacccgctccagcgagccgctacgcgtatcgaaaatatcgcgaaaggcgatttgaccatgccggacgaaccgaccgggcgcagtgaaattggccgccttacgcgcgatctgcaaacgatgcagcacgcgctggtgaccaccgtaggcaccgtgcggcaaggggcggaggagatctaccggggaacgagcgagatctccgcgggtaacaccgatctctcttcccgtactgagcagcaggcggcggcgattgaacagacggcggccagcatggagcagctcaccgcgacggtgaaacagaacgccgataacgcgcatcatgcaagtaaactggcagaagatgcctccgggaaggccagccgcggggggcagatggtctccggcgtggtgaaaaccatgggtaatatttccactagctcgaagaagatctctgaaattaccgccgtgattaacagcatcgcgttccagaccaatattctggcgctcaacgcggcggtcgaggcggcgcgtgcgggtgaacagggacgcggctttgcggtcgtggcgagtgaagttcgcaccctggcaagccgcagcgcaaacgcggcgaaagagattgaaagcctgattaatgaatcggtgtcgcttatcgatcagggttccggggaggtggttgcagcgggcaataccatgaatgaaatcgtcgaggcggttaaacgcgtcaccgatatcatgtcttcagcacggggtggaagtaccgagtcc

SEQ ID NO: 458 - DNA, 501 bp, Enterobacter cloacae
aaggactttttactgcccccaaattgcccccaaagcgtattttgcccccaaatttgcccccgaaatttactcttttgcgtagctccttccagtttcgaatcacacctctttacgcaattcagactgatcagcataatcgccacgaatccgtttgtaagacttaaccagcgcgcgctactttttcccactaacctatactttcagtctgacacacgactggaggtttctatgtgtggacgttttgcacaagcccaaacccgtgaagagtacctagcttacttcgccgatgaagccgttcgtgacatagcctatgacccagaaccaattggtcggtacaacgtggcacccggttctaaagtcctgttgttgagcgaacacgacgagcaattacatcttgatcctgtattctggggttatcccccggggtggtgggataaagcgccactgataaacgcccgcgtcgaaaccgcggccaccagccgaatgtttaagcctctctga

SEQ ID NO: 459 - DNA, 333 bp, Enterobacter cloacae
caacatggtcgggcgatttgctttgctgatggatggttcgaatggaaacgagaagaaggcaagaaacaaccctatttcattcaccgcgccgacggccagccgatattcatggccgcaatcggcagtacgccatttgagcgaggcgatgaagctgagggctttctaatagtcacatctgcagctgataaaggcctggtcgacattcacgatcgccggccactggtactgtcaccggaagcggctcgcgagtggatgcgacaggaggtaggaggaaaagaggctgaacagatcgctgccgacggagtatcgacacgccagggcgaagtacagcgt

SEQ ID NO: 460 - DNA, 429 bp, Enterobacter cloacae
aacagtgcttcacaaaaggagatcgcaatgacgttaccgagtggacacccgaaaagtagactgattaagaagttcatggctcttggcccgtatattcgagaagagcagtgtgaagagaatcgcttttttttcgactgcctggctgtttgcgtcaacgtgaagcctgcacccgaaaaacgtgagttctggggctggtggatggaaatggaagcacaggaaaaccgttttacctatagctatcagtttggcctgtttaataaagacgggcactggcaggcgacgagcatcaaagatcaggaagtgatcgatcgcctggagcatacgctaaaagaatttcacggcaaagctcgcgacctgctggccacgctggatctgaagctggagcctgcggacgatttttccagcgaagcggtgaaattgagagcctga

SEQ ID NO: 461 - DNA, 507 bp, Enterobacter cloacae
ctgcggcctcggcctgctataaaagcgctggagaatatcccctgggttgatcacacccgggttggcgcgtttggcttccgctttggcgctaacgtcgcggtacggcttgcctaccttgaatcttcacgcctgaaggccgtcgcctgtcttggtccggtggtgcatgctctgttaagcgatcctgcgcgtcagggtagcgttcctgagatgtatctggacgtactggcgagccgacttggcatgcatgatgcttcagacgaagcgttgcgcattgaacttaatcgttattcattaaaaacgcagggcttactcggccgccgctgcccaaccccgatgatgtccggtttctggaagaacgatccgtttagcccggaagaggagtcacgcttaatcacgtcgtcatcttctgatggtaaattgctggaggtgcccttcagcccggtgtaccagaattttgacaaagcgctgaaagagatcacacgctggatcacgcagagattgtgttaa

SEQ ID NO: 462 - DNA, 1143 bp, Enterobacter cloacae
ctgacatcattttcccttattgttgaacggcagagaatcatgagtgacagccagacgctggtggtaaaactcggtaccagtgtgttaacaggcggatcgcgccgcctgaatcgtgcccatatcgttgagcttgtacgtcagtgcgctcagttgcatgccgcagggcatcgtattgtaattgtgacatccggggcgattgccgccgggcgtgaacacctgggctaccccgaactccccgcgacgatcgcttccaaacagctgctggccgccgtgggacaaagccgactcatacagctctgggaacaactgttctccatctacggcattcacgtcgggcagatgctgctgacgcgtgcggatatggaagacagagaacgtttcctgaatgcccgcgatacgctgcgtgcgctgctggataaccatatcgttccggtcattaacgaaaacgacgctgttgccaccgctgaaatcaaagtgggcgacaacgataacctctctgcgctggcggcgatcctggcaggggccgataagctgctgcttctgaccgatcagcaggggctgtttaccgctgatccgcgctctaatccacaggctgaactgatcaaagacgttcacggcattgacgatgcgctgcgcgccatcgcgggtgacagcgtttctggtctggggacaggcggcatgggcaccaagctccaggccgcggacgtggcgtgccgggccggcatcgacaccatcatcgccgcaggcagccgtccgggcgtgataggtgatgtgatggaaggcatctctgtaggcactcgcttccacgcccaggcgtccccgctggaaaaccgcaaacgctggatctttggcgcgcccccggctggtgaattgaccgtggatgaaggcgcgaccgccgctattctggaaagaggaagctcgttacttccaaaaggaattaaaagcgtgacaggcaacttctcgcgtggtgaagtgatccgaatccgtaaccttgaaggtcgcgacatcgctcatggcgtaagtcgttataacagcgacgcgctgcgtcggattgctggtcaccattcccagcagatcgacgccatcctgggctatgaatatggcccggttgccgtgcatcgtgacgacatgattattcgttaa

SEQ ID NO: 463 - DNA, 1080 bp, Enterobacter cloacae
cgcgtttttataaaatcaggattgaaaatgaaaaagagcactctggcattagtggtaatgggcgtagtagcttccgcatctgttcaggcagcagaagtttataataaaaacgggaataaactggacgtgtacggcaaagtaaaagcaatgcactacattagagatgatgacgctaaggatggtgaccagacttatgttcgtttcggctttaagggtgaaacgcagattaacgatcagctgacgggctacggacgttgggaagctgagttcgcgggtaacaaagctgaaagcgactcttctcaaaaaacacgtctggcatttgccgggctgaaactgaaagacttcggctcactggattatggccgtaacctgggcgcgctgtatgacgtcgccgcatacaccgatatgttcccggagttcggcggtgacggcctggcacagaccgataacttcatgacgaaacgcgcctccggtctggccacataccgtaataccgatttctttggcctggttgacggcctgaatatgaccctgcaataccagggcaaaaatgaaaaccgcgacgtgaagaagcaaaacggtgacggcttcggtacctccctgagctatgacttcggcggcagcgatttttctgtgattggtgcgtatgccagctccgatcgcaccaacgagcaaaaccttcaggctcgcggcgaaggtaaaaaagcagaaggctgggcaaccggtttgaaatatgatgccaacgatatttatctggccactatttattccgaaacccgcaatatggcccctatttccggtggctttgcaaataaagcgcaaaacttcgaagtggtcgcgcaatatcaatttgactttggtctgcgtccatctctgggttacgtgcagtctaaaggcaaagatatcgaaggtatcggcgatgaagatatcgtgaaatacattgacgttggtgcgacatattatttcaacaaaaatatgtctgcctttgttgattataaaatcaaccagatcgatgacgataataaactgggcgtaagcagcgatgatatcgttgcgctgggcatgacctaccagttctga

SEQ ID NO: 464 - DNA, 732 bp, Enterobacter cloacae
cgaaagggatacccttttcataaggaaagtattgtgaaaaaagcattattatcagcgctggccgtgacaagcctgtttgcgctttttggctgtaataaccgttcggaaacgcaggtactacagccaacgcaaaatgaagaattaaagccgatgcagcaaagctggcgcggcgtattaccgtgtgcagattgcgagggcatcgaaacctctctgttcctgcaaaaagatggcacctgggtcatgaaccagcgttaccagggggcgaaagaaccgtcttcttttgcatcttacggaacatgggcgcgtacggctgagaagctggtattgacggataccacgggcgataaaaccttcttccgcgccaaaggcgaggggatggagatgctcgatcgcgaaggcaatccgattgaatcccagttcaattacacgttggccccggtgaaagcgaccctgccagccaccccaatggcgatgcgaggaatgtatttctacatggcggatgcggcgatcttcactgactgtgcaaccgggaagaaagtcagcgtggcgaacaatgcccagctggagcgagactatgccgttgcgcgcggcaacgacagtaagccagtgttgctgacggttgaagggcattttacgctggagccaaacccggatagcggcgagctggtaaaaacgctggtggcagataaagacgcgaagtttgctgcggggaaagactgcgaaagcaaataa

SEQ ID NO: 465 - DNA, 453 bp, Enterobacter cloacae
tctggaaattcatctcacggcctggcagcccgcatcatgattgtattgtcccgaaatgtcagcatccctgataacgagctggagatcaccgctatccgggcccagggcgcaggggggcagcacgttaacaaggcctcaacggctatccatttgcgctttgacattcgagcctccagcctgccagagtattataaagaaagcctgcttgccgccagccatcacctgatcaccagcgagggtgtgatagtgattaaagcgcaggagtatcgcagccaggagcttaaccgggaagcggcaactgcccggctggtcgcggtcatcaaagagctgacggctgtacaaaaaagtcgccgggcaacacgtccaacgcgggcatcgaaagaacgtcggttgtcatcgaaggcgcagaaatccaccgtaaaatcactgcgtggcaaagtccgtcacccataa

SEQ ID NO: 466 - DNA, 564 bp, Enterobacter cloacae
ttcgaaaggagttctctcatggcgctgaaagcgactatttataaagctgtggtcaatgtggcggatcttgaccgtaaccagtttctggatgcgtcattgacgctggcgcgtcacccttctgaaacccaggagcgcatgatgctgcgcctgctggcgtggattaagtatgccgacgagcgtctgcaatttacccgtggtttaagcgcggaagatgaaccggaagcctggctgcgcaacgatcatctgggtatcgatttatggattgagcttggcctgccggatgaacgccggatcaaaaaggcctgcacccagtctgctgaagtggcgttgtttgcctacaaccagcgcgcggcggatatctggtggcaacaaaataaaaataaatgtgcgcagttcaaaaatctcaccgtctggtatctggatgatgaacagctggcgcagttgagtgcgttcgccagccggacgatggcgctacaggcaacaattcaggacggtgccatctggctttccgattctcagaataatctggaaattcatctcacggcctggcagcccgcatcatga

SEQ ID NO: 467 - DNA, 183 bp, Enterobacter cloacae
agaccaacgaatcaggactctccacccaatattccgacagcccgcaagcgtatgcaaatcaacgcgtcgaaaatgaaagccaacgcggtgttgctgcacacctgtgaagtcaccagcggcacaccaggttgctatcgtcaggcggtatgtatcggttctgcgcttaacattacggcgaaatga

SEQ ID NO: 468 - DNA, 294 bp, Enterobacter cloacae
gcgttatccgctccccttataaagaaaagttcgccgtgccgcgtcagccgggtctggtcattcacggcggcggcgagcttcatcttgtcgcgccgtataaccaggccgatgcagtgcgcgggcttgaggcgttcagccatttatgggtggtctttgtgtttcaccagaccatggaaggcggctggcgtcccactgtgcgtcctcctcgtctgggcggaaatgccagaatgggggtctttgccacccgctcaacctttcgtcccaaccccatcggaatgtcgctggtcgagctga

SEQ ID NO: 469 - DNA, 1785 bp, Enterobacter cloacae
accactttttttgtgtcaggctggtgtttcagcctgttccaatcgtcgaaatggaaccgtaacaacatgcgtactagccaatatctgctctccactctgaaggagacacctgccgacgccgaggtgatcagccaccagctgatgctgcgcgccgggatgatccgcaagctggcctccgggttatacacctggctgccgaccggcgtgcgcgtcctgaaaaaagtcgaaaacatcgtgcgtgaagagatgaacaacgccggtgctatcgaggtgttaatgccggtcgttcagccctctgaactgtggcaggagagcggtcgctgggagcagtacggtcctgaactgctgcgtattgccgatcgtggcgatcgtccattcgtcctcggcccaacgcatgaagaagtgatcaccgatctgatccgtaacgagctgagctcttacaaacagctgccgctgaacttcttccagatccagaccaagttccgtgacgaagtgcgtccacgctttggcgtcatgcgttctcgcgagttcctgatgaaagatgcttactctttccatacttctcaggaatcgctgcaagagacctacgacaaaatgtacgcggcctacagtaaaatcttctcccgcatggggctggatttccgtgctgtacaggctgataccggttcaatcggcggtagcgcctcccatgaattccaggttctggcgcagagcggcgaagacgatgtgatcttctctgactcctctgattacgccgcgaacatcgaatttgcagaagcgctggcaccaaaagaaccacgcggcgcggcaacgcaagagatgacgctggttgatacgccaaacgcgaaaaccatcgccgagctggttgagcagtttactctgccgatcgaaaaaaccgtgaaaaccctgctggtgaaatcggctgaaggtagcgcttatccactggttgccctgctggtacgaggcgatcacgagctgaacgaagtgaaagccgagaagctgccgcaggttgccagcccgctgaccttcgcaacggaagcggagatccgcgccgtggtgaatgcaggtcctggttctctgggcccggtgaacatgcctgttccggtggtcattgaccgcaccgttgcggcgatgagcgacttcgctgcgggcgcaaacatcgacggtaaacactacttcggcatcaactgggatcgggacgtggcgacgccggaagtggctgacatccgtaacgtggtcgcaggcgatccaagcccggacggcaagggtaccctgatgatcaaacgcggtatcgaagtaggccacatcttccagctgggcgataagtactcacgcgcaatgaacgctgccgttcagggcgaagatggtcgtaaccaggttctgaccatgggctgctacggcattggcgtaacgcgcgttgttgctgccgctatcgagcagaactatgacgaacgcggaatcgtctggccggataacatcgcgccgttccaggtagcgatcctgccaatgaacatgcacaagtcttaccgcgtgcaggagctggctgagaaactctacgctgagctgagcgcgaaaggtatcgacgtgctgatggatgaccgtaaagagcgtcctggcgtgatgtttgctgacatggaactgatcggtattccacacaccatcgtcattggcgaccgtaacctcgacagcgacgagattgaatacaaataccgtcgcaacggcgaaaaacagatgatcaagacgggagatattcttgattacctggtgaaagccatcaaaggttaa

SEQ ID NO: 470 - DNA, 225 bp, Enterobacter cloacae
gtcagtacgctggcaggaggtgatgtgaataattattgtgagttgattcgcagacggtatgcggagatcgccagcggagatctggggtacattccggatgcgttgggctgtgtattgaacgtgctaaatgaagtggcctctgatgagagcctttctgaatcggtcagcgggaccgcaggttttcaacacgccgcgccagatcatacagtactctcccccgggggg

SEQ ID NO: 471 - DNA, 720 bp, Enterobacter cloacae
cattacggcgaaatgagttcatttcagttcgagcatataggcgttatccgctccccttataaagaaaagttcgccgtgccgcgtcagccgggtctggtcattcacggcggcggcgagcttcatcttgtcgcgccgtataaccaggccgatgcagtgcgcgggcttgaggcgttcagccatttatgggtggtctttgtgtttcaccagaccatggaaggcggctggcgtcccactgtgcgtcctcctcgtctgggcggaaatgccagaatgggggtctttgccacccgctcaacctttcgtcccaaccccatcggaatgtcgctggtcgagctgaaaggcatacgttgtcagagagatcaggtgatcctggagttaggtagccttgacctggttgatggcacaccggtcatagatattaagccttacctgcccttcgccgaagcgctgccggatgcccgggcaagctatgctcaggacgcaccgcaggcagatatgccggttcacttcacgtctgaaataacgacgcaaatcagcgagctggaaaagcgttatccacgtctgcgtgactttatcgttgaagtgctggcgcaggacccccgtcccgcctaccgcaaagaagaggaagccgggaaaacgtacgccgtctggctgctggactttaacgtgcgctggcgcgtgactgcggcgggttttgaagtgtttgccctggaacccaggtaa

SEQ ID NO: 472 - DNA, 441 bp, Enterobacter cloacae
gagaggaactgggggatgaagtctaagattagatatgttttatctggttttgttgtgttatgtgcatttgctggagtttataaaatcctaaacaatgttccggttaaacctgaccttttggacttcactggaaacacatttaaaaagacatcactcttcctgccatgtgataaaagctcgccttctttaaacattaaaattgctgataacgagaaaatcgtgatcaacggcatcgcttcaaaagtaacttttgttgaaaaggctgaccccgtcaaaagccctggtttttgtgatgatcttgatctaaacaattctcgccttgtacatacggcatcttacagcctggtgatttctgaaaccaaaacaggatttacactatcaaatttcaagcatcttgccgatgatgaatcattaggcggtatgtggttttatcaaaagtga

SEQ ID NO: 473 - DNA, 3678 bp, Enterobacter cloacae
ttttgctcagaaaaacaggtattcgtcatgagaaaatcaggtttaggtttagccctgttgttttctttaattgctccgattaaagcggtctatgctgaagcgattatgatttcaggaaagctacaggctgatttgccagccgtatcctttgacccggggccgggcgactttgttgcatacgttaattctaacactatcactgcctcaggtgcaggcacagcctgtaatgtaacggttgatgatcgagcgacttcctctgttgataacctcgtttgtttttttgagtggttacccaataccttgggattaacttctaacggcttcattctttcaggcgttccctacaccaccggtgatttaaaactaccttacaagatttcttacttctctggttctgaacggaaaaaagttgaaatagtaaaaggtgaatattcaatcaaaagtgtggcaccggtaaaaccaactatcaccggtcttaaatcatccctgaacggattagtctatgacggcttttctttcaaatcgtatttaaaggatgaagcgatcaaagatatcgctgtttctgttgaaccccgcaattatattcaatacatctcaataggttcaggctccgcctgtgaagtacctattggcggaacttcctgtaccattgaagttggaagcattaaggccagtgatacagatgaacttttgggttcacgtgatatcacaattacagcaaactctaagaataattatttcgcacctcctgaatccaaaaagcttgttgttaactgggattatcggcctcctgtagtagaccatacactttggaattttaccgatgaggctaaaacaatcaaagtaggtggccaggacatctataccggagccaaaaccgttgctgtggccgttaaggtaccccagcaagaaacagaaggtgaatggtggctcccaacagctatgtcgctcactatgactccggatggcgtgtttaagccgacgactaaagtgactttagatgatggcactgagattgatttcaaacagtcctgggcaacccctttacgtagaactttacagccggtaagtggacctcaaaaagtcggtgatgagtacctctatatctttgacttaacggatcttataaacgggtcctacgcagcgacttttacagtagaaaatacgagcaaaaactcttctacgtacactgagcctgaaagcaaactgatgctgtctgataacccaacgcttatggttctcaaagatgggcaggtattaactaaacgagcacccgtatacttcctgaacgagattatcgttgcagctttccaggggcaggctggggttgctgacataaaatcagtaacaatagacaacaaagtagtttcgttaacacctacaaattataaaggtatttactacctgccggttggagacgatttagcagttaattcggatcacgagattactgtggtggctgaaaacctttatggaaaaaacgtaaatttcagtaccgtgttcacttatcaacctactggattcactcttaagaatctggaaaaaaacgtaactctttactcgcgcgtacgtcagtatacggacctgcttagtcaaacagctggtgataaatgcactctgtttaccacagaggaaaatgcgaatgcttacctcgcctggtatggggaaaaatcagatgttacagcatgctaccctcagtggaacaatgtccctgatgggttggagttctattttaaaggacgtaccccgggtctaactggattctttaataaaacaggtgagaatctgctcgactatcaagtctatatgattaacgggaagggctctaaagcggtttccgcaaggaatcgccgtactctgaccacacaattaccatacaacccgatcatctcttacaaaaagaataaagtcatagcaggcatcaatccgaacactgctctggcttatacgaccgggggggaggccgctcgaatattagcgaaggtggtaccagctgacgttacgatgatcgtctctcaaaacggctctgaggctgtcaaaacgtcatttaaaaatcgttcctcaaacaacgatgcaacgacctttgtacaaagggtcaaggttgctgctgcaccattgtggacaaagaacgtctttgacatagctgtagaatactcaaaggatccagaattaagaactacagacaccctcaacgtatatacggtgcctgatttcaatattcgagcatcgatggaagtggatgacaaaaaaacagccacatctcttgaagtgcccttaaaggtaacagtggggcgttataacaactccacacgtaaaagtgcatttgaccgtaaaacaatgggagaatgggacgtcacgatatactctcaaaaaagtgtatacggcaaagatccagaaacaggccgttataaaactacatacgaaagaactgcgctgactgaagcattgccggtcaatgatgcgggcattgtcgaaaccaagattaaaattgaaaatatggatctgggtaatatgcgtctggttggtgtggctaaggtcagatcgccattctctgattttgaaatgaaacgtgagaccagtgctgtaggcattcgaatctataaaggtgaggaactggagggtaacctgtcgaaaagccttattatcggaaggatcccacttagtactctggtaagcttcaaatctgccagtacggctaactctgatgcactcgcccccaccgaatggcagcagtcctctgataatggtcaaacctggaccatgctttccgacatgaccggaaagagaagtgtaagtatcaaaaagacagaagtaggaaagtggctttatagggcaaaaatgactaataaattcacatccaagatttcctacacagatgccttaacggtagttacctacaagcagcctaagctcagtatagatgttacagacattcttcagggctcagatatacctgtaaccctgcttgataacgatgaacctataccagcaggcaccgctgaggttctctggtcagaggataaagtcaactgggtgcagggagatacaacttacactgtggcttcagctgataccctaccgtctacgatttatgcccggatgcgttaccttgattccgatgaactggcagaggagtcttcatggaaggaaacgtctgctcggttggcagccgcaaaacccaagcgcctttctgtctcggtaacgggggtttcaaaggtagaggttggtcaaaaagttactttggaaggtaagttcacgaaccctaacagtaagtaccagaatggtaataacgtagttgaagaatggaaaacaccggatggccagacatttaagggctcttcactgtctgttacccttactgagcaaatgttggataaacagggatatgctgcttttgaatacagtgcatggttagcggacaataaggagaatacggtttctacccgtagagtttctgtcaaatcgtgggtttataaatttcccgagatgaaaataagctccaaacttaaatacgacatggcaccgaccaccctacgcgttgcgttgagcggtattaaggatggagactatcctggtgttacttattcccgtgaatggatctacgacaaagagaatctggtaatcactacagatgtcttcaccacggagctggccgggcccgcacccaaagggatgggg

SEQ ID NO: 474 - DNA, 480 bp, Enterobacter cloacae
ttgattattataataaaggctgatcgaatgctatctcgcaactcactaatacatggtttacgccgagaccagttaatcggagttctgactatttcagagtttccggtagttatggtagaaagccacttcattcagtctgaggttatgggaataaaacccgtaatttttaatattgatgagcttcttgtttctatatccccaatttcctctcttaagttcgattgggagtgggccccagttgatacaatactcattgaagttatcattccacctgtagagtcagaccttgtaagtgcagaaaatgacttcctccgtgattctggtattggccatatccagtgcgagcctggcggagcatcaatacgacgtacagttaccttcgttggtggaataaccgctgataacttactgtatcagttgaggcttatgtgcgtaagcgcgttaaaacttttaggagaggaactgggggatgaagtctaa

SEQ ID NO: 475 - DNA, 597 bp, Enterobacter cloacae
atcattaggcggtatgtggttttatcaaaagtgactttttatatggcaacttcagacttcgctcttaaaaaccataatgttaaagcatttggtcaggatgcagcccttgtcattgagatgaacaatgaagatgttagctcatcaaaaccttcacctttttcaaatgagattgataattattatcttacattgcacgtcgctccaaggaacgcaaaaaaagattatgactggggctcaaaccgttctgtacttctaaaattgtcgacgaatgaagttatgcagatggcatctgtatttcttagaatcatgcatactttaaagattgataagaggaaaacctcacatcatggccacgtcgtatacaaaaatataagcgttaccccaaacgagaggggcggtttgttgttatccgcagggatagttccagtcgataaagatggcttaaaacccttcatgcacatggtccccgtctcacaaatggattgcgttaaaattggcctctacatacttggatatcttgctcaaaaaacgccctgggtaagctccgagtctataattaccgcgcttcgcttatctgaagccaagaattcaaaatag

SEQ ID NO: 476 - DNA, 519 bp, Enterobacter cloacae
cagttcaagttacttaacccattaaaaggagtttttatggcaattccagcatacctctggctgaaagacgatggtggcgcagacatcaaaggcgctgtagatgtgcaagatcgtgagggaagtattgaagttctggggttcggtcacggtctgcatctaccgaccgataacatgaccgggaagatcaccggcacgcgcgttcacagcgcacttgtttttgaaaaggagttcgacagctcaagtccgtatttatacaaggccgtcgcgaaaggccagacgctgaaaagcgctgagtttaaatggtacaaaattaacgacgccggtcaggaggccgagtacttcaacatgaagctggagaacgtcaaagtcgtctcgatttgcccgatgatgcacgatgtgaaaaacccggcgaccgagaagcataaccaccttgagagcgttgcgctgcggtacgagaagatcacctggaaacactgcgacggcaatatcatcttttctgacgagtggaaagaccgatga

SEQ ID NO: 477 - DNA, 1284 bp, Enterobacter cloacae
atctgcgagctgaatatgtttgctctctgtgatgtgaattcgttctacgcatcatgcgagacggtgtttcgtcccgatttgagggggcggccggtggttgttctatcgaataacgatggctgtgtaattgcacgcagcgcggaggccaaagctgctggaattactatgggagagccgttcttcaagcaaaaggagcttttccggcgcgctggcgttgtttgcttcagcagtaactacgagctttatgcggacatgtcgaaccgggtaatgaccacgctggaggaaatgagccctcgcgtcgaaatttacagtatcgatgaagctttttgtgatcttactggagtgcgaaactgcagggacctgaccgagttcggcaaagagatccgcgctacggttctgaagcgtacgcacctcaccgttggagttggcattgcccagacaaaaacactcgctaaactcgccaaccacgccgcaaagaaatggcagcggcagacgggcggggtagttgacctgtcaaatatcgatcggcagcgcagattgttggctctggtaccagtagaagacgtatggggcgtcggaaggcgtatcagcaagaagctcaatgctatgggcatcaaaacggctctggacctctccgagcaaagcacctggattatccgtaaacacttcaatgttgtactcgagcgaaccgtccgagaactgcgcggcgagccatgtcttgaactggaagagttcgcgccggcaaagcaggaaatcgtctgcagtcggtcgtttggcgaacgcgtcaccgagtacgaacagatgcgccaggctatttgtagttatgcggcgcgtggtgcagaaaagctacgcggtgagcatcagtattgccgttttatctctgcattcgtgaaaacctctccctttgcccttaacgaggtatattacggtaacagtgcgtccatgaagcttctcacccccactcaggattcccgcgacattatcaacgccgcggtaaagtgcttggataaaatctggaaggatggtcaccggtaccagaaggcaggaatcatgcttggggattttttcagccagggtgtagcccagctcaatctattcgacgagaatgcgccacgggccggtagcgaaaggttgatggaagtgctcgatcacctgaacgcaaaagatggaaaaggaacgctctactttgcagggcagggcgttcagcagcaatggcagatgaagagagaaatgctttcaccgcgatatacaacacggatatcagatattcttaaagttagataa

SEQ ID NO: 478 - DNA, 474 bp, Enterobacter cloacae
tcactgagtcagttaaaactactgtatataaaaacagtgtttgaggtatgcaacatggaatttatcaggcctgcagaactgcgagaaattatcgctctcccgcttttcagtgacttagttcagtgtggtttcccgagccccgcggctgattacgttgaagagcgcatcgatctcaatgagttacttgttgctcaccctagctcaacatacttcgtcaaagcagcgggtgattcaatgatcgaggccgggatcagcgacggtgatttgctggtggtggacagttcgcgcacggctgagcacggtgacattgtcatcgcagcagtagaaggggaatttactgttaaacgcctgcagctgcgcccgaaggtgcaactcaatccaatgaacagcgcctacagtccgattgttgttggcagcgaagacacgctggacgttttcggcgtcgtgactttcatcgttaaatctgcgagctga

SEQ ID NO: 479 - DNA, 948 bp, Enterobacter cloacae
cgtaaggaattttgtatgaacgtaaaaccatcacttgatgaattgtttgagcggcgtattaacttccctgattttgagcctcaggagcgtctggctcgtttagttggtcttgatgaacacaaagatcgattatcaaaaatattaggcttgcttgtaaatccttatgggattcaggaatgggccaaaaaatatcatccagatgctcgtgcggctgttgatacagtactcagacggccacctttagttgtattggctggggacgtgggctcaggtaaaacagaactggcggaaaccattggtgatgctgttgcccggcaggaagatattgatattacgttgtatcctttgagccttgctactcgagggcagggtagagttggcgaaatgactcagctggtttcagctgcatttgattacaccattgaggccgcagataaattaaaaaacacgaatggaaaagctcgtggtgcggttttgctgttgattgatgaagctgatgcattggctcaatcccgggaaaatgctcagatgcaccatgaggatcgtgctggtgtaaacgcttttattcgcggaatagaccggatcgccaatcagaaactaccagcggcagttcttatgtgtactaaccggctgaaagctctcgatccggccgtccagcgtcgtgctgctgaagttttaactttttccaggccaaatgatgaacaacgacactatttattgcattcaaaacttacggggttgggattaaattctacggcgatagaagaattagtcaggttaaccggtccaagggacacgaattcgccgggatttactttctcagatattacccagcggctaataccatcaataattcttacggcctacccatatagcgcagtgtcagtccattcagcactgcaggtagtcaataaaatgacaccaacacctgcatttattgaccgctaa

SEQ ID NO: 480 - DNA, 522 bp, Enterobacter cloacae
aatagcaatctattgaacaacagaacgatttgtcctcaggtaaggatgcatatgtcaggttttcaggaatggttactgagtaaggcaacgggcaattatttcctgtacatcaaacgcttgtcagcaaatgatactggtgcaacaggcggtcatcaggtcggactgtatattccttcaggtattgttgcagagctgtttccctcgatagataacactaaggaacaaaacccctcggttttcctcaatgcaacctattcctcgcatgtttgcagtgatagtgaagctcgcgcgatttattataacggcagctttttcggtaaaacccgaaatgaaaagcgtataacgcgctgggggccagggagtccgcttcaggatcctgaaaacacaggtggattgtccattctggcctttgagcacgagcccggaagtgacagtaagaacgttgatgtgtgggtttgcaaaaatcctgacgaagaggacattgtcgaatccattcttggcgaaattatccctggcgcgctg

SEQ ID NO: 481 - DNA, 243 bp, Enterobacter cloacae
ccgaaatccttgctcatccaacttggccctaatcctggtactttccggcgggttttgaacaataaaaaattccaccttcccttcccgaaccaaaaacccaatgaatttgggtccttgaacaccccccaacttccgaatggctccttccccggcgttcccggggcgaacacccctgctggtgtgctctccattcctctgcttctgccgacgggcgacatcttcccggcgcgctacgaactggtg

SEQ ID NO: 482 - DNA, 315 bp, Enterobacter cloacae
actatgatctgcgccgcttgtagaaaaccggcggtaggtgcggggatgaccatcacccgctccggcgtgatgcgccgcgcaccgctggcgatgcgcctgcgtgcaaacagtacctgggcgatgctcgagtttgtctttaacggcatggtgttcctgctgttgggcctgcaactgcccgggcaattatggaaatcctccgctgaattgccggcccaaagccgattccaaaaccttggaaattctggaattccaattaaccgaaatccttgctcatccaacttggccctaatcctggtactttccggcgggttttga

SEQ ID NO: 483 - DNA, 294 bp, Enterobacter cloacae; identical to SEQ ID NO: 235

SEQ ID NO: 484 - DNA, 2109 bp, Enterobacter cloacae
cctgaaagaggctgggaacctataatgtcagattcgaagaggactaacctccatgcacaagagaatttttatcggcctattcttgagtatcgtagtgcctcaatacttttgatttgttcggtttctatgctttatatgggactttcttcagacggactggacatcgccccaatagttctgttcacctcaatattgctttttttgctgtgcctttatcgttgcaaaacagcagcgccatttttgatggctcattggcgtgtattcaagcgacatttcatgttcgttagtcttgattcactgcgtgtaattaacaaaagtaactttttctccaatgagcgaaagtatcgtcaactggttcaggattatcaaaataaaaataaggatatacccgagcgaaagtcctatttttgtgatgggtttgagtggggtccggaacatgcggatcgggcatatcaaatagctaacctctccagtgataaacgtgagatcgagttgccattcgtcttcaacccaattaagagacattttgacgcaatggctcgtaagatgggcggcagcaatgcaatttttgctgtggaacgtagggaacccatatttgtaactgaagacaattggtttggtcatactctgataaccggaaacgtgggtaccgggaaaacggtgctacagcgtttactaagcattagcatgcttcatcttggtcatgttgttgttgtcatagatccaaagaacgatgcagagtggcgagaatctctaatggaagaggctaagaccctcggtcttcctttctataaatttcatcctggccagccagcatcttcggtctgtattgatgtctgcaacacctatactaatgtttctgacctaacatctcgtcttttgagcttggtgacagttcccggtgaggttaacccattcgttcagtatgccaaggctctcgtttccaatgtgatttccgggctttcttacatagagaaaaagccttctatttatctgattcacaagaacatgaaaagccacatgtctattgtgaatcttacagtcaaggtaatggagtcatgttacgcgagatattatggttacgatgtctggaccgaaaaagttaagtacgtcgctaacgataccttgccggtacgtttcaagcgtctcgctgaatggtttacggctcatttcatgaattacgaggggtccgaacaaatagactggttagatactgtttcccagcttattgattactcaatgtccgacccagagcatatggctaaaatgaccgcaggtattatgcctgttttcgatatgctcattgaaaaacctttaaatgagcttttatctcctaacccgaactcagtatcatcaagagaaattgtaacaagcgaagggatgttcagcactggcggggtgctatacatttcgcttgatggcctttcaaaccccgatacagcagctgctatttctcaattaataatgtcagatctgacctcctgtgccggtagtcgctacaacgctcaagatggtgatatgtcagctaattccaggataagtatttttgttgatgaggcacactcagccattaacaaccctatgattaaccttctggcgcagggtcgtgcagcgaaaattgcactgtttatttgcacccaaaccatctccgactttattgctgcggcaagtgttgaaactgccaatcgaattacggggctctgcaacaattatataagcttgcgagtcaacgatactcctactcagacgcttgttgtagagaactttggtaagagtgcgataagcacaaatatggtcacttatacgaccggttcagaaacatctttgccgcataataacttctcaggttcaatctcagaaagaaagcagacaactttagaagagagtattccaaaggatctcttgggtcaggtccctatgtttcacatagttgccaggcttcaagatggcaggaaggttgtaggccaaatccctattgctgttgctgagaaacaaatgaagccaaacacaactctgtcggaaatgcttttcaagaaagccggaaaagttactttgcgtcaaaatctcgatatcaaaaatcttaataaatttctaaggaagttgcattga

SEQ ID NO: 485 - DNA, 2613 bp, Enterobacter cloacae
agaccatcaacatcacggcttcccgcttctggtctgtcgtcagtactttcgcccaagagccacctgaagcgcctctttatccagcatggcttcggcaagcagcttcttgagtctggcgttctcttcctcaagcgacttcaggcgcttaacttcaggcacctccataccgccatacttcttacgccagatgtaaaacgtggcatcggaaatggcatgcttgcggcagagttcacgggcgggtaccccagcttcggcttcgcggagaatactgatgatctgttcgtcggaaaaacgcttcttcatggggatgtcctcatgtggcttatgaagacattactaacatcggggtgtactaatcaacggggagcaggtcaacgtgaccctatcatgggtctgcgttctaatgatgcagcagcaagggccattagtaccatcaagcacaactttaccagtatcaatatcaacaattacaatgctaagcctatgcacatcattatcgtaaatggtgaggtataccttaacgagaacgcattccttgattttgttctcaatgatttcgaattacataaatataacttccctcagggagaggctggtaagaccgtattggtagaatccctagttcaacgtggttacgtcgagccctatgatgatgagcgtgtcgttcactacttcattccgggtatctattcggaaaacgaaatatcaaacatctttagaaatgggatagggaaactagaattctataaccttcttaagctaaggtggattggtttaatctttgattcctataaaatccctgactcagtgccgggtctttttagcgttaatgccaataaagactttatttacattgacgagcaaaaaacagttactgaatacagaagaccagtgcccggtcgggacgttataactaaaattactgatactgttgagacggctgttcttaaggttaatgatttaggccgctcctctgcctctattgatgttgatatacattctaagaaaaatgaaggctcatccgacgattttgagaagaaagccgaaagtgataatgaaattgataatgacacgcagatagttaaatctgagggtgaggaagcagctgatcctgtcattcctgatatagaagaaagtgaagatgaatcggcaaaggacacggaatcccatgtcctggtcaaccaacttcatgaactccttttaagcgctccactttccaatgactatatagtgtgtgttgatgctgtcccctacctcaacatagataccactatggcattgctgccgggattagatgaaaaagcattcagtgaagagccctatttccaactgacattcagagaaggctctctcgatggaatgtggatagtaagggacattgacgatctgcgtttagtccagctcggcgataactgcgccgggttccagctcacctatcatgagccaagaaggccaacaactttaaagtcacttttcaatacttctatgtatcaggcattagtgattaatgatgagtcttctgttgaaaactctgccccacgtccaaagcaaacgcttgagctgcctcccccacgtgtaaatgcagtcgaagaacattctggcgacgtggaatatcatggaaccgatagtgcatccgcgactggtccgctgaaaactgaggctgtggaatatgaacattatcaacatctttttgagaaagaagatgaagagcatgagatcattgattataccgatttctcacagcttagtgtttctcggccagaagtcggtagttgtgcaacaagctcttcggtccataatgaaaagcttctctccgagccgtcagaattaccagaacttaaccgagaacagaacgctgatccccagggtacgaatgaacgctctatggatgtttctgtaggacaagaaaactcagaaccagatactgagggtaactgcccaccaccagctgaagttgtgtattcccagaccgaagcagccgcaaccagtgtgatggcaagtgaagagcccgccttacctcctgtacttgaagaatcaaatggagagcatgcgcccacagacgctaaggggcatcatctttcgccagcactggccagactgttcgccccaacagcaccggtagaaaaacaaaatcccaagcgcaaccggaataaatcatcggacaaagcagaagtacaaaaaccagcatcacctgtttctggtcacaatctgaacagtaaagtctttgcatctactgaatcagaccaaaatggtgaattctcgcttataagcgaaggtgacgttacagagcttgaatttgtagaaattgcgttagtactgcatcaaattctgtccaaaatggaggtggcgtttaaaagaaagcgcaaaaacagatttatggtaagtactcctaatactctctatctgacccaatcttgcgtggaaaaatttgggtcgcagttagaggctcaagatcttttcaataagcttcctcagtacctcgttaattctggtgctgtgatcaatacaaaatgccatgcatttaacatgcctactttgctggccgcatcagaccgggcgaaagtggacattgaacgaattatcaataacctgaaagaggctgggaacctataa

SEQ ID NO: 486 - DNA, 768 bp, Enterobacter cloacae
tccagctctcaacattatgaatcattcatcagcacaggatcgacaatgattgaaattgaaactcgccagctgagtgagcatgaaatcatccatgcttttccggctggtaaaggtgaacagccgctgccgacggtagttttctatcatggctttctctcctcgaagctggtctacagctattttgccgtcgcgctggcgcaggccggtttccgggtggtcatgcctgatgcgccgaatcatggggcacgctttacgggcgatgagcaggcgcggctggggctgttctggcaaacgctgcacggcaatctgaccgagttcgccgggctgcgtgacgcgctcttgcaggccgggctggtggaggggaaacggctggcggtcgcaggcgcatcaatgggcggaatgacggcgctggggatcatggccaggcatccggaggtgacgtccgtggcttgcctgatgggatcgggctactttacgtcgctggcaaagacgctgttcccgccgcaggcccctcaggagattgagaccctgttgtctgaatgggacgtcagccatgcgctttcgcagctggccgatcgtccgctgctgctgtggcatggggatgccgacgacgtcgtaccgaccggtgaaactttccgcctgcaacaggcgctacagcgcgaagggctggacagcaatctgacctgcctgtggggagcgggtgtccggcaccgtattaccccggaggcgctggaagccaccgtggcgtttttccgccagcacctttaa

SEQ ID NO: 487 - DNA, 759 bp, Enterobacter cloacae
ctcatgacggaagcgcaacggcatcaaattttactggaactcctggcgcaaacagggtttatcaccgtcgagaaagtgatcgaacgtttagggatctcccccgctaccgcgcgacgggatatcaacaagctggatgagagcggcaagctgaaaaaagtccgcaatggcgcagaggccatcagccagcagcgtccacgctggacgccgatgaacatccaccaggcgcagaatcacgatgaaaaggtgcggattgccagagcggcgtcacagctggtgaatcccggggagagcgtggtgatcaactgcggttcgacggcgtttctgctgggccgtgaaatgtgcggcaagccggtgcaaatcattaccaactatctgccgctggccaattatctcattgaccaggaacatgaaagcgtggtgatcatgggcggccagtataacaagagccagtccatcaccctgagcccgcaggacagtgaaaacagcctctacgccgggcactggatgtttaccagcggcaaaggcctgacggcggatggactgtataaaaccgatatgctcaccgcaatggcagagcagaacatgcttaacgtggtgggcaagctggtggtgctggtcgacagcagcaaggtcggtgaacgcgccggcatgcttttcagccgcgccgagcaaatcagcatggtgatcaccggcaaaaacgccaaccccgagatcctcagcaagctggaggatcagggtgtcacggtgctgcgcgtttaa

SEQ ID NO: 488 - DNA, 231 bp, Enterobacter cloacae
cccgatcccatcaggcaagccacggacgtcacctccggatgcctggccatgatccccagcgccgtcattccgcccattgatgcgcctgcgaccgccagccgtttcccctccaccagcccggcctgcaagagcgcgtcacgcagcccggcgaactcggtcagattgccgtgcagcgtttgccagaacagccccagccgcgcctgctcatcgcccgtaaagcgtgccccatga

SEQ ID NO: 489 - DNA, 447 bp, Enterobacter cloacae
atgattcataatgttgagagctggattacggtttcacgatattttcattcgaaatctacgtcccagataacacttcgggaacattcccccaaaactaaattcgcagacaactacactatgactatcaggaaaagagacaggtttatgcgcaggcttaccgctttattgctggtctcgctgctcagcggatgttccgtattgcagggtacgccagaaccggcgccgccggttaccgatcatcctcaggaaattcgtcgtaatcagacggaaggattacaacgcctgggtaccgtatccgcgatggttcgtggttccccggatgatgcagaagacgcaattgaagcgcaggccgttgccgcaaaagcagattattacgtcatcacgatgattgatgaaaccattattacgggacagtggtacgcccagggcattttgtaccgtaagtaa

SEQ ID NO: 490 - DNA, 333 bp, Enterobacter cloacae
gtttattcgcgaaggattgcccggcggataccggagacacgtgaaaaggagctgacgatgaaacgaacccttgctttaacgacgctattgctttcagcgggcctgctgagcaccacggcgcagtcggccgaatttgccagcgcggattgcgtcacgggcctgaacgagattggtcagatctccgtcaataatatcacggggagtccgcaagacgttgaacgtgtcgtcgctctgaaggccgatgaacagggcgcatcctggtatcgcatcgtccagatgcaggaagatcaccatgttaatcactggcgcgtgcaggccattctttatgcctaa

SEQ ID NO: 491 - DNA, 1182 bp, Enterobacter cloacae
  unsure (1096)
  unsure (1146)
  unsure (1176)
gagggtggggcaatggaacaaacctggcgttggtacgggccgaacgatccggtttctcttgatgatgtgcgtcaggctggcgcaacgggtgtggtcacggcgctgcatcatattccgaacggtcaggtgtggccggtggaggaaatccaaaagcgtcaggctcagctggcagagaaggggttaacctggtctgttgtggaaagtattccggttcacgaagatatcaaaacccactccggtgagtgtgatacctggattgcgaattatcagcagagcattcgtaacctggcagcctgcggtattgataccgtctgctacaactttatgccgattctggactggacgcgtaccgacctggaatatgtaatggccgatggttcgaaggcgctgcgtttcgatcaaatcgcttttgcggctttcgagctgcacattctgaagcgtccgggtgcggaagcagactacaccgccgaagagcagcagcaggcgctggcgtggtttaatgccgccagtgaagcggacattgagaagctggttcgcaatatcatcgcgggcctgccgggggcggaagagggctataccctcgatcagttccgcgcgcgcctggcggaatatggcgatatcgataaaaaccagctgcgtgaaaacatggcgcacttcctgcgcgctatcgtgccggtggcagaagaagtcggcgtgcggctggcggttcatccggacgatccaccgcgtcctatcctcggcctgccgcgtattgtgtctacgattgaagatatgcagtggctaaaagagacggtggatagcatctacaacggctttaccatgtgtacgggctcgtatggggtgcgggcggataacgatctggtgcggatgatcgaaaccttcggcgatcgcattcatttcacccacctgcgtgcaacctgccgtgaagagaatccaaaaaccttccacgaagcagcccatcttggcggcgacgtgaacatggttgcggtggtggatgccattctctctgaaaaagttcgtcgtaagcaggcgggagatgttcgtcctatcccgttccgtccggatcacgggcaccaaatgctggacgatctgcgcnagaaaacaaatccagggtattcggcgattggccgtctgaaaaggatggcngaattgcccggtatccagcttgcgctgaanatgacg

SEQ ID NO: 492 - DNA, 1482 bp, Enterobacter cloacae
tcaggtgtgtactacatgaagactattgcctccaccgcgcttcctgctcatgtccagcagccccgctacgatcgcgagcagttacgctcccgcatcgtccatttcggttttggcgcgttccaccgggcgcatcaggcgttgttaacaaaccgggtactaaatgccagaggaggcgactggggaatttgtgagattagcctctttagcggcgatgtccttatgcgccagctccgggcgcaggatcatctgtttaccgttctggagaaaggtgccgaaggcaatcagcccattattatcggtgcagtaaaagagtgcctgaacgccaaactcgactcgctggcagccattattgagaagttctgcgaaccacaggtggcaattgtctccctcaccattaccgaaaaaggctactgcatcgatccggcgacgggaaaactggatatgcagaacagccgcatcctgcacgatctcgagcatccgtctgaaccacattccgcaccgggtattctggtcgaagcgcttcatcgccgccgcgagcgtggcctgccggcgtttaccgtgctctcctgcgacaatattcccgacaacggccacgtggtgaaaaatgccgttctcggcatggccggaaagcgttccgcagagctggccgcatggatcgaggcgcacgtgagcttccctggcaccatggtcgaccgaatcgtgcccgccgccaccgacgcctcactcgcggaaatcacccaggaacttggcgttgaagatccctgcgccatcagctgtgaaccgttcattcagtgggtagtggaagataactttgtcgccggacgtccggagtgggaggttgcaggcgtacagatggttgaggatgtcctgccctgggagcagatgaagcttcggatgctgaacggcagccactccttcctcgcgtatctgggctaccttgctggctacgcgcacataaatgaatgtatgcaggacgacagtttccgcgaggctgcccgcaggctgatgctgaatgagcaggcccctacgctgcgcatcaccaacgttgatctgacagcctatgctgacagcctgcttaaccgcttcgccaacccggcccttcagcatcgtacatggcaaatcgccatggacggcagccagaaactgcctcagcgcatgctggatgggatccgcgtgcatcttgagcttaacaccgcctggccattactggcgctgggggtggcgggctggatgcgctacgtcagcgggacggacgaacagggcaacgccattgacgtccgcgatccgctgagcgacaagttccaggccattgtcgccaccagcagcgacgcagaacgcgttagcgccctgctgacgttaaatgaaatctttggcgacgacctgccgcaaaaccctgtctttgtcgaggcaattaccggcgcgtaccagcgcctcgtccggctcggcgcgcaccaggccgttatcgaaacgttaaaaatttag

SEQ ID NO: 493 - DNA, 1026 bp, Enterobacter cloacae
  unsure (322)
gtagttgttactacatcacaattatttatcggagcgcacgtgaccaaaaccaacctgatcaccggttttctcggcagcggtaaaactacgtccattctgcatttgctggccaataaagatccggcggaaaagtgggccgtgctggtcaacgaatttggggaagtcggcatcgacggcgcgttgctcgccgacagcggcgcgatggtgaaagagatcccgggcgggtgtatgtgctgcgtgaatggtctgccgatgcaggtcgggctgaatacgctgctgcgtcagggcaagccggaccggttgccgattgagcctaccgggntgggtcatcctaagcaaatccttgatttactgaccgccccggtatacgagccgtggcttgagctgcgtgcgacgctttgcctgttagacccccgccagctgctggatgaaaaaacgatcaacaacgacaatttccgcgaccagctcgcctcggcagatattatcgtggcgaataaatccgatcgcgcgacggctgagagtcaggccgcgttcgagtcctggtggcagcaggctggcggtggacgtcagtacgtgcagaccacccagggcaacattgatggcgccctgctcgatcttccccgcctcaaccagacgcaactgcctgccagcgcagagcattcgcatagccacggcacgaagcaaggcctggctgcactgagcctgccggaacatcagcgctggcgtcgaaatttgaacagcggtcaggggcaccaggcctgcgggtggatcttcgatgccgatacggttttcgacaccattggtatactggaatgggcgagactggcgccggttgagcgggtaaaagggatcatgcgcactccggatggtctggtgcgcattaaccgtcagggcgaggatttctttattgaaacccagaatgtcgcgccacccgacagccggatagagttaattagtgcggttaataccgactggaatgctctccagtcaagcctgttgaagcttcgtttaagtttgggcggctaa

SEQ ID NO: 494 - DNA, 735 bp, Enterobacter cloacae
tttcacacattgctgaagactatgacgactcgacttcctgctattttattgctcaacgctgccggtctggcgctctttttctcctggtatatcccggcggatcacggtttctggttcccgctggattccgggctgttccacttctttaaccaggcgctggcgaagagtgaagccttcctgtggctggtggcgatcaccaacaaccgcgcgtttgacggctgttcgctgctggcaatgggctgtctgatgctctccttctggctgaaggaagacaaaacgggtcgtcgccgtattctgattatcggcctggtgatgctgctgacggccgtgattatcaaccagctggcgcagcatctgatgccggttaaacgcgccagtccgtcgctctttttcccgaatattaaccgcgtcagcgagctgcttcatattccaaccaaagatgcctcgaaggacagtttcccgggggaccacggtatgatgctgctgatttttgcaggcttcatgctgcgctattttggtaaaaaagccttcgccatcgccctggttattgtggtggtatttgcattcccgcgggtgatgattggtgctcactggctgacagatatcgccgtaggctccctcacagcggtgttaattggtttaccgtgggtgctgatgaccccactgagcgatcgcgtaataggtatttttgatcgctatcttcccggtaaatttaaacaagtcagaaacaaataa

SEQ ID NO: 495 - DNA, 369 bp, Enterobacter cloacae
gaatacgcgcgcgacggacagattgtactgaatattgcgccacgcgcagtgggtaacctggagctggcgaacgacgaagtgcgctttaatgcgcgcttcggcggcgtgccgcgtcaggtttccgtgccgctggcagctgtgctggctatctacgcccgtgaaaacggtgcgggcacaatgtttgagccggaagcagcttatgatgaagaggttgcgagcctgaacgatgaagagggcggcgttgggaccgagagcgaaacggtgatgtctgtgattgatggtgataagcccgatcgcgaagatgataacgatcctgatgacgatccgccgccgcgcggaggacgtccggcattacgcgttgtaaaataa

SEQ ID NO: 496 - DNA, 2436 bp, Enterobacter cloacae
ataacactcaatagggatatgacggtgtgtaaaaaaagccgccttgcactttgtgtccgcgctattctttgcggcacattacctctggtagtcctcgcgtcaccctctttgtatgcgagggaagtgacgtttgatacgggcattattcagtcacgtggattaagccccgatttaaaccattactttgcacaagcgccacgattcttacccggcacacactctgtacaggttaaagtgaatgggaaagatcgcggtacggccgctgcacgttttaatgaagacggcgagctctgtattgataaagattttctggattttgccgggattatgcctgtcccgctcaaggctggcgaagcgtgccatgatatccgcagcgattatgcgcaggcggttgtcaacgcattaccaaaccaggacgcggtagagctttatttaccccaggaggcaattaacagtttaacctccaatattaaacactttcagcaaggtggcacggcggggttactgaactactcattattcagtacccgtaacgaatatggcgacagcgataacagccgctattcgcaggctagcctggaggctggctttaatacgatggactggtctgtgcgcagccgttatatcctgacggatgatgatggcgataaaaatgcggaaagcatttacacctacgcggagcatgtatttgttccccagcgcctgaccatgcaggtgggtgaaattaacgccatgtccggtgtattaagcggcgtgccgattacgggggtgcagctcatgcccaccaacggcctggaaagggacgggactggcgtaagcgtatcgggtatcgcccgttcctcgcaggcgcgcgttgaggtgcgccagagtggtcgtctcgtctacagtacgttagtgccggcgggtccgtttaccctggacgatgtgccagttgtcagaaataacgtcgatctcgacgtgactgtcgtggaatcagatggctcttcaagccacttcattgtgcctgcttccgcagtcagaacccgcaagctggggcgtccgcagggattgaccatgtctgtgggccaggtacggagtattgacagcgattatagcgatccgctggtcgcgaacgtctctgacggctggcgtatcacaccatggatgaacgtactggcatccggcgcagtggcagaaaagtatcaggctgcgggcggcagcgcggagtttatgctctctgatatatggggcatcacgactaccgctgcggcaagtaaagagcagtttggcgacagtaatagcgggctcaaaaccgagctgcaaagcgatttaacgctgggtgaacacgtgagcctttccgccagcgcaacgcattttagcagcggttaccgcgagcttgccgatgcgctggatgatgaatttcagcctaatgataatacttacagcggcaacgtaagttttgcgacagggattgcgggtacgtttagcgcagggtttaactacaaccagagcgcaaactacgaggacagccgctacctgctgctgtcgtggggtaaaacctttaaatatgccagcatcaccgtgaactggcagagcgccgtcggaaatactgatgacgagcaggatgacgatatgctctacgtcaacctgagcattccactcggcggctcgcaaagcctgagcagctatatgcgcaagcagggtgacagaaccacctatggtgtcgcgaacagcggcgccattggcgataacaccaattattatatctctgcggatcgtgataacgatgacaatgagaatagctttaacggcaatatcaacactaacctgcactatacccagttgagcgttggtgggggcagcagcggtagtaaccagcgcaactatagcgcaacgctgacgggcggtatcgcaatgcataaagatggcgtgaccttctcgccgtacgctattaaagatacgttcgccatcgctaagctgaacgagccgaagagtggcgtagagatttcaacgccgcagggcaccatctggaccgatcattggggacaggctgtggtaccggggctgaatgagtggcgtaactcccgtattgaaattgatgccaataaacttccgccaagcatgacgctggcgaacggcattaaatacgttgcggcagggcatgcttccgttagtgaagtcagctttaaaatcctgaatagccgtcgcgtgatgctgcgggtgaagagagcggatggtacaccactggcgaaggggttatccattgttgatgagaagggcaattatatcgtcaccagcgtggatgacggccatgtgtttatcaatgatgccgatcagctgaaagggctgtatgccatggatgacaataacaatcggctttgtcagattcactataccttaagtgataaaaaagatgacgaagcgttctatgaggaagtaaacggagtatgccaatga

SEQ ID NO: 497 - DNA, 816 bp, Enterobacter cloacae
tattttaaaatcggtatattaattaaaaatggaataaacatatcttgtttattcctttctaactacacgtggacatggaatgttgtgttgtggattaaaggagtgataattatgtcttgtttaaagaaaaccttactgaagtccgttattgctgccgctctgttttcagctcaattctcgacgtatgcagcaggaatggttcctgaaaccagtttactggtaattgatgaggcaacgcacagcggtacgatcaacgtcaaaaatacggacagctttccggctctgttatataccaatgtccttgatttaccggacgatcagggtttaaaactgatttccacccaaccagtggtacgtctggagcctggccagacccagcagcttcgttttattttacaaaataaagaaccgctggaggctgagcactataaacgtgtgacgttcgagggtattccgccgaaaagcgataacaagaacattaagatcggatttaatcttcgtcaggatttgcctgtgcttatccgtccggcgaaactggcggttgttaccgatgcatggaagtacctggaatggaacgcaacgggtacaacgcttacggtgaaaaaccccagcaaatacgttgtgcgtttggcacaaaacgttatgactcagccatctggcaccgcaggcacgctgcctaaaacgtatattttaccaggccaaagtatgaccgcaacgctgaagaaaacggtgagcggcgataataaagtgaaatttttcccggccagtcgctacggtgtggaagtaccgagctttgtttcagaattaaataaataa

SEQ ID NO: 498 - DNA, 681 bp, Enterobacter cloacae
cgaatgaaaaaagttcttattgccaccgcactgtctctttgcgtcgcttccgcatttgctgctgataccgcagtattgcaggtaaaaggtaagctgacaaatgctgcctgtactccagaattaagtaaaggtggtgtagtagattacggtactattcaccctggttcattgtctgccagcgcagtaaaccagttaggtcagaataatatcgatctaaccatcacttgttctgctgcgacgaaagtttcgtggactatggttgacgatcgtgcagagacgaatgcgggtttaaccgttaataacgcaatgtttaccggtgcaagcctatccaattctagtcagacctacggtgtaggtaaaacaacgggcggcgtgaacatcggcagctatgcaatgtttgttaaggttgatagcgtaaccgctgacggggcgacagttgatcctatttacactcagaatggtgatacctccaagtggaccacgagcacgaatggttctagtcaggctcaaaacatccgtgagtttactgttgcaaaatctggcgaaaaagttccattggcattcctgagtgcaacattcccgctggtgacatcactggctattcaggatactaccacgctggccattaccgacgataccacacttgatggtcagctgactatcagcctgaaatatttataa

SEQ ID NO: 499 - DNA, 282 bp, Enterobacter cloacae
caaatgaaaaaagttcttctcgctaccgcgttgtctctttgtgtcgcttccgcatttgctgctgataccgcagtattgcaggtaaaaggtaagctgacaaatgccgcttgtactcctcagttaagtaacggcggtgtcgtagattatggcactatccatttgggtgagctctctgcaacagctgttaaccagttaggtgacaaagatattaacctgacgattacatgcggtgcgcctactcaggttggttgggttgttgatgacaatcgcgaattcaagtaa

SEQ ID NO: 500 - DNA, 228 bp, Enterobacter cloacae
ttcttcctcacccaaatcgataccgtgctggtgctgttcaggctcccggcgtggtggaacgactttatcgccgggctggtgctgctgggcgtgctggtgctcgacgggcgtctgcgtcaggcactggcgcggcatcagcgggcgctgaaatacagccgtttccagcccggtaacaaagggggaaagcacgttaccccgtttcccaaacgcaaaaaagaggtggcgtaa

SEQ ID NO: 501 - DNA, 978 bp, Enterobacter cloacae
atgaggcttaactgggaaagcgcgctgctgattttactggtgctggagatcctgctcttcggcgccatcaacccgcgcatgcttgatatcaacatgctgctgttcagcaccagcgatttcatctgtattggcatcgtggcgctgccgcttacgctggtgatcatcagcggcgggatcgacatctccctcggctcaaccatcggcctgtgcgcgattgcgctgggggtgatgatgcaggcagggtggccgatggcggttgccatccctctgacgctgctgctcggcctgctgtgcgggctggtgaatgcggcgctgatccactacaccggcatcagcccgttggtcattaccctcggcacgctctacctctacggcggcggcgcgctgctgctctccggcatggcgggggcgacgggctacgagggcatcggcggcttcccggacagctttaccgccttcgctaacctcacggtgctggggctgccgatcccgctggtgctgttcgcggtgattaccgccttcttctggctgattacccaccgtgggcgctttggtcggcacctgtttttgattgggcagaacccgcgcgcggcgcgctatgcggcgctgccggtgaacggcatgccctacgcgctgtacggcctggtgggcgtggcctcggcgattgccgcgctggtgatggtctcctatttcggctctgcgcgttcggatctggggcgcgatttgctgatgcccgcgctcaccgccgccgtgctcggcggagccaatatctacggcgggtcaggttctgttgtcggtacggcgctggcggcgctgctggtggggtatctgcaacagggtttacagatggtcggcatccccaaccaggtgtcgagcgcgctgtcgggggcgctgctggttgtggtggtgatggggcgttcgctgagtctgcaccgcgaatgggtgcgatctctcttcagaaaactatccggagcgtaa

SEQ ID NO: 502 - DNA, 978 bp, Enterobacter cloacae
ggcgaagggcaacggcatcgtgctgctgccggagcgcgtggtgttcaccaaagagaacatcagcaaatacgatttctgacgggggagcaaatggctgatttagacgacatcaaagacggcaaggattttggcatcggtacgccgcagcagaatgtgccgtacaccctgaagggctgcggttcgctcgactggggcatgcagtcgaggctttcgcgcattttcaacccgcagagcaaccgcacggtgatgctggcctttgaccacggttactttcagggaccgaccaccggccttgagcgtatcgatctctccatcgcgccgctgtttggcgaaaccgacgtgctgatgtgcacccgcggcatcctcaggagccaggtacctgccgcgacgaacaaaccggtggtgctgcgcgcctccggcggtaactcgattctgggcgaactgtcgaacgagtgcgtggcggtggcgatggaagacgcgctgcgcctgaacgtctgcgcggtggcggcgcaggtgtacatcggaagcgagtttgaacatcagtcgatcaataacgtcattaagctggtcgatgcaggggcgcgctacggcatgccgacgctggcggtgacgggcgtggggaaagagatggcgcgtgacgctcggtatttttcgctggcaagccgcatcgccgccgaaatgggggcgcagttcgtcaaaacctattacgtggacgagggctttgaaaaagtgaccgccagctgcccggtgccgatcgttatcgcggggggcaaaaagctgccggagcacgaggcgctggagatgtgctggcgcgcgatagaccagggcgcgtccggcgtggacatggggcgcaacatcttccagtccagcgcgccgctcgccatgctgaaggcggtgaagaaagtggttcacgagaacatgagcgcccgggaggcgttccagttctggcaggaagagaaacagggagaagcaaaatga

SEQ ID NO: 503 - DNA, 1056 bp, Enterobacter cloacae
gtctgcaccgcgaatgggtgcgatctctcttcagaaaactatccggagcgtaagatgaaaacaaaactgctcgtcctggcaatggccctcagcttcgcttcggcgcaggcggcggaccgcattgcctttatcccgaaactggtaggcgtgggattcttcaccagcggcggcaacggtgcgaaagaggcggggaaagttcttggcgtggacgtgacctacgacggcccgaccgagccgagcgtctccggtcaggtgcagctcatcaataacttcgtcaaccagggctataacgccatcatcgtctctgccgtgtcaccggacggtctctgcccggcgctgaagcgcgcgatgcagcgcggcgtcaaggtcctgacctgggattccgacaccaaaccggagtgccgcagcatctacatcaatcaggggacgccggaacagctgggcggcctgctggtggagatggcgggcaagcaggtcaccaaaccgaacgcgaaagtggcgttcttctactccagcccgaccgtcaccgaccagaaccagtgggtgaaagaggcgaaggccaaaatcgagaaagatcatcctcagtggcaggtcgtcactacccagtttggctataacgacgccaccaaatcgttgcaaaccgccgaagggatcttaaaggcttattcggatctggatgcgatcatcgccccggacgccaacgccctgccggcggcggcacaggcggcagaaaacctgaagcgggaaggggtggcgattgtcggcttcagcacgccgaatgtgatgcgcccgtacgttgagcgcggcacggtgaaggccttcggcctgtgggacgtggtgcaacagggcaaaattgcggtcaatgtcgccgatcgtttgctgaaaaaaggcgatcttaacgtcggcgacagcgtagacgtgaaaaatatcgggacgctgaaggtcgagccgaacagcgtgcagggctaccagtatgaggcgaagggcaacggcatcgtgctgctgccggagcgcgtggtgttcaccaaagagaacatcagcaaatacgatttctga

SEQ ID NO: 504 - DNA, 543 bp, Enterobacter cloacae
aaaagtgaccgccagctgcccggtgccgatcgttatcgcggggggcaaaaagctgccggagcacgaggcgctggagatgtgctggcgcgcgatagaccagggcgcgtccggcgtggacatggggcgcaacatcttccagtccagcgcgccgctcgccatgctgaaggcggtgaagaaagtggttcacgagaacatgagcgcccgggaggcgttccagttctggcaggaagagaaacagggagaagcaaaatgaacgtgacgctggtggagatcaacatcaagcccgagcgggtggacgagtttctggaggtatttcgcgccaaccacgagggggcgatcaaggagccgggcaacctgcgcttcgacgtattgcaggacccgcgggtgaaaacccggttctttatctacgaagcctataaagacgaaaaggcggtgctggcgcataagcaaaccccgcactatctcgcgtgcgtggataagctggaggagctgatgtcggagccgcgcaaaaaacgcagctttgtcggattgttgccggagtaa

SEQ ID NO: 505 - DNA, 1338 bp, Enterobacter cloacae
attcttcccaacgaaaggaacgggcttctctacactccaggtagtattcactggaggcatgacatcatggcgaacaccatcacggctgatgatattcgggaacacttttcgcaggctatgtcggcgatgtaccagcaggaagttccgcagtacggcaccttgctggaactggtggcggacgttaacctggcggttctggaaaataacccacttttacatgaacaactggcgaacgcagacgaactggcgcgcctgaatgttgaacgtcacggtgcgatccgcgttggcaccgcgcaggagctttccaccctgcgccggatcttcgccattatgggcatgtacccggtcagctactacgatctctcccaggcgggcgtgcccgtccactcgacggcgtttcgtccgacagacgatgcggcgctctgccgtaatccgtttcgcatttttacctcgctgctgcgcctggagctgattgaaaacgttgcgctgcgcgaaagggcggcggagatcctctcccggcgcaacatctttacgccgcgctgtctggaactgatcgacctgcatgatgcgcagggacactttaccgaggcacaggcgcgcgaatttgtgcaggaagccttagaaaccttccgctggcatcgccatgcgacggtcgatcaggaaacctatctggcgctgagcaacgaacatcgcctgattgccgacgtggtctgtttcccggggtgccacatcaaccatctcacgccgcgcacgctggatatcgaccgggtgcaggagctaatgccgaagtacggcatcgagccgaaaatcctgattgaaggcccgccgcgccgcgaggtgccgatcctcctgcgtcagaccagctttaaggcgctggaggagccggtgctgttcgcgggggaacacaagggcacccataccgcgcgtttcggtgagattgagcagcgcggcgtagcgcttacgccgaaagggcgcgagctgtacgacagcctgttaaaccaggccgggaccggcaaagacaacctgacccaccagcttcacctgcgcgagatcttcagcgccttcccggacagtgaaatgttcctgcgccgtcaggggctggcttatttccgctaccgtctgaccccgacaggtgaggcgcatcgccacgcgtttcgtcccggcgtcgatccgcaaccgctgatcgaacgcggctgggttgtggcacagcccatcacctacgaggattttctgcccgtcagcgcggcggggatcttccagtcgaatcttggctatgaaacgcaggcgcgcatccacggaaatgccagccgcaatgccttccaagccgcccccctcccg

SEQ ID NO: 506 - DNA, 960 bp, Enterobacter cloacae
cttgtcacccgcgtcgctctgtttttaacatcgcctatggaaaaaaatggtctgttcagtcagcgcatacgcttgcgccatttgcatacttttgtggccgtcgctcaacagggaacgctggggcgagcggctgaaacccttaacctcagtcagcctgcactctccaaaacgctgaacgaactggaacagcttaccggaacccgcctgttcgatcgcggccgtctgggggctcagcttacgctcgtgggcgaacagttcctgacgcatgccgttaaagttctcgatgccctcaataccgccggtcaggcgttaaaccgtaaagaggagccggccagcgacatcgtgcgcgtgggcgcgctgccaacggcggcgctgggcatactgcctgcggcgatcggccagttccaccgtcagcaaaagcacgccacgcttcaggtcgcgaccatgaataacaccatgctgctggcgggcctgaagtcaggcgagctggatctgggcattgggcggatgtccgatccggaactgatgagcggcctgaactacgagctgctgttcctggaatcgctgaagctggtcgtgcgtccgaatcatcccctgttgcaggacaccgtgaccctgagccgtgtgatggagtggccggtggtggtctcaccaaaaggaaccgttccgcgtcagaatgcggaagcgttgctgcaaatgcagggctgcacgctgccttccgggtgtattgaaacgctctcggcgtcgctgtcgcgccagcttacggtggattatgactacgtatggtttgtgccgtccggcgcggtgaaggacgatctgcgacgcggcgtgcttacggcgctgccggtaacatcgcccggcgcgggagaaccgattgggatcctgacgcgggtagatgccccgctctctgaaggtgcccaaacgctgttaagcgccattcgtaaatcaatgcctctttga

SEQ ID NO: 507 - DNA, 1038 bp, Enterobacter cloacae
gcaaaccaggtagtcatgaagaaaatgttacgctttgtcctccttctgatcgttgcgttaggtatcgctggcggagcaggagtgtggaaagtccgtcagctggcggagagtcagatcctgataaaagacgagacgatttttaccctgaaagcggggaccgggcggcaggcgcttggtcagcagctgtatgacgacaaaattatcaatcgcccacgcgtattccagtggctgctgcgtattgaaccggacctgtcccatttcaaggccggtacctatcgttttacccctggcatgaccgtgcgcgagatgctgcaactgctggaaagtggtaaagaagcccagttcccgctgcgtttcgtggaaggtatgcgtctgagcgattacctcaggcagctgcgtgacgcgccgtacatcaagcatacgctgaaagatgaccgctaccagaccgtggcagacgccttaaaattcgaacatcccgagtgggtggaaggctggttctggcccgatacgtggatgtatacggcaggcacgacggatgtggccattctgaagcgcgcgcacaacaaaatggtcgcggcggtagacgctgcctggaaagggcgagcagaaggcctgccttataaagatcaaaaccagttcatgacgatggcctcgatcatcgagaaagagacggccgttgctgccgaacgtgaccaggttgcctcggtgtttattaaccgtctgcgcatcggcatgcgtttgcaaaccgatcctaccgtcatctacggcatgggcgaaaactacaacggcaggatttccagaaaagatctggagacgccaacggcgtataatacctacgtgattagcggcctgccgcctggaccgattgcgacgccgagtgaagcatcgttgaaggccgccgcgcacccggccaaaacgccgtatctctattttgtggctgacggaaaaggggggcacacgttcaataccaacctggccagccacaatcgctccgttcaggactatctgaaggcacttaaggaaaaaaatgcgcagtaa

SEQ ID NO: 508 - DNA, 759 bp, Enterobacter cloacae
tattcagcagactgttacgcagtggctacaggagcagcaggcatgaaatggtatccatggttgcgcccacactttgaacagctgatcggcagctatcaggttggtcgggggcatcatgcgttactgatccaggcgcttccgggaatgggtgatgatgcgttgatttacgccatcacccgctttctgatgtgccaacagccggaaggacataaaagctgcggtaagtgccggggttgccagctcatgcaggcgggcacgcatcctgactattacaccctcgaacccgagaagggcaaaaatacgctcggtatcgacgcggtgcgtgaggtcagtgagaaactgtacgaatatgcgcgtctgggcggggcgaaagtagtgtggctgaaagacgccgcgctgctcacggaagccgcagccaacgccctgttaaaaaccctggaagagccgccagagaacacctggtttttcctctcctgccgcgagccggaacgcttgctggcgacgctgcgcagtcgctgccgtcttcaccacctcgctgtccctcaggaatcctggtcgctcgcctggcttgagcgagaagtgacggtgtcacaagacgcggcgcgctcggcgttgcgcctgtgcagcggtgcgcctgcggctgcgctggccttattgcagccggaggtgtggtcccagcgtgaaacgctgtgtcgtgcggttgaatcagccctcgagtcttcaccacgggagctagacaggatccccgcttacgcacat

SEQ ID NO: 509 - DNA, 1299 bp, Enterobacter cloacae
gttttatcttttgttgtcccacgaatctctttttttatccctccctggaggacaagcgtgtctaagcgtcgtgtagttgtgaccggacttggcatgttgtctcctgtcggcaataccgtagagtccacctggaaagctctccttgccggtcagagcggcatcagcctaatcgaccatttcgatactagcgcctatgcaacgaaatttgctggcttagtaaaggattttaactgtgaagagatcatctcgcgcaaagaacagcgcaagatggatgccttcattcaatatggaattgtcgctggcgttcaggccatgcaggattctggccttgagattacggaagagaacgcgacccgtatcggcgccgctatcggctccgggattggcggtcttggtctgattgaagaaaaccatacatctctgatgaatggcggcccgcgtaaaatcagcccgttcttcgttccgtctacgattgtcaacatggtggcaggtcacctgaccattatgttcggcctgcgtggcccaagcatctcaatcgcgacagcctgtacgtctggcgtgcataacatcggccaggccgcgcgtatcattgcgtacggcgatgcagatgctatggttgcgggcggcgctgaaaaagccagtaccccactgggcgtcggtggtttcggtgcagcgcgtgcgctctctacccgaaacgataatcctcaggcggcgagccgtccgtgggataaagaccgtgatggtttcgtgctgggtgacggtgcaggcatgatcgtactggaagagtacgaacacgcgaaaaaacgtggcgcgaaaatttatgctgaagttgttggctttggcatgagcagcgatgcttatcacatgacgtctcctccagagaatggcgcaggtgctgcgctggcgatggaaaacgccatccgtgatgcgggcattacgccggcacagattggctacgttaacgcgcatgggacgtctacccctgcgggcgataaagcagaagcgcaggctgttaagtctatcttcggcgaatctgccagccgtgtgctggtgagctccacgaaatccatgaccggtcacctgctgggcgctgcgggggcagtaaagtcaatctactctattctcgcgctgcgcgatcaggctgtaccaccaaccatcaacctggataacccggatgaaggttgcgatctggacttcgttcctcacgaagcgcgccaggttagcggtatggagtataccctgtgtaactccttcggcttcggtgggactaacggttctctgatcttcaaaaaggtctga

SEQ ID NO: 510 - DNA, 819 bp, Enterobacter cloacae
ggagccactatgtttttgattaatggccttgagcaagacacgctgccggcaagcgacagggcgacccagtttggcgatggctgtttcacgactgcgcgtattctcgacggtgacgtgtgcctgctcggggcccatatccttcgtttacaaaaagcctgcgaaacattactgatccccttctcgcagtgggacattcttgaaagtgagatgcgtcggctggcgtcagaaaaagcaagcggcgtcctgaaagtcattatcagccgcgggagcggtggccggggctatagcggttctgcctgtctgcatcctacgcggatcctttccgtttcagattatccttcccattatgcgcactggcgtgaagagggcgtagccctggcgctaagtccggtacgtctgggaagaaacccgatgctcgctggcataaaacacctcaaccgccttgaacaggtgctaattcgtactcatcttgagcagacggaggccggggaggcgctggttcttgacagcgaagggtacattacggaatgctgtgcggctaatttactctggcggaagggcagtgaagtgttcacgccttcgctggagcaggccggcgtcaacggcattatgcggcagttttgtatgcacctgctggcacgcgcaggctttcgcgttgtcgaagtcaacgctaaggaagaggcgctgttggctgccgatgaagttgttatctgcaatgcgctgatgcccgttgtccccgttcgcgcttatggccgcaaatgctggtcatcccgcgagctgttccagtttctggccccgttatgtgagcaaaccaggtag

SEQ ID NO: 511 - DNA, 660 bp, Enterobacter cloacae
aggcacttaaggaaaaaaatgcgcagtaaatacattgtcattgagggactcgaaggggcgggcaaaacaactgcccgtaacgtggtggtggatacgcttacgtcgcttggcgttgccgacatggtcttcacccgcgagccgggcggtacgcagctggcggaaaaactgcgcagcctggttctggatatcaaatccgttggcgatgaagttattaccgacaaagcggaagtgctgatgttctatgcggcgcgcgttcagctggtggagacggtgatcaaacccgctctggcagaagggaaatgggtgattggcgatcgccacgatctctcaacccaggcatatcagggcggtggccggggtatcgaccagaccatgctggctacgcttcgcaacgcggttctgggcgatttccgtcctgacctgacgctgtatctggacgtgacccctgaggtgggcctgaagcgcgcccgtgcccgcggcgaactggaccgcattgaacaggaatcttttgatttctttaaccgcacccgtgcgcgttatctggagctggccgggcaggacaagaccattcgtaccatcgatgcgacgcaatcccttgaagacgttacgcgtgatattcagcagactgttacgcagtggctacaggagcagcaggcatga

SEQ ID NO: 512 - DNA, 1008 bp, Enterobacter cloacae
ctggtggaatatatgactatcaaagtaggtatcaacggttttggccgtatcggccgtattgttttccgtgctgctcagaaacgttctgacatcgaaatcgttggtatcaacgatctcctggacgctgaatacatggcgtacatgctgaagtacgactcaactcacggtcgtttcgacggcaccgttgaagtgaaagacggccacctggttgttaacggcaaaaccatccgcgttactgctgagaaagacccagctaacctgaaatggaacgaaatcggtgttgacgttgtagctgaagctaccggtatcttcctgaccgacgaaactgcacgtaaacacatcactgcgggtgcgaagaaagttgttctgactggtccttccaaagacaacaccccaatgttcgttcgcggtgcaaactttgaaacttacgctggccaggatatcgtttccaacgcatcctgcaccaccaactgcctggcaccgctggctaaagttatcaacgacaacttcggcatcatcgaaggtctgatgactaccgttcacgcaaccaccgctactcagaaaaccgttgatggcccgtctcacaaagactggcgcggcggccgtggcgcggctcacaacatcatcccatcttctaccggtgctgctaaagcagtaggtaaagtactgccagaactgaatggcaaactgactggtatggcgttccgcgttccaactcctaacgtatccgttgttgacctgaccgttcgtctggaaaaagctgcttcttatgaagaaattaagaaagcaatcaaagctgcttccgaaggcccaatgaaaggcgttctgggttacaccgaacacgacgttgtatctaccgatttcaacggcgaagtgtgcacttccgtgttcgatgctaaagcaggtatcgcactgaacgacaacttcgtgaaactggtttcctggtacgacaacgaaactggctactctaacaaagtactggacctgatcgctcacatctccaaataa

SEQ ID NO: 513 - DNA, 900 bp, Enterobacter cloacae
acagaggattgcttaatgattaataaaatttttgcacttccggtagtcgaacaacttacccctgtgctctcccgccgtcagattgacggtgccgatatcatcgtcgttgatcatccgcgcgttaaagcctccgtcgcgctcaacggcgcccacctgctctcctggaaaccagaaggtgaagaagaaggcctgtggctgagcgaggccacctcgttcaaaagaggggcggcgatccgcggcggcgtaccgatttgctggccatggtttggcccgtcagcgcagcagggattaccgtctcacggtttcgcccgtaaccagcagtggacgctgaaagcccacaacgaagatgaaaacggcgcggtgttgacctttgagctccaggcgaatgatgaaacgcgcgccctgtggccacatgaattcaccctgtatgcccgcttcaagctgggtaaaacctgcgagattgaactggaagcgcacggcgaattcgaaactacgtccgccctgcacacctatttcaacgtaggcgacattcaggccgttaaggtgagcggacttggcgatacctttatcgacaaagtggataacgcgaaagaaggcaagctggacgacggcgtgcagactttcccggatcgtaccgaccgcgtatacctgcacccggaagcctgtagcgtcatccacgacagcgcgctgaaccgcggtattgatgtggttcatcaccaccacagcaacgtagtgggctggaacccgggccctgccctttccgtcagcatggcggatatcccggatgacggttacaagaccttcgtctgcgtggaaaccgcgtgcgtgaccgcgccgcagaaaaccagcgaagaaaaaccgtcccgcttaggccagacgatcaagattgtgaagcgctaa

SEQ ID NO: 514 - DNA, 1574 bp, Enterobacter cloacae
aaaacgaaaggacggcatgccatgaatatattcgatcactatcgccagcgctacgaagctgccaaggacgaagagttcacactgcaggagtttcttaccatttgtcggcaagatcgcagtgcctatgccaatgcggcagaacggctattgatggctattggtgagccaaacatggttgatactgccctggagccacggctttcccgtctcttttcgaatcgggtggtcgcccgatacccggcgtttgaagagttctatggcatggaagatgccattgagcagatcgtctcctacctgaagcatgccgctcaggggctggaagagaagaagcagatcctttacctgctgggtcctgtcggtgggggtaaatcctccctggctgaacggctgaaagcgctgatgcagcgcgtgccgatctatgtgctgagcgccaacggcgagcgcagcccggtcaatgaccatccgctgtgcctgtttaatccgcaagaggatgcgcaaattctggaaaaagagtttggcattccgcatcgctatctcggtacgatcatgtcgccgtgggcggcaaaacgtctgcacgagtttggcggggacatcaccaaattccgcgtcgtgaaagtgtggccgtctatcctcgagcagatcgccattgccaaaacagaacccggtgacgagaacaaccaggatatctcggcgctggtgggtaaagtcgatatccgtaagctggagcatcacgcgcaaaacgacccggatgcctacggctattccggtgcgctgtgccgtgccaaccaggggattatggaattcgtcgagatgtttaaagcaccgatcaaagtgctgcatccgctgctgaccgccacccaggaggggaactacaacgggacggaaggtatttccgccctgccgtttaacgggattatccttgcccactcgaacgaatctgaatgggtgaccttccgtaacaacaaaaacaatgaggcgttcctagaccgtgtgtacatcgtcaaagtgccttattgcctgcggatctccgaggagatcaagatttacgaaaaactgctcaaccacagtgagctggtccatgccccttgcgcaccgggaacgctggaaacgctgtcgcgcttctcgatcctgtcgcgcctgaaagagccggaaaactccagcatctactcaaaaatgcgcgtgtatgacggcgaaagcctgaaggataccgacccgaaagcgaaatcgtaccaggaataccgcgattacgccggggtcgacgaagggatgaacggtctgtcgacgcgtttcgcgtttaagatcctctcccgcgtctttaacttcgaccacgcggaggtggccgccaacccggtacatctgttctacgtactggaacagcaaattgaacgtgaacagttcccacaggagcaggctgaacgctacctggagttcctgaaaggctacctgatcccgaaatacgccgagttcattggcaaagagatccagaccgcctatctggaatcctattccgaatacggccagaacatcttcgagtcttcaccacgcggctcgaaggaccacgaacgttcccgcga

SEQ ID NO: 515 - DNA, 774 bp, Enterobacter cloacae
ttatttgactacaggaaagaatggattgtgaccaaactcaaacttctggcattgggcatccttgccgctaccgcagcgagcaccgtacaggctgagagccagtggactgttggcgcgggtgctggcgtgattaacagcccgtacaagcagtatgaccgcgacgtttatcctgtccccgttgtcacctatgaaggcgataacttctggttccgtgggttgggcggcggctactatctgtggaacgatacggccgataagctctccatcatggcctattacgacccaacgcactttaaaccaggcgacagcgacagcaatgcgcttcgtcaactggacaaacgcagaagctcactgatggcggggctttcttacgtccataataccgagtatggcttcctgcgcactgcgctggcgggcgataccctggacaacagcaacggcttcatctgggatctggcgtggctttaccgctataccaacggcgcagtgacgctgacgccgggtatcggtgtgcagtacagcagcgaaaattacaacgactactactatggcgtgtctaaagcggagtctcgccgcagtggtttgaatagctacagcgcggatgatggctgggacccgtacctggaactcaccgcatcgtataacttcctcggtgactggaatgtgtacggtactggccgttacattcgtctgagcgatgaagtgaaagacagcccgatggtcgacaagtcctggtctggcatcttctctgtaggtgtgacctacaagttctga

SEQ ID NO: 516 - DNA, 184 bp, Enterobacter cloacae
tgtcgatttccttcagggcgactttcgtgatgaattagtgctgaaagcattacttgatcgtgtaggtgacagtaaggtccaggttgtcatgtcggatatggcgccaaatatgtgtggaaacaccggcggtggatatcccccgcgccatgtatctggtggaactagcgttagaaatgtgtcgtga

SEQ ID NO: 517 - DNA, 933 bp, Enterobacter cloacae
agcgtttgtctgtatctcaaaccctggagcttgctccggggtttttcttatctgtttaaccacattaatcccagagacttcaccatgaaactattcgcccaggactcgcatctcgaccttacacatccccatgtgatggggatcctgaatgtcacgcctgattccttctctgacggcggcacgcataattcgcttatcgacgcggttaaacacgcgaatttaatgattaacgcgggtgccaccatcattgacgttggaggggagtcaacgcggcctggcgcggcggaggtttcggtggaagaagagctggcgcgcgtggtgccggtggtggaggctatcgcccggcgctttgaagtgtggatctctgttgatacctccaaacccgaagtgatccgtgaagtggcgagagtgggcgctcacattatcaatgatatccgctcgctgaccgagccgggcgcgattgaagccgccgcagaaaccgggctaccggtgtgtctgatgcatatgcagggccagcctaagacaatgcaggaggcgccaaaatatgaagacgtgtttgccgacgtcacccgcttctttattgagcatatcgaacgctgtgaacgtgcgggtatcgcaaaagagaaattgctgctcgacccgggcttcggtttcggtaaaaatctctcacacaattacgcgttgcttgcgcgcttatcagagtttcatcagttcggcctgccactgctggtgggaatgtcgagaaaatcgatgattggtcagttgttgaatgtcgggccgagcgaacgtctgagcggcagtctggcctgcgcggtgattgccgcgatgcaaggtgcacacatcattcgcgtccatgacgtaaaagaaacagtagaagccatgcgtgtggtggaagccacactggcagcgaaggaaaacaaacgctatgagtaa

SEQ ID NO: 518 - DNA, 288 bp, Enterobacter cloacae
gtgacagtaaggtccaggttgtcatgtcggatatggcgccaaatatgtgtggaaacaccggcggtggatatcccccgcgccatgtatctggtggaactagcgttagaaatgtgtcgtgatgtactagcgcctggtggtagttttgttgtgaaggtgtttcagggcgaaggtttcgaggagtatcttaaggaaattcgctccctgtttgcgaaggtcaaagttcgtaagccggactcttcccgggcccgttcccgtgaagtgtatattgtagcgaccgggcgaaaatga

SEQ ID NO: 519 - DNA, 1959 bp, Enterobacter cloacae
tatgaggttaatcccttgagtgacatggcgaaaaacctaatactctggctggtcattgccgttgtgctgatgtcagtattccagagctttgggcccagcgagtcgaatggccgcaaggtggattattctaccttcctgcaagaggtcaatcaggaccaggttcgcgaagcgcgtatcaacggacgtgagatcaacgttaccaagaaagatagtaaccgttacacgacttacatcccggtgaacgatcctaagctgcttgataaccttctgaccaaaaacgtcaaagtggtaggcgagccgccggaagaaccaagcctgctggcttctatcttcatttcctggttcccgatgctgcttcttatcggcgtctggatcttctttatgcgccagatgcagggcggtggtggcaaaggtgccatgtcgttcggtaagagcaaggcgcgtatgctgacggaagaccagatcaagaccacgtttgctgacgtagcaggttgtgacgaagcaaaagaagaggtgggtgaactggttgaatacctacgcgagccgagccgtttccagaaactgggcggtaagatcccgaaaggcgtcctgatggtcggccctccgggtaccggtaaaaccctgctggcaaaagccatcgcgggtgaagcgaaggtgccgttctttactatttcaggttctgacttcgttgaaatgttcgtgggtgtcggtgcatctcgtgtgcgtgacatgttcgagcaggctaagaaggcagcaccgtgcatcatcttcatcgatgaaatcgatgccgtaggccgccagcgtggcgcaggcctgggtggtggtcacgatgaacgtgagcagacgctgaaccagatgctggttgagatggacggcttcgaaggtaacgaaggtatcatcgttatcgcggcaactaaccgtccggacgtacttgaccctgcgctgctgcgtccaggccgtttcgaccgccaggttgtggtcggtctgccggatgttcgcggtcgtgaacagattctgaaagtgcatatgcgtcgcgtaccgctggcgccagatatcgacgcggcaatcatcgcgcgtggtactccaggcttctccggtgcggatctggctaacctggtcaacgaagcagccctgtttgccgctcgcggtaacaagcgcgtggtgtccatggtggaatttgagaaagcgaaagacaaaatcatgatgggtgcggaacgtcgctccatggtgatgacggaagcgcagaaagagtccacggcatatcacgaagcgggccacgcgattatcggtcgtctggtgccggaacacgatccggtacacaaggtgacgatcattccacgcggtcgtgcgctgggtgtgaccttcttcctgcctgaaggcgacgcgatcagcgccagccgtcagaagctggaaagccagatttcaaccctgtacggcggtcgtctggctgaagagattatctacggtgcggaacatgtttccaccggtgcgtcgaacgatattaaagtggcgacaaacctggcgcgtaacatggtgactcagtggggcttctccgacaaactcggtccgctgctgtatgcagaggaagagggcgaggtgttcctgggccgctccgtggcaaaagcgaaacatatgtccgatgaaacggcacgtatcatcgaccaggaagtgaaagcgctgattgaacgtaactacgctcgcgcccgtcagatcctgaacgacaatatggacatcctgcattcgatgaaagatgcgctcatgaaatatgagaccatcgatgcaccacagattgacgacctgatggcgcgccgcgaagtgcgtccgccggcaggctgggaagacccaggcgcgtctaacaattctgacaacaatggcaccccgcgtgcgccgcgtccggtcgatgaaccgcgtacgccaaacccgggcaacaccatgtcagagcagttaggcgacaagtaa

SEQ ID NO: 520 - DNA, 1125 bp, Enterobacter cloacae
aagccatgcgtgtggtggaagccacactggcagcgaaggaaaacaaacgctatgagtaatcgtaaatattttggtaccgatggcatccgtgggcgcgtaggcgatgcgccaattacccctgactttgtcctgaagctgggctgggcagcggggaaagtgctggcgcgtcatggctcccgtaagatcattattggtaaagatacccgtatttcgggttatatgctggaatccgcgctggaagccgggctggcggcggcggggctttcagcttcctttacggggccaatgccgactcctgctgttgcctatctgacccgcaccttccgtgcggaagcgggcatcgtcatttccgcttcccataacccgttctatgacaacggtatcaaattcttctccatcgacggcaccaaactgccggatgacgtggaagaggcgattgaagcggaaatggaaaaagagatcacctgtgttgactccgctgagctgggtaaagccaaccgtattgtcgatgccgcaggccgctacattgaattctgcaaaggcactttcccgaatgaactgagcctggcacacctcaaaattgtggtggactgtgcaaacggtgcgacttaccacattgcgccgaatgtgttccgcgagctgggtgcgaaagtgatcactatcggctgcgagccggacggtctgaacatcaacgaagaagttggcgcgacagacgtacgtgccttgcaggcgcgtgtcctggctgaaaaggccgatctgggtattgccctggatggcgatggtgaccgtgtgatcatggttgatcacgaaggtaacaaggtcgatggcgatcagatcctctacatcattgcgcgtgaaggcctgcgtcaggggcaactgcgcggtggcgcggtgggcactttgatgagcaatatgggtctggagctggcgctgaaacagctgggcatcccgtttgttcgtgcgaaagtgggtgaccgctacgtgctggaaaaactccaggagaaaggctggcgtattggcgcggaaaactccggccatgtgatcctgctcgataaaaccaccaccggtgacggcattgtggcggcccttcacttttcactcggagtagccgagccgcgcatagag

SEQ ID NO: 521 - DNA, 2178 bp, Enterobacter cloacae
  unsure (193)
catgcgagcacgggcgtggagaattctcctacgcccgtgccgattacttaccctgcatcagggcgattattttttgtctttcacttcttcgaactcagcgtcgacaacatcatcgtctttcgcgttgttcgccgaagcatcagcgcccgcctgctgctgtgcgtgctgctgctgagcgatttccatcagcttntgagaaacctgtgccagctcctgcatcttcgcttcgatgtccgctttgtcttcgcctttcagagacgtttccagcgcgctcagtgcagtttcgattgcagttttgtcttccgctggcagtttatcgcccgcttcttcaacctgcttacgggtgctgtgcagcagatggtcaccctggttacgggtctgaaccagctcttcaaacttacggtcggattccgcgttagcttcggcatcacgaaccattttttcgatttccgcttcgttcaggccagaagatgccttgatggtaatcttctgctctttaccgctgtttttgtctttcgcagacacgtgcaggataccgtcagcatcgatgtcgaaggtgacttcgatctgtggcatgccgcgtggtgccgggttaataccgtccaggttgaactgacccagagatttgttatccgccgcgcgcttacgctcaccctgaatcacatggatggttaccgcagactggttgtcttcagcggtagagaacacctggctgtgtttcgtcgggatagtggtgtttttgttgatgagcgcagtcatcacaccgcccatggtttcgatacccagagacagcggggtaacgtccagcagcagtacgtctttcacttcaccggtcagtacaccaccctgaaccgcagcaccgatagcaaccgcttcgtccgggttcacgtctttacgtggctctttaccaaagaattcagccactttcttctgaaccatcggcatacgagtctgaccacctaccaggataacgtcctgaatgtcagacacggacaggccagcgtcctgcaatgcaactttcagtggctcgatagaacggttcaccaggtcttctaccaggctttccagtttcgcacgggtcactttgatgttcatgtgttttggaccggtcgcgtctgcagtgatgtacggcaggttcacgtcggtctgctgagcggaagacagctcgatcttcgctttctcagcggcttctttcaggcgctgcatagccagcgggtcgttacgcaggtcaatgccctgatctttcttgaactcgtcaacgaggtagttgatcagacgggtatcgaagtcttcaccacccaggtgggtatcaccgttggttgccagaacttcgaaggttttttcgccgtcaacatcgtcgatttcgataatagaaatatcgaaggtaccaccacccaggtcgtaaaccgcgatagtacggttgccaacttctttatccagaccgtaagccagtgctgctgcggttggttcgttgatgatacgttttacttccaggcctgcgatacggccagcatctttggttgcctgacgctgagcatcgttgaagtaagcaggtacggtgataacagcttcagttaccggttcacccaggtaatcttccgcagttttcttcattttcttcagcacttcagcagagatctgcggaggtgcagttttggtgcctttcacatcaagccatgcatcgccgttatcggctgcgatgattttgtaaggcatgatggaaacgtcacgctgaacttcttcgtcctggaagcggcggccaatcaggcgtttgatcgcaaacagggtgttttgcgggtttgtcactgcctgacgtttagccggctgaccaaccagagtttcaccatcctgggtataagcaatgatagaaggcgtggtgcgatcgccctcggcgttctccagcacacgtgcagtagtgccatccataatcgctacacaagagttggtagtacccaggtcgataccaataattttacccatctaaacgtctccactaaaaattcagtcaacatgtggttgtgtacctgtaataagggcagaacgtgctttttcaactgcccagatttgatttttttcaggtccacacactgcggttgcttacaagatggggtcacaacggcatccatcaaggggggaaggataaaaaattttttaatttcacccccgatgagatcatag

SEQ ID NO: 522 - DNA, 687 bp, Enterobacter cloacae
tctgggcgctatcgtgattatcgcgctgttctacaccagcgatctgtccgttctgtcgctgagcgtggcggccgtggctattgcggtgctggcgttgctgaacgtcttcaacgtccgacgcacggggatttatattctggtggggatggtgctgtggacggcggtgctgaagtctggcgtgcatgccacgctggcgggcgtcatcgttggcttctttattccgctgaaggaacaggacggcaaatcgcctgccagacagctggagcatgtgcttcatccgtgggtgggttttatgatcctgccgctgtttgcgtttgccaacgcgggtgtttcccctggcccggggttaccctggacggactcacctctgtgctgccgctgggtatcatcgccggtctgtttattggtaagccgctgggcatcagcctgttctgctggctggcgctgaagctgaagctggcgtcattgccaaacggaaccacctttagccagattatggccgttggcgtgctgtgcggtattggattcaccatgtcgatctttatctcgacgctggcgtttggcgcaagcgcgcctgagcttatcgtctgggcgaaactcggcattcttatcgggtcgttcctggccgcggttatgggttacaccttgttgaaggtgaagttgtccggacaggctgtccagacataa

SEQ ID NO: 523 - DNA, 1914 bp, Enterobacter cloacae
  unsure (1788)
atgggtaaaattattggtatcgacctgggtactaccaactcttgtgtagcgattatggatggcactactgcacgtgtgctggagaacgccgagggcgatcgcaccacgccttctatcattgcttatacccaggatggtgaaactctggttggtcagccggctaaacgtcaggcagtgacaaacccgcaaaacaccctgtttgcgatcaaacgcctgattggccgccgcttccaggacgaagaagttcagcgtgacgtttccatcatgccttacaaaatcatcgcagccgataacggcgatgcatggcttgatgtgaaaggcaccaaaactgcacctccgcagatctctgctgaagtgctgaagaaaatgaagaaaactgcggaagattacctgggtgaaccggtaactgaagctgttatcaccgtacctgcttacttcaacgatgctcagcgtcaggcaaccaaagatgctggccgtatcgcaggcctggaagtaaaacgtatcatcaacgaaccaaccgcagcagcactggcttacggtctggataaagaagttggcaaccgtactatcgcggtttacgacctgggtggtggtaccttcgatatttctattatcgaaatcgacgatgttgacggcgaaaaaaccttcgaagttctggcaaccaacggtgatacccacctgggtggtgaagacttcgatacccgtctgatcaactacctcgttgacgagttcaagaaagatcagggcattgacctgcgtaacgacccgctggctatgcagcgcctgaaagaagccgctgagaaagcgaagatcgagctgtcttccgctcagcagaccgacgtgaacctgccgtacatcactgcagacgcgaccggtccaaaacacatgaacatcaaagtgacccgtgcgaaactggaaagcctggtagaagacctggtgaaccgttctatcgagccactgaaagttgcattgcaggacgctggcctgtccgtgtctgacattcaggacgttatcctggtaggtggtcagactcgtatgccgatggttcagaagaaagtggctgaattctttggtaaagagccacgtaaagacgtgaacccggacgaagcggttgctatcggtgctgcggttcagggtggtgtactgaccggtgaagtgaaagacgtactgctgctggacgttaccccgctgtctctgggtatcgaaaccatgggcggtgtgatgactgcgctcatcaacaaaaacaccactatcccgacgaaacacagccaggtgttctctaccgctgaagacaaccagtctgcggtaaccatccatgtgattcagggtgagcgtaagcgcgcggcggataacaaatctctgggtcagttcaacctggacggtattaacccggcaccacgcggcatgccacagatcgaagtcaccttcgacatcgatgctgacggtatcctgcacgtgtctgcgaaagacaaaaacagcggtaaagagcagaagattaccatcaaggcatcttctggcctgaacgaagcggaaatcgaaaaaatggttcgtgatgccgaagctaacgcggaatccgaccgtaagtttgaagagctggttcagacccgtaaccagggtgaccatctgctgcacagcacccgtaagcaggttgaagaagcgggcgataaactgccagcggaagacaaaactgcaatcgaaactgcactgagcgcgctggaaacgtctctgaaaggcgaagacaaagcggacatcgaagcgaagatgcaggagctggcacaggtttctcanaagctgatggaaatcgctcagcagcagcacgcacagcagcaggcgggcgctgatgcttcggcgaacaacgcgaaagacgatgatgttgtcgacgctgagttcgaagaagtgaaagacaaaaaataa

SEQ ID NO: 524 - DNA, 1011 bp, Enterobacter cloacae
tctgtttttaccgatctgtttgcactgatattatggttttaccgaggtattgttgtaaaagagagtttaaacgtgaaattactacaccgtttctttagcagtgaggcatccggcggcgtcatcctgattattgctgctgcggccgccatgctgctcgccaatatgggcatgacacgcgatctctatcacgcatttctggaaacgcccgtcgagctgaaggtcggggcgctggaaattaataagaacatgctgctgtggatcaacgatgcgctgatggcggtgttcttcctgctggtgggcctggaagttaaacgtgagctggtgagcggttcgcttgccagccgtcagcgtgcggcgtttccggtgatcgcggctattggcgggatgatcgttccggcgttgctctttctcgcatttgcgtggcaggatccggttgctcgtgacggctgggcgatcccggccgcaacggatatcgcgtttgcgctcggggtcttatccttgctcggtagccgcgtcccggtagcactgaaaattttcctgatggcgctggcgattatcgatgatctgggcgctatcgtgattatcgcgctgttctacaccagcgatctgtccgttctgtcgctgagcgtggcggccgtggctattgcggtgctggcgttgctgaacgtcttcaacgtccgacgcacggggatttatattctggtggggatggtgctgtggacggcggtgctgaagtctggcgtgcatgccacgctggcgggcgtcatcgttggcttctttattccgctgaaggaacaggacggcaaatcgcctgccagacagctggagcatgtgcttcatccgtgggtgggttttatgatcctgccgctgtttgcgtttgccaacgcgggtgtttcccctggcccggggttaccctggacggactcacctctgtgctgccgctgggtatcatcgccggtctgtttattggtaagccgctgggcatcagcctgttctgctggctggcgctga

SEQ ID NO: 525 - DNA, 987 bp, Enterobacter cloacae
agttgtccggacaggctgtccagacataacaggaaaccgggagaagggaagccttctcccgataaactatcagggagtgaaaacgtgatgtctcatttgaactataaccatctctattacttctggcatgtctacaagcagggctcggtcgtgggtgccgcagaggcgctctacctgacgccacagactatcaccgggcaaatcaaagccctggaagagcgcttgcagggaaagctttttaagcggaaagggcgtggcattgagccgagcgagctgggtgaactggtattccgctatgcggacaagatgttcaccctgagccaggagatgctggatatcgttaactatcgcaaagagttgaacctgctctttgacgtgggcgtggcggatgcgttgtccaaacggctggtaagcggtgtgctggatgcggcggtggtggaagatgaacagatacatttacgctgctttgagtccactcacgagatgctgctggaacagctgagccagcataagctggatatgattatttcggattgtcctatcgattccacgcagcaggaaggcttgttctcggtgaaaattggcgaatgcggtgtcagtttctggtgcatcaatccaccgccggaaaaaccgtttccggcttgcctggaagagcgccgcttgctggttccggggaggcggtccatgctcggacgtaagctgctgaattggtttaactcgcaggggctaaacgtagaaattctcggtgagttcgacgatgcggcgctgatgaaagcctttggcgaggcgcacaacgctatcttcgttgccccgacgctgtatgtgcacgatctctattcagacgacaagattaccgagattggcagggtggataacgtgatggaagagtatcacgccatattcgccgaaaggatgattcagcatccggcggtgcagcgaatctgcaaccgggactactcggcgctgtttacgccgccggcaatctga

SEQ ID NO: 526 - DNA, 1116 bp, Enterobacter cloacae
gcgttccgaaaactgcggaagagcgtgaaatcaaaaaaggcgtataagcgcctggccatgaaattccaccctgaccgtaatcagggtgacaaagaggctgaagccaaatttaaagagattaaagaagcttacgaagtcctgaccgatgcacaaaaacgtgcggcctatgatcagtacggacacgcggcctttgaacagggcggcatgggcggtggtggatttggtggcggcggcttcggcggcggcgctgatttcagcgatatctttggtgatgtatttggcgatatcttcggtggcgggcgtggccgtcagcgcgcggcgcgcggcgcagacctgcgctacaacatggacctgacgctggaagaagcggttcgcggcgtcaccaaagagatccgtattccgacgctggaagagtgtgacgtttgccacggcagcggtgcgaaagcggggactcagccacagacctgcccaacctgtcacggttccggtcaggtgcagatgcgccagggcttcttcgcggtgcagcaggcctgtccgcactgtcatggtcgcggtacgctgattaaagatccgtgcaccaaatgtcatggtcacggtcgcgtggagaaaaccaaaacgctgtccgttaagatcccggcaggcgtagatacgggcgaccgcatccgtctggcaggtgagggtgaagccggcgagcacggcgcaccggcaggcgatctgtacgttcaggttcaggtgaagcagcacgccatcttcgagcgtgaaggtaacaacctgtactgtgaagtgccgatcaactttgcgatggcggcgctgggcggcgaaatcgaagtgccgacgctggacggtcgcgttaacctgaaaatccctggcgaaacccagaccgggaaactgttccgcatgcgcggcaaaggcgttaaatccgttcgcggtggcgcgcagggtgacctgttatgccgcgtggtcgtggaaacgccggtcggcctgaacgataagcagaaacagctgctgaaagagcttcaggaaagctttggtggcccgacaggtgagaaaaacagcccgcgctccaaaagcttcttcgatggcgtcaaaaaattcttcgacgatttaacccgctaa

SEQ ID NO: 527 - DNA, 318 bp, Enterobacter cloacae
agaggcgcttcaggtggctcttgggcgaaagtactgacgacagaccagaagcgggaagccgtgatgttgatgtgtgatgcgaccggtctgtcgcaacgtcgtgcctgcaggcttacaagtttatccctgtcgacctgccgctatgaggctcaccgtccggctgctgatgcgcatttatcagggcgcatcactgaactggcactggaacgcaggcgttttggctaccgtcgtaatttggccaattgctgccccgtgaagggcttcatgttaatcataagcgcgggtaccggctttatcacctcagtggcctgggcgtaa

SEQ ID NO: 528 - DNA, 294 bp, Enterobacter cloacae; identical to SEQ ID NO: 235

SEQ ID NO: 529 - DNA, 561 bp, Enterobacter cloacae
  unsure (6)
  unsure (21)
  unsure (27)
aagggntggcaacagaacttntgccgntgttccgtcccggcggcgcccaatctgacctggtcgatggatttcgtcatggacgcactttccaccggtcgcaggatcaagtgtcttacctgcgtcgatgatttcacaaaggaatgcctgacggtcactgttgcctttgggatttcaggcgttcaggtcacgcgtattctggacagcattgcactgtttcgaggctatccggcgacgataagaactgaccaggggccggagttcacttgccgtgcactggatcaatgggcctttgagcatggtgttgagttgcgcttaatccagccgggcaagccaacgcagaacggatttattgagagctttaacggacgatttcgcgatgaatgtttgaatgagcactggttcagcgatatcgttcatgccaggaaaattattaatgactggcggcaggattataacgaatgccgcccgcactccacgctgaattatcagacaccgtctgaatttgcagcgggctggagaaagggtcattctgagaatgaagattccgacgttactaactga

SEQ ID NO: 530 - DNA, 2418 bp, Enterobacter cloacae
ggtactggaaactggcttcagaactgtaatgttgagacctctaaaaaaacagtaaccacacactatcctgattacaaagagttctactgtaactcgcctaagcaagataacttcagcagctgcacgataacccgtgatttttcagtccctgtttacatttcaggcggaaacggagacatgtcgatgtgcggcgataattgtgtgcgtatatggtttggtcgccgtgatgacaactactggagtgacggggtatatgataacgaactgacattaaaattccatccggatgcaaaattggcctcagcaaagattgttaacgcggagtgggatgaccacatgcgggtaacacttgatggcacgcagatttttgctcacatagatggtgcatatcgagaaagtgactatccggctcctaagggatcttgggagttaaaaaaatcgtggaaactcgacaaggtttacgatgtgactgataaggtcagaaaatcggtgtatgaggagcctgatcgagaagtgacaatggcatccagagtatgggttggtgggaagggtgaagggtattttgaggttgagctgacttttgaaaatatgaagctcgaagataagcacgtccaggaaccagctggttgttacgatgctgtacaagctccgaatacattctgccgtttcgatcggtttaaagatatggatgttggcacaaaacggcttccggaaagcgtgctttcattggcaaagcctctgtatgaaggtgataaaggatttcttacctggaagacaaaccttgaaggctacttttgtgatccattggccaaagacaaaatttgctcttatgacgctagtggaaaaattatgaaagacgctaatggaaaggacctctgttacaactatgaagaaataaagagtatgcctgatgcatgtagtgcttataaaaatgatgcagcatgtgtactcgataaacaaacatgtgcagagggttggttcgatgagggcactaacagttgctacatgtatgaacagaaatacacctgtgacagagggaaggatgtagttcgggaggttgaatcttctacaaatgcctgtgttggcatgatcccatgttcaggtggaacatgcgaaactgggccaaaggaagagaacaacgattttggaaaagttgcggcttattcaaacatggttcagtacatgcagggcgaagccaaatgcgaagaccctaacgatgccaattcatgttccgtctttgaaggaaaacctgaatggtgtggtcgttcagtaggctttgtaaatggcctggcaaagacggactgctgcgaagcaccacagggaaccgcaggagcacttgaaggtatcatgcttgccggatctatgatcagaaacacaaactggaccagagttaatgctcagctaataaaatggaccggcggtgatacaggtacatgggcttctatgtctaatgcggtcggagagtggactgcatcagctggtaaaacagtagggcaaatgtggaacaacgtcacgagctccttaacgagcgtatatgaaaacgtcgctggtaatctaagcagggcagttgggtcttccgcaacttctggaggggcaggaggtgctggccagttggcacaggaaacaatgtccagcttcggtataggtcagcttaagcagatggcaatgaagaaagcctacgaattgctaccagatacagttcgtgactttgtctttaagaacgttgctactaccggaggagaggttgtcttctcggctgcggttcaaaactttatgcttgcattaaacgtgatcggttggatttatacagcctatcaggtcactaaaatgcttttagaaatgttggtagcatgcgaccagaaagagatggaagcttctattcataagaatcaaaaatcctgttttacattagatacggaacgatgcgtcaaatatctgaatgttggtttcacaaagaaatgcgttaaaaaagcaacagacatgtgctgttataattccatgttgtcacgcgttattatgcaacaagcttatccgcaattaggaatagaccctgtcgcctctaattgcgtggggctatcaataaagcaaatacagcaactggatttcgataaaattgatctgacggagtggattaatgatgcagttcaggtaggagaagttcctgatcaatattcaaaattctccgaagaatcaattgtggaaaacttaccattccagaatgagaactatcaacttccatcagaacgtaccaaggaagcaatgggcggtgaagaaaatatgataaaggccagacaagaaaatgctcaggctataaaagaggaaaatgtagattgtagctatttacctcgaccggccatatgtgaggtaggttcaactacgctggatccggttacgggcaagcagttgccgaaatattga

SEQ ID NO: 531 - DNA, 1680 bp, Enterobacter cloacae
  unsure (1654)
ttattaaaacgaagtaatgaggttgaaatgggtaagccaacagaagagcaaagacctgttatcgagaatgctagcgcaaacaatatggtgatagcagcgcctggatcaggcaaatcgttcaccatgatagaagcggttatatcgattctcaaaaagtatccatatgcaagaatcgggatggtgacctttactcgcgctgcaacaaacgcacttgcagcaaagttacaaaagcgattgagcaagaaggatcttgaccgggtgctggtggatacttttcacggactcgttaagaagcaactggacatgattcgctggccgggaaagatgttgatagggccagcacagagatctgtcattcaccgggctttgaaagaatccggtgtaacgatgaagtttgctgaagctgaattcgttattgatgctatcggcagagaaatggatacggatgtgatttcagttcggcataacagacaacagatccatttgtttaatacctatcaggcgttatgccagaaagaccatgtggcggacctcaatgctctttcaaaatttgttgtcggtcaaatgcattcgggaaaaatgcgcacgttagatttgacacatttgatagtagacgaagttcaggatactgactctatacaattctcatggatagcattgcatacaagagctggagtctatacgagtatagttggagacgatgatcaggccatctactccttcagatcctcaggaggagtcaaaatatttcaacagtttgaaaaacacttcagacctaacatattttacttaaacacatgctttaggtgtgaacctgaaattttagaggtggccggagcactgataggaaagaatgtttaccgttatgccaaagagttacgctcggcaaaaaagggagggggaaaggtcacttttcgttcatatgtagatatggaggaacagatacagggtattttaagccttataaatcaggatccacatggatgggcaattctaagccgcaataatgctcacttggatgagctagaaagtttgatcgaacagccagtaattcgttacggaggtaaatcattctgggatgaaaaagaaacaagcgatgtgttaagccttatggcctttttccgacaatcaaatgatcctcgcttaatgaagagagtattggcattgtttggagaacaggaatcagttttggatgaagtggcattgagtatgagaggaagaaaagttacttttggcgaccttgccatcccggaggacagttctctcgaaacaaaaacattacattcaaacttcgtgcgctttacccaggaaagttctgataaagttgagatagcaaaacgtttcgccaaccttacgaaatggatggaatcgtcgtcaatcaagatgaggagtaataaaggtacagcaaccttaacaaaaattgctttagacacttgtaaacagtgggcagaaaagactggttggatgaatatgataaatcgtgctgctgcaatgtcattaggccctaggaagaaagacgaggaatacagcccagagaaagtagtcctatcaaccttgcatggttcaaagggtcttgagtggaataaagtaataataatgagttgtaatgcggatcagataccaagtaaaagatcagttggggaggaggcaatanaaaaagaaagacgtttgctttatgtt

SEQ ID NO: 532 - DNA, 321 bp, Enterobacter cloacae
ttaaaggtatatctcatgaaaaaaacgacttcacgtaaggcggcccgccgtccggcaaaacacactgacctctatcgccagataaccgaccgtatcgttgtcgcgctggaaaacggcgtcgcgccctggcgtaagccgtggcgcgcggctgccggcagcggtctggccggtctgcccctgaatgccacaaccggacgtcactatagcggtgtgaatgtcctgcttctctggatgtcagcggaagaacagggttttcgcaataaccgctggctgacttaccggcaggcgcagccaggccggcggccaggtgcgaaagggtga

SEQ ID NO: 533 - DNA, 900 bp, Enterobacter cloacae
atgtccagattcagtaaacagctgtgcaaacaactcgtcactcttgctcgtcaggggaggggaagttataaaacggtggctgaccgttcacgaattgcagaacggttttctgaacgtttgtctgaactgaatattcagatcagggacgtaaaacatattaaaacttcccatattgaaaagtatattgagagcaggaaggcagacaatttgtctctaaggacgttacagaatgagatgtctgctatccgttctgttttattatcagcaggaagaaataaactggccgatcccagtcacattaacctgagtaatcaggcgctcggtatttctggtgctaaccgggatggaactaaacttcctattacagacgaaaaacttaatgctgtggtcagttttgctcaaagaaaagatgaaggcgttgctcttgctgtgcaactttcccgatatctcggattgagaacacaaaaaaccgtgcagtctgcaaagtctttaaagacatggaggcaggcactgattaataatcatgaacgtgttcgcgttgtatttgggacgaaaggtgggcggccgagagagacaacagttttcaatcgtgaaaaagttttatcaattcttgataaggcaattcattatgtcagtgaacataacggaaaactgattgataatccttctctgcattctgctatagatcgttaccgaaatattgtacgagaggcagggatgaatggtaaaaatgccccacatagtttgcgttacgcttattcacgtgatgctgtaaatcatcatattaaaaatggaatgagccgcgacgaagctgaagcattagtctctatggatttggggcatggagatggtcggggtcgttatattaaacaggtttattttcgtggagaggctgaataa

SEQ ID NO: 534 - DNA, 729 bp, Enterobacter cloacae
cttaccggcaggcgcagccaggccggcggccaggtgcgaaagggtgagaaagccaccctggcggtggtttataaggactggacgaaacaggcggaggaccgcgagggcaaccgcctttatgacagcgacggcaaaccgctgacggaaaccgtgccgatgcttaaacccctgcagctgttcaacgctgagcagtgtgaggggttgccggcagaggttgcggcttcacctgagcaaccgccggcggtggatgaggacggcatactcagtccggacgtgatggacagggtgctccggatggttaacgccacaggggttaaacaccggatgctgcctcagaaccgggcttattaccgcccgctgacggatgaaattgtgatgccggtggcagggcagttttttacggaagcggactggtggtccacgctgctgcatgagctggtacatagtaccggtcatacaaagcgacttaaccgggaggggataacatcctcatcccgccagttcggggacccggtgtatgcctttgaagagctcattgccgaaatgggcagtgcgtttttgtgtgctcagctcggcgtgtccggtgaggttcagcacgacagctatgtggaccactggctcaaggtgctgaaatctgacaaaaaggccctgttccgcgcctgccggcatgcacgggaagcgtcggaatacctgctggcactgcctggacgtcagactgtggcggcgtaa

SEQ ID NO: 535 - DNA, 192 bp, Enterobacter cloacae
gaatacttcgcggaccgtcagctccgtggtgaagacatacaagaactggaacaccagtctggcaaattggccgattgggtcagggatctactgtgtaggaaaagcaactttgtcgtcacttgtgctctggcaaacaagctggccagaatagcctgggccctaacggcacgacagcaaacttatgtagcataa

SEQ ID NO: 536 - DNA, 480 bp, Enterobacter cloacae
cggaacgatattgatttcggacttgagctcgcgacgacctcgtccacgcgatctggccatggtttaccccttgttgctctcggtgctggtaaacgcctgacgatgcagaatcgcggtgaactcttccataaagttgtcgtagttcagttccagtttgttcacgcgctggttcagacggttgtacgccattaccgccggaattgcggcgaacagaccgattgcggtcgcgatcagtgcttctgcgatacccggtgcaaccatctgcaacgttgcctgcttcaccgcccccagggcgataaaggcgtgcatgatcccccacaccgtaccaaacaggccgatatacgggctgatggagccaacggttccgaggaaaggaatatgcgtttcaagattttccagttcgcggttcatggagatgcgcatcgcacgcgacgccccttctaccacggcttccggcgcatggctgttagcgcgatgtaa

SEQ ID NO: 537 - DNA, 450 bp, Enterobacter cloacae
cgaagtttgaaagctccaacttttcttgtattaccgggatgtaaagtgaatacaacgctgtttcgatggccggtacgtgtctattacgaagataccgatgccggtggtgtggtctaccacgccagctacgttgccttttatgaacgggcacgcacagagatgctgcgccatcatcactttagtcaacaggtgctgttggctgagcgagttgccttcgtggtacgcaagatgacgcttgagtattttgcgcctgccagactcgacgatatgctcgaagttcaaacagaaattacatcaatgcgcggaacttcattggttttcacgcagcggatagtcaatgcagagaacacggtactgaactcagctgaagtcctgattgtctgtgttgatccaaccataatgaagcctcgtgcgcttcctaagtctattgtcgcggagtttaagcagtga

SEQ ID NO: 538 - DNA, 1128 bp, Enterobacter cloacae
ctcagcctatttgatcatctgcgtagtttttgggaaccgatagtgtcaaaggcaaccgaacagaacgacaagcttaagcgagcgataatcgtctccgcagtgctgcacgtatttctttttgcagcgctgatctggagttcgttcgatgagcaccttgatgcatcaggcggcgatgggggctcgtccatcgacgccgtcatggtggatcccggtgcggtagtgcagaactataatcgccagcaacagcagcaggcgagcgcaaaacgcgcggaagaacagcgtgaaaaacaggcgcaacagcaggcggaagagctgcgtgaaaagcaggccgccgagcaggaacgtctgaagcagcttgagaaagagcgtttgcaggcgcaggaagccgctaaagagcaggcggagcagcagaaacaggctgaagccgcagcgaagaaagctcaggaacagcagaagcaggcggaagaggcggcagccaaagccgcggcagacgcgaaggcgcaggcagatgctcaagctaagttagccgcagaagccgcgaagaaagctgctgctgatgcgcagaagaaagcggaagccgaagcggcgaagaaagccgctgctgatgcgaagaagaaagcagaagccgaagcggcgaaaaaagctgccgctgacgcacagaagaaagccgaagcggaagccgccaaaaaagctgcgcaggaagcagagaagaaagcggctgccgatgctgcgaaaaaagcggccgccgccgagaaagctgcggcagaaaaagccgccgctgcggaaaaagccgctgcggaaaaaaaagcggcagctgagaaagccgctgctgataagaaagctgctgctgaaaaagccgcagctaagaaggccgctgctgcggaaaaagccgctgccgcaggggttgacgatctgctgggcgatctgagctccggtaagaatgcaccgaaaacgggcggaggggcgaaaggaagtaacgcagcaccggcaggaagtggtaacactaagaacaacggtgcttctggcgctgagatcaacgactataagaatcagattgccgcggctattgccagcagacttaacgataaatcggtcttacaccgacggggatggaaggaagagccctcc

SEQ ID NO: 539 - DNA, 1515 bp, Enterobacter cloacae
agattcctgtttgtgccgctgacgctcggtatggcgttcctgctggccatcatggaaacggtttacgtcctctccggcaaacagatttataaagatatgaccaagttctggggcaagttgtttggtatcaactttgcgctgggcgtggcaaccggtctgaccatggagttccagttcgggacaaactggtcttactattcccactatgtgggggatattttcggtgcgccgctggccattgaaggtctgatggccttcttcctcgaatccacctttgtaggtctgttcttcttcggttgggaccgtctgggtaaagtccagcatatggcggtaacctggctggtggcattaggctccaacttgtccgcactgtggatcctggtggcgaacggctggatgcaaaacccaatcgcatctgatttcaacttcgaaaccatgcgtatggagatggtcagcttcgctgagctggtcctgaacccggttgcccaggttaaattcgttcacaccgtggcgtctggctatgtgtgcggcgcgatgttcgtgctgggcatcagctcctactatatgctgcgcggccgtgacttcgcgttcgccaagcgttcttttgctattgcagcaagcttcggtatggccgcgattctgtccgttattgttctgggtgatgaatccggttacgaaatgggcgacgtgcagaaaaccaaactcgccgcaattgaagctgaatgggaaacccagccggcaccggcagcgtttaccctgttcggcgtgcctgaccaggaagcgcaggaaaaccgcttcgccattcaaattccttacgctctgggtattatcgccacgcgctccgtcgacaaacaggtgactggcctgaaagatctgatggtgcagcatgaagagcgtatccgtaacgggatgaaagcttactcgctgctggaacagctgcgcgccggctctaccgaccaggccgttcgcgatcaatttaacgacgtgaagaaagacctcggttacggtctgctgctgaaacgctataccccgaacgtctctgacgcgacggaagcgcagattcagatggcaaccaaagactctattccacgcgttgcgccgctgtacttcgcgttccgcatcatggtgggttgcggcattatcatgctgctgatcatcgcggcctcgttctggtcagtcattcgtaaccgtatcggtgagaaaaaatggctgctgcgcaccgcgctttacggtatcccactgccatggattgctatcgagtccggctggtttgttgcggaatatggccgtcagccgtgggcgatcggtgaggtgctgccaacagcggtagcgaactcctccctgaccgcaggcgacctgatcttctccatgctgctcatttgcggtctgtacaccctgttcctggtggctgaactgttcctgatgttcaagttcgcgcgccttggcccaagcagcctgaaaaccggtcgctatcactacgagcagtctgttgcgactactcagccggcacgctaa

SEQ ID NO: 540 - DNA, 1155 bp, Enterobacter cloacae
gacaggagtcatcaaatgatcgattatgaagtattgcgttttatctggtggctgctgatcggtgttctgctgattggtttcgcggtcaccgatggtttcgacatgggcgtgggcatgctcacccgtttcctcggtcgtaatgacaccgagcgtcgaatcatgatcaactccatcgccccgcactgggacggtaaccaggtgtggctgatcaccgcaggcggcgcgctgttcgctgcctggccgatggtctacgcggctgcgttctccggcttctatgtggcgatgattctggtgctggcctctttattcttccgtccggtgggtttcgactaccgttccaagattgaagacacccgctggcgtaacatgtgggactggggcatcttcatcggtagcttcgttccaccgctggtcattggtgtggcgttcggtaacctgttgcagggcgtaccgttccacgtcgacgaatatatgcgtctgttctacaccggtaacttcttccagttgctgaatccgtttggtctgctggcgggcgtggtgagcgtggcgatgatcatcacccagggcgcaacctatctccagatgcgtaccgtaggtgaactgcacctgcgttcccgcgctaccgctcaggtggcggcgctggtgacgctggtctgcttcgcgctggctggcgtgtgggtggtgtacggtattgatggttacgtggtgacctccgcgatcaaccatactgcaccgtctaacccgctgaccaaagaagtggcgcgtcaggccggtgcatggctggtgaacttcaacaatactcctgcgctgtgggctatcccggctctgggtgtgctgctgccgctgctgaccgtgctgacgtctcgtctggagaaaggcgctctggcgttcgtattctcttcactgacgctggcgtgcatcatcctgacggcggggattgcgatgttcccgttcgtgatgccatccagcaccatgatgaatgccagcctgaccatgtgggatgcaacgtccagtcagttgacgctgaacttaatgacctatgttgcttgcgtgttcgtaccgattatcctgctctacaccacctggtgttactggaaaatgttcggtcgcatcactaaagaacatatcgaaagcaacacccactctatgtactaa

SEQ ID NO: 541 - DNA, 303 bp, Enterobacter cloacae
agaaaagcactaatgaatattatcgcaaccttatatgcggtaatggataagcgccccttgagggcgctttccctcattatggcattactgctggcaggctgtatcttctgggacccgtcgcgcttcgcggcgaaaaccagcgagcttgaaatctggcacggcttcctgattatgtgggcggtgtgcgcaggcgtgattcacggtgtcggctttcgtccgaaagcgctacactggcagggcatcttctgcccactgattgccgatctggttctcctcgccggtttgattttcttcttcttctga

SEQ ID NO: 542 - DNA, 696 bp, Enterobacter cloacae
gcagtgactgacatgaatatccttgatttgttcctgaaggcaagccttctggttaaacttatcatgttgattttgattggtttttcaatcgcatcctgggccatcatcatccagagaacgcgtatccttaatgccgctggccgcgaagccgaagcgtttgaagataagttctggtcgggaattgagctttctcgtctgtaccaggaaagccagggacgccgtgataacctttcaggctccgaacaaattttctacagcggtttcaaagagttcgctcgcttacatcgcgctaacagccatgcgccggaagccgtggtagaaggggcgtcgcgtgcgatgcgcatctccatgaaccgcgaactggaaaatcttgaaacgcatattcctttcctcggaaccgttggctccatcagcccgtatatcggcctgtttggtacggtgtgggggatcatgcacgcctttatcgccctgggggcggtgaagcaggcaacgttgcagatggttgcaccgggtatcgcagaagcactgatcgcgaccgcaatcggtctgttcgccgcaattccggcggtaatggcgtacaaccgtctgaaccagcgcgtgaacaaactggaactgaactacgacaactttatggaagagttcaccgcgattctgcatcgtcaggcgtttaccagcaccgagagcaacaaggggtaa

SEQ ID NO: 543 - DNA, 432 bp, Enterobacter cloacae
accatggccagatcgcgtggacgaggtcgtcgcgagctcaagtccgaaatcaatatcgttccgttactggacgtgctgctggtgctgctgctgatctttatggcgacagcgcccatcatcacccagagcgtggaagttgatctgccggatgcgacagaatcacaggcggtaagcaccaatgacgatcctccggtcatcattgaggtttccggcgtagggcagtacagcgtggtggtagagaaagatcgtatggatcagcttccgccagagcaggttattgctgaagcgcaacgacgtctggagtcaaatccgaagacggtcttcttaatcggtggtgcgaaagacgtaccatatgatgaaattatcaaagcgctgaacttgctacatagcgcgggcgttaagtcagttggcttaatgactcagcctatttga

SEQ ID NO: 544 - DNA, 903 bp, Enterobacter cloacae
ttaactcagtatcatgtgatacgcgatccccgggagcatattttgaacaggttaccttccagcgcctcggctcttgcctgtaccgcgcacgcactgaatctcattgaaaagcgaacgcttgatcatgaggagatgaaacaacttaaccgtgaggtcattgattactttaaagagcatgtgaatcctggttttctggagtatcgcaaatctgttaccgccggcggggattacggagccgtagagtggcaagcgggcagtctgaatacgcttgtcgacacccagggacaggagtttatcgattgcctgggtggttttggtattttcaacgtggggcaccgtaatccagttgtggtttccgccgtacagaatcaacttgcgaaacaacctctccatagccaggaactgctcgatccgcttcgcgccatgctcgcgaaaacgctggcagccttaacgcccggcaaactgaaatacagcttcttcagcaacagcggcaccgaatcggtcgaagcggcgattaaactcgccaaagcgtaccagtcgccacgcgggaaatttacctttatcgccaccagcggcgcgttccacgggaaatccctgggcgcgctgtcggcgaccgctaaatccactttccgtaaaccgtttatgccgctgctgccgggcttccgccacgtaccgttcggcgacatcaacgccatgcgcaccatgctcggcgaatgccgtaaaaccggcgacgacgtggcggcggtgatcctggagccgattcagggtgaaggcggcgtgatcctcccgccgcagggctatctgcccgccgtgcgtcagctgtgcgatgagtttggcgcgctgctgatcctcgacgaagtgcaaacccgggatggggcgcaccggcaagatgttcgcctgtga

SEQ ID NO: 545 - DNA, 576 bp, Enterobacter cloacae
tcctcgacgaagtgcaaacccgggatggggcgcaccggcaagatgttcgcctgtgagcatgagaacgttcagccggatattctgtgcctggcaaaagcgctcggcggcggcgtgatgccgattggcgcaacggtcgccactgaagaggtgttctcggtgctgttcgacaatccattcctgcataccaccacctttggcggtaacccgctggcctgcgcggccgcgctggcgaccatcaacgtgctgctggagcaaaacctgcctgcgcaggcggagcagaaaggcgacatgctgctggacggcttccgccagctgggccgggaatacccggatctggtacaggatgcgcgcgggaaagggatgctgatggcgattgagttcgttgataacgaaaccggttatagcttcgcaagcgagatgttccgccagcgggtactggtggcgggaacgcttaacaactcgaaaaccatccgcattgaaccaccgttgacgctcaccattgagcagtgtgagcaggtgctgaaggcggcgcgtaaggcgctggcggcgctgcgggtgagtgtggaagaggcgtaa

SEQ ID NO: 546 - DNA, 606 bp, Enterobacter cloacae
ccaatgactgataaagtcaatataatgaccgatgcgggtgccgatgttgcccaggtaagcctggccgtcgcgaaccgtatccgcagctggcggaaagagaaaaaactgtcgctggacgagctttctcgccgcgccagcgtcagcaaaggcatgctggtagagatcgaaaaaggggctgccaaccccagcattgccattctgtgtaaactggccgccgcgcttggcgtctcggtggcagatatcgttaacgtctccagcgagccgcagatacacattattcgggaagaggcgatcccggttctgtggcagggcgcacagggcggttacgccagattgctggcaggcaccgcaggcccggatatgattgagctgtggcagtgggagatgcatccgggagaaacgttcacctctccgggacatccggcgggaacgtttgagctgctgcacgtgaacgaaggcatgttaaccctgacggtggacgagacggtaacgcaggtagctgccggggcgtcggcggtggcgaaaacggaagcggcgcacggctatgccaatgaaagcgataccgtgcttcgcttcaccatgacggtggcagagtttcaccgataa

SEQ ID NO: 547 - DNA, 414 bp, Enterobacter cloacae
atactgaactcttcagagcagacggttaatcttggccagtaccgtaccgcgaaattcactaaagtgggtgacaccacctccaatattccgttcaccatcgaactgaacgactgcgatcctgcggtagcgaaaaccgctgctgtcgcgtttaccggccagatcgacgccaccgacaaaacgctgctggcggtaagctccggtaacaacgacaactccgcgaagggcgtaggtattgagatcctcgacagcaaatcctccacgctgaccccggacggcgcaaccttctctgcggcgcagaacctgattgaagggactaacaccctgaacttcaccgcgcgctacaaagccacggcggcgaccaccgagccaggccaggcaaacgcggacgcaacattcgtaatgaaatacgagtaa

SEQ ID NO: 548 - DNA, 612 bp, Enterobacter cloacae
tgcctgagtacagggatgtggctggcctcagggaagaggtcttttgatcgcctataccgggagcgaaggatgacaaggactgggatactgctgtgcgcccttgcgattgccccagcggtaaacgcacataccgtggttattgacggcggcaaagtacacctcaggggagagctggttaacggcggttgcgccgtggctccggacagccagaatatgcgcgtggatatggggcaataccgcacaaacgccttttccggcgtcggcagcttttccacggttaatgtgcctttcaccgtacgtctgctggattgcagcgtggacgtctcccgcaccgtggggatccagttccagggagtgacaccggcagaagacccgcaggttttcctggcgacatcgcggccgggggaaaatgcggtcagcagtggtgtcgggctggcgctttttgacgaacagcaacgtcagatcatcccgaacgcgacggcggtgagctggttacccattaacacccgcgagctggtatttcatttcagcgcccgctaccgggcaatttccgaacaccttgtcccaggcactattcagtcgaatgtctggtttacgttgatttatccctga

SEQ ID NO: 549 - DNA, 2586 bp, Enterobacter cloacae
cgtcagcctgtgagcagagacagggcgatgaacactcaatggcgttactgcccggttgcgctggcactgatggcaacgctctggccactcgctggctggggcgaaagctactttaacccggcgtttctctccgatgacacggcgaacgtcgcggatttgtcgcgttttgaaaaaggccaccagcaggcaccgggcgtctatcgcgtcgatatctggcgtaacgatgagtttatcggcacgcaggacgtgcggtttgagcaagctgacaacacgccgccggtcgcaggcggtttgtcgccgtgcattacgcgcgcgatgctcgatcgctttggcgtcaatatcgccgccttcccggaactgagcaacgtgcagggcgatacctgcgttccgctcacaacggctattccgggcagcgaagcggcgttcaacttcgcctcgttgcgcctgaacgtcagcctgcctcaggtggcgatgcaaaacagcgcccgcggatatattccgcctgaacagtgggatgaaggcatccctgccgcgctgctgaactacagctttaccggcaaccggggcagcgacgacgacagctactatctgaacctgcaaagcgggttgaactatggcgcctggcgattacgcaataacggcgcgtggcgttataccgaaagcaacggccagcggcacagcagctggcaaaatattggtacctgggcgcagcgtacgatcatcccgctgaaaagcgagctggtgcttggcgacagcaacaccggtaacgatgtcttcgacagcgtcggttttcgcggtggtcgcctctattcgtccgacagtatgtacccggacagtctgcaaggttacgcgcctaccgtacgcggaatcgcccgcacccctgccaaagtggtgatccgccagaacggatacgtgatttaccagagctatgtgcagccgggggcttttgcgataactgaccttaacccgacctcctcaagcggtgacctggaggtgacggtggaagagaaggacggcagccagcagcgctacaccgtcccgtattccaccgttccgctgctccagcgtgaaggacgctggaaatacgatctggtggcaggggactatcgcagcggcaacagcgagcaggacacgccgttctttactcagggtacgatgattgcgggtcttgccgacggctacacgctgtacggcggaacgcagctggcctcgcgctataccgccatcgccattggcgcgggtaaaaacctcggtgactggggggcggtttcacttgatctcacccatgcccgcagccagcttgccgatgatagccgccatgaagggcagtccctgcggttcctgtacgcaaaatcccttaacggattcggcaccaacttccagctgctgggctatcgctactcgaccaaaggcttctacaccctcgacgatgtggcctggcgcacaatggaaggctaccagtatggcgacgatcaggacgatgacggcgtgccggacgtgcagagctatcacaacctgacgctgaataaaaaagggcgtttccagctcaatatctcccagtctcttggcgattacggctcggtgtacgtgtcgggcagccagcaaaattactggggcaccagcgaatccaacgtctggtatcagctcggctacgcgggcggggtgaaaggggtcagctacgccttatcctggtcgtggaacaaggccgtcggcattgatggaaccgaccggatcgcctcgttcaacgtctccgtcccgttcagcctgttcacccgtcacggctaccgtcgcgataacgcgatcgatcgggcctatgccacggcctctgccagccgtaacagcgacggtgataccagctggcagaccgggatcagcggaacgctgctaaaagatcgtaacctgaactacagcgttacgcagggccacaccagcaataacggtgccagcggcagcgccagcgctaactggcaggcaacgtacggtacgctgggcgtgggctacaactacacgcgggatcagcacgacctcaactggcagctttccggcggtgtggtagggcattcagacggcatcacattcagtcagccgctgggcgataccaacgtcttgatcaaagcgccgggcgcgtcaggcgtgagcgtcgaaaaccagaccggtgtcaaaaccgactggcgtggctatgcggtgatgccgtacgccacggtgtaccgttacaaccgcgtggcgctcgacactaacaccatgagcaacaacaccgacattgaaaataacgtttccagcgtcgtgccgacgaacggtgcgctggtgcgcgccagttttgacacccgcatcggcgtgcgcgcgttgctcaccgttaagcgtgataaccagcctgtgccgtttggggcggtggtgcgtgagacgcagagcggcgtaaccagcatggtgggagatgacggtcagatttacctgagcgggctgccactgagcggggagctgctgattcagtggggagacgggaagcagtcccagtgtcgtgcgccctacagcctgccagaacagagcctgcaacaggcgatcacacttaaggggatccgctgtgaataa

SEQ ID NO: 550 - DNA, 738 bp, Enterobacter cloacae
tttatccctgacgcctgcgaactaattattaaaggtacggttgtgatgaacaccctgattaaacctggactgtttttatcttttattttgatgatggtttctgccagcacgaatgcgtccggcggaattgcgctgggtgcgacgcgcgttatttatccggccgatgccaaacaaacgtcgctggcgatcaccaacagcaataaacaagagcgctatttaattaacgcgtggatagaaaatgccaacgggcaaaaggaaaaaacctttgccgtcacgccgccgctgtttgtcagcgagccggccagcgaaaacaccctgcgcattatctacgcaggcccggcgctgcctgccgatcgcgaatcgctcttttacatgaacgtcaaagcgattccctccgtcagcaaaaaacatcaggacggcaacaacgtcctgcaactggctattctgtcacgtatcaagctgtttgttcgcccggctaacctggcgatgccgccggaagaggcgctctcacagctgcgctttgagcgcgtcggcaaccatcttaaggtgagcaatgcctcaccgtattacgtcacgctggtcaatctgaagctcggcggacagacgctggataacctgatggttgctcctaaaagctcggcgcagcaggtgctgcctgccgctacgagcggcacgctctcctggcagagtgtgaatgactatggcgccattacgccggcgcgtagcgtcagcctgtga

SEQ ID NO: 551 - DNA, 1104 bp, Enterobacter cloacae
ttcagtggggagacgggaagcagtcccagtgtcgtgcgccctacagcctgccagaacagagcctgcaacaggcgatcacacttaaggggatccgctgtgaataaaatccattatctggggctatccctgctggcatttttgccgctatctcaggcgttcgccaccgtctgcgtcaatgaaaatggcgtgccgacggaggtgtattacgacctgacggataaattcaacagctccaataaccaggtggggcagattgtcacactcagcgagaagtctcagtgggtgggtgttaacgccgtctgtcctaagggaacgtccgggaacaccaccaagcgcagctatgttaccgattacccggtcacgggcaccagcgatggctaccagtatctgaagcttaacgactatctggacggagcgatgaaaatcaccgacagctacgctggcaccttctatccacccagaaagtacattcagatggggagccatccgaacgtgtctaaaaacaaaccgtttggtgtacaggattccagcctcgtcttccggcttaaggtgacccgacgctttatcaatatggtagtgatcccccgggcgaccatgttccgggtttacgtcaccacgacctcctcggatccgctcaccacgccggtttataccatcagctacagcgggaccattcaggtgcctcagagctgtgaaattaatgccgggaatgtggtggagttcgatttcggagacatcggcgcctccctgttcagtaaagcgggcattgggaataagccggaggggatctcagcgcaaagcaaaaccatcggcataaaatgcaccaacgtcgaggcgaacgccatgctcacgatgcgtgttgaagcggagaaggtttcaggcagtacgctggtttccgataacgcggatgtgggttttgtgattgccaacagtaatggcgtgccgctgacgcccaacaacctgaccagcaaaatcccgttccgtctggacgacagcgctcaggcacaggtggggatccgcgcgtggcccgtcagcgtgaccggtaaaaaacctgccgaggggcgttttacctctcgcggctatttacgcgtcgactacgactaa

SEQ ID NO: 552 - DNA, 240 bp, Enterobacter cloacae
acgtatttcttattcccgaatatgcgcgggaagggttatttacattttaaaggaatagacatgaaactcagcaacattgcttctactgttattgcaactctggccctggtcgcgggtgccgctcacgcagaagatccggtagcgcctgtatctgtaaacggtggtacggtgcattttaaaggtgaattagtgaatgccgcgtgttcagtgaatactgaactcttcagagcagacggttaa

SEQ ID NO: 553 - DNA, 498 bp, Enterobacter cloacae
ccgtcgcgatgctttgcgctttgctcccctgcacacgcagagatggcgcttggggaaattaacattcagttatacggcaatatagtggattttacttgcgtggcggagggggacgacagcaataaaaccgtcacgatcggcacttggcccacgaaacagctccgcacaacggggagccggacgcagcctgtgctgttcaccctgaagctgaccggatgcccgccgggggcagcttcggtcacatttacggggaagatggacgggcatgataacagcctgctggcgctgaatgatgccagcgcggccagcaacgtgtccgtggagatccttgaccgggataaaacgcgcctcgcgttgcagcaggccagccagacggtggcggtggatgcgcagggaaatgcagaactgtcgttttatgccaattatatcgccacggcggataatccgcagccgggccgggctgacgccgatgcaacgttcatgatcaattataattaa

SEQ ID NO: 554 - DNA, 503 bp, Enterobacter cloacae
  unsure (273)
gatacttgcgaatattcccacggttgatcccgcttttcagtgatttaaatcaattgctttcatcgcgtttggtagtgaacattgaaacccgcgcttccccgatcattgacttgctggaccgattacgccgccacagcctgttggccccgtacctgacaccatacatgtttttccgcgccgatgattatgatgctcgcttgttttgtaaagcggctggcccttttcatgtgcttgcacgccagcttacggcgttggatatgcaacaaaccttgntggaagcaccggcacccgccggcaaccgcaaagagtggttttcacgggatgaatggccgatcttacaggcgttgtcacagggtagctccttgcgtcagatcgcgcagttacagaaccgcccatatagctgcattatttacagtctcagctgcatcctggcgaaacttggactgaattatcgtcatgagttgctacatcttctcaacaacctctcagatttcacgtattaa

SEQ ID NO: 555 - DNA, 276 bp, Enterobacter cloacae
cagcggcgctcgcttctgacaaaatacaggcaatcccccctttctaacgttacagacggaatcttctctctgatggcagcaaagattattgacggtaaaacgattgcgcagcaggtgcgctctgaggttgcggaaaaagtgaaggcgcgtaaagccgccggatttcgcgcccccgggctggccgttgtgctggttggcagcaacccggcttcgcaaatttatgtcggcagcaaacgcaaagcgtgtgaagaggtggggttcgtctcccgctcttag

SEQ ID NO: 556 - DNA, 636 bp, Enterobacter cloacae
aaaatgaaaccggcatccgttatcattatggacgaacaccctatcgtcagaatgtcgatagaagtcctgctacagaaaaataaaaacatccaggtcaaactgaagtcaggcgacagccacgaagtgcttgactgtatacgcaaccaccccattgacctggtcattctcgatattgaaatgacggacacggatgggttcgtattactgaaaagaatcaggaacttaaataaagacattaaggttcttttcctctcttcaaaatctgaagccttgtacgcaggacgcgccatccgcgccggggataatggttttgtcagtaagcgaaaagatctgggggaaatttataacgcggtggaaatgatactgacgggctattctttcttcccttcagaaacattaagttttataaaccatctgggctcgcggacgggcgccgctgtggatatgccattatcgaatcgtgaagtgacggttctgcgatatctggcgaacggattatctaataaggagattgcggatcaattattacttagcaacaaaacaattagtgcccataagtctaatatcttttccaagctgggcgtgcaaagtatcgttgaattaattgattacgcgaaagcgcacgaattactgtaa

SEQ ID NO: 557 - DNA, 753 bp, Enterobacter cloacae
cactcaatgaacttgcagacatacgagtcgacttcagcgattacgatgtcagcgatatcgaacgcgatattgaacgggttgagtcccttacgcgtgacgataccgatgacgggggttgagtgggcggataaatatttctatttaccggaaggttcaagccacatcgccggtcgctggaagacacaacccgttcagctggcgatgctgaacatgatgacaaacgatgcgatcaaaatcgtatctatccgtaaatcagcacgcctcggctatacaaaagtgatggtcgttgcgctgctgtattttgcagagcataagaagcgcagctcggtcgcataccagcccgtagatgatgaggctgaagggttcgtatctgatgaaatagatccggcgatctgtgagatgccggttatacaaaaaatattcccggattgggacagcagcaacgaacggaacaatatcaaacgaaaggaaatgtcaggcgcaatcctggattttcgcggagcaaatagcccagggaattttcgtcgcttaactaaacaggtcgtcgccggtgatgaagtcgacggctggccgcttgaagtctcgaagaaaggcaagggcgaagggtcgccgattgaactggctctggtacgtattaagggcgcgtcatacccgaaagccattttcggctctactccgaccgttaccggcaaaagccagattgaaatgctcgaggatggcgccgatctggtcttccggttttatctgccttag

SEQ ID NO: 558 - DNA, 333 bp, Enterobacter cloacae
ggagcagttatgacaacagaaagctgtcagccggatgattttttcgtcggtcctgacgtgacaacaactaccggtatcatggcttcgggtgtgaatatcgcgaaatatacacccgtcatgattgatgcaactgccgggacttttaaatcgtgggatggtacgccaggaaaagcagtgggtattacagcaatggcagtcaatgccagcgctggccaggtcgagttttcgtactacaacggaggcacattccgtgccagttatctgaactggtcagctgatgcggtgaagcgaaaatcagcatttgccggaacgccggtgagcatccaggaataa

SEQ ID NO: 559 - DNA, 540 bp, Enterobacter cloacae
ctaaacaggtcgtcgccggtgatgaagtcgacggctggccgcttgaagtctcgaagaaaggcaagggcgaagggtcgccgattgaactggctctggtacgtattaagggcgcgtcatacccgaaagccattttcggctctactccgaccgttaccggcaaaagccagattgaaatgctcgaggatggcgccgatctggtcttccggttttatctgccttagcgcgcaggcggcgtcaaatgagctggctcgcgtaatgtcgatcatcggctgtgaagaagcgaaagggcgcgagcagcaggcgcatgcgcttgccgcgattcctggcatgacgctggatcaggctaaagcggtcctggcagcagcgccgcaaaccgcccaggcgcgcactgaaacagcgcttgatgcgctgatgacaaaagagtcgccggaagcggtggcttatatgcccgctcaacacaatcactctgcagacggttctgcagcgaaaatttcactcctggttcaagcaggtaaatcacttattgaggagcagttatga

SEQ ID NO: 560 - DNA, 1035 bp, Enterobacter cloacae
atgagtgattcatacactacgcaggaactgatcgcggcaacgcagcaagtttttaaattccagccgcttttcctgagcctcttttttaaagagacgtatacgttcgatactgaagacgtttttctcgacaaaattcccggcgaagtgtcgatggccgtttactgttcgccactgatcacaggcaaagtcgacagaacgcgtgggtttaaaacgacgcacttcaaacccggttatacaaagccgaaacacacagtcaatccgcataccgtcatcaagcggtctgccggtgagcatatcggccagcctaaaacgcctgcagaacgtcgcgcagaaattattatgcaaaacctgaaggatgaagagctgtccattcagcagctggaagagtaccaggctgtgcaggccgtgttgaaagggaagtacacgatctccgggccgaatatcgatacgacggaaatcgatatgcagcgcagcgttgcaaataatatcgtgcagtcgggcagcactgcatggtcagcacaaaacaaggacacattcgatccgagcaacgatatcgaagagtatgcagagcatgcctccggcacgatcaacgttatggttctcgatggaaaggcctggaagacgcttaaaagcttcaaactgttccgtgaagcgctggatacgcgtcgcggctcgaacagtaagctcgagctggctcttaaaaacctgggcgacgtggtgagctttaaggggtactacggtgacacagcggtgatcgtctataagggccagtacattgacccggatacaaaagccaaaacgaaatatatgcctgacaacacgatagccctgggtaatttacagtccaaaggttatcgcacttatggcgccgttcaggatgaagatgcgcttcgtgagggtattacagaagcgacccgctatccgaagatctggactactaccggcgacccgtcaatcactcagactatgacgcaatcagcgccagcaatggtcctggcagacgctgacgcgtttgtcattgtaaccctcgcataa

SEQ ID NO: 561 - DNA, 444 bp, Enterobacter cloacae
gagccgaaaggctcttttttatacccggagacaaaaatggctaataaaacagaactgctggcgcgtatcagtgatttaagcgcgcagctggggcgtgagctttcaacaactggcacaaatgaggcgctgcaggcggttatagacagtgctgaagctgagctgaagctactgaatgaagatgacggcgaaacgctgcccctgcagccgctgccgggtgggtcaaattcaggaacgctgctgactgccagctctcctgacgaaaatgatgaagctgatgcagacggcgctgcgtatcgacttgtgaaattacgcgcgacgcttcatgtcgttcattacgttaatcaaaagccggtgcgtgaaatcgtccctgctggtcagtcaatctacgttgatccggaagaggccgcgttgctcatcgctgcaaatcacgtctacgcgctatga

SEQ ID NO: 562 - DNA, 990 bp, Enterobacter cloacae
tttcttatcgtggcatttgaagcatcacgaatagcaaatgaggtctccatgattaagcaaaaaaccatcaaaaatattgtcgaactaagtggtattggtttacatagcggcagcagcattcatatgaaaatcatgcccgctaccgctaatagtggcatacggttccgtagaacagatttaaatccttcagttgatattcagcttcgagctgagcaggttcatgacaccatgctggctacaagtctaattaatcctcaaggtattagggtttcaacgatcgaacatttcctttctgctgtatccagtctggggattgacaatctcctggtagaactggatgcacctgagctccccatacttgatggaagcgcaagagaatttattgattctcttatcaacgctggttcgatagaacagtgtgcacttaaaaaatatcttcttattaaaaaaactgtgtcagttaaagacggtgataagtgggctcttttacatccggactctaagttttccgtggatttcacgattgatttcaagcatcctttaatctcggctgatactaataaattaaatattgaaatgtcgaaagaaaaatatatagaagaaatagctggtgcacgtacttttggatttgttcatgatgtagaaaaactgcaaaaaattgggcttgtactaggggctggtttgaacaatgcgataggtctcgatgaatatagcgtcctcaatcctgaaggtcttcgttttaataatgaactagttcgtcataaagtacttgatgcaattggagacctctttgtttctgggtataatatcatcggtgcttaccatgcatataaatctggccatgctttaaataataaactaatgcttgctttattaaatgataccgatgcatgggaattcgttaatttgcatgattacagcagggggaaacttaaagttaatatgttgcctgcgattaataaagaatgcccagtatcattaactatctaa

SEQ ID NO: 563 - DNA, 453 bp, Enterobacter cloacae
  unsure (17)
tatcaccgaatagcatntggggagagaatgagcactattggtgatgcagctcgattatccggggtttcggccaaaatgattcgttattatgaggaggcaggattaattccttctgtctctagaaccgcagctggataccggatatacaaagatgtagatgtctataaattacattttatacgccgttgccgagagctcggtttttctctgtctcaaacgggagatcttctctctctttggggaaatcattcgcgccagagtgcggatgtgaaaaaattagttgaatcacatataaatgatttgacttcaaaaatagaagaacttcagcgtattgcatcgacccttacaacgctttcagattgttgcgccggtgatgataaaccagattgtccaattctgagggcactgtatctggcggagacttcgcgtaaggacaaggaaaatagtccttga

SEQ ID NO: 564 - DNA, 933 bp, Enterobacter cloacae
ttaatgaaattccctcatttctttatacagcgacccatttttgcaatcgtcctttcactatttatgctgatagcgggtgccttagccttctttcaattgccactcagcgaatatccttctgtaactcccccaacagtgcaggtgactgcaagttatcctggggcgaatcctaatgttatagctgataccgtagctgctcctcttgagcaggctatcaacggggtagaagggatgctatacatgagctctcagacttcgtctgatggccgtatggtgttaactatctcattcaggcaaggtaccgatccagatattgcgcaaattcaggttcagaatcgtgtatccagggctttacctcgactgccatctgaagttcagcaaatcggcgttgtaacggaaaaaacctcgccggatatactcatggtagttcatctgttctcaccagataatcgatacaatccgctttatgtatctaactatgcgatgttgaacgtgcgtgatgagctttctcgcttacctggtatcgctagtattgcgctttggggggagggtgaatatgcaatgcgagtttggcttgatcctaataaaattgcttccagaggtttgaccgcaagcgatgtcacttcagcaattaaagaacaaaacgttcaggtagcggcagggtcagttggacaacagcctaatacttcatcctccttccaggtcacagtaaatgcgttagggcgtctgacaaccgaggagcaattcggcgatattattattaagtcaggaactgatggccaggttactcgcctacgtgatgtagccaggattgagctcggttcagataactattcgttacgaagtctgctggataataaagatgctgtaggtatgcagattgtaatgacacctggagccaatgcgctggacgtatcagcatctgtacggtca

SEQ ID NO: 565 - DNA, 3639 bp, Enterobacter cloacae
gggcactgtatctggcggagacttcgcgtaaggacaaggaaaatagtccttgatgtcattatagccacctacctcgaatcattacaacctggatttattgtgcgaaacctgtatgccgttaattttaacggcaatcactgcttgcacaaggaacaacttcaattatcgaaagatcactttttattggtgaggtttacaatgttaaatattattcccggatattgcacgctttgtcgttcccgctgcgggacgttgaatgaggtgattgaggacctcctctttttggtaaggcctaaccctgttcttccttttggtaaggctatgtgtatgaagggtaaagcggcacctgagttagtagacagcgcaaatcgaattctgcacccgatgaagagaactcatcctaaaggcgcagaaaatccgggctggcaacgcataagttgggaagaggctatgtcaaccatagccgggcaactgaaaaaatttaaaaatgagaatggggcggaatctgtcgctttcggttttactagcccaagcggtacaccccttagtgatgcaattgaatggttagaacgttttgttcgtatctatggcagcccaaacaccagctatgggacggagatatgtaattggcacaaagacgttgctcatcgttggacctttggttgtggcatccctgttgctgactattcacatgccgaacttattattctttgggggcataatccagccaatacatggctagcgcaggctaatgcgatagggactggtcggaataatggcgcaaagctgattgttattgatccgcgtccgacacctttagcaaaagaggcaaatgcttggcttaatgtatgtccgggaactgatggtgcattagctttgggattaagccatcttttggttgaaaggcatatgtttaaccaggaattcgttcgtgactggactaatggtcctttactgattagaaatgataatggctattttcttcgtgaaatagatattaacccatttgccaccagcaatcgctacgtggtttgggacgaacacatccagcaagtaatatttatcgattccgaaacccgtacagaagaaactcttacacctacagctgcacttgaaagcgatgttgaagtcacattagctgatggcggtaaaatatcctgccataccgcattttcctcttttaaaaatatactggctaattattcaccagaaaatgtaagccgtattactgggatatctgttgcttcaattgaagctgctgcaagtatgattggcaatgctaagaaaattgcatatcacagttggtctggagtagcacagcatactaacgcaacccaaacagaacgtgctattgcgacactgtatgctttaaccggttgtttcgatcaggaaggatgtaatcgaatctatgccagccacccggtaaatgtggttaattcaccgacattgatgcctaaaacgcaatgggaaaaggcattaggtcttgaagaaaggcctatcggcccgccttcacagggttgggttcattctcaggatatctggcattcagtattagaaggaacgccctacaaaattcgcggcttaattggctttggtgccaacatattactttcacaaagtgatacttccctcggacaacaggcacttgaggcgcttgagttttatgctcatgtagatttgtttgaaacacctacatcaaagtatgctgatatccttttgccagtaaacaccgcttgggagcgtgaaggcctaagagccgggtttgaaagtagcgctgctgctcaggagcacattcagttgagaaaacaaatggtttctccgcgtggtgaaagtcgttcagatcttgagattgttttcgaccttgcatgtcggttaggaatgaatgaagcattttttgatggtaatattgaatctgcttggaattatcaattgaagccactcggtttgactgttgagatgctcaggaataagcctgaaggttacgacataccacttgagcataaagtcaggaagtacgccttaaaagatcaaaagaccgggtatctgacaggttttaatacggaaacaaaacgtgcagagttttactctgaggtacttcatcggcacggttataatcctttacctgaatacgtacaacctcaggaatatcagcgtaatgatcctgatttccccttaatgctgacatcagttaaaagtggttttttctgccatagccaacatcgcagcctaacaagtttaagaaaaaaagcatcttatccaacggtagagatatcggttactcttgctgatgaagaaaaaattaagacaggtgattgggttgaaattgagactcgggtaggtcaggctcgtttcagagctaaggtggaagaaaaattatctcacgaaacagttattgctgaatttggatggtggcagggttgtcctgattttggaaaaccatcatatcctgttataggtgaatttagcagtaattttaatagcctaatcagtggggatagttatgatcctgtaagtggtgcactgccactccgttcgttcagatgccgtattcgtaggctgaatgaatttgaattagtaagacgtccatgggacggacgtagaactttccaagttataagtttgaagaaagaaactgataatgttacaaccgtgacttttcaatctaaagctgagggttttttaccggattatgaaccaggccagcatgtaacaataagctgttacccactgatcgattctgaagatatcgtaactagagcgtattcgttaacaggcccagcatttgtagacgctcgtaaaacttattctatttctgtaaggcaccagacagcgagagatgagaatggggagtttgttgaaggaataatgtcatcctttattaacactcgtttgcaagtaggcagttttgttgaaataactccacctggaggcaacttcatcgtcccacttaacgcaatgcaacctgtcgtgatttttgctggtggtattggtattacaccatttatctgttatctggagtctattgatcctgatgaaactggccctgaaatatggcttttctatgccaatcaaaatagtaagcaacatgcgtttaagaaaagaatacaggagttaagtagcttaattagcaggctaaaagtaataaatgtttataatcagccactagattgtgatgtcctgggagaagattacgatcgagcaggatttgctggagcgggagacgttgatgcccatctaattgaaaataatgctcgttattacatgtgcggcccaatgccaatgatggaggcgatatcgaagggccttcagcaaagaggtgttccagcatttgcaattttttatgagatatttcgttctccagcaaaaatcaatgatgatccttctctacgccataaagtaacttttgcgaaatcaggaagagaagagatatggacaactgataaaggtacattattgaattttggcgagaaacttggaatatcaatgccaagtggatgtagggttggccaatgcgaaagttgttctacaaaggttatcacggggagtgttcagcatttgaataatgtggaaccctctgatgagggggcatgtttgacatgtcaatgtatcccagcaggcgatatcacgattgatgcatga

SEQ ID NO: 566 - DNA, 1299 bp, Enterobacter cloacae
gaaattgctacaggcgccaacttcgggctgtccgaagggttttggggaacgaaaagggtcattatgatgaaaatgagcattaggacaatggtgatggcagttgctgttgcaatcacagcaagcacatcggtagcggtggctaaggaagatggcagcggaaaaacatctacggcgcagataccagcaggtccgcaggtaccggtcgctgaggttatttcgcgcaatattataccttcggccgagtttactggttccctggcagcgatcaaaacggtagagctacgacccagagtcggcgggacaatcgaatctgtaagtgttccggaaggaagcttggtacataaaggacaacttctatttcaaattgatccgcgaccatttcaggtagctcttgatagcgctaaggcgcaacttcgccaagctgaggctcaggcgtttcaggcaaatcgcaattttgaacgtgtcagccgactggtcaataatggggctgtttcccgtaaagattatgacgatgcagcttctgataaaaatgcccgtattgcccaagtcaatgtagcgcaggctgcagtagaggcggcaaagcttgatctctcatatacacgagtaactgcgccaatagatggccgcgttgatcggattttgattactgaaggaaatctgattagtaatagtgaagggggggctgcaactttattaaccacgatcgtttcctcaaatccactatatgcatattttgatattgatgaagcaacgtttctcaataccgtcagtaaagcgcgtcctgatgcaatggagggtagtaaagaaaaattaccagtacatgtaggtctggctactgaaaagggatacccacattccggtactcttgattttgttggtaatcaaatcgatcgtaataccggtactgttcgagtaagggccattatcccaaatacggatggtttgcttactcccggagcatttgccagagttcaattaggcacgggaaaagctcaacaggttattttgatcaatgaccaagcagtgggaactaatcagggtaataaatatgtcctggttattggtgacgatagtaaggcgcagtatcgccccatcgaattgggacccgttgttgatggcttacgaattgttgctaagggcctacaagccggtgaaaaaatcatcataaaagggttagtgcgaccgggtatggcggtaacaccaagtatggtttcgatgcagtctctagagagttcattggatgcaaaaccagcaactcaaggaaaggcttctgatagtaataataaggggggtaattaa

SEQ ID NO: 567 - DNA, 546 bp, Enterobacter cloacae
acagtcagatgctcaggccgagatccgccgtcttcagaaagagttgaagcgggttacggacgaacgggacatattaaaaaaagccgcggcgtacttcgcaaagctgtccgactgaggtacgcctttatccgcgacaacagccgttgctggcctgttcgtttgctctgtcgggttctggatgtccatccgagtggattttatttctggcttcagcagccacattcgcagcgtcaccagacagatcagatgctgaccgggcaaatcaaacagttctggcttgagtctggctgcgtctatggttatcgcaaaatcaatctcgatctgcgtgataccggacagcagtgcggagtgaaccgggtctggcggctgatgaagcgtgccggaataaaagctcaggttgggtaccgtaccccacgagcacgtaaaggcgaatccagtatcgtgacacccaacatgctccagcggcagttcaatccggactcaccggatgagcgttgggtgacggacataacctacatccgaacccacgaatgctggctgtatctg

SEQ ID NO: 568 - DNA, 291 bp, Enterobacter cloacae
agagaggtgcccatgagcggtaagcgttatcctgaagagtttaaaattgaagcagtcaaacaggttgttgatcgtggtcattctgtttccagtgttgcaacacgtctcgatatcaccactcacagtctttacgcctggataaagaagtacggcccggattcttccactcataatgaacagtcagatgctcaggccgagatccgccgtcttcagaaagagttgaagcgggttacggacgaacgggacatattaaaaaaagccgcggcgtacttcgcaaagctgtccgactga

SEQ ID NO: 569 - DNA, 2382 bp, Enterobacter cloacae
cgtcagaggttgtgggaaatgaaaaaaaatatagagaactttgagacttttatcatagaacagaaagcttggttcgaagagaatctggcagcagattttgcagaatcatgggatagctttgtctggatatgtgggatcaaaggctccggctggttacgtggcaatggggctaatttattacgttttgatgaagttaaccggctcaaagggatcgatgatcgccatactgtctccgagccttatcagttgttcatgaaagcgatgctggtactcgtctatcgagggagaaatcgcagtatttcctctgcggttgctgtcgcaacgctgattattttgaaacgatggtactgcgctctcattaagttaactgggcaaacacatcccatctatctgactacagatgtcgtacgtagcgcaatggatactctgagtgcagcttcccggccaggtgataccaacctagccaactacaaggggcgttgtgttaagattcagaaattagtaaaccatcacgccttcacattagtaacattgcaatatgtttccgatgattgttataccaatcagactaatttgacccggaaagcccgggaaacaatctcactaaaagaaaaagacaagctggatgatacttccactgatggtgaagatacactgattaccattaaaggtttcctcaatatcgtgtcgttaatccagcgagttgaaagcggtactgaaaagattgccctcaattgtcttctgttactgatcgtcactggattccgttctgttgaggcattcaatctcagacaggatgccttggtcaaacgacatatagataactctgacctcagcaaacgtttgcggaataaaggattgccagattattttcttggcatacgctatgttggtgttaagggggctggcgaacgaacgcattgggtcgagcctttagctgtacctctggtcgaaaatatatttaagtcggtgaagttactaacagctgagtttcgcaaacatatcgaatatttacgatcaaaaaaattttctgattatttaccaaagccaatcagtgatattaccggtgaactcgttgagcttgatgatattgtaaaatacatggtccagtcctcatcagagcttcgggggcgtgcaggcttacgtgataaagcttcgaaagcattagagaaacgtggctttataccagcaaaagtcatccttaaatcaggcaatgaaaaagaaaaatattttacaaagtctgatcttagtaattttcttaaaagtgaattcggtgataacagtgcaaatactccctgtactcatgcatgggcagaaaatggcaaaagatatgagattaaatatgaagagctattgttccttttccccaaaggatcactgactctaaagagagtattgcaactaaaagccacgccactaccactaaataataacggtctaaacaaatttctaggtaacgttgctggctatgtatctgttttcagcaaatacagcttgcttgaagatgacggccgccctactcagctccgcacgcatatccctcgacacaacattaatacttttctcgcaattgcagagatctcagaccacttacaagcgatgttgatggggcgtgttgatattactcaaaatcagcattatcagcacctggctctcaaggaacggcgaaaagcagcttctctaacccctttagttccaaccgtaccggagcagtcagcatttactgctgttgacgttgattcaccgctcgatatggtaaagcaaagcggtttaatgacgtttaatagtagccaaagtctggaaaccaacataaaggcaaacctgcatacctttgatgatcgttacgatgttgctggtttcattgaagcgtcgtcaggggatggattattcgaagacatagccgctgcgttcgaggaaatcagtaaaaatgaagggccattacaagcgtctgagatggtacaaaggcatgcggtattgcatccattaaaactgggctcctgcatgagagacgttaacttgtggggatgcccttatcgaatgaagtgtcaagcattgaagccctgtgagcatttcacgttgacaggtcgtattgatgaatactcaactattgcagtcaaaggtcgggcattaaacgaggcttcgctcgcttttgaacagtatatcgcggcccttccagacaaccagttaatacaaggcaatatcgaagaaaatctaactcacctggatgccttaagcgatcaattacgcaggcgctcaaacttgctacaagttctctctgctcaagagattctgtctggagagataaaggtggaaggtgaaattcgtactttagctcaattatttgcccttgagcaccataaaaacaaagaggaagaaaactaa

SEQ ID NO: 570 - DNA, 279 bp, Enterobacter cloacae
agattcactgtagggaataatgacgttctggaggtaggtgtggcagagcaactggaatttttccctgtccagagcccgtgccggggtatttgccaggttgatgaacgaggatactgtcgtggctgcatgcgcacgcgcgatgaacgttttaactggcaaaatttcagcgacgcgcaaaagcaggaggtcttacggctttgccgacagcgtctgctgcgtaaaattcgtgcaaacaaagcggttgaacccgaagaacctcagcaaccttcactgttttag

SEQ ID NO: 571 - DNA, 921 bp, Enterobacter cloacae
cattacttccttgaggaaaatgttatggttcagcgtattacccttgccccacagggcccggaattctcccgatttgttatgggctactggcgcctcatggactggaatatgtctccggtccagctggcggactttatagaagagcatctcgatctcgggatcaccaccgtcgatcatgctgatatttatggcggctatcagtgcgaggccgcctttggcgaagcgctgaagcgtgcgccggggctgcgtgaacgaatggagattgtgaccaaatgcggtattgccaccacagcaaaaccggagcatgcgcttggacattacatcactgacagcgcgcatatcgttaaaagcgccgagcagtcactggtcaacctggccaccgatcgtatcgacctgctgctgatccaccgtcccgatccgttgatggatgcggatgaggtcgcggaagccttcctgacgctgcaccagagcggcaaagtgcgccattttggcgtgtctaacttcaccccggcacagtttgcgctattgcagtctcgcctgccgtttacgctggcgacgaatcaggtggagatctcgcctgttcatcagccactgctgctggatggcacgctcgaccaactgcaacagctgcgcatccgtccaatggcatggtcttgcctgggaggcggccgtctgtttaacgatgaggcattccagccgctgcgtaacgagcttgaaacggtggcgcgcgaactgaatgcggagagtatcgagcaggtggtttacgcctggatcctgcgcctgccgtctaaaccgctgccaattattggctccggcaaaattgagcgtgtccgcgctgcgcttgttgctgaggagctggatatgacgcgtcagcagtggttccgcattcgtaaggcggcgctgggctacgacgtaccctga

SEQ ID NO: 572 - DNA, 573 bp, Enterobacter cloacae
aatctgcgcctctggtatagacttaaggtgcaaaaaataacccgtggaggtcatatgaagcgttttgctctggcaatggtcacgctggttgtttgcgcaggggcgcaggcagccagcgaggacgttgaaatgaatctcgtcacttctcagggggtaggtcagtccatcgggacggtgaaaatcaccgaaaccgataaagggctggaatttgctcccgatctcaaggctcttccacccggcgaacatggttttcacgttcatgctaaaggcagctgtcaacccgcgatgaaagaggggaaaccaacagctgcggaagccgcaggggggcatctcgacccgcagaactccggtaagcatgaaggcccggaagggatggggcacctcggcgatctgccggtgctggtggtaaataacgatggtaaagccaccgatccggttgtggcgccacgactcaaaaagcttgacgaggtcaaaggcaaggcgctgatgatccacgtgggcggcgataacatgtccgatcaacctaaaccgcttggcggcggcggggcgcgctatgcctgcggggtgatctga

SEQ ID NO: 573 - DNA, 282 bp, Enterobacter cloacae
aatctgccattgtggccctcattccaccgcaaaggatcgctgcttgtgacgttgttttccttctccgcagggttgcccctccaggatctgattgttggcgcatcggtctactttccgccactgtttaaagccgtgatggtcggttttgtgatctggctcattgcgcatcgtctgctgcgcgactggatgtattccggtgaaatctggcacccgatgttaatggatctctccctgtttaccctctccgtctgtcttggccttgccgtgttaaccgtgtggtga

SEQ ID NO: 574 - DNA, 2100 bp, Enterobacter cloacae
tcaactgccgaaagacattaccctggtctctggcacaacctgcactgtcgccatcggatcgcgatgatgaacctgggagctctctcctggcgcaatacgccgtggataaaagcgacacggccgcagtggcgttacgcgctgcgtaacggcatcgccatgtgccttgcgcttacggttgcctattatctgaatctggatgagccttactgggcgatgacctctgcggcggtcgtcagcttccctaccgtcgggggcgttatcagtaaaagcctcgggcgcgtggcgggtagcctgctgggggcaaccgccgcactgcttcttgccggccatactctgaacgatccctggctctttttgttaagcatgtcggcatggctggggctgtgtacctgggcctgcgctcattttaccaataacgttgcctatgcgtttcaactggcgggttacaccgcggccattatcgcctttccggtcgtcaacgtgctggataccactgagctgtgggatatcgcccaggcacgcgtgtgtgaagtgatggtcggcattctgtgcgggggcgtcatgatgatgatcctgcccagtacctcagatggcactacgcttatcaccgcccttaaaacgatgcacgcacgtttgctggaacatgccagcctgctctggcagcctgacagcagcgatgacatccgcctcgcgcacgaaaaggtcatcggccagatcctgaccatgaacctgttgcgcatccaggctttctggagccactaccgttttcgtcgccagaacacgcttctgaactatttattgcaccagcaattgcggatgacgagcgcgatctcgagccttcgtcggatgttgctgaactggcctacccccccagcccatacccgggagattatcgaggcgctgctcgctacccttgcgcgttcggatgccgatatttataccgtggcccgcattatcgcgccgctcgccccagcggatgaatatgactaccggcatcgcgccttctggcagcgtctaaactatttctgccgcctgtatctgcgcagcagccgctggttaaaagccgtcgagaatgccacgcccgtcaccgaattttccgttcccggtagtcctgctctggcgcggcataccgacgcaatggaggcgctatggagcggttttcgtacgttttgcgcgttgacggccgtaggcgcatgggccatcaccacgcaatgggatgcgggcagtgcggccctgacgcttgcggcaatcagctgcgtgctctattccgtcgccgcttccccctttaactccctgacgcttctgctgcgtacgctggtgctgctgtcgctgttcagcttcgtggtgaaatttggtttgatggtgcagataaccgacctctggcaatttctgctgtttctcttcccgctattaaccaccatgcagttgctcaaactgcaaatgcctaaactggccggtctgtggggtcagttaattgtttttatgggctcatttatctctgtaacgaatccaccggtttacgattacgctgattttctcaacgacaacctggcgaagatcctcggcgtggggctggcgtggctggctttcgccgtgctacgcccaggctcggacgcgcgtaaaagccgcaggcatattcgggagttgcgcaggggttttgtcgatcagctgagccgcaggccgcatctgcgcgaaagcgagtatgaatcgctggtttaccatcatgtcagccagctgaataacagccaggattcactctcccgtcgctggctactgcgctggggcgtggtgctgctaaactgttcgcacgtggtgtggcagttgcgcgcctgggagacgcgttccgatccgctgtcgcaggtccgtgataactgtatttctatgctccgcgatgtgatgagcgagcgcggggtgcagcagcgccccctgagcgtcacgctcgccgagcttcagcgtatttgcgacacgctggcgcaccatcatcagcctgcggcccgcgatctggcatccattatctggcggctgcactgctccctgtcacagcttgaacaggcgccgccacccggaacgattggcgatcagatcaccccgcaggcatag

SEQ ID NO: 575 - DNA, 945 bp, Enterobacter cloacae
aatctggcacccgatgttaatggatctctccctgtttaccctctccgtctgtcttggccttgccgtgttaaccgtgtggtgagaatagcattgaaaacgttaaaatatttttccactcttttcgtcttagcgctggcgcttatcgccggctggtggctctggaattattacatgcagtcgccctggacgcgtgacggcaagatccgcgcggaacaggtcagcatcacgccacaagtgtccggcagtatcagcgcgctgctggtgaaggacaaccagtccgttcatgcgggtgatgtgttattccgcatcgacgagaccccttttcacattgcggtgctcaatgcccaggcgcagctcgcaaaagctcaatccgatctggcaaaagccaataacgaagccgaacgtcgccgacatctgtcgaggaattacatctctgcggaagatctcgataccgccaatatcaatgtaaaagccatgcaggccagcctgaaggttgcagaggcaacgctgaaacaggccgagtggcaactgacccagaccgttgtcaaagctccggtggatggatggatcacgagcctctcgacccgtgtgggggattacgccaccacaggccagccggtctttgccctggtcgacagccgctctttctatgttgtaggttattttgaagagaccaagctgcgccatatccgcgagggagcgcctgcccgaatcacgctttacagcggcgcagaaacgttacagggtcacgttagcagcataggtcgggcaatttacgatcagagcgtggaaaccgattctggcctggtccccgacatcaaacccaacgtaccgtgggtgcgtctggctcagcgggtgcctgttcgcgtcgagtttgatcaactgccgaaagacattaccctggtctctggcacaacctgcactgtcgccatcggatcgcgatga

SEQ ID NO: 576 - DNA, 1200 bp, Enterobacter cloacae
aaccagtgtatcccggtgagcaggatgaagaatcaatcagtgatcagacagttttcggaaagcgaattacatcagcagctggaaacgttcggcaaccatgataaacagctttcacgcttgatccgttacttttcccatctgagatacaacactgctaaaacctatctgcactggctacgagtatggaacgaatggtatctggcgaatgcccggttgcatacagactggccagtaagttcgctccccgtgtctgaggacgctctgcttgcgtttatggggcatcttgaaggcaaattgtcacgaagcagcataaacagctgtcttcaggccttaaatagtatccataaaaaagggcttaacctgcccgggattattacgtctgaagcatggtacatgctggaagccttaaaacaatcggaagcccggaagcgaaagacgactaaacaggcaactccctttcttattggcgatctcaaggctctgataaagttacgcagtactacaaactcagttcgtaaacttcgtgacctgtgcctgatctggacaggctttgaaacactgctccgttcatccgaaattcgccgtatacgtctgaaagatctgtctctggatagtatgaccggtgaatttaacctgacggtataccgtacaaaaacgaacatcagtacacttcttacctaccggctgacacgtcagttaactaactgcctcttgagattgatgaacctcgtgaaaatggatcagcacagtcatccggatgaataccttttccaggccgtaaatttccatgatacaggctatatgccacccggctggaagcttcggagtaaagggaatgagctatctgaacttcttaaaaggcataacctaccctatcgtgctaaacaaagtcttctgaacgatgaagatgaagaagacactgtggacgatgccggtatgctcagcaaaaattcccttttacgagcatttaaagagatgtggaatgagctttatccaaatgagactaaaacccgttactggacagggcacagcgttcgtgtaggcggtgcgatacagctggatattgaaggttactcgctaccacagattatggaaatggggaactggtcgaatgaagaaatggttatgcgctacattcgcaatattgaagctggtaaaaaagccatgatcaagcttatgcgaaatgcctttgatgaatag

SEQ ID NO: 577 - DNA, 1032 bp, Enterobacter cloacae
catttatgttctgcaaggtcagcctgggcagcaaaattgattggaaataacatgagcctggagaaacgtatgagttatgacgatttgccctattttcgtgaccagattctggaacgcatcgactcgctcaagtgttttttttcgaacacccccccgatgatggcaaacctgatgactgtctccaccgtatctcgaacagaagagcgcctgaagcaggttaaacccatcagggttagtattaaagacgatgcttcggttgaggaaattattcaggcacttactgacatctgtgtggatgacatagagtcattaagtcatgattccaccaaagtaaccactaaatacccgggtctaatcattgtccccgaaagagcagatcttctcgaaagcttgatcacttctataaacgaagcaaaaaatgattttgctgcggcaatgaggcgtatcgataataaaaagaatgtccgttttgataaagtgcacaagaagctcccgggccttgtcgctatgcactcaacaagaaatatccttttcatcaagtcccagcttaaaaaagttactttttcatggcggctaaaccgaaaccaggaagttaaaacagcagagcaacttgtgagtttgttggagcgcaggagagcctcagaagtaaaaaatgtagcaactaccaatttgaatgtcgtgtctaatatcgataaggctttacaccgtcttgaatttcacccactgaagcagggcgaatcttatcgcctttgtcgaactaactctttccctgttccgattgctcacatttttgcatttaggcctgaagggcaggaacgaaacgggaataaatatgctgagactgattattcagtagtaaaagcatccttgcccattttcgcagcaggcaacatacctcaattaaaaacgctctctgactgggctcctgaaaacagccagggtccgtccaaccaacggaagctgagcctgaaatatacagaactcgtgccgggggctgagctgggcattttcattgtcagccccgaaaattaa

SEQ ID NO: 578 - DNA, 606 bp, Enterobacter cloacae
  unsure (59)
ttttcccaaattgaaaaaatgggccgaaggtttaattttaactccagcgcatcccggtnttcgctcaacccgctcggatatgccgggatcggggctgacggcgcattcaacaccgcgatcagcttcaccaccaacaccaactggcaatggtattcgggcgaggcggcgatgagcaacctcagccagatgctggcgctgacaatccacaacttcctatcggcggcgaccgggatcgcgctggccttcgcgctgttccgcggcttcgcgcggcgcgaggcgacggggatcggcaatttctgggcggacgtcactcgcgtgacgctctacgtgctgctgccgatctcggtggtctacggcgtcttcctgatcgccagcggcgtgccgcagacgctggctgcgtccgtggacgtctccacgctggagggcgtgaggcagacgctgggcctcggcccggtcgccagccaagaagcgatcaagatgctcggcaccaatggtggcggcttcttcaacgccaacagcgcgcacccgttcgagaacccggacgcgctgaccaacttcatcgagctgctggtcttcactacggacagccggatccgcactagtggt

SEQ ID NO: 579 - DNA, 303 bp, Enterobacter cloacae
atcctgatctgcgccctgatcgtctccgtcctgctgctgatccccttggcgatggtgctgtctccctggctgctcggcgtcctgcgcttcctgctgggggctgccgatggcgctctgctcccggccgtgctgacgctgctggtctttttttcctccttcctgattgccggtcgttttttctgctttttccagtcgtttcgcgatctgggtatcgtctccgggccgctggtcggtgcggggatttcagcctgtttcggtttccgggcggtctttatcgtgacggctggcgtcgtgctgttcaac

SEQ ID NO: 580 - DNA, 438 bp, Enterobacter cloacae
tggccatcgatgccggactcgagcggctgcggcatgccgtactggaaaagggggctgacgatgatcgttaagtttcatccccggggacgcggaggcggtgccggcccggttgattatctgctggggaaagaccgccagcgcgacggtgccagcgttcttcaggggaagccggaggaagtccgggagcttatcgacgcctcgccctacgccaaaaagtacacctccggggtgctgtcctttgccgaacaggacttaccgcccgggcagcgtttaaaacgcctgatggcgagcttccagcgggttctgatgcccggactcgataaagaccactacaccgtgctgtgggttgagcaccgggacaaggggccggctggagctgaacttcctgatcccaaaccacggaactgcttgacggcaaacggtccaaccatactatga

SEQ ID NO: 581 - DNA, 432 bp, Enterobacter cloacae
atgccactgacgcgcctgcggcttgcccaacaccgcgccgaccgggaaaagatttcccgcccgtcccggcgttatcaggaggccggattggcagacaaacgcagcaaaatgctcacgatgtgggtaacagaagatgagcaccgccgtctgctggaacgctgcgacggtaaacagctcgcggcctggatgcggcagacgtgcctggacgagaagcccgcccgggccggcaaacttccctcgatctcgccggcgctgcttcgtcagcttgccggcatggggaacaacctcaaccagattgcccgccaggttaacgccggtggcagtagcggtctcgaccgcgtgcaggtcgtcgccgcgctgatggccatcgatgccggactcgagcggctgcggcatgccgtactggaaaagggggctgacgatgatcgttaa

SEQ ID NO: 582 - DNA, 993 bp, Enterobacter cloacae
gcccgcacccgccgtttcgtgatggttcacagaagcatgcttatgagcaaaaaagagcaaacgttaatgacgccctatcttcagtttaaccgtagccagtgggcagccctgcgtgactccgtccctatgacactgacggaaggtgaaatcgcacggctaaaagggataaacgaagatctctccctggaagaggtggcagaaatctatctccccctctctcgcttgcttaacttctatatcagctccaatttgcgtcgtcaggccgtcctggaacagttcctcggcacgaacggtcaacgtattccttatatcatcagtattgcgggcagcgtggcagtgggtaaaagtaccaccgcgcgcgtgcttcaggcgctgctgagccgctggccggaacaccgcagcgtggagctgatcaccaccgacggcttcctgcatcccaacgaggtgttgaaagaacgcggcctgatgaaaaagaagggcttcccgctctcttatgatatgcaccgcctggtaaagtttgtttcagatctaaaatcgggcgtacctcacgttaccgcgccggtttactcacatctgatctacgaccgcatcccggatggcgacaaaacggttgtgcagcccgacatcctgattctggaaggcttaaacgtcctgcaaagcgggatggattaccctcacgatccgcatcatgtgtttgtctctgactttgtcgatttctcaatctatgtcgatgcgccggaagatttgctgcaacgctggtatatcaaccgcttcctgaagttccgcgaaggggcgttcaccgacccggattcctacttccacaactacgcccagctctctgaagaagaggctatcagcgtggcgaccgggctgtggaatgagatcaactacgtcaacctcaaagagaacatcctgccgacgcgcgaacgcgcaagcctgatcctcaccaagagtgagaaacacgccgtcgaccagattcgtttacggaagtag

SEQ ID NO: 583 - DNA, 1185 bp, Enterobacter cloacae
ataataagtagggtgttctccctctccctgtgggagagggcaggggtgtggggcgtgcatgcaccccctcaccctaaccctctcccacagggagagggaatttacatttgtgagcaatacagacgtcacgccactgagtgtgcgtcatcagagagaatccgggttatgttgcagttcatcctccgacgtctgggactggttatcccgacgtttatcggtatcacccttctcacttttgccttcgtccatatgatcccgggtgatccggtgatgattatggcgggcgagcgtggtatctcccctgaacgtcatgcgcaactgctggctgaactcggccttgataagccgatgtggcagcagtatctccactatatctggggcgtgttgcacggcgatttagggatttcactgaaaagccgtcttccggtgtgggacgagttcgtacctcgctttaaagcgacgctggaactcggtatctgcgccatgatcttcgcgaccgcggtagggatccccgttggcgtactggctgccgttaaacgtggctctatttttgaccacaccgctgttggcctggcactgaccggctactccatgcctatcttctggtggggcatgatgctgatcatgctggtctcggtgcagtggaacctgacgccggtctccggacgcgtcagcgatatggttttccttgacgacaccaatccgttaaccggctttatgctgattgatacagcgatctggggcgaagagggcaacttcattgatgcggttgcgcacatgatcctgcctgcaatggtgttgggcaccatccctctggcggtgatcgtgcgtatgacccgttcctccatgctggaagtgctgggcgaggattatattcgtactgcccgcgctaaaggcctgacccgtatgcgcgtcatcatcattcatgccctgcgaaacgctatgctgccggtggtaaccgttatcggtttgcaggtcggtacgctgctggcgggggcgatcctgaccgaaaccatcttctcctggccgggtcttggacgctggctgattgatgcgctgcaacgccgtgactatccggttgtgcagggcggtgtactgctggtcgcgacgatgattattctcgtcaacctgctggtcgatttgctgtacggcgtggtgaacccgcgtattcgtcataagaagtaa

SEQ ID NO: 584 - DNA, 912 bp, Enterobacter cloacae
ggggccatcatgtcacaagttactcaaaataaagtggtcaccgcaccggtgccaatgacgccgatgcaggaattctggcactacttcaagcgcaacaaaggcgcggtcgtcgggctggtgtatgtttccatcatgatcctgattgcggtgtttgcgaacgtccttgcgccgtataacccggctgatcagttccgcgatgcgctgctggcacctcctgcatggcaggacggcggaagcctggcgcacctgctgggcaccgacgacgtgggtcgcgatgtgctttcgcgcctgatgtacggcgcacgcctgtcgctgctggttggctgcctcgttgtcgtactgtcgctgatcatggggatcgtactcggcctggtggcaggctacttcggcggcattgttgataacatcatcatgcgcgtcgtcgacattatgctggcattaccaagcctgctgctggcgctggtgctggtggcgatcttcggtccgtcgattggtaacgccgcgcttgcgctgacgtttgttgcgctaccgcactatgtgcgtctgacccgtgcggcggtgctggtggaagtgaaccgcgactacgttaccgcctctcgcgtggcgggtgccggtgcgatgcgtcagatgtttatcagtatcttcccaaactgccttgcgccgctgattgttcaggcgtcgctcggtttctctaacgccattcttgatatggccgctcttggcttccttggcatgggtgcgcagccgccaacaccggagtggggcaccatgctctccgacgtgttgcagttcgcgcaaagcgcctggtgggtcgtcaccttcccgggtctggcgattctgctgacggtgctggcatttaacctgatgggtgatggtctgcgtgatgcacttgatcccaaactgaagcagtaa

SEQ ID NO: 585 - DNA, 1032 bp, Enterobacter cloacae
tgccgggaggccaacactatgagtacgcaccaggccaccacgcaacagccgctgttgcaggctatcgacctgaaaaaacattaccctgtgaagaaggggatttttgcccccgagcgcctggtaaaagcgctggacggcgtctccttcagccttgaacgcggtaaaacgctggcggtcgtcggggagtcgggctgtgggaaatccacgctgggccgtctgctgacgatgattgaaacgccaaccggcggcgagctttactatcagggccaggatctgctcaagcacgatccgcaggcgcagaagctgcgtcgccagaaaatccagattgtgttccagaacccgtacggttctttaaacccgcgtaaaaaagtggggcagattctggaagaaccgctgctgattaacagcaatctgagcaaagagcagcgtcgtgaaaaagcgctggcgatgatggcgaaggtggggcttaaaaccgagcattacgatcgctacccgcatatgttctctggtggtcagcgtcagcgtattgccatcgctcgtgggctgatgcttgacccggacgtggtgattgccgatgagccggtctcagcgcttgacgtgtccgttcgcgcgcaggtgcttaacctgatgatggatttacagcaggatctgggactgtcgtacgtcttcatctcccatgacctgtccgtggtcgagcacattgccgatgaggtgatggtgatgtatctgggacgctgcgtggagaaggggacgaaagatcagatctttactaacccgcgtcatccgtatacccaggcactgctgtctgcgacgccgcggctgaacccggatgaccgccgtgagcgcattaagctgaccggtgagttgccaagcccgcttaacccgccgccgggatgtgcgtttaacgcccgctgccgtcgccgcttcggtccgtgtacgcagttgcagccacagctaaaggattatggtggacagctggtggcctgcttcgcggtcgatcaggatgaaaacggcgaaaagccgcatgcataa

SEQ ID NO: 586 - DNA, 228 bp, Enterobacter cloacae
ggctggtgctacaagccgtttgaagatctgatccagccggcgcgtgcgaccgacgatcacaacaaacgtatcgaactgtataagcaagcgcaggttgtcatgcacgatcaggctccggcgctgattgttgctcactccaccgtgtacgagccagtgcgtaaagaagtgaagggctacgtggtcgatccactgggcaaacaccacttcgaaaacgtgtctgttgaataa

SEQ ID NO: 587 - DNA, 1002 bp, Enterobacter cloacae
agcagtaagaggcacgagatggcgttattaaatgtaaataaattatccgtgcactttggcgacgaaggcacaccgtttcgcgccgtggaccgtatcagctacagcgttaatcagggcgaagtggtcgggattgtaggagagtcgggctccggtaagtcagtgagttcgctggcgattatggggctgattgactaccccggccgcgtgatggcagaaaatctggagttcaacggtcaggatctgaagcgtatttccgaaaaacagcgccgccagctggtgggcgcggaagtggcgatgatcttccaggaccccatgaccagcctgaacccatgctacaccgtgggtttccagattatggaagcgattaaggtgcatcagggtgggaataagaaaacccgtcgccagcgtgctatcgatctgctgaaccaggtggggatacctgacccagcatcgcgtctggacgtttacccgcatcagctttccggcggcatgagtcagcgcgtgatgatcgccatggcgattgcctgtcgaccaaaactgctgattgccgatgaaccaactaccgcgctggacgtgaccatccaggcgcaaatcatcgagctgctgctggagttgcagcagaaagagaatatggcgctggtgctgattacgcacgacctggcgctggtggcggaagcggcacacaaaatcatcgtgatgtacgcgggtcaggtggtggagaccggaagttcgcacgatatcttccgcgcgccgcgtcatccgtatacgcaggcgttgctgcgtgcgctgccggagtttgcccaggacaaagcgcgtctggcgtcactgccgggtgtggttccgggtaaatatgaccgtccgcagggctgcctgctgaatccgcgctgcccgtatgcgacagataaatgccgcgccgaggagccagagctgaatctgctggccgatggtcggcagtcaaaatgccactacccactcgatgatgccgggaggccaacactatga

SEQ ID NO: 588 - DNA, 1221 bp, Enterobacter cloacae
caatcctctactatcgtcatgtcattttgcacagaggtcgtgatgaaagatgtcgttatagtgggtgcgttacgtacggctatcggctgttttcagggagcgcttgcgcgtcactctgcggttgatctcggcagcgtggtggtaagagcgctggtggaacgcagcgggattgccgcacatgaaattgatgaggtgatccttggccaggtgctgaccgctggcgcgggacaaaaccctgcgcgccaggcagcgctgaagggcggcctgcccaataccgtttcggcaattaccatcaacgacgtctgtggttcaggtttgaaagcgctccatcttgcgacgcaggccatccagtgcggtgaagcggacgtggttattgccggcgggcaggagaatatgagccgcgccccgcacgtcctgaccgacagccggaccggcgcgcagctcgggaacagtcagctgcttgacagtctggttcacgacgggctgtgggacgccttcaacgactaccatatgggcgtaacggcggaaaacctggcgcgggaatacggtatcagccgcgagcttcaggatgcatatgccctcagctcacagcaaaaagcgcgtgcagcgatcgactccgggcgttttcgcgatgaaattgtcccggtcagtacccagcgccagaacggcgaagcgctcatcgtcgataccgacgagcagccgcgcaccgatgccagcgcagaagggctggcaaaactcgatccggcctttgaaacgctcggttctgtaacggcaggcaacgcctcatccattaacgacggtgcggcggcggtgatgatgatgagtgaaagcaaagcccaggagctggcgctgccggtgctggcgcgcatcaaagcgtttgccagcgtgggtgttgatcctgcgttaatggggatcgccccggtctatgccacgcgccgctgcctggagcgggcgggctgggagctgagcgatgtggatctgattgaggtcaacgaagcctttgctgcacaggcgatctcggtcgggaaaatgctggaatgggatccgctgcgggtcaacgtcaacggcggtgcaattgcgctgggtcatcccattggcgcctccggctgccgcattctggtgtcgctggtccacgaaatgaaaaagcgtaacgcccgaaaagggatcgcaacgctctgtattggcggagggcagggggtggccctggctatcgaacggtag

SEQ ID NO: 589 - DNA, 717 bp, Enterobacter cloacae
aaacgaaacgttattttaattgagggttttttcatgtttaagaaatctctgctccttgcttcccttattagtgcctcttttgcggctagcgccgttaccgtcgatctgcgtcacgaatatattgacagcggctcgaatgccgaccgtgttgccgtctcgcaccgctttgataatggctttggtttttcagtcgaggcgaagtggaaatcaggcggggacaaggcagatcagccattcgcggatgtagtggggaacggtcacgaagatcagattagctggcgctggaaagcgacagacaatatcgccctgacccctgcgtttacgattgaaagcacagacagtcgcaccatttataaaccgaatctgcatgtgcaatatagcttcgataatggcttctacgtggctgcgcgttaccgttacgaatatactcgctacccgtcaagctcaaataaggacgatgataaagttaaccgtggcgatgcgtgggtcggttgggtattaggtgactggcgtaccgagctgaactatgtttacgcgaaaagttctgaaggcgtggcccgaaataataataaagattattccaacgaatataacgccaagctggcctacaaatgggataaaaactgggcaccgtatgtggaggtggggaacgtgggggttaaagacacggacgaacgccagacccgtttccgtttaggtgtggcgtactccttctga

SEQ ID NO: 590 - DNA, 327 bp, Enterobacter cloacae
agtagatacatcatgcgttattctcccgaagcactgaccgcgtttgttgaaactgtcgccgcaggttcgttttctgctgcggcacggcggctgcgtaaaagccagtccaccatcagcacctccatcgccaaccttgaagctgaccttggctttgagctgttcgatcgctcggcgcgtcacccggtgttgaccgcccagggtgaacaggtgctgggctatgtccagtcgatactcgccgccagcgcgcgcctggatgagctggccgtatccttaacggcgcaaaaagaaggccccgttttaacctttgttctctccgatacgctttaa

SEQ ID NO: 591 - DNA, 555 bp, Enterobacter cloacae
ccggccgtgctggaacagatgatgagcaagttcgaccagcgttttccgcacacggaatttgagtgcctgattggtgaagaggaggacgtgatcgatctgctgcaaaaggagcgggcgcaaattggcctgacggaagcgcgcgacagctacccgaccgatattggcgcgacccgtctgcctatgcagacaaggatggctatttacgtttctgccggacatcctctggcagggcaacatgagacgcaggcggacgagctgcatggctggcgcgagctgcggctgagtacctatcttgaacgggaagcgccccttgcgcgcgggccggtctggtctgcgccgaattacctgttactgctgagtatggcggtacagggctttggctggtgcgcgttaccctgcgcgctggtcgacgaatttgccgcgtcgaaatcgctggtgcagctgaacgtgccgggctggccgaggtcgattgccatcgatctggtatggaacaaacgaaccccgcccggcgtcgccggaagctggctgcgccagtacttgcaggacgcacgataa

SEQ ID NO: 592 - DNA, 276 bp, Enterobacter cloacae
tacgttgctctaatgtcgaaaatttggtcaaaagaagagactctctggagtttcgccctctacggcactgccgtgggcgcaggaaccctgttcttgcccattcagctcggctctgctggcgcgattgtcctgctgatcaccgcccttgtggcgtatcccttaacctactggccgcataaagcgctggcgcaatttattctgtcgtcgaagacgaaaggcaacgcagggatcacgtcttcaccagcaggggccggaagaatccaacgcaatgcgtat

SEQ ID NO: 593 - DNA, 1428 bp, Enterobacter cloacae
  unsure (713)
ccagtcacattgactacccttaataccctaagcggtaaaacaaggagattcgatatggcttaccagacagtaaatcctgccacgaaccagctcatcaaagaatatccctctcacactgacgcagacgttgaagcggcgctgaaggcagccgatgcgctctatcactccgaatgggcgaaaggcgacataagccagcgcctgccggtgctgcataagctggcggacctgatcgacgaacgcgtggaggatctggcgaaaatcgccagtcaggagatgggtaagctcatcgaacaaagccgcggtgaagtgaagctatgcgcgcaaatcgcccgctactatgctgacaacgcgaagcagttcctggccccggtgaagtatgactctgaactcggggaagcatgggttgagcatcaccccatcggcgtgctgatggccgtcgaaccatggaacttcccatactatcagctgatgcgcgttctggcgccaaacctggcagcgggcaacccggtgatcgccaagcatgccagcatcgtgccgcactgtgcagaaacctttgcacagctggtacgtgaaagcgggcgcccccggaaaggggcgtggaccaacctgtttatctcgtccgaacaggtggcgaacatcatcgccgacgatcgcgtacagggggcggcgctgaccggttcagaaaaaccgggtagcgtggttgcggcacaggntgcgaaacacatcaaaaaatcgacccttgaactgggcgggaacgacgtcttcgtggtgctggacgatgcggagctggagaaagccgtgaagatcggcgttaacgcgcggcttaataacgccgggcaggtctgtaccgcggcgaagcgctttatcctgcatgaaaagattgcagacgccttcctgagcaaattcaccgaggcgtttaagcaggtgaagattggcgatccgctggacgaaagtaccacgctggggcctttgtcatccaaagacgcgctggagacgctaactaaacaggttaacgaggcggtgaaaaacggcgcgaagctgcaccatggcggcaagccggtgcagcgtgacgggagcttctttgagccgaccatcctgaccaatatctcgcgcgataacccggcgtatttcgaagagttctttggtccggtagcgcagatttatgtggtgaaaaacgacgacgaggcggttgccctggcgaacgactcccactacggtctgggcggagcggtgttcagccagaacatcgagcgcgcgaagaaaatggcgtcgcgcattgagaccgggatggtgtacatcaactggctcaccgatacggcggcagaactgccgttcggcggcgtaaaacgttcgggttacggacgcgagctgtcggatctggggatcaaagagtttgtgaaccagaagctggtggtggtgcgtaagtga

SEQ ID NO: 594 - DNA, 1863 bp, Enterobacter cloacae
attggtaggcgtaatatggcaatcattattcccacggttagcagctgtagcgagaaaattacggcaggagaaaaaagactggcaaggcttctggagggtgggctcagcgaacaatgtacctgctggtatgatacccgaatgggagacaaagacgatcatcctgattttgtgattctggcccccgataaagggctgctgtttatagaagtgaaagactggtatatcacaaaaataaaatcggctaataaaacccatattaattatgaaaccaaaaacggcatagagccgttgaagaacccactcgaacaagttcgacaatatacctttcatatcatcaatagcctgaaaaaagatcccctgcttcgccagaaacagggagatcatgagggcggttttattatgccgtatggatacggcgtttatttgagcaacatcactcgggcacagctggaaaagagttttacacctgaggagttgaatgaaatattgcccgccagccaggtaatatgcaaagacgaactcaacgagtttatgactcgagaacaaatctctggccggctcgaatcccttctcaaacatcactttgttcataacacaacaccacagcagctcgaccgcatccggtggcatctttatcccgatgtccgcattaacccatccgttacgcgggttggcctggataattttactttccacacccctgatgtggtatgcatgatggacaggaaccaggaacaactcgccagaagtatgggggcgggacacagggtaattcatggcgtggcaggttcgggcaaaacgctcattttgcaccaccgatgtattgagcttgccaacaacattgaaaacaccaaaccgatactggtgatttgctacaacattacgctggctaaaaaactcaaagcgcagctcgaacagcatagcctcagacttcccgtcgaagttatccatttccacgcctggtgttatcagcaattaaacgcgcatcgacgtcttccccccaggagcaaaaactttattgagctgatggaaaatgcgctgacggtggcatttgaagaaggagcaatcacaccggagcagtacagcgccgttttgatagatgaaggacacgattttaaaccggaatggctaagaatcctcgccaaaatgccggacaataaagatagctccctgctgttcctgtacgatgacgctcagtcaatttatcagaaaaagaaagctctcgattttaccctgtccagcgtcgatataaaggctcagggccgtacaactattttggataccaattatcgcaacacccggcaaatactccattttgccagcagcgtaccatttaattatctcaataatcacatagaagcttctctcaaataccagcagcctgccgcaggtggcctgtccgggaagtatcccgcgctggccagctttgataatcaggacgaggagattacacgcgtcctcgattgggtcacagagcagcgacaggaaggtgttgcgtggtcagaaatcgccatactgtgcccctcaacctacagcatttcaggcatgctcgcgccaaggcttgaagcccgcaagatcccataccagatgattgtctccagcgatgataaaaagcactggtccccgcagaatgattacctctgcgtcatgccgctgcccagcagcaaggggcttgagtttaattcggtcgccattatggatgcggcaaaggaaagagacagtgaagatctgagtgacgatatcaagcgcctttacgtcggcattacccgcgcacgacagaatcttctggtgacaatgcacggaaccggaagcctgcgagatcatctggtcgagacctgggaaaagagcgttaagtcgatctaa

SEQ ID NO: 595 - DNA, 567 bp, Enterobacter cloacae
tttgatgacgaggaaacacgcatgaaaaagcttaacgttctcatcctttctgctctcaccgccgtatcgggctccgcactggcaatgggcggcagcattgagcagggtaaaaactttaccaacctgaatgtggaaatgggcaaatcaacctccggtctgtacaccgaaggtaattggctgaaaaacaccgacgacggcaccacgaccggtggcgtgggcgcaggctacaatttcgaagtcggcccggtaatgctgaacgcaggcgctaaggccctctacgttggcccgaagaaaggcgataacggcgtggcgttcccggtcggcggcggtgtgaacgttgccctgaccgacagcatcagggtattcggtgaaggctacgttgcgccagacggactgaacaacagcgtgaagaactacgttgaagctaacggcggcgtaagctggaccccggtcaaaccggttacgctgaaagtgggctaccgccacgtgagcgttgatggcaaagacggtcgcccaaaccacacgctggtagacggcgcttacttcggcggcggcgtgagcttctaa

SEQ ID NO: 596 - DNA, 222 bp, Enterobacter cloacae
ggaattttgcaaatggcaaagattaaaggtcaagttaagtggttcaacgagtctaaaggttttggtttcattactcctgctgacggcagcaaagacgtgttcgtacacttctctgcaatccagggtaacggcttcaaaactctggctgaaggccagaacgttgagttcgaaattcaggatggccagaaaggcccagctgcggttaacgtaactgctatctga

SEQ ID NO: 597 - DNA, 1779 bp, Enterobacter cloacae
atcagggcgttgatcaacagccctggggttaaggtgaaaaaaaagacaataacgaccaccggaaactttactccggcacgttttgcacttctgtgtctcgctatcttttgtagtcttgcgtttctgctgggccgcgtggcgtggctgcaaattatcaaaccggataatctggttaagcaggaggatatgcgctccctgcgcgaagtggcgatagacgccccgcgggggatgattgtggaccgtgaaggacgaccccttgcggtgagcgtacctgtccaggccgtctgggccgatcccaaaacagtgctggaaaaaggggggatcggttatgattcgcgctggcaggccctggcaaatgccttacacctttctctgagcacgctcgcatcgcgaatcaacagtaacccgcacgggcgatttatttaccttgcccgtcaggttgatccctcccaggcaaagtggatcgataagctgcgtcttccgggtatcaaccttcgcgatgagtcccgccgcttttatcctgccgggcacgtggcggcgaacctgattggcttcaccaatattgatggtcagggcattgagggtgtcgagaaaagtttcaacacgcagcttaccgggaaggcaggcgtgcggctggtcaggaaagatcgctacggacatgtggtggagaacctcacggaggtggctcccgtacctgcacataatatccagcttagtatcgatgaacgcctgcaaactatcaccgaagacgcgctggataatgccgtggcgtggaacaaagctgagtcaggcgcgtcggtgctaattaatatccagacgggcgaaattctggcgatggcgagcttccccgacttcaaccccaacaaccgggaaggggcaacgctggatgattttcgcaatcgcgcgatcagcgacacctttgaacctggctcgaccgttaagcctctggtgctgatgacggcgctacagcaggggctggtacagcctgacagcgtcatagacacgcatccctacaccattgatggccatcgtatccgcgacgtgggctactaccccgagctgacgatgaccggcatcctgcaaaaatccagtgacacgggcgtgtcccgtctttcgctggcgatgcctgtgcaacggttactggatacctataaacactttggctttggcgagagtaccgggcttggcttaacgggagaaagcgcaggtttactgccgcagcggaaattctggagccagttagaccgggcgacctttgcctttggatatggcctgatggtaacccccctccagctggcgcatgtgtatgccaccatcggcagctatggcattgaacggcctctgtccatcacccgaatcgatccgccggtgattggcaagcgggtgatgcccgaggaaattgttcacgaggtggagcacatgatggagagcgtcgcgttacccggcggtggtggaatcaaagcggcggtgcgtaactatcgcgtggcgataaaaaccgggacggccaaaaaaatcgatgaacacggtaagtatgtggataaatacgtcgcctataccgcaggcgttgcgcctgccagcgatccccgttttgcgctggtggtggtgattaacgatccgcaaaacggtgcctattacggcggggccgtttccgcgcccgttttcagcgaaatcatggggaacgttctgcgtctggaaaacgtaaagcctgacgggctgccggcagattctgaccatctgatcgtgatgcatcacccagccgtttataaccctggcgaatag

SEQ ID NO: 598 - DNA, 855 bp, Enterobacter cloacae
cggtacacttcgccttttggtttacgccctggagctgtcatgtctttcagttgtcccctttgccacgcgccgctgacgcgcgcggagaaaacgtttatctgtccacagggacatcagtttgaccgggcgaaagagggctatgtaaatcttctgccggtacagcacaagcgctcccgggacccgggtgacagcgcggagatgatgcaggcgcgccgggcgtttctcgatgccgggcattatcaaccgctcagggatgccgttgtcgccttactccgtgaatatctgacagaaggcgcatccgccatgctggatatcggctgcggcgaaggttactacaccgccacgtttgctgacgtggcggctgagaagggcgccgaaacgtacgggctggacgtatctaaagtggctatccgtgcggcagccaaacgctactcagcggtaacgttctgcgtggcctccagccaccgcctgccgtttgaggaagcgagtatggacgccgtggtgcgtatctatgcgccgtgcaaggctgaggagctggcgcgcgtcgttaagcccggtggctgggttatcaccgtcacgccagggccgcgtcatctgctggagctaaaagggctgatctatgatgaagttcacctgcatgcgcctcactctgaacagctggcaggctttgcgttaaagcaggcgcagtcggtagcgtatgaaatgacgttgcagggaagtgaagcggtggcgttactgcaaatgacgccgtttgcgtggcgggcaaaaccagaggtgtgggaaacgctggcagcgcagacagaatttcgctgccagacggatttcagcatccattgctggcagcgcgaaggttaa

SEQ ID NO: 599 - DNA, 425 bp, Enterobacter cloacae
attctatacctcgcccgcggttaagactcctgttcaacgcggtgcgtctgctgacccgttactacggcgtggcctacggctatcgtaaaggtgtggatatcgttaaggatatgggcggcggcttcctgcaaaaactgactgagggggcgtcaattctcggcctgtttgtaatgggggcgctggttaacaagtggacgcacgtaaacatcccgctggtggtatcaacgatcaccggtcaggatggtcagacgcgcgttaccaccgtgcagaccattctggaccagctgatgccgggcctggtaccgctgctgttaaccttcgcctgtatgtggctgctgcgtaagaaagtgaacccgctttggatcatcgttggcttcttcgtcatcggtatcgcgggctacgctgtcggcctgctgggtctgtaa

SEQ ID NO: 600 - DNA, 459 bp, Enterobacter cloacae
atgactgtcacggacaccgtactggttttatttattgttgcccttctggcttacgcgatctatgacgagtttattatgcctcgccgccacggcgagacgctgctgacccttcccctcttacgccgtggacgtattgatgcgtttatcttcgccggtctggtagtcatcctcatttacaataatgtgaccagccacggcgcaatattaaccacatggttattatgtgcgctggcattaatggcgatttacctgttctggatccgctcgccaaaactcatttttaaaaaacacggattcttcttcgccaatgtctggatagaatataaccgtattaaagagatgaatttatccgaagacggggttctggtgatgcaattagaacaacgccgcctgctcatccgggtcagaaatattgatgacctggaaaagatatacaaattacttgttaaaactcaatga

SEQ ID NO: 601 - DNA, 774 bp, Enterobacter cloacae
ggttgcgcccgtcgttggggagtagccgatttcctgcctgcgggaaatgtacgtgtcaacatactcgttgaaaaacgtggcgcgtacggatcgtttttaagcacaattactgtgccagaagcgatcaggcgagaccatagatacatcaactgctgtttactgggggcagtgatgtgtcatatggatatccccggtctggacgctcttatgaatatctccgctacgatccttctggcttttggcatgtccatggacgcatttgccgcctctatcggcaaaggtgccactctccataaacctaaattttccgaagccctgcgtaccggtctcatctttggcgctatcgaaacgctgacgccgcttatcggctggggactggggatgctcgccagccagtttgtgctggagtggaatcactggattgctttcgtgctgctggtgttcctcggcggacgtatggtgattgaaggttttcgtggcaacggcgatgaagatgatgcgccgctgcaacgccacggcttctggcttctggtgacaaccgccatcgcaaccagcctggatgcaatggccgtgggtgtcggtctggcgtttttgcaggtcaatattatcgccaccgcgctggcgattggctgcgccacgctgatcatgtcaacgctggggatgatggtgggtcggttcattggcccgctgttaggcaaacgcgccgaaattctgggcggtatcgtgttgatcgggattggtgcccaaatcctttgggcacacttcgcgggttaa

SEQ ID NO: 602 - DNA, 204 bp, Enterobacter cloacae
ttcagtcggttagaatacctgcctgtcacgcagggggtcgcgggttcgagtcccgtccgttccgccaatattcaggcccacgttacttgtaacgtgggcctttttgtttttcctctttctcatgttttccttaatttctgctctggcacatctgctgaaaatcatatttataccattctgttttttgtatttaatcaattctaa

SEQ ID NO: 603 - DNA, 3627 bp, Enterobacter cloacae
atttcaccaaggactttaagtatgactgaaaataaggtcattttagcggtcaacaacggagacggtaaaacgcggttgttgacagcagatgcaggccgaacggttaaggtaaagcttatccccggcaataaatatttgctgaaaaatgtgaatgacgactttgcgccagaaaatattacgcttcaacgcgttggcaaagcgttacatattattcaggaaggcgacacacagcccagcattattattgaaaattattttgacggcgattcgaaaaacccaaccctgatgggtatggcagaagatggattgctttatgcctatatccctttgtctggtgaaagctacgataatggctatctcatggctgaaggtggtctggctccggttgccctgggcggtgaaccgttaggcgccggtgggcctcttttgtctgccccggacgacgaaaatgacatgctgtttggcatgttagggtggtttgcgcttgcggcggcaggtgttggcgctgcgtttgctctgtccgaactggacaaggatgaaagcgatagccagcccgcccccgaaaaaccgagcattggcaaggctgtggatgatgaaggctcgattaaaggaccgcttaagtccggagacgtgactgatgactcaacgccttcattaatcggtaaaggcaagccgggcgataccatccatatcatcgataatgataaggaaattggctccgtcatcgtcgacgacgaaggcgaatggagctatacgccggataagccgctgggcgaaggtgaacatgacctctccgttgtggttgaagatccggacggcaacatgagcccgccgtctgaccccattaccatcgtggttgataccgttgcgccagatgcgccaacgattgagcacatcatggataaagtgggtaaagtcaccggcgagatccttgaagacgcttacaccgacgatccaaaaccggagatgagcggtaccggtgaagcgggcgcgacgattaccatttacgataacggtaaaaagatcggcgaaaccagcgttaacgacgacggtcgttggtatttcaaaccttcagaaaacctgactgacggcaaccacagcatcacggttagccagacggataaagcgggtaacgtcagcgagccttctgatgaacgtgattttattgttctgacggaacctccggggaaagcagaaacgccgtcagttattgacgacaacggtccggtaacgggtccgcttaagccgggtgacgtgacggatgacactaaaccttcattcagcggtgaaggcacgccgggcaataccatcgttatcaaggataacgacaaagagatcggctccgttatcgtcgatgacgaagggaagtggacctacacgcctgagaaagatctcagcgagggtgagcataacgttgaggtgattgaagaagatccgctgggtaatgtcggccaaccctccgatccgatccagatcattgtcgataccacgccgccggcaagaccggacagggtctatgctgaagataataccggtccgattaccggccagctgaagggcggcgacgtcactgacgaaacgcgtccggtattcagcggtaaaggtgaaccgggcgacaccgtgaccatttatgatggtgatgaagttctgggctctaccgtcatcgatgacgaaggcaactggtcgctgaaaccggagaaaccgctgggcgaaggcgatcacagcatcaccgttacgcaaacggataaggcgggcaataccagcgacccctcggaagcgctggagtttgaagttgacactaccgcgcctgctgcttcagcagatgttctgaaaattaccgccgtagcggatgacgtaggcgatcgtcagggcaacgttgccagcggtgaaatcaccgatgacagcaagccgctcattagcggtatcggcgaagcgggcaataccgtctatgtctataccaccgacgcctccggtaaacacctgattggttcagcggttgtgggcagcgatggcacctggagcctgacgcctgaaaccccactgacggaaggtttgaaccagctgacgctggagacacaggatccggcgggtaaccgcgttgcgggcgatgcaccgtcttacgacatcaacctcatgatcccgatcagcactcagccgtccatcaacagcgtggtggacaattcagaaccacacgttggcccgctgcaaaaaggcgacgccaccaacgataccacgccaaccctgagcggcagcgctgcgccgggtgacatcgtgtcgatcctcgacaacggtaaggtgattggctccgtcacggcggacagcaacggcaagtggacgttcactccggacgccgcgctggctgatggcaagcacaccttcaccgtcactgcgactgacgcagcgggcaactcgcgcaccagcggcagcttcccgatcgtgattgacactgcggcaccatctccggcagaaaatatcgttatcaatgataacgtgggcgacaagcagggaccggtaggttcaggcgacaccacagacgatcagtccccgaccctgagtggcgaagccgagccgggcagcgtggtggacatctatgataacgacgagaagatcggttccgtcatcgttgatgacgaaggtaaatggtcctatacgccagacaaaccgctggataaaggcgatcatgagatcaccactaccgtaaccgatccgtctggcaacaccagtgaaccgtcgccggggatctccttcaccgtcgaccctgatccaaaccaggttaccgtgggtgaagtggtggatgatcagggcccgatcgtgggcaacctaaagccgggcaccgtgaccgatgatgttcgccctgaactgagcggtaaaggtaagccaggcagcaccgtgaccattaaagatggcgacgacgtgctgggctccaccgtggtggatccggacggcaactggacgttcacgccagagcaggatctggctgacggcaatcacagcctgaccgtggtgtccaaagatccggcgggtaacgaggtgacctcaccgtccttcgatatcaccgtcgatgcgaccgcgccggaaaaacctgtgctgggatccgcaacggatgacgtgggcactattcgcggcgatctgagcaacggcagcaccaccgacgacgcaaacccaaccttcaacggctctgcagagccgggcatccatcagctggttaagcgatttcagggccgttttggcatgctgataacgcaacgccagcccgacaacggatgccagcggggcgagagaacggctggaaaggatcactacgccaatcatggcgcccatcgtgagctcgcccgcgtggatcaaatacacacccagcacaacaatacagaccgtggtaatttgctgaacgaaggagacaaaattggtagtcagcatggaaaggttgcgggttttcatggaggaagcggcagccagcgcgctgaaatcatcccagcgcttttgcataacgccttcaccctgcgcagctttcagggcttcaagtccctcaatgctttcaatcagcaggccttgcttgagcgaaatctcgcgaacgttttcttccatatagcgacccagcggccactgaataacgatgctggcaattaa

SEQ ID NO: 604 - DNA, 570 bp, Enterobacter cloacae
aataaatgtgtttgtccttcttttcgtactgaacaacagggcgagtgtaatggttctgaattttatatctggcctgaaaataactcttttttgatagaaggtatattacaatactttaacaacattacggttaaaatcatttctcaacccattgtagtcattgattttaactataagaatataaattttttcttaacaaacagctggttagatcgttttaaaaacgcaagactgatcctgataactgataaaaagatggccgcgattgcccattactggttttataacgacacaagcgaaacaataatcagcaccgtcatttttcatgatgatattattgatgatataaaatttaaaattcgccagtcgttccttggcaagataacgcgaccttcggagaagaaagccaaacttagtgcaaatgaatacgccctgttttctgaattgtataagggacaactcccgaaaaagatagccatgaagaatgctacaaatgttaaaaacatttacgccatgaagataagaatcgagaacaagctgggcgtacctatttcaaggctcgccagttaa

SEQ ID NO: 605 - DNA, 1806 bp, Enterobacter cloacae
aaaaacataaacctggatcaatccacatataatattcttaatcatgcagtggtttatctttattgtgtacatatacggctaactttacactacgatattgccagcgcttgtaatttcactataaccatcagccataaacttcgtacttacggatgttcttggtcaattttaatagcatgccttcactttatttttaaagtaaggaacgtaactacaggtctggattcgataatgaatacgcatctttccaccgtaaaatttaattcagagcacgatttcaataatattgaagaacccagaaaagattctcttctgtggggtgttgaatggctttgtgcacatcacgctaagtatgccagcaaagaagttctttacgctggcttgccgaaaagcgacaagcttgagccggaaatggctttgcgtatgctcgaccagatggggatatctgctggctgggtaaaacgcgatcttaattcaatatcgtcctggctctttccgctgctgatcgcccgcaaagatggaacgtattgcattattaccgcgcgtaacggtaaacgcggacaattcacctatcagatcgtggtgcctgaaaacgaaggaatacttaccgtttcagcggctgatttgctggaagtttacggcggctatgcccttgtcaccacgccaaaacccagtctggatgcgcgtgccgacgatctcctcttaccgaaagcgcagaatgaaggtcactggctttattctacgctgtggcgctaccgccactatttttacagcgctgcgctggcggcactgctggcaaatatacttacgctggctggcaccttctttacgatgaacgtctatgaccgggtgatcccgacgcaggcctatgtcaccctctggtcgctggctattggcgtcgtgattgccaatatatttgagttttccagccgccagatccgcgcatacctgatcgatatcgcggggaaaaaggcagacctgatcctgggcgcgaagctttttcgccaggtgatgtctatgcgcatggaatataaaccacagtcttccgggaccttcgctaaccagctgcgcgattttgaggcagtacgggattttattacctctgcgacgctcgccacgctgtccgacctgcccttctgcgtgctgttcatgttcatcatttatatgattggcggtccgcttgccgtggtgcccctggtggcaatgccgctcattttaattgccagcatcgttattcagtggccgctgggtcgctatatggaagaaaacgttcgcgagatttcgctcaagcaaggcctgctgattgaaagcattgagggacttgaagccctgaaagctgcgcagggtgaaggcgttatgcaaaagcgctgggatgatttcagcgcgctggctgccgcttcctccatgaaaacccgcaacctttccatgctgactaccaattttgtctccttcgttcagcaaattaccacggtctgtattgttgtgctgggtgtgtatttgatccacgcgggcgagctcacgatgggcgccatgattggcgtagtgatcctttccagccgttctctcgccccgctggcatccgttgtcgggctggcgttgcgttatcagcatgccaaaacggccctgaaatcgcttaaccagctgatggatgcccggctctgcagagccgttgaaggttgggtttgcgtcgtcggtggtgctgccgttgctcagatcgccgcgaatagtgcccacgtcatccgttgcggatcccagcacaggtttttccggcgcggtcgcatcgacggtgatatcgaaggacggtga

SEQ ID NO: 606 - DNA, 990 bp, Enterobacter cloacae
aaaactgctgcacttccgggagcacagggagggcgtatgagtgcttttgcccgccgtctcgaaacccttcacgccacgcgtcccgtaacggtgctcggcgcggcggtcatcgacgtgattgccgacgcctacgctctgccctggcgcgggtgtgatatcgaactgaagcaacagggagtgaatattggcggctgcgcgctgaatatcgccatcgccctgaagcggctcggcattgctgcgcaaaacgcgcttcctgtcggccacggcgtgtgggccgatattatccgtaacgccatggcgaagcaggatctgcacagcgccgtggaagcggaaacgggcgataacggctggtgcctggcgctggtggagcctgacggtgaacggacctttatgtcgttcagcggcgtggagaatcagtggcagcagcgctggctggacgggttaagcgtgccggcagggagcctgatctctttgtccggctaccagctggcgtcccccagcggtgagctgctgacggcctggctggaaagtcttcaggatgcgacgctctttatcgatttcggtccgcgcatcgcggatattcccgacccgctgatggcaaggattatggcctgcaaaccgattgtctcgcttaatcgtcaggaggcggaacttgccgcagaatggcttggcgtaagcgtggaagagctcggcacacggtggcagcagaggtttggcgctgcgctgatcatacgccatgataaagacggggcggtctggtatgacggtgacgcttccggacacgttccggcgtttcctgctaccgtggtcgataccatcggcgcgggtgacagccatgcgggaggtacccttgccggtctggccgcgggatggtcactgccagaggcggtgcagcttggcaatgccgtagccgcctgggtagtcagccatcgcggtggcgactgcgcccccacgcgcgaggccctactcctcgcacacaaagacgtatag

SEQ ID NO: 607 - DNA, 1005 bp, Enterobacter cloacae
atgaaacaagaccgtattctcggtgctctttacgggcaggcgttaggggatgcgatgggaatgccgtcggagctgtggccgcgcaagcgggtgaaagcgcacttcggctggatcgaccgtttcttacccggcccggctgagaataatgccgcctgttactttaagcaggccgaatttacggatgatacgtcgatggcgctgtgcctggccgatgcgattatcgaatgcgagggggaaattaaccctgacgttatcggtaagcatattctggactgggcgctggattttgacgcgttcaataagaatgtactcggcccgacctccaaaattgccctgaacgccatccgtgacggcaagccggtgagccagctggaaaacaacggcgtcaccaacggtgcggcgatgcgcgcctccccgctgggatgcctgctgccggccacgcgtctggcgcactttgtggaacaggttgcgttagcctccagcccgacccataaatcggatctcgccatcgccggtgcggtggtgatcgcctgggcggtttcacgcgctatcgacggcgagcgctggcagaacatcgccgatgccctgccgggtattgcccgtgcggcacaggaggcgaacacgaccaccttcagcgcatcactttccgctcgtattgagctggccctgaaaaccgtgcgcgaagccaacggtaccgagtccgccagcgagcagatctatcagcttattggcgcgggcacgagcacccttgagtccgttccggcggcgattgcgatggtcgaactcgcgggcaccgatccgaaccgctgcgcggtgttatgcgccaacctgggcggtgatactgacactatcggcgcgatggcaacggccatctgcggtgcgctgcacggtgtacaggccattgatccggcactcaaaaacgaacttgatgccgtaaaccggctcgatttcggccactactgtgaaaaactgctgcacttccgggagcacagggagggcgtatga

SEQ ID NO: 608 - DNA, 1236 bp, Enterobacter cloacae
tggtttatctggggcgcatggtttgtcccgctgtggctgtggatgagtaagagcgggtttaccgccggggaaattggctggtcgtatgcctgtaccgcgattgccgcgatcctctctcctatcatggtcggctcgctgacggaccgtttcttcgccgcccagaaagtgctggccgtgctgatgttcgctggcgcgattctgatgtatttcgcagcacagcaaatccagttcagcaccttcttcccgctgctgctggcctactccctgacctatatgccgaccatcgcgctgaccaacagcatcgcctttgcaaacgtcgatgacgtagaggctgatttcccgcgcatccgcgtgatgggcaccatcggctggattgcctccggcctggcgtgcggcttcctgccgcagatgatgggctatagcgacatctctgacaccaatattccgctgctaatgaccgctgccagctcccttctgctcggcgtcttcgcgttgttcctgccgaacacgccaccaaagagtaccggcaagctggatttcaaagtgatgctggggctggatgcgctgatcctgctgcgcgataaaaactttctggtgttcttcttctgctcgttcctgttcgccatgccgctggccttctactacatctttgccaacggctatctcaccgaagtgggaatgaaaaacgccaccggctggatgaccctcggccagttctctgaaatcttcttcatgctcgctctgccgttctttaccaaacgctttggtattaagaaggtcttgctgctgggcctgatcaccgccgccattcgctacggtttctttgtttacggtggcgccgagcaatacttcacctacgccctgctgttcctcggcattctgctgcacggcgtaagctatgacttctattacgtcaccgcgtacatctacgtggataaaaaagcgcccgtgcatatgcgcaacgcggcgcagggcttgatcacgctgtgctgtcagggctttggtagcctgctgggttaccgtctcggcggcgtgatgatggaaaaaatgttcgcatataaagagccggtgaatgggctgaccttcaactgggccggaatgtggacgtttggtgcaatcatgattgtggtgattgccgtgctgtttatgctgtttttccgcgaatcggataaagagatcaccgcaattgaggtggttgatggcgataccgcgctgacacgaggggaagttaaatga

SEQ ID NO: 609 - DNA, 896 bp, Enterobacter cloacae
ccacgtatccctttggatcctggccagcgtcccgttgtgtgaagacgctttgcctccgcgtttctggacgcgctttacgcgctggaggaacaggtatgacacgcataaatgccctgactattgcgggaaccgatcccagcggcggagcggggatccaggcagacctgaaaaccttctctgcgctcggcgcttacggatgttcggttatcaccgcgctggtggcgcaaaacacgcgcggtgtacagtcggtgtatcgcattgagccggattttgtcgccgcacagctggattcggtattcagcgatgtacgtatcgacaccaccaaaattggcatgctcgcagaggcggacattgttgaagcggtcgcggaacgtctcaaacgttatcagataaaaaacgtggtgctcgataccgtgatgctggccaaaagcggcgatccgctgctctccgcctcggccgtcgacaccctgcgtaaaaagctgctgccgcaggtggcgctgatcacgccaaacctgcctgaggccgccgcgctgctggatgcgccacacgcgcaaaacgaacgtgaaatgaaagagcagggcaatgcgctgctggcgatggggtgtcgcgcggtactgatgaaaggcggtcatctcgatgatgcagaaagcccggactggctcttcacccacgatggcgcgcaacgtttcaccgccccgcgcgtacagaccaaaaacacccacggcacgggctgtacgctctcggcggcgctggcggcgctgcgtccccgaaacgcgaactgggcggatacggtacaggaggcgaagatctggctctcggacgcgctggcaaaagccgattctctggaagtgggtcacggtattgggccggttcaccattttcatgcatggtggtaa

SEQ ID NO: 610 - DNA, 789 bp, Enterobacter cloacae
gccgtatactggcataaaaccttatgccagagaaaaacagagatggaacaagcgcatacccggttaattgctcaactcaaggaacgaattgccgcaccggacaacacgccgctgtatctgaaatttgccgaaacggttaaaaacgcggtacgcagcggcgtgctcgcgcacggtaatattttgcctggcgagcgcgatctgagccagcttgccggtgtgtcgcgcattacggtgcgtaaagcgatgcaggcgctggaagaggctggcgtcgtcacccgcgcgcgtggatacggtacgcaaatcaacaatatctttgaatattcgctaaaagaggcgcgcgggttttctcagcaggtggtgctgcggggcaaaacgcccaacacgctgtgggttaataaacgcgtcgtgaaatgtccggaggagatcgcccgccacctttcccttgcgccagacagtgatgtatttctgcttaagcgcatccgctatgtggatgacgatgcagtatcgatagaggagtcctgggtaccagtaggattaattcccaacccggacgacattggcgtctcgctttatgattacttccgcagccagaatatctttccgcagcgcacccggtcccgcgtcagcgcccggatgccggacagcgagtttcaggcgcatatcaagatggacgataagataccggtgctggtgatcaagcaagtcgcgctcgatcaacagcaccggccaattgagtacagcatcagctactgccgcagcgacctatacgtctttgtgtgcgaggagtag

SEQ ID NO: 611 - DNA, 1629 bp, Enterobacter cloacae
acaaacatcatgaacacgacgcctgaacttcattgtgatgtactgatcattggcagcggtgctgccggcctctccctcgcactgcgcctggcggaacatcagaacgtaatcgtgctgagtaaagggccgatgagcgaaggttccaccttctatgcacaaggcggtattgccgcggtgtttgatgaaacggatagcattgcctcgcacgtagaagacaccctgattgccggtgccgggatcgtggatgagcatgccgcagagtttgtcgccagcaatgcccgccactgcgtgcaatggcttatcgatcagggcgtgctgtttgatacgcaggttcagcctaatggtgaagagagctatcacctgacccgtgaaggcgggcacagccaccgccgtattctgcacgctgctgatgcaaccggaaaagcggttgaaaccacgctggtcagcaaagccctcagccatcccaatattcgggtactggagcgcagcaacgccgtcgacctgattatttccgataaaattggcctgcccggcacgcgccgtgttgtcggcgcatgggtgtggaatcggaataaagagaaggtggaaacctgccaggcaaaagccgttgtgctggccaccggcggcgcctccaaggtttaccactacacgactaacccggatatcgcctccggagacggtatcgccatggcctggcgcgcaggttgccgcgtggcgaatctggagtttaaccagttccatcctaccgccctgttccacccgcaggcgcgtaacttcctgttaactgaagcgttgcgtggcgaaggcgcgtatctgaagcgtccggacggttccaggtttatgccggacttcgacccccgaggtgaactggcaccgcgggatatcgtggcccgcgccattgaccacgagatgaagcggcttggcgtggactgtatgtatctggacattagccataaaccggcagactttattcgccagcacttcccgatgatttatgaaaagctgctgagtctgggtattgatctaacccgcgatccggtgccgattgtacctgccgcccactatacctgtggcggggtgatggttgacgatcatggtcgtaccgacgtggatggtttgtatgcgatcggcgaggtcagctataccggcctgcatggtgcgaatcgcatggcctcaaactcgctgctggagtgtctggtgtatgggtggtcggctgcggaagatattaccaaacgcatgccctatgcacgtccgacaacacacttgccggcatgggatgaaagtcgggtagaaaacccggacgaactggtggttatccagcataactggcacgagctgcggcttttcatgtgggattatgtcgggattgtacgcacaacgaagcgtctggaacgcgcgttacgccgcatcatgatgttgcagcaggaaattgatgaatattacgccaacttccgcgtttccaataatctgctggagctgcgcaaccttgtgcaggttgccgagctgattgtgcgctgtgcaatgatgcgcaaagagagccgtggcctgcattatacgctggactatcccgaaccgcttgaaacgtccgggccgtcggtgttgacgccgcaggttcacataaaaagataa

SEQ ID NO: 612 - DNA, 1332 bp, Enterobacter cloacae
aacatgactgtaacgactttttccgaacttgaactcgatgaaagcctgctcaatgcccttgagagcaaaggctttacacgcccgaccgccattcaggccgcggccattccgcctgcgcttgagggccgcgatgtgctcggttctgcgccaaccggcacggggaagacagcagcctacttgctgcctgtgttgcagcatttgctcgactttccgcgtaaaaaatcaggcccgccgcgcattttgatcctgaccccgacccgtgaactggcgatgcaggttgccgaacacgcgcgtgagctggcggcgaacacccatctggatatcgcgaccatcaccggcggcgtagcgtatatgaaccacgccgaagtgttcagcgaaaaccaggatatcgttgtcgcgacgacaggccgtctgctgcaatacataaaagaagagaacttcgactgccgcgcagtggaaacgctgattctcgatgaagctgaccgcatgctggacatgggctttgcccaggacatcgaacacatcgcgggtgaaacgcgctggcgtaaccagacaatgctgttctcggcaacccttgaaggggatgccattaaagatttcgccgaacgtctgctggaagatccggtggaagtgtccgctacgccatcgacccgtgagcgtaagaagatccaccagtggtactaccgcgcagataaccttgagcataaggttgagttgttgaaacacctgctgaagcaggaagaggcaacccgtaccatcgtattcgtacgcaaacgtgagcgcgtgcatgaactggcagaaatgctgcgcaatgccggtatcaacaactgctatctcgaaggtgaaatggcgcaggttaagcgtaccgaagggattaagcgcctgaccgatggccgcgtgaatgtgctggttgccaccgacgttgccgcgcgcgggatcgacatcccggacgtgagccacgtgatcaactttgatatgccgcgcagcggtgatacttacctgcaccgtattggtcgtaccggccgtgcgggccgcaaaggtattgctatctctctggtagaagcgcacgaccatttgctgctacagaaaattggccgctacgttgaggagccgctgaaagctcgcgtgattgacggacttcgtccgaccacacgtgcgccgagtgaaaaaatgacgggtaaaccgtccaagaaagcgctcgcgaaacgtgctgagagaaaagagaaagaaaaagagaagccgcgcgttaaacagcgccaccgcgataccaaaaatattggtaagcgccgtaagccaagctctgctgcgtcagagacaaaaacggaagagtaa

SEQ ID NO: 613 - DNA, 396 bp, Enterobacter cloacae
gggaggcaacacatgattacaggtatccagattactaaagctgcaaatgacgatctgctgaactctttctggctgctggacagcgagaaaaacgaagcgcgctgtgtagtagcgaaagcaggttttgcggaagacgaaatcgttccggtgagcaaactgggcgaaattgaataccgtgaaattccaatgcaagtgcagccagaagtacgcgtggaaggtggtcagcacctgaacgttaacgtcctgcgtcgcgaaacgctgatggatgccgttgagcacccggaaaaatacccgcaactgaccatccgtgtgtctggctatgcggtgcgtttcaactctctgaccccggaacagcagcgcgacgttatcgcgcgtacctttactgaaagcctgtaa

SEQ ID NO: 614 - DNA, 1089 bp, Enterobacter cloacae
ttttttacgcggaaagtcgagcaaatgctgcaacacaggcagcaagtaggctgctgtcttccccgtgccggttggcgcagaaccgagcacatcgcggccctcaagcgcaggcggaatggccgcggcctgaatggcggtcgggcgtgtaaagcctttgctctcaagggcattgagcaggctttcatcgagttcaagttcggaaaaagtcgttacagtcatgttctacctctgtgtggggcgctgattatagacgttacggctgtaatcttcatctgtttgtatggatatcgcttttcgaccacttcgctttcccctatgctactccagtttcactcagaaggttgccctgacatgtctcaactcaaagcgcagttgcgccgcgatggttttacgtttaaacagttttttgtggcgcacgatcgttgtgcgatgaaagtcggtacagacggtattttactgggggcatgggctcctgtcgcaggtgtaaaacgcattctggatattggtacgggcagcggacttcaggcgctgatgctggcgcagcgaacggaagaacacgtcacgatcgatgccgttgagcttgatcctcaggcggcccggcaggcaagtgaaaacgctgccgactctccgtgggcagaacgcatcagggtagaatgcgccgatgtcctgacctgggcgccggagcagaccgcgcgttacgatttgattgtcagcaatccgccgtatttcacgccaggcgtggaatgtggcacgccggaacgcgagcaggcacgttacaccggctcgctcgatcacaaggcgctactgaccagtgcggcggagctcatctcggaagagggatttttctgcgtggtcttgcctgaaagcacgggtaataccttcattgagatcgcacatgagatcggctggaatctgcgtcttcgtaccgatatttcggatacggaaggacgcttaccgcaccgcgtgttgctggcactctcgccgaaagagggcgagtgctttatcgacaggatggtcattcgtgggccagaccagcgttattccgaagattacacagctctgacccaggccttttatctttttatgtga

SEQ ID NO: 615 - DNA, 414 bp, Enterobacter cloacae
agtggcgtttcgataacgcgtggaatttggtttggggagacattacctcggatgagcgagcagttaacggaccaggtcctggttgaacgggtccagaagggagatcagaaagcttttaacctactggtggtgcgctaccagcataaggtagcgagtctggtttcccgctatgtaccgtcaggcgatgttcctgatgttgtacaagagtcttttattaaggcctatcgcgcgctggattcattccggggggatagtgctttttatacctggctgtatcgtattgcagtcaatacggctaagaattatttggttgctcagggccggcgtccgccttcaagtgatgttgacgctatcgacgcagaaaacttcgaaagtggcggcgcgctgaaagaaatttcgaaccctgataactta

SEQ ID NO: 616 - DNA, 915 bp, Enterobacter cloacae
tatgtgttcatcactaaaacggaacgttgtttcgttatttatctttgccttcgggcacgatcaattctggaggtttacgtggacgtcagacaaagcatccacagtgcgcacgctaaaatgctggatactcaggggctgcgcagtgagtttttagttgagcaagtgttcgaagccgacaagtacaccatggtctacagccatattgaccgcattattgtgggcgggattatgccggtggcgaaaaccgtctccgtgggcggtgaagtgggcaaacagctgggcgtgagctacttcctcgaacgccgtgaactgggcgtgattaacatcggcgggccgggcaccattaccgtcgatggccagtgctacgaaattggtcaccgcgacgcgctgtacgtcggcaaaggcgcaaaagaggtggtgttcgccagcagtgatgccagcaaaccggcgaagttttactacaactgcgccccggctcatacgacttacccaaccaaaaaagtcacgccagcggacgttgccccggtgacccttggcgataacctcaccagcaaccgtcgcaccatcaacaaatactttgttccggatgtgctggaaacctgccagctcagcatggggctgaccgagcttgcgccgggcaacctgtggaacaccatgccgtgccatacccacgagcgccgcatggaagtctacttctatttcaacatggatgaagacgcctgcgtgttccacatgatgggacagccgcaggagacgcgccatatcgttatgcacaacgagcaggcagtcatttcgccgagctggtccatccactctggcgtgggaacgaaagcctatacctttatctgggggatggtcggtgaaaaccaggtctttgatgacatggaccacgtcgctgttaaggatctgcgctag

SEQ ID NO: 617 - DNA, 771 bp, Enterobacter cloacae
ggaacaaacatgattctggatgcattttctctgcaaggtaaagtggctgtggtttccggttgtgacaccgggctggggcagggtatggcgttaggtctggcggaagcgggctgcgatatcgtcgggattaacatcgttgagccaacggaaaccatcgagcgcgtcaccgcgctgggccgccgtttcctgagcctgaccgcggacctgcgcaaaatcgatgcgatccctgagctgctggatcgcgcggtggcggagtttgggcatatcgatattctggtcaacaacgccggcctgatccgtcgtgaagacgcgattaacttcagcgaaacggactgggacgacgtgatgaatctgaacatcaagagcgtgttctttatgtcccaggcggctgcgaagcacttcattgctcaggggaaaggtggcaagatcattaatattgcctccatgctctctttccagggcggcatccgcgtgccgtcttacaccgcatcgaagagtgccgtgatgggcgtgacccgcctgctggcgaacgagtgggcgcagcacaacatcaacgtcaacgcgattgcgccgggctacatggccaccaacaatacccagcagctgcgtgcggatgaagagcgcagcgcggcaatcctggagcgtattccagcgggtcgctggggtctgccgagcgatctgatgggcccggttgtattcctggcgtccccggcttcggactacattaacggctacaccgttgccgtagacggcggctggctggcacgttaa

SEQ ID NO: 618 - DNA, 1557 bp, Enterobacter cloacae
cgaatttcgctgttgaggcaggaaacaatgacatctgtaaatgactctacccttatgcccgctgcgctgcgcgatacccgacgcatgaaccagtttgtttctgttgcggccgccgtagccggtttactgtttggtctggatatcggcgttatcgcgggcgcactgccctttattaccgaccactttacgttaagcaaccgcctgcaagagtgggtggtgagcagcatgatgctgggtgcggccatcggcgcactgtttaacggctggctgtcgttccgtctcgggcgcaaatacagcctgatggtcggggcgatcctgtttgttgctggctctcttggttcggcgtttgccaccaacgttgaagtgttgctgctttcccgcgtgctgctgggcgtggcggtaggtatcgcgtcctacaccgcgccgctttacctctccgaaatggcgagcgaaaacgtgcgcgggaagatgatcagcatgtaccagctgatggtgacgctcggtatcgtgctggcgttcctgtcggatacgtacttcagctacagcggcaactggcgggcaatgcttggcgtgctggcgctgcctgcggtgctgctgattgtgttagtcattttcctgccgaacagcccgcgctggctggcgcaaaaagggcgtcacgtggaggcggaagaggtgctgcgcatgctgcgcgacacgtctgaaaaagcgcgtgaagagctgaacgaaatccgcgaaagcctgaagctgaagcagggcggctggtccctgtttaaggcgaaccgcaacgtgcgccgcgcggtgttcctcggcatgctgttacaggcgatgcagcagttcacggggatgaacatcatcatgtattacgccccacgcatctttaaaatggctggttttaccaccaccgaacagcagatgatcgccacgctggtggtggggctgacctttatgttcgccacctttatcgcggtgttcaccgtcgataaggctggacgtaaaccggccctgaaaattggctttagcgtaatggcgctcggcaccttgatccttggttactgcctgatgcagttcgataacggcacggcgtcaagcggcctctcctggctctccgttggcatgaccatgatgtgcatcgccggttacgcgatgagcgccgcaccggtggtgtggatcctgtgctctgaaatacagccgctgaaatgccgcgactttggtatcacctgttccaccaccaccaactgggtgtcgaatatgatcattggcgcgaccttcctgacgctgctggatgcgattggcgcggcaggcaccttctggctctatacggtgctgaacgtggcgtttatcggcgtgacgttcaagctgatcccggaaaccaaaggcgtgaaccctggaacatatttgaacgcaaccctgaagaaaatgggaaaaacaccagtaatatcggggttttatgttattgcccggggtgtcccccccactttccggggcgctctcctcccttttgcgccgtccgtcactaccctagtctccgcgtgctctccccagcacttttcctcctaa

SEQ ID NO: 619 - DNA, 741 bp, Enterobacter cloacae
ttttcaacctacattacgcgttcaaaggagtgcattatggctaaaggtatgcgggtcaagctgaactatgaggtcagccgcgatccggatacaggcgtggaagtcacccgcctgaccccaccggaagtaacctgtcatcgcaactacttttaccagaagtgcttctttaacgatggcagccacctgctgttcgccggggagttcgacggtcactggaactattacctgttggatctgaaaaacgccgaagcggtacagttgaccgaaggcgcgggcgataatacctttggcgggttcctctctccggacgataaatccctctactatgtgaagaacgatcgcaccctgctggaggtggatttacagacgctggcagagcgcgaagtgtaccgcgttccggaagagtgggtcggctacggcacctgggtcgcgaacagcgactgcaccaaactggtgggtattgagattgccagatgtgactggacgccactcaacgactggaaaattttccacgacttcttccacaaagggccgcactgccgcctgctgcgcgttgatctgaaaacgggtgaaagcaccaccattcatgacgagaagatctggctgggacatccgatttatcgcccgttcgatgacaataccgtggccttctgtcatgaagggccgcacgacctggtcgacgcccgcatgtggctggtcaacgaagatggcagcaacgtgcggaaagtgaaaacgcacgcg

SEQ ID NO: 620 - DNA, 861 bp, Enterobacter cloacae
tacggcctcgatcccgcgaccggacccatagggagacccgccatggtcagtaagaagaaaacccgtgttgttgatgatgtcgttaaaaacgcgccgctcaaaaccaaaacgtacgagcaagagctgcgccgcctccatgttgaactggttaagctccagcaatgggtggtcgccaaagggttaaaagtctgtattgtttttgaagggcgagacggcgccggtaaaggcggcgtcatcaaagccatcaccgaacgcgtcagcccccgggtgtttcgcgttgttgcgttaccggcccccaccgataaagagaaaagtcagctctattttcagcgttacgttcctcatctgccctctgccggggaaatcgttatttttgaccgcagctggtacaaccgcgcgggggtggaaaaagtaatgggtttctgtactgaagagcaggccgaaaaatttcttgatggaacgccggtaatggaaaaagcgatggtcgatgccgggatcatattgttgaaatactggcttgaagtaacgccaaaagagcaggaacgccgcctgcgcgatcgcattaatgatggtcgcaagatctggaagctgtctccaatggacataaaatcttttaatctgtgggatgaatataccctcgcccgtgacgcgatgtttaaagcgaccgacaccgcctgggcgccgtggtttgtggcgcgctcagaagataaaaaacgggtgcggctgaatattatttcgcatctgctttcacagatcccctataaagaaattcacgtagacaaagtggatttaccgaaacgcaagatcggcaaagtgaagcctacaaaatatcccttccggtatattgcagagcgattttga

SEQ ID NO: 621 - DNA, 930 bp, Enterobacter cloacae
cggatagatgctataagttttccctttgattttttgaagactggcagggtaatggacagaaaaagagcaacgctgacaggcctggcggccatattgctgtggagcaccatggtgggtctcatccgcagcgtcagtgaaggactgggcccggtgggcggcgcggcgatgatttacaccgtcagcgggctgctgtgtctggtaacggtgggttttcccgatcttcggcgtttttccaggcgctatctttttgcgggcagcatcctgtttgtcagctatgagatgtgcctggccctgtcgctgggatatgccgcgacgcgctcacaggcgattgaagtcggtatggtcaattatctgtggccaagcctgacgattgccttcgcgattttgttcaacgggcaaaaatccaccctgtgggtcatccctgggcttctcatctcgctgttgggggtgtgctgggttttaggtggcgaaaacggtctgcaactgaatgacatcatgcagaacgtcgtttcaagtccgctgagttatgggctggcgtttgctggcgcttttatctgggccgcctactgcaccgtcaccagcaagtatgccaaagggcaaaatggcattacccttttcgtcctgctgaccgccctgagcctgtgggtcaaatatgccgtcagcgatcagcccgaaatggtgttcagcgtcccggttgtggtgaagctattgatgtgtggggttgcgcttggctttggctacgccgcctggaatatcggtattcttcacggtaacgtcacggtgcttgcggctgtctcttatttcacgcccgttctttccgccgcgctggcggctattgtgctgagctctccgctttcattctcattctggcaaggggcattaatggtgtgcgccggatcgttactgtgctggtatgccacccgcaaatag

SEQ ID NO: 622 - DNA, 531 bp, Enterobacter cloacae
ggattatttaagatgaaacttaaattagttgcagtggcagtgacttccatgttggcagctggcgttgttaacgcggctgaagtttttaacaaagacggtaacaaactggatctgtacggcaaagttactggtctgcactatttttctgatgatgctggtagcgacggcgacaaaacgtatgttcgcctgggcttcaaaggtgaaactcagatcaacgatcagctgaccggatacggccagtgggaatatgagttcaagggcaatcgctccgaagctcaaggttccgacggcaacaaaacccgtctggcctacgctggtctgaaattcgatgaattcggttccttcgactacggtcgtaactacggtgtggcttatgacatcggcgcatggactgacgttctgccagagttcggtggcgatacctggacgcagactgatggcttcatgaccggccgtaccactggcgttgcaacctaccgtaacaccgacttctttggtctggttgacggcctgaacgtggctgctcagtac

SEQ ID NO: 623 - DNA, 282 bp, Enterobacter cloacae
tttgacgcaataaaaaaaggggctttgctgttagtttgccgcgcgaagtcttatcagataacgaggacaacaatggacgtcagccgcagacaattttttaaaatctgcgcgggcggtatggccggaacaacagccgcgatgctgggattcgctcccaaaatggcgctggctcaggcacgcaactataaactgctgcgcgcgaaagagatccgtaacacctgcacatactgctccgtgggttgtgggctattaatgtatagcctgggtgatggcgcgaaataa

SEQ ID NO: 624 - DNA, 333 bp, Enterobacter cloacae
agccgcggggcgctttgccccgaaaggggcggggctgttggactacgttccacagtgaaaaccgttttgcgctacccggaatatcgtgcgccggggtctgacaaatggcagcgtatttcctgggacgacgctttctcccgaattgcaaaactgatgaaagcggatcgcgacgccaattttattgagaagaacgagcagggcatcacggtaaaccgctggacctccaccgggatgctgtgtgcctctgcggcaagtaatgagaccggcatgctgacgcaaaaatttgtgcgctccctcggcatgctggcggttgataaccaggcgcgcgtctga

SEQ ID NO: 625 - DNA, 2460 bp, Enterobacter cloacae
cacggaccaacggtagcaagtcttgctccaacatttggtcgcggtgcgatgaccaaccactgggttgatatcaaaaacgcaaacgtcgtggtggttatgggcggtaacgccgctgaagcccatccggtggggttccgctgggcgatggaagcgaaaaacaacaacgatgcgacgctgattgtcgtcgatccacgctttacgcgtacggcatcggtggctgatatctatgcgccgatccgctcaggtacggatattacgttcctttccggcgtactgttgtacctgatcgaaaacaataagattaacgcggaatacgttaagcattacaccaatgccagcctgctggtgcgggaagatttcgctttcgaagatggtctgttcagcggctatgacgccgagaaacgtcagtacgataaatcatcctggaactatcagttcgacgaaaacggctacgcgaaacgcgatgagaccctgagcgatccgcactgcgtgtggaacttgctgaaacagcacgtttcccgctatacgccggacgtggtggaaaacatctgcggtacgccgaaagcggacttcctgaaagtgtgtgaagtgctggcctccaccagtgccgccgacagaaccactactttcctgtacgcgctgggctggacgcagcataccgtgggcgcgcagaacattcgcaccatggcgatgatccagctgctgctcggcaacatggggatggccggtggcggcgtgaacgccctgcgcgggcactctaacattcagggcttaaccgacctaagcctgctgtcgaccagcctgccgggttacctgaccctgccgtccgagaagcagaccgactggcaaagctggcttgacgccaacacgccaaaagcgacgcgtccggaccaggtgaactactggagtaactatccgaagtttgccgtcagtctgatgaaatcgttctacggcgacgcggcgcagaaagagaatgactggggctttgagtggttgccgaaatgggaccaggcttacgatgtcatcaagtatttcaacatgatggataagggcgacgtcacggggtatatctgccagggctttaacccggtggcgtcattcccggataaaaacaaagtcgttcgcagcctgagcaagctgaagtacatggtggttatcgatccgctggtcaccgaaacgtctacgttctggcagaaccacggtgaatcaaacgatgtcgatccggcatccattcagacggaggtgttccgcctgccatcgacctgctttgcggaagaggacggttctattgccaactctggccgctggctacagtggcactggaaaggtcaggatgcgccgggtgaagcgcgtaatgacggcgaaattctggccgggatttaccatcgtctgcgcgagatgtaccgcacagaaggcggcaaaggcgctgagccgctgctgaagatgagctggaactacaagcagccggatcatcctgagtccgaagaggtggcaaaagagaacaacggtgtggcgctggccgacctgtacgatgccaacggcaatctggtggcgaagaaaggccagttgctcaatagcttcgcgctgttgcgtgacgacggtaccaccgcctcgtcctgctggatctacaccggcagctggactgagcagggtaaccagatggccaaccgcgataacgccgatccgtcaggcctgggtaacaccctgggctgggcatgggcgtggccgttaaaccgccgagtactgtacaaccgtgcctccgcagacgtgaacggtaagccgtgggatccgaaacgcatgctgatcgagtggaacggcacgaagtggacggggaacgatatcccggacttcaacaccgccgcgccgggtagcaacaccgggccgtttatcatgcagccggaagggctgggacgtctgtttgctatcgacaaactggcggaagggccgttccctgaacactacgagccgatggaaacgccgctcggcactaacccgttgcacccgaacgtggtgtcaagcccggtggtacgcatctacgaagacgacgtgctgcgtttaggtaaaaaagacaagttcccgtatgtcggcactacttaccgcctgaccgagcatttccatacctggaccaagcacgcgcggcttaacgccatcgcgcagccggaacagtttgtggagataagcgaaaccctggcgaaggcgaaaggcattgccaatggcgatcgcgtgaaggtcagcagcaagcgcggctttattcgcgcggtggcggtggtcacccgtcgtctgcaaacgctgaacgtgcacggccagcaggtggaaacggtgggcataccactgcactggggctttgaaggggtagcgcagaaaggctacatcgccaataccctgacgccaaacgtcggcgattccaactcgcaaacgccggagtataaagcgtttctggtcaacatcgagaaagcgtaa

SEQ ID NO: 626 - DNA, 717 bp, Enterobacter cloacae
tttatcactacatcggtatcgggccgaataaagaggtggatgacgacgaggaggagcatcatgagtaagtcgaaaatgatagtgcgcacaaaatttgtcgatcgcgcctgtcactggacggtagtcatctgcttcttcctggtggcggtatccggcatatcgttcttcttcccgacgctacagtggctcacggaaaccttcgggacaccgcagatggggcgcattctgcatccgttcttcggcgtgctgattttcgtggtgctgatgtttatgttcgtgcgttttgttcatcacaacatccctgacaagcaggatattccgtggctaaaagggattgttgaggttctgaaaggcaacgagcataaagtcgcgaaggtggggaaatacaacgccgggcagaagatgatgttctggaccatcatgagcatgatttttgtgctgctggtgaccggggtcatcatctggcgtccgtattttgcgcactatttcccgattcaggtagtgcgttatgcgctgctgatccacgcgacctcggccattattctgatccacgccattctgatccatatgtatatggccttctgggtgaaaggatcgattaaaggcatgattgaagggaaggtgagccgccgctgggcgcaaaaacaccatccgcgctggtaccgggacgttgagcgtcttgaagcgcaaaaagagagttcggaagggttgaagtaa

SEQ ID NO: 627 - DNA, 270 bp, Enterobacter cloacae
  unsure (229)
tttgaactggttcaccatacaagtttaatcaataatgcacgctgcgtattttttaacagtggtcgcggtatgaaaaagacaattttttcgttagcactggctacctttggtctggggatggctgaatttggcatcatgggcgtgctgacagaactggcccatgatacgggcatttcgattccctctgccggaaatatgatttcgttttacccttttggcgttgtgatcngcgcgcccattgtggcgctgttctccacaaattttcgctga

SEQ ID NO: 628 - DNA, 885 bp, Enterobacter cloacae
atggcgatggaaacacaagacattattaaacgctccgcgaccaacccgataacgcccgcgcctcgtgcgcgggactacaaggcagaagtcgccaagctgatcgatgtctcttcctgcgtgggctgtaaggcctgccaggtggcctgctcggagtggaacgatatccgcgacgaggtggggcactgcgtaggggtctatgacaatcctgctgatctgagcgccaagtcctggacggtgatgcgctttagcgaaaccgaccagaacggcaagctggagtggctgatccgtaaagacggctgtatgcactgtgaagatccgggctgcctgaaggcatgcccgtctgccggggcaatcattcagtacgccaacgggatcgtcgacttccagcaggataactgcatcggctgcggttactgtattgcgggttgtccgtttaatatcccgcgtctcaataaagaggataaccgggtctataaatgcaccctgtgcgtcgatcgcgtcagcgtcggccaggagcctgcctgcgtgaagacctgtcctaccggggcgatccacttcggcaccaaaaaagagatgctggaagtggcgcagcagcgggtggataagctcaaagcgcgcggctatgacaaggccgggatttataacccgcagggcgtgggcggcacgcacgtcatgtatgttctgcaccacaatgaccagccggagctgtatcataatctgccgaaagatccggcgatcgatacatcaatcaacctgtggaaaggggcgcttaaaccgctttcagcggcgggctttatcgccacctttgccgggctgatttatcactacatcggtatcgggccgaataaagaggtggatgacgacgaggaggagcatcatgagtaa

SEQ ID NO: 629 - DNA, 297 bp, Enterobacter cloacae
  unsure (97)
  unsure (98)
  unsure (99)
  unsure (100)
  unsure (101)
  unsure (102)
  unsure (103)
  unsure (104)
  unsure (105)
  unsure (106)
  unsure (107)
  unsure (108)
  unsure (109)
  unsure (110)
  unsure (111)
  unsure (112)
  unsure (113)
  unsure (114)
  unsure (115)
  unsure (116)
  unsure (117)
  unsure (118)
  unsure (119)
  unsure (120)
  unsure (121)
  unsure (122)
  unsure (123)
  unsure (124)
  unsure (125)
  unsure (126)
  unsure (127)
  unsure (128)
  unsure (129)
  unsure (130)
  unsure (131)
  unsure (132)
  unsure (133)
  unsure (134)
  unsure (135)
  unsure (136)
  unsure (137)
  unsure (138)
  unsure (139)
  unsure (140)
  unsure (141)
  unsure (142)
  unsure (143)
  unsure (144)
  unsure (145)
  unsure (146)
  unsure (147)
  unsure (148)
  unsure (149)
  unsure (150)
  unsure (151)
  unsure (152)
  unsure (153)
  unsure (154)
  unsure (155)
  unsure (156)
  unsure (157)
  unsure (158)
  unsure (159)
  unsure (160)
  unsure (161)
  unsure (259)
tggcgtaactgtgtcagaatagagacttctcttttcacgacgccagaatgtatgaaagcgatcactctttatgacgttgcccgcgtggcaggcgttnnnnnnnnnnnnnnnnnnnnnnnnnnnnnnnnnnnnnnnnnnnnnnnnnnnnnnnnnnnnnnnnnggtccggcaggccatggcggcgctacactatgtgcccaaccgtggcgcgcagcagctggccgggaaacgcacccgcacgctggggccgatcaccagtntttacctagcggccgggacgatccaacgattgcaactc

SEQ ID NO: 630 - DNA, 453 bp, Enterobacter cloacae
ccggggcagcggtgctgttgctgtggatcccgctgcgtcagctgccgggggctgggcactatcagtaatgtgatttgtattgttcaggcggcagatgcgtcaatggcgctgatccctgagctcacatcgctgcccgtgcgcatcaccctgctggtttccggcattgtggttaacgcccttgccaccgggatgtatatcggcgcgggttttggcgcaggcccgcgcgacggcctgatgaccggcatacacgcccggctgggctggtcgatccgcagcgtgcgtaccgcgatcgaggtgactgtgttgatcgtcggctacctcctcgggggagcgtttggcgttggaaccgtgctgtatgcattaaccatcggcccgctgatccagctctgtttgccgtggtttcgccagagaccgcgcattcagaaagctgcacagccggagcggattgtttaa

SEQ ID NO: 631 - DNA, 483 bp, Enterobacter cloacae
ctacagggtcaagcacatgaagggggattcatgaaaattggtgaattagctcgtaaggccggttgcccagtagaaactattcgttactacgaaaaggaaggtttacttcaggcccctttacgagatattgaaaataattatcgccattatgataataaccatctggaaaaattgttatttatccgacgctgtcgctctctcgatatgacgcatgaggaaatccgcgcattactactggcaatcaataataacggtaaagaatgtggacctattgacgcgataatcagtgcccacctcgctcatgtccagcatcgtattaatgaattaatagcgctagaaaaacaacttcaagaacttaatgatgtttgcaatgcagaccgtagcgtagacgaatgtgggatagtccaaaaactgacagctgaagatgaagatagagaccttcctctaactgtacccaccgaccatctgggaggcgtacattag

SEQ ID NO: 632 - DNA, 468 bp, Enterobacter cloacae
gttatgaacattggtaaagcatcaagcgaatcaggaatctccgccaagatgattcgttattacgagcaaattggcttgatccctgctactggtcgtactgaagctggttatcgtgactatgctcccaatgatatccatcgcctgatttttattcgaagcgctcgcgacctcgggttttctctggaagagatagagggtttgcttaagctatggaatgataaatctcgtcagagctctgatgttaaacggttggcgcaggaacatattaatgatttagatcggcgtatagaaagtatgcgtcaaatggcagacacactcagagtgttaatccaaagttgcgcgggagatgaacgagctgaatgtcctattcttcatagattaacgattgctgatgatataagtcattcgggtaaacgagaaggtgcggtgcaacgtcgttctcgtggaaacagagtgtcaaaagattag

SEQ ID NO: 633 - DNA, 243 bp, Enterobacter cloacae
aatttagttataaggggacatatgatcacaaaaacgtatgcggatagtgtggttaaagatatcgtccaatgggtcgaaaattcactgacatctactttacttgtggaggaaattgcagaaaaatctggctattctcgatggcattttcaacgcatttttaaacacgcaaccggaattgcgttaggtgaatatgttaaacccgacgattacctgtgctgccgtagagttgaaactaactactaa

SEQ ID NO: 634 - DNA, 1641 bp, Enterobacter cloacae
ggttgttctatatctgaacccaacgatgagaaatacatcatgagcattcaaaaaaaacagcattctaatgatgctgaaactcaggttagcctgcctattgaggggatgacctgtgcaagctgtgttggacgagtcgaagccgccttaacgaaagttgagggtgtggaaagcgtaagtgtaaatcttgcaactgagcgtgcagacattctcttgaatacacctgttgaacgtatggcgctaatcaaagcaattgaaaatgtgggttatgaggttcccctaacttctgttgaattgtcagtccagggcatgacgtgtgcatcgtgcgtagggcgtgtcgaaaaggcgcttagagctgttgaaggtgtaaaggatgcaacagttaatttagcgactgagagggccactatacgtggagtagccggaactgatgacctgattgcggctatcgagaaagttggctacgaagccagcctggttgatacccgtggccagaataatgttgaggccgctgaaaaaaaagatgctgaaaaggctgcattgaagaaagatttagttctggcgaccatacttgcactaccagtctttattatggaaatgggatcgcatctgataccgggaatgcaccaatggataatggataccattgggctccaggaaagctggtatctccagtttgtgttaactctgctggtgttagttattccgggacggcgcttctacctgaaaggtattccggcgttaataaggcttggcccagacatgaactctctcgtctccgttgggacacttgctgcattcggttactcaatggttgcgacctttgcacctggccttctgcctcaggggaccgtcaatgtgtattacgaagctgcagcggtaattgtcgcccttattcttttaggacgatttatggaggctcgggctaaagggagaacgtccgaggctatcaaacgtttggttggattacaggccaaagaggcgcatgtgttgcgtaatggcgttgttgtcgatattccaattaatgatgtagtccttgatgacattatcgaagttcgaccaggtgagcgagtgcctgttgatggtgaggtaagtgaaggaacaagttttgtagatgaatcgatgataacgggggagcctatcccagtggagaaagtgcctggtagcttaatggttggcgggacggttaaccagaaaggtgcattgaggttgcgtgcaacagccgttggtggtcagacgatgctgtcgcaaataatccgaatggtagagcaggctcagggttctaaactaccaatacaagcagtggtcgataaagtaacgctgtggtttgttccagtagtgatgctggcggctttgttaacattccttgcctggttaacatttgggccatcaccagctctgtctttcgcactggttaatgccgtggcagtgctgatcattgcctgcccatgtgcaatgggattagctacacctacttctatcatggtaggaactggccgtggcgctgaaatggggatcttgttccgtaagggggaagctctgcaattgctcaaagatgctaaggttgtagctgtagacaaaactggcaccttaactgagggggcgccccgtaatgacagacctggagttagccgaagggtttga

SEQ ID NO: 635 - DNA, 2556 bp, Enterobacter cloacae
ttaacaggcgaggcaattaaaatgagtggttccgtaaaaaacagcaaaactcaagtaagagaggaatctgctggttgttgtgaaaaaattaacttgatagtagggagcaaaatgcagcgttctgaagaaccggctaaggctcatggtcacgcacatgaccataaagattgcagcgctgagctctctcataaggagcatggtcatggaagtgacaaacatttacatcgcgagcaagggcatgtgaaaggtgggcatgcacatgaaggatgcagccatgaacatagtcatactgatgaagaacatgatcatggtgaggaagaacatagtcatggcgatcatcagcataaggggtgtaaccatgaccacgctcaggatgatcaggctgatgaacatcatggacatagcggtgactgctgctcaggtgcgccaacaaatttaagtaatctaggtggttctaaagttgtagctggtgggttacgaactgaaatacgtattatgcagatggattgccctgttgaggaaaatctcatcaaaaagaaactgggggcaatgacctctgttaaagagcttgatttcaacctgatgcagcgtgttctgactgtaacccatacacctgattcgcttgaacctatcttggttgcaattcgctccttgggattcgtacccgaagtttcggataacaatggtgaaaagaaaaacatccaggagaaaaaaaagccttggtggccgttagctctggctggtgtggctgcacttgcggctgaagttatgcactgggctgatatgcctgactggcttgaagcgggattagccttgatagccgttcttttgagtggtttgacaacctataagaaaggttggatttcaattcgcaatggtaacctgaatataaacgcactgatgagtattgccgttaccggggctttggttcttgggcagtggccagaagcagcgatggttatggttctatttaccatcgctgaactgattgaagcaaaatcactcgatagagctcgaaatgccattggttcactgatgagcctgacccctgaaaccgcaatggtccaacaaactgatggatcatggcaggaagttgatgccagcagcgtacaaccaggaagtattgtaagggtaaaaccaggcgaacgaattggtcttgacggtgagattgttaaaggtcaaacaacgattaatcaggctccaattactggtgaaagtttgcctgtcgataaaatggcgggtgactccgtgtttgccgggacaataaaccagtcaggttcttttgaatataaagtcactgcagctgccaataacaccacccttgctcgcatcattcatgctgttgagcaggcgcaaggcgccaaagcagctacacaacgttttgttgaccgcttttcccagatttacacgccagtcgttatggggatttcggttgctgttgctgtattgccaccattgtttggcgcaggtacatggcaagagtggatctataaagctctagtcatgcttgtcatcgcgtgtccatgtgcgctggttatttctacaccagtaacaattgtcagtggacttactgctgctgctcgtaaaggaattctcattaaaggcggtgtttaccttgagcagggacgtaaattaaaagctttggcgcttgataaaactgggacgattactcatgggaagccagtacaaactgatgtcatggttttcaatggggaaagtgagcttgaggttcgtacagttgcagcaagtcttgctagctactctgatcatcctgtctcacaggccgttgtgaatgcttctgttgatttgaaaaaacagagtgttgaaaactttgaggctattgtaggtcgaggtgtgcatggtgtgattgccggcaaagacttttatcttggtaatttgcgattggcagaagacctcctgagttgtccgttagaggttaaagctacagtacaaagtctggaaagcctaggtaaaacagttattttgttcaatgatggaaagcaagtgcttgggttatttgctgttgcagatactgtcaagaacacgagtcgcgaagcgattcaacaactccatcaccttggtgtcaagacagttatgttgactggggataacccgcatacagccaaagcaatagcatctcaggtcggtattgatgaagctcgtggtagtcagttacctgaggacaaacatcaagtagttcaagagtattcacgtattggtgttactggaatggttggtgatggcatcaatgatgcgccggcactggctgcggcagatataggttttgctatgggggcaatgggtactgatacggcaattgaaactgcagatgtggccttaatggatgatgacctgcgtaaaatccctgcctttgtaaaattgtcccgacagacgtatagcttactcgtgcaaaatatcagtctcgcattaggtattaaagctattttccttgtattaacgctcatgggaatggggactatgtggatggcggtatttgctgatgttggtgctagccttctggttgtagcaaatggtctgagattgttacgtaaatag

SEQ ID NO: 636 - DNA, 948 bp, Enterobacter cloacae
ctgagggggcgccccgtaatgacagacctggagttagccgaagggtttgagcttaacgaagttttagcaaaagttgcggctgttgaatcacgttcggaacatcctattgcccgcgctatcgttgaatccgcactggaaaaaggaatatcgctgccaatattgactgagtttgattcaattactgggatgggagttcgggctatcgttgacggggagtgtatagaggttggtgccgatcgctttatgcgtgagttaggattggatgtagagcatttttcgcagacttcagtacgtcttgggaacgaagggaaatcgccactttatgttgctatcggtggccgcttggcagccatcatcgcagtggctgatcctattaaatcaagtacaccaattgccataaatgcattgcaccaactggggctcaaagtcgcaatgattaccggtgacaatgccaatacggctcatgctattgcaagacaactaggctttgatgaagtggttgctgaagtgttgcctgaaggaaaagttgaagcggttcgtcggctgaaggaatcctacggcaaggtagcttatgttggtgatggtattaatgatgctccagcgctagcagtggcagatattgggcttgcaattggaacggggaccgatatcgcggtggaatctgctgatgttgtcttaatgtccggaaatctgcagggcgtccctaatgccattggattgtcgaaggcaacgatcggtaacatcaggcaaaatcttttttgggcatttggttacaatgcagcattgatccctgtagccgcaggactgctgtatcctgcctacggattgctgctttcgccaatttttgctgcaggtgcgatggcgctatccagtgtatttgttctgggcaatgcacttcgtctgcgtcgtttccagcccccgctgatggaagatgctgggaatcattaa

SEQ ID NO: 637 - DNA, 866 bp, Enterobacter cloacae
  unsure (21)
catgccagagatttgcggcgntctttcgcgcccctgtggtaagagcgctgatggcgcgtctgtacccgaacggtccggcggacatcaaccacttccaggccgcgggcggcgtgccggtgctgatgcgcgagctgctgaaaggcggcctgctgcatgaggatgtcaacacggtggcgggctttggcctgcatcgctatacccttgaaccctggctgaacaacggtgagctggactggcgcgaaggggcgagcgactcgctcgatcctcaggttatcgcaaccttcgaacagccattctctcctcacggcggcaccaaagtgctgagcggtaaccttggacgtgccgtgatgaaaacctctgccgtgccggaagagaatcaggtgattgaagccccggcggtggtgtttgaaagccagcacgacgttttacctgcttttgacgcgggtctgcttgataaagactgtgtggtcgtggtgcgtcatcagggaccaaaagcgaacgggatgccagaattacataaacttatgccgccgcttggtgtattattggaccgccgtttcaaaattgcactggtgaccgatggacgcctctcgggggcatccggtaaagtgccttcagcgattcatgtcaccccggaagcctacgacggcggcctgctggcgaaagtgcgtgatggtgacatgatccgcgttaacggtcagacaggcgagttaaccctgctggtggacgaagcagagctggcggcgcgtcagccacatattcctgacctgagcgcatcccgcgtgggtaccggacgcgaaatgtttggtgcattgcgtgagaaactctccggtgcggagcagggcgcaacctgtattacgttttaa

SEQ ID NO: 638 - DNA, 681 bp, Enterobacter cloacae
gacgacttgattttaacgatctggcgagagaaaactctgatgaaaaactggaaaacaagtgcagaagcaatcctgactactggccctgtcgtgccggttattgtggtaaacaaactggagcacgctgtcccaatggcgaaggcgctggttgcgggtggcgttcgtgttctggaagtgaccctgcgtacggcctgtgcgatggatgcgattcgcgctatcgccaaagaagtgccggaagcgatcatcggtgcaggtacggttctgaatgcgcagcagctggcggaagtgaccgaagcgggcgcacagtttgccatcagcccggggctgaccgagcccctgctgaaagccgcaaccgaaggttctattccgctgatcccgggtatcagcaccgtttctgaactgatgctgggcatggactacggcctgaaagagttcaaattcttcccggctgaagcgaacggcggcaccaaagcgttgcaggcgattgcgggcccattctcccaggtgcgtttctgcccaacgggcggcatctctccggtcaactaccgtgactacctggcgctgaaaagcgtgctgtgcatcggtggctcctggctggttccggcggatgcgctggaagcaggcgactgggatcgcatcactaaactggctcgcgaagcggtagaaggcgcgaaacagtaa

SEQ ID NO: 639 - DNA, 2520 bp, Enterobacter cloacae
ctaataatgtcaggggaatctgaggtagctcaaaggcaggacacgttaaacagatatttattgtatttcccgcgtagcaaaaatgttatttcagatgttcattcttttacaggaaaagagatattaagcgagccttatcgctataccattcgctttaccagtccggatctaaacattgccattaatgctgttcttaatcaaagggctgagtttattctgcgtgcacccaatctggaagcctcatggcatgggcaaacctcctggctgccggttcgccagattaatggcacgatcacccaattttcgcggctgatgtcttcaggtgacgaagcactgtatgaatgcgtgctggagcatgagctggcgctgctggatcaaaattaccgttctgcggtttacatgaacatgacagtcccggagctcgttacaaagctgatgaaggacagtggtcactttgacggctacaacattgattttgaccaactgagccacagttatccacgacgggaaatgatcgttcagtggaaagaaaccgatttgcggttcatccgtcggctgctggcagagatagggatctggttccgatttgagaatcacaacaaagtgaaaacggaaaccgtcgttatttttggggattctgcgcgtcgttacaacttcagcgacaaacagatgccttatgtccgacattcaggcatgaccagttatagcgaatacattaccgatctggaggatcagcacggcctgatccccaaaaatgtgttggttcgcacctatttctaccgtgacccgcaatcgccgcagacggataagaccgttaaaacgagcgatattcccgaaggtgtaacgacaggccaacactatcactatgccgatcactatctgactgcgggggattttcacggtgaagaggcggaaaccgccgcattttacgctcgtctgcgttatgaacgcctgttgaacggacagagtcttctgggggcgacaaccagcgatcccgagcttcagccaggcattatgttttatccctcagggcctgtacctgacgggtttaagtccgggtttgtgataactgcgatgactatccgcggcagccgtgctgaacactatcgcgccgtactttctgggatcccctatatccagggctataccttccgtcctgaatacttatcccggccggtgatagccggaacggtgcccgccagagtgaaggctatcgggggagataaaacctatgccggacttgatgcggttgggcgctacagggttaagttcgattttgaccttgatgaaaaacgggtcggattcgaaagcgccctggtacgcctcggcaggccgtacgccggtgacacctttggtattcactttccgctactggaggggactgaagttgccgttggtttcgaaggcggcgatccggacagaccttttatcgcgcatgtcatgcacgacggcagccacccggatttagtcacaaaccgtaacgatacccgaaacgtgatccgcacggccgcgttgaacaagatccgtcttgaagatcgtcgcgggcaggagcacatcaaaatcgctacggagtacggcaaagggcaagtgagtgtgggtcacctggttgatgctgaaggcaaaaagcgcggggaaggtgtggaggctcgcaccgacgactggatggcgctgcgtgctgcgaaaggcgtgatgatcaccacggaagcccagccccgcgcggggggtaagcagctggatatgacagcggctattgcacaacttgaaaaggcgttatcgctggcgatgaccctacaacaaagtgcgcttacggcaggtgcgagtaatgtggaaaccgatcggcaaaatgcgctcagccagacgctgagtcatctcgcggagcccggtattttggcatatggaaaaagtggaattgcgctggttacgccggacagcctgcaactttccgccgggaaagacctgattgccacagcgggcgggaatgccagcgtgaatgtggtgaaaaaattctcgctggccgtaggggaaaaactgtcgctgtttgcccgcaaactcggcatccagatgattgccggtgcgggggatattacgacgcaggcgcagcggggcgaaatgcacatgctgtcgcagcaggatttcacgctgacgagcaccgccgggaaaatgaacggcagtgccagaaagggaatgcagtttgtctgcgggggcggcgggatccgtatcagcccgaccggactggtcacgattttctcgccgacgggcattgaactcaaagcgccgagcctgaaatacgacggtccggaaagtgtgtcggtaccgacgccatcctttgagaaaggcgcctttaaacttcgctacaaactgcacgccggcgatgatccggagcaaattctggcaaacaaaaaattcaggctgaccagtgcatccggacaggtggtggaaggcgtgacggacagctgcggtcgttcacccctgctcgatgctgacgacctcgacagctataaaatggagataatggaatga

SEQ ID NO: 640 - DNA, 1311 bp, Enterobacter cloacae
aaaaacgctctccttctccggcgatccgctcacgcaggcacaggtgctctattccctctggttaggcgccaacctgcaagcaaaaatgtctcgcagcgccgtgccgctcgaaagcgcgctggcgcacgtgaaaaactgtataaccgcgccaggcgtgtagccggcgtttttatttacccttttactagtcgactggtctactcaggagccattatgtccgctgaaaagctgtttaccccactgaaagtgggtgccgttactgccccaaaccgcgtgtttatggccccactcacccgtctgcgcagcatcgagccgggcgatatcccaacgccattgatgggtgagtattatcgtcagcgcgccagcgcgggcctgattatttccgaagccacgcagatttctgcccaggcaaaaggctacgccggtgcgccgggtctgcacagcccggaacagatcgccgcgtggaaaaaaatcaccgcaggtgttcatgctgaagatggccgtattgcggttcagctgtggcacaccggtcgtatctcacacagcagcatccagcctggcggtcaggcgccggtttctgcttctgccctgaacgccaatacccgcacttccctgcgcgatgaaaacggtaatgcgatccgcgttgacaccaccacgccacgcgcgctggagctggacgagatcccgggtattgtgaatgatttccgtcaggccgtcgccaacgctcgtgaagcgggcttcgacctggttgagctgcactctgcgcacggttacctgctgcatcagttcctgtccccttcttccaaccagcgtaccgaccagtacggcggcagcgttgaaaaccgcgcgcgtctggtgcttgaagtggtggatgctgtctgtaatgagtggagcgcagaccgcattggtattcgtgtctccccgatcggtactttccagaacgtcgacaacggtccgaacgaagaagcagacgcgctgtatctgattgaagagctggcgaaacgtggtatcgcctatctgcacatgtccgagccggactgggcaggcggcaagccttatagtgaagccttccgccagaaagtgcgcgagcgcttccacggcgtgattatcggggcgggcgcgtatacggcagagaaagctgaagatctgatcgggaaaggcctgatcgacgccgtggcctttggccgtgactacattgctaacccggatctggttgcccgtttgcagaagaaagccgaactgaacccgcagcgccctgaaagtttctatggcggcggcgcggaaggttataccgactacccttcactgtaa

SEQ ID NO: 641 - DNA, 435 bp, Enterobacter cloacae
tccattccactggttaatgaggaaattatgcgcctacttcacaccatgctgcgcgttggcgacctgcaacgttccatcgatttctacactaacgttctgggcatgaagctgctgcgcaccagcgaaaatccggaatataaatactctctggcgtttgtcggttacggcccggaatctgatgaagcggtcatcgagctgacctacaactggggcgtggacagctatgagctgggtacggcttacggacacatcgcgctggaagtgggtaacgccgccgaagcctgcgaacgtatccgcagcaatggcggtaacgtcacccgtgaagccggtccggttaaaggcggtaccaccgtcattgcgtttgtggaagatccggacggttataaaatcgaactgattgaagccaaagacgctggtcgcggtctgggcaattga

SEQ ID NO: 642 - DNA, 669 bp, Enterobacter cloacae
gagaccctgatgtccgataacgctcaatttaccggtctgtgcgaccgttttcgtggtttttatcccgttgtcattgatgtagaaacagccggatttaacgctaaaaccgatgcgctgcttgagattgccgccatcacgctgaagatggatgaacagggctggcttgtaccggacaccacgctgcatttccacgttgaaccctttgaaggggcaaacttacagccagaggcgctggcctttaacggtatcgatccgacaaacccgctgcgcggggcggtaagcgaatacgaggcgctgcacgccattttcaaaatggtgcgcaaaggcatgaaagagaatgactgtagccgcgccatcatggtagcccacaacgctacgttcgatcacagcttcaccatggctgccgccgagcgcgcctcgctaaagcgtaatccatttcatccgtttgtgaccttcgacaccgccgcgctgagcggcctggcgctggggcaaaccgtgctctcgaaagcctgcatcacggcgggtattgcgtttgacggtacccaggcgcattccgcgttatacgataccgagcgtacggcggagctgttctgtgagatcgtcaaccgctggaaacgtctgggcggctggccgctgccgatgggcgacgaggccgatcttcaatcgtag

SEQ ID NO: 643 - DNA, 849 bp, Enterobacter cloacae
cttcttctgattttatggattagaatcgacaggttttgtaaatctcacgcgggtatgcattgtggcctgcatttatcaggggactgcccagtggcgcggataactaaaatctcgatgacgctctgtgctttactgtttaccacactctcatttacgccagcggcgaacgcctctgaacaggcgcggcattctgctgtacaaaaaacgcatctggcaaaatccacagaacgtaagaaaaaaaccaccagcaaaacagttaagaagaaaatcaccgctcagaccaaaaagaccgcctccagtaaaaccaaaactctccgctccggcacgcacaaaaccacccgcacaaccgccagcctggtgaatgaaaaatgcaccgtgcgcaaaggccataaaacgaaatgcgcaaaagtgacgaagctggctgacgtgcataaagcgcgcatgcagaaagcgcaaaaaacggcgatgaacaaactgatggggcaaataggtaagccgtatcgctggggtggcacctctccgcgcaccggttttgactgtagtgggctggtttattatgcctataaagatctggtgaagtttcgcattccacgcaccgccaatgagatgtaccatctgcgcgacgccgcccctgtaaaccgtggcgaactgcaaaatggcgacctggtgttcttccgcacccagggacgcggtacggccgatcacgttggggtgtatgtgggtaacggtaaatttatccagtcaccgcgcagcggtcaggacattcagatcacctctctcagcgaagattactgggtgcgccactatgtgggtgcgcgccgcgtgatgacgccaaaaaccatccgctag

SEQ ID NO: 644 - DNA, 609 bp, Enterobacter cloacae
agtaagggcatgagcagacacactgaacacgatacacgagaacatttgctggctaccggcgagcgcctttgcatgcatcgcgggtttaccgggatggggcttagcgagttgttaaaaaccgctgaagtacctaagggatcgttttatcactattttcgttccaaagaggcgttcggcgttgccatgctggagcggcactacgccagctaccatcagcgcctggcagcccacttcgccagcggtgaaggtgactaccgggatcgtgttctgaactactatcaggaaacgctgacgcagttctgtcagcagggcatcatcagcggctgcctgacggtaaaactgtctgccgaagtgtgcgatctctccgaagatatgcgcaccgccatggataaaggggccagcggcgtgattgcactgctggctcaggcgctggagagcgggcgcaatgaaaaaacgctctccttctccggcgatccgctcacgcaggcacaggtgctctattccctctggttaggcgccaacctgcaagcaaaaatgtctcgcagcgccgtgccgctcgaaagcgcgctggcgcacgtgaaaaactgtataaccgcgccaggcgtgtag

SEQ ID NO: 645 - DNA, 1767 bp, Enterobacter cloacae
gggaggaatacatgcctctggtcgcgtcataataaaatggcttgcagtgcaacggatgtctgccacaaacaggacattaaggtttcgctaatcttccattcttatactcgccgcattgatataacgaatggtctgcttatcatgtggttcgcaaaaaagttacactgtaacgatataaaatttactctgggctgtgcatttttctttaccgtactgaatgcactgtttatccagcgcagctggtcaattattgcgcctgcgcatctgcacgatgtcctgtttgctgccagcgtgccgctggtactgttctgcggctgggtgattgtcttcagcctgttaaatatcccctatattcgtaagccgctcctgattgtcctgaccctgggatgtgccgccgcgacctggtttatgtatacctatggcgcggttatcgatcagaacatgattgtgaacgtgttcgagactaattctcaggaagcgacagccctggtgacgccgcagatgatcctgtggctggtcgtagcgggtctggttccatctgttgtgttagccctgacgcgcattcgcaccggaaaatggtggtatgccctcctgacgcgcttcgccgctatgctgggtgcgctgctggtgatcatcctggtcgcgtcagtgttctataaagactatgcttcgctgttccgcaataacaaaagcatcgtaaaaatggtcaccccggcgaattacgtgagcgccgtggtgaaatacagcaaaatgcgctggtttgccggcgaccagacgctggtccgcattggcgaagatgctcataaaggcgcgctgattgccagccaacgcaagaaaaccgtgctggttgtggtggtgggcgaagcctcccgcgctgcaaactactcgttaaatggttacccgcgtgaaaccaaccccgagctgaaaaagcaggatgtcatcaacttcccgcgggcctcctcctgtggcacggaaaccgctgtttccgtcccctgcatgttctccggcatgacgcggaaaaaatatgacgcggacctcgcccatcatcaggaaggtctgcttgatgtgcttaaccacgccgggttcaacctgctgtggcgcgacaacgacggcggatgtaaaggcgcctgcgaccgcgtaccgcacacggacatgacccagtggaaactggatcagttctgtaaggacaaatcctgtatcgacgacgttaacctgtaccgcctggacaacgtgctggatggaataaagcaggatacggttctggttattcacctgatgggcagccacggtccggcctattacaaacgctacccggacagcttccgcaagttcaccccaacctgcgataccaatgaaattcaggattgcgatcatcagtcgctgatcaatacctatgacaacacgattctgtataccgacagcgtcgtcagccgaaccatcgacgcactgaaagcccggcaggccaacatgaacacggcgctcatttacctctccgatcacggtgaatcgctgggcgaaagcggaatttacctgcacggtacgccgtatatgctggccccggagcagcaaacgcatattccttttatgttctggctctccccggattatgcgaaaaacttcggcgtaaacacggattgcctgcgtgaccatgccgcaaaagaggcggtttcacaggacaatttattcgccaccgttctgggcatgatggacgtgaaatcagcggtttatcagccgcagctggatattctgtcgcagtgtcgtcgctaa

SEQ ID NO: 646 - DNA, 822 bp, Enterobacter cloacae
atttatccagtcaccgcgcagcggtcaggacattcagatcacctctctcagcgaagattactgggtgcgccactatgtgggtgcgcgccgcgtgatgacgccaaaaaccatccgctagcccctgccctgccgcctctgtggcagggtaagttcctcttttgcataccctttcaatttgctattctgtccttgttgtctgtaaggttattggcaacgtataaaactataaggagagaagcaatgtcgttcgaattacctgcactaccgtatgcaaaagacgccctggccccgcatatttccgcggaaaccctggagtaccattacggcaagcatcaccagacctatgtcaccaacctgaataacctgatcaagggcaccgattttgaaggcaaaacgctggaagagatcgtgcgcagttcagacggcggcgtattcaacaacgccgcacaggtgtggaaccacaccttctactggcactgcctggccccgaatgcaggcggagaacctgacggtgagctggcggcagcgattaacgccgcgttcggcagtttcgcggattttaaagcgaagtttactgacgcagccgttaaaaactttggctccggctggacctggctggtaaaagaggctgatggcaaactggctatcgtttccacttctaatgcgggtacccctctgaccaccagcgccacgccgctgatgaccgtggacgtatgggaacacgcctattacattgattaccgtaatgcgcgcccgaactacctggaacacttctgggcactggttaactgggaatttgttgcgaagaacttcgccgcgtaa

SEQ ID NO: 647 - DNA, 414 bp, Enterobacter cloacae
agacgcaactatctcggcgggaaatttgccgaccgctccgtgagtgggacgctgaaaggttttttaacgctgctgattgtcatcatggtggcgattccgtggctggcgcgtaacgaagtgggtgccgcgattgccatggtggtgtggggcgccgcaacctttgccgtggtgccaccgttgcagatgcgcgtaatgcgcgttgcacacgaagcgccggggctctcttcatcggtgaatatcggtgcgtttaacctgggcaatgcgctgggggccgcagcgggcggggcggtgatctccggtggtttgggttatagctttgtgccggtgatgggggcgatcattgccgcactcggcctgctgctggtgataatgtctggtcgtaaacagcctcaagcggtgtgtacggcggaataa

SEQ ID NO: 648 - DNA, 360 bp, Enterobacter cloacae
aggaagcaagacatgagcaccactattgaaaaaattcagcgccagatcgctgaaaacccgattctcctgtacatgaaaggttctccgaagctgccaagctgcggcttctccgcgcaagcggttcaggcgctgtccgcctgtggtgagcgttttgcttacgttgatatcctgcaaaacccggacattcgcgctgaattgccaaaatacgcaaactggccgaccttcccacagctgtgggttgatggtgaactggttggcggatgcgacatcctgattgaaatgtatcagcgcggcgaactgcaacagctgatcaaagagactgcggcgaagtataaaaccgaagagccggacgcagaataa

SEQ ID NO: 649 - DNA, 633 bp, Enterobacter cloacae
tcacgccgtggaagcgctcgcgcactttctggcggaaggcttcactataaggcttgccgcctgcccagtccggctcggacatgtgcagataggcgataccacgtttcgccagctcttcaatcagatacagcgcgtctgcttcttcgttcggaccgttgtcgacgttctggaaagtaccgatcggggagacacgaataccaatgcggtctgcgctccactcattacagacagcatccaccacttcaagcaccagacgcgcgcggttttcaacgctgccgccgtactggtcggtacgctggttggaagaaggggacaggaactgatgcagcaggtaaccgtgcgcagagtgcagctcaaccaggtcgaagcccgcttcacgagcgttggcgacggcctgacggaaatcattcacaatacccgggatctcgtccagctccagcgcgcgtggcgtggtggtgtcaacgcggatcgcattaccgttttcatcgcgcagggaagtgcgggtattggcgttcagggcagaagcagaaaccggcgcctgaccgccaggctggatgctgctgtgtgagatacgaccggtgtgccacagctgaaccgcaatacggccatcttcagcatgaacacctgcggtga

SEQ ID NO: 650 - DNA, 231 bp, Enterobacter cloacae
ggtaacatcatgaaaagattcctttccgttgcacttctcgctgcgctgcttgctggttgcgcgcacgactctccatgtgtaccggtatacgacgatcaggggcgactggttcacaccaatacctgtatgaagggcactacccaggataactgggaaacagcaggtgcgattgctggtggcgccgcggcaatcgctggcctgacactcggtattgtcgccctgactaaataa

SEQ ID NO: 651 - DNA, 2973 bp, Enterobacter cloacae
cgcccctaccctttgagcatatgcgcaccggcggtgaaaataactcaggttatcgaacagaacatgaacggtatcgataatttgatgtacatgtcgtccaccagtgattccgccggtaacgtcaccattacgctgacgttcgagtcgggtacggatcctgatatcgcgcaggtgcaggttcagaacaaactccagctcgccatgccgctgctgccgcaagaagtgcagcagcaggggattggcgtggagaaatccagcagcagcttcctgctggttgcaggctttgtgtcggacaataaaaatctcacgcaggatgatatctccgactatgtcgcttctaacgtaaaagatgcgatcagccgtacttccggcgtcggtgacgtgcaactgttcggtgcccagtatgcaatgcgcatctggctggacagcaacgcgatgaacaaatatcagctcacgcctctggatatcattaaccagctgaaaacacagaacgaccagattgctgcgggccagttgggaggaacgccgtccgtaccagggcagcaactgaacgcctcaattattgctcaaacacgcttgaaatcgccggaggagtttggtcgtgtgacgctgaaggtgaaccaggacggttcaatggtccacctgaaagatgtggcacgcattgagctgggtggcgaaaactacaacatggtcaccaaaatcaatggccaggcagcaacggggctggggatcaagctggcgactggcgcaaacgcgctggataccgctgccgccatcaagagtaaactggcgcagttgcagcccttcttccctcagggtctgaaagtcgtgtatccgtacgacaccacacctttcgtgaagatctccatccatgaagtggtgaagacgctgtttgaagcgattgttctcgtgttcctggtgatgtacctgttcctacaaaacctgcgggcaacgcttattcccactatcgccgtgcccgtggtgttactgggcacctttgcggtactggctgcgttcgggttctccattaacaccctgacgatgttcgggatggtattggcgataggtcttctcgtcgatgacgccatcgtggtagtcgagaacgtagaacgcgtcatggttgaggacaagctgccgccaaaagaggcgacgcagaagtcaatggagcaaatccagggcgctctggtgggcattgccatggtgctttcggcggtatttattccgatggcattctttggtggttcaaccggggctatctatcgccagttctcgctgaccattgtctccgcgatggccttgtcggtactggtggcgttgatattaacgcctgctctttgtgcaacgctgctcaaaccggtttccagcgaacatcatgaaaagaaaggcggtttcttcggctggtttaacgcgctctttgataagagtgtggagcactacagcaacagcgtgagcggcattttacgtaagaccggccgctatctgctggtttacgtcatcatcgtcggcggcatggcagttctgttcctgcgcctgccttcctccttcctgccggaagaggatcagggggtgtttatgacgatggttcagttgccggcaggggcgacgcagatgcgtacccagcaggtactcgatcaggttcaggattattacctgacgaaagagaaagcgaacgttgaatcggtctttaccgtaaacgggtttagttttagcggacagggtcagaactccggtatcgctttcgtcagcctgaagccatgggaagagcgtccgggcaaggaaaacggcgttgaggcgattgtcagccgcgcgacgaaagcgttcagccagatcaaagacggccttgtatttccgtttaacctgcctgccattattgaactgggtaccgcaacaggctttgactttgaactgatagaccaggcaaacctgggacatacgcagttaacgcaggcgcgtaaccagctgctgggcatggtgagagaacatcctgacttactggtccgcgtgcgtcctaacggactggaagatacgccacagttcaagctggacgtcgatcaggagaaggcacaggcgctgggtgtgagcgtgtctgacgtcaatcagactatttcaacagccctgggtggcacctatgtgaacgactttatcgatcacggacgggtgaaaaaagtttatgtccaggctgatgctcgcttccgtatgctacccggagacattaacggcctgtatgtgcgtagcgctaacggcgaaatggtgcctttctctgcctttagcagctctcactgggtgtacggttcaccgcgtctggaacgttacaatgggatgccatcaatggagatcctcggtgagtctgcaccaggcaaaagtaccggtgaggcaatggcgctgatggaaaaccttgcgtcaaaactgccgtccggcatcggctacgactggacggggatgtcttatcaggaacgactttccgggaatcaggctccggcgctgtacgccatttcacttattgtggtgttcctgtgtctggcggctctctatgaaagctggtcaattccattctcggtcatgctggttgtgcctctgggggtgatcggtgcgcttctggctgcatcaatgcgagggctgaacaatgacgtttacttccaggttggtctgcttacaacaattggtttatcagccaagaacgccatactgatcgttgagttcgccaaagatctcatggataaagaaggcaaagggattatcgaagccacgcttgaagcctcgcgtatgcgtctgcgtcctatcctgatgacttccctggcattcatccttggtgttatgcctctggtcatcagcagcggtgcaggtagtggggcacaaaacgcggtcgggacgggcgtgatgggcgggatgctgtcagccaccctcttggccattttctttgttcctgttttctttgtggttgtccggagacgatttacaaagcacaaggattaa

SEQ ID NO: 652 - DNA, 495 bp, Enterobacter cloacae
cttagcctttctcctgctacgcttgttgtatggttcagaaacgcaggaacgctttcgatgaaaaaaatcgccattatcggctcaggcccaacagggatttacaccttttactcacttcttaacaacgcagcgccgctttcgatcaccgttttcgaaaaggcagaccaacccggtgtcggaatgccctacagcgacgaggataattcccggctgatgctggcgaacatcgccagtattgaaataccgcccattttcatcacttacctggactggctcaaacagcagaatgcggcccgccttgcccgctataacgtcgacagtgagaagctgcacgaccggcaatttctgccccgtattctgctgggtgaatatttccacgaccggtttctcgctggtgctgccgaggcgaacaacgctgggtttcatatcgaagttcaccccaccgcagaaattcctgatattaacgctgatgccaacgcgtggccctttcattga

SEQ ID NO: 653 - DNA, 318 bp, Enterobacter cloacae
acactggcagatggatgcgcacacatcgctcaaaaatcgatctttttcaggcggatactgagatcagaaaagcatatgaccttgaatagtaaccacagcgactggagggatatgctaatgaagcgacaagatataaacgcattaaagaattttgattttctggcacgcagttttgcccgtatgtacgcccagggccagccagttgatatcgatgccgtgaccggcaatatgagtaataaacagcaggcatggttccgggagcgatatgaccactaccgaaagcaggctgagcgggcgagagtaatagaactgcgatga

SEQ ID NO: 654 - DNA, 522 bp, Enterobacter cloacae
catttatttcttttaaagaaagggattgctatggccgattcattccagaatgaggtgcccaaggcacgcataaacttaaagctggctctgcatacaggtggcgcgcaaaagaaaatcgaactgccgcttaaactcctcaccgtcggtgatttcagtaatggaaaagagaatcgcccattatcggaaagggagaaaattaacgtcaataaaaataacttcaacagcgtactttcggaatttaacccggaagtgaatctgacggttcctaacacaatggccggggatggctcggaagaaagcataaaactgaatttctccgatattaaggatttcgaacctgaacaggttgcccgccagatcccccagctccgcgccatgctggccatgcgtaatttattacgcgacctcaaatccaatctccttgataacgccactttcagaaaagaactcgagaaaattctcaaagacccggcgctgtctcaggaattacgcgacgaaatgagtgcactggccccgaaataa

SEQ ID NO: 655 - DNA, 438 bp, Enterobacter cloacae
ggggatgccctgagtatgatgacgtcaatcatggatacagatatgaaaacgagaattctccttcttacggtcagtgtactttttaacatgcaggctgatgccgcccgtggaagacagccctgctctggctcaaaaggtggcatagcacactgtacatcggatggtcgttttgtctgcaatgacggaagtctgagccagtcgaagcgattctgttcaggttatggtgcctccgaactgccccggcaggtaaaaccctccccctccgccaggaaagcgcagacgaaaaagagaatagccgtgaaaggccaggagcagcgtgttgtagaaaacaatgcgcagttcgatacacaaccgcggcaacctacatgcgcccctctctatatggccaacaagcccggattcacccatttacccatttgttcaggtaatcagtattaa

SEQ ID NO: 656 - DNA, 543 bp, Enterobacter cloacae
aaagcgggtaaggaacacctgcccataagacatgaactttttgaatattcttttttactgttcaggaggtacatgatgactctcagaacctttcccgtgttgaacgatctctccgactctctgtttgcggaccgttttaaccgtatcgatcgcctttttagccagctaaccggcagtacgccgttgccctccacgccttcttacaatatccggcggctgggcgataaccgctatgaactgacgctcagcgtgccgggctggaaagagagcgaactggaaattgaaaccgttggcggtcagctgaatatcagcggtaaacgtgaagaggagaaaaccgaaaacggcgaagaagggtggatccatcggggtatcagccgcagcgacttccgggccagctatagtctgccggagcatgtgaaagtgaccggcgcttcgctggaaaacggcttactggcaattgaattacaccaggatatcccggaagaagagaaaccgcagcgcatcgccatcaacaacaacccggcgattgaacataagccgtaa

SEQ ID NO: 657 - DNA, 669 bp, Enterobacter cloacae
ataacgtggggtttcatcatgtttaatgaagtccatagcttacccggtcatacattattgttgatcacaaaaccttccttacaagcgacagcgttattgcagcatttaaagcaatgcctgtctcttaacgggaaactgcataatattcaacgttcttttgatgatatcgcttctggcagcatcattcttctcgatatgatggaagcggataaaaaactcattcattactggcaagataatttaagcaggaaaaacaataatatccgcgtattgttattaaatacgcctgatgagtatcctttccgcgaaattgagagctggccgcatattaacggcgtgttttacgtcactgaagaagaaaaccgtgtcgtggagggtttgcagggcatattgcggggggagtgttatttctcgcagaaactggccagctacctcattacccactccggaaattatcgctataacagttcggaatcggcccttctgacgcaccgtgagaaagagatcctgaacaaactgcgtattggtgcttcaaatattgaaatcgcccgttcgttatttatcagcgaaaatacggttaagacgcatctttataatcttttcaaaaagatagctgttaaaaatcgcacgcaggcggtgtcgtgggcaaacgataacctcaggcgttaa

SEQ ID NO: 658 - DNA, 450 bp, Enterobacter cloacae
gttctaacaacgatacctatttcggaggctgtaatgcgtctcgcacacacagtgatttcgttaatgctcattgcgccgttgagctgggccggaaatatgacattccagttccgcaaccctaattttggcggcaacccgaataacggagcctttatgcttaaccaggctcaggctcaaaactcctataaagaccccagctatgacgatgatttcggtatcgagaccccgtcagccctggataattttactcaggccatccagtcgcaaatattaggtggcttattaactaacattaataccggaaaacccggccggatggtcactaacgactttatcgtcgatattgccaataaagacgggcagcttcagttaaatgtgacagaccgaaaaaccggtaaaacgtcgacaatccaggtttccggtttgcagaccagttcaactgatttctaa

SEQ ID NO: 659 - DNA, 450 bp, Enterobacter cloacae
ctgttaaaaatcgcacgcaggcggtgtcgtgggcaaacgataacctcaggcgttaatagcatgaaacgcaccttaagttggattgccgccgcaggcattatgcttgctgccggaaaccttcaggctgttgaggtagaagttcccggactgttaaccgaccacaccgtcacctctgtcggacacgatttttatcgtgccttcagcgataagtgggaaagcgattatccgggtaacttaaccatcaacgaacggcccagtgcgcggtggggaagctggatcacaataaccgctaatcaggacgttatttaccagacttttttattcccaacgaaaagagacttcgatcagaacgtcgctttcgcgctggcacaaacagaagaagctattaaccgcctacagttagacaaagcccttttgagcacaggcgatttagcaaaagatgagttctaa

SEQ ID NO: 660 - DNA, 867 bp, Enterobacter cloacae
tttctaaacaaccccgaaataaggacaattattatgcagcgcttttttattttagttgcagtgtgcttattaagcggttgtttaactgccccgccaaaagaagccgctaaacccaccctgatgcctcgtgcccagagctatcgggatcttacacatctgccggtcccaaccggaaagatattcgtctcggtgtataacattcaggatgagacgggtcagttcaaaccgtatccggccagtaacttctcgacagccgtaccgcagagcgccaccgcgatgctggttaccgccctgaaagattctcgctggtttatcccgctggaacgtcaggggctgcaaaacctgcttaacgaacgaaaaatcattcgtgccgcgcaggagaatggtaccgttggcgtcaataaccgcatgccgctacagtctctcaccgcagccaatatcatggtggaaggctcgattatcggctacgaaagtaacgtgaaatcgggtggcgcgggtgcgcgttactttggcatcggggccgacacgcagtatcagctggaccagattgccgtcaacctgcgcgtggttaacgtgagcacgggtgagatattatcctcggtgaccaccagcaaaacgattctctcttatgaagtgcaggccggggtattccgctttatcgattaccagcgtctgctggagggtgaaattggctatacctctaacgagccggtcatgctgtgtctgatgtcggccatcgaaaccggcgtgattttcctcattaatgacggtatcgatcgcggcttgtgggatcttcagaataaaagtgacgtgagtaatgcggtgctggtgaaatatcgtgagatgtcggtgccgccagagtcataa

SEQ ID NO: 661 - DNA, 567 bp, Enterobacter cloacae
cggaataaaaacatgaatgagttttccatcctttgccgcgtgctgggcaccttatattaccgccagccgcaggatccgctgctggttccgctgtttaccctgattcgtgaaggtaaactggcgcagagctggccgctggaacaggatgaattgctggaacgcttgcaaaaaagctgcgatatgcagcagatttcaacggattacaacgcgctgtttgtgggggaagagtgtcgcgtgtcgccgtatcgttctgcctggcaggaaggtgcgaccgaagcggaggttcgggcgtttctttcagaacgcggcatgccgctgacggatatgcctgccgatcatatcggtaccctgctgctggcggcctcctggattgaagataatgcaggtgatgatgagaacgaggcgattgagaccctgttcgaaacgtatctgctgccgtgggttggcaccttcctgggtaaagtggaagcccacgccacttcgccattctggagaacgctggctccgctgacgcgtgacgctatcgctgctatgtgggacgagctggaagaagagaacgaagagtga

SEQ ID NO: 662 - DNA, 579 bp, Enterobacter cloacae
cttgaatcacaaaaatcctgcaacgatacatttcaacttgcacgtaatgtgcttctgatctcatttctatggtgcgcatctgctaagatgcgcaccatgaacatattactttgtattgcaatcacgactggcatcctctccggcctctggagttgggtggctgtttctctcggcttgttgagctgggctggttttcttggctgcacggcctatttcgcctgcccgcagggtggtctcaaagggctctttatttcaggctgcacgttactgagtggcgtggtctgggcgctggtcattatgaaaggcagcgcgctggcgccgcatgtggaaatcctggggtacgccatgaccggcattgtggccttcctgatgtgcgttcaggcaaaacatctgctgttgtcctttgtgcccggcacattcatgggtgcctgcgcgacctttgcagggcagggggactggaagctggtggtcccttcgctcatgctggggttactgtttggctacgccatgaagaacagcggcctctggcttgcggcccgacgcgagaagagccagagcgttcctgcggtaagtaaataa

SEQ ID NO: 663 - DNA, 801 bp, Enterobacter cloacae
  unsure (158)
cggattgcgcagctggagggacgcctgggtgttcggttgatacaacgtaccacgcggcagtttgcggtgacggaggtggggcagacattctatcagcactgtaaagctatgctggtggaggctgaagctgcggaggaggcggtggctgctttacaggntgagccgcgcggtatggtccggatcacctgtcctgtcaccttgctgcacgttcacgtggggcccatgctggcgcggtttatggcgcgctatccagggatcaacctccagctcgaagccaccaaccgccgggtcgatctggtggcggagggggtggatgtggcgatccgcgttcgtccgcgcccgtttgatgacagcgaactggtattaagggtgctggcggacagggggcactgtctggttgccgggccggcactgattgaacggatgggcaacccggcgatgccctctgaactcagcgagtggccggggttaagtatgggggcgggcaagcacctgcataagtgggaattgaacgggccggagggcgcaaaggcagaaattcacttcacgccgcgcctggtgactaccgacatgttggcgctgcgggaggcggcgatggcgggcgtgggcgtggtacagctgcccattttgatggtgaaggatcagctggcttcaggtgaacttgttcgggtgctgaatgcctgggaacccagacgggaagtgatccatgcggtgtatccttcccggcgcggcctgctgccatcggtcaggacgctggtggattttctcaccgaagagtatgcaaagatggttgaagactag

SEQ ID NO: 664 - DNA, 435 bp, Enterobacter cloacae
ctttttgtaggtcgggtaagcgtagcgccacccgacacaattaccgcaggggctgcaaagttcgaatcccccacaggcgtgcaacatgtgaaaaaaaagcccgcattttcatgcgagctctttttcaaatatggcggtgagggggggattgactcgcttcgctcgcccttcgggcagcctgttcgctacgctctcagtctgtccaactggctgtcgccagttgccgaaccccggtcggggggtctcatccccccttacgagaatataaaagaaaaaagcccgtactttcgtacgagctctcatcatgaatatggcggtgagggagggattcgaacccccgatacgttgccgtatacacactttccaggcgtgctccttcagccactcggacacctcaccatattgtcatcccgttgttgtcgggacgggcgctaa

SEQ ID NO: 665 - DNA, 951 bp, Enterobacter cloacae
aaggcaatgactatggatattatcttctatcaccccacatttgatacggcttactggattaacgcgcttacggcggcactgcctggcgcacgcgttcgcgaatggaaacagggcgataatgaacatgccgactacgcgctggtttggcatcccccggtcgaaatgcttcagggacgccgtttgaaggcggtatttgctcttggtgcgggggtggattccattctcagtaagctgaaggcacaccctgaaatgctgccggaagatattcccctgtttcgtctggaagataccggtatggggcagcagatgcaggaatatgccgtgagccaggtgctgcactggttccgccgtttcgacgattatcaggcgtttaaacagcaatcccactgggaaccgcttccggattatcagcgtgaagatttcaccatcggcatcctcggcgcgggagtactgggttcgaaagtcgccgaagcgctcgcaccgtggggcttcccactgcgctgctggagccggagccgtaaggagtatccgggcgtcgagagctttgccggaacggacgaactcccggcgttcctgaaagggactcgcgtcctcattaacctgctgccgaatacggcggaaacggtcggcattatcaatggcacgctcctcaaccagttggcagaagacagctacttaatgaacctggcgcgcggggtacacgttgtggaagacgatctgctgaaagcgctggatagcggtaaactgaaaggcgcaatgctggatgtgtatagccgcgaaccgctgccaaaagacagcccgctctgggcacatccgcgcgtggcgatgacgccccatattgcggccgtgacgcgaccggcggaggccgtggcgtacatctcgcataccatcagcgaaatagagaagggcaacgcggtgaccggacaggtcgacagacagcgaagctactga

SEQ ID NO: 666 - DNA, 774 bp, Enterobacter cloacae
ctgctatcctttggaaaaaccgcagaggagagaaagatgtatcccgttgacctgcatatgcacaccgtcgccagtacccacgcttacagtaacctccatgattatatcgctcaggcgaagctgaaaggcatcaaactgtttgcgataaccgatcacggtccggatatggcggatgcgccgcactactggcattttgtgaatatgcgtatctggccacgcctggtggacggtattgggatactgcgcggcatcgaagcgaacatcaaaaataccgacggtgaaattgactgcaccggcccgatgctgacctctttagatctgatcctcgctggcttccatgagccggtctttgcgccccaggataaagagaccaacaccgcagcgatgattgccactattgccagcggcaacgtgcacattatcagccacccgggaaatccgaaatacccgattgatattcaggccgtggcgcaggcggcagcgaagcaccgcgtggcgctggagattaacaactcctcctttgttcactcgcgtaagggcagtgaagccaactgccgcgaagtggcggcggccgtgcgtgacgcgggcggcatggtggcgctgggctctgattcacacacggccttcacgctgggggatttcagcgagtgcctgaaaatattgcgggacgtgaatttcccggaagaacagatcctgaacgtcacgccgcgtcgtatgctcgacttccttgagtcgcgcggcatggcgccgattgatgaatttgccgatctttaa

SEQ ID NO: 667 - DNA, 1527 bp, Enterobacter cloacae
gtcattaccaaaaaagtctcgaacaccaaagcctggaccggttcgttgcatggcgatgcaaccttccagggaaatcatgattccggcgatattttccagaccaacgcgtacgcctgtggtcccctgatcgacggacttctgggcgcaaaggtgacggggctgttgtcacgccgcgcagaagataaaatcgtgaacggctataacgagcagaaaatgcgtaacggtggcattacgctgaacttcacgccggacgagaagaacgatttcgacctcgactttgctcgcgaacttcaggacagaaacagcaccccggggatgtcgaaagcggctgaaacctgccggggaacaacctgtacgccaaataccaaaagcgactcgcgctatgagcacacgacctactcgttaacccacagtggttattacgaagacttcaataccaccagctatatccagcaggaagagaccaataatccaggtcgcgaaatgcgctcctataacaccaccttcaacaaccagaaccaaattttcctcggcgatcatacgttgaccctcggcgggcagtatcgctatgagaaactgcgcgacaacggtaatcagctggaagctgctgacggcctgaacaaactgacgcgctggagctgggccctgtttgccgaagatgaatggtcaatgacggaaagctttacgttgaccggcggcctgcgtatggacaaagaccaaaactacggtactaactggacgccgcgcggttacggcgtatggcacctggccgatcagtggacgttgaaaggcggggtttctgctggctatcgtgcgccggatctgcgtcagtcgtctgccagctggggccaggtgacaggtggcggccgtcttgacggtatcatcgtcggcaacccggatctgaaaccagagaagagcctgagcgaagagctcgccctgctctgggataacaacgatgacctgaatgccggcgtaacgctgtttaataccgacttcaaggacaaaattacggaagttcgccgctgtaacagcagcgccgatcccgcctgtacgattggcggtcacagctatgatttcgtcagcgatcgcgtcaacgtggacaaagccaacatgcgcggtgtggagtcctccttcgggtggaagatcacgcgtgatgtgaactggactgcaaactacacctatacagagtccgagcagaagagcggccagttctccggcaagccactgaacaaaatgccgaaacacatgttcaacaccaccctggactggcaggcgacgccagacgtcgggttctggagccgtctgaacctgcgcggtaaaacgtctgagtacctgagccgcacgtcaatgtcccagggtacgccgtcctacactcaggttgatgtcggtatgcgctacaacgccaacaaaaacctgctggttactgccggtgtgtataacgtgctcgataagcagattgattacgatacgtatgacaccgtgctggatggccgccgctataccgttggcatgacctacagcttctga

SEQ ID NO: 668 - DNA, 1104 bp, Enterobacter cloacae
tcaattttatttttaagccagagcgccgtaacctttagccagacaaaggagaaggttatgtcagaaatcaccttacaacatcatcgtacagtgtggcacttcgtgccgggtctcgcgctcagcgccgtggttaccggcgtggccttatggggcggcagtataccggcggttgccggtgcagggttcagcgccctgacgctggccattctgctcggcatggtggtcgggaacaccgtttacccgcacatctggaaatcctgcgacggcggcgtgattttcgccaagcagcatttattacgtctcgggatcatcctttatggcttccgtctcaccttttcgcagattgcggatgtgggtgtcagcgggattgccattgacgtcctgaccctttcgagcacctttttactggcgtgctttatcggccagaagatctttggactggacaaacagaccagctggctgatcggtgcgggtagcagcatctgcggcgcagcggcggtactggcaacagaacccgtcgttaaagccgaagccagtaaagtcacggttgccgtcgcgacggtagttatcttcggtacgctggcgatcttcctgtatccggccatgtatccgctggtggcgcactggtttagtccggaaacctacggcatttatatcggctcaaccatgcacgaagtggcgcaggtggtggcggcaggtcacgccattaacccggaagcggaaaacgcggcggtcatcgccaaaatgctgcgcgtgatgatgctggccccgttcctgattttcctcgcggcgcgggttaaacagcttgctccggcaggcggcagcgagaaaagcaaaatcaccattccgtggtttgcgatcctgttcatcgtggtcgctgtcttcaactctttccacctgctgccaaaagcgatggtggatatgctggtcacgctggatacggtcctgctggcgatggcaatggcggcgctgggcatcaccacgcacgtcagcgcgctgaaaaaagccggggcgaaaccgctgctgatggcgctggtgctgttcatctggctgatagttggcggcggtgcgattaaccttgcggtacacagcctgttggcataa

SEQ ID NO: 669 - DNA, 873 bp, Enterobacter cloacae
gcatttcgggttaacaggagtctttttatgaaatatgttggagcgcacgtcagcgctgctggtggccttgcgaatgccgccattcgcgccgccgaaatcgaggcgaccgctttcgccctgttcaccaaaaaccagcgccagtggcgcgcagctcccctcaccgcggaagtgattgatgacttcaaagccgcctgcgagaaatacggctacgggcctggccagatccttccccatgacagctacctcattaacctcggtcacccggttgccgaggcgctggaaaaatcccgcgaagcgttcctggatgaggttcagcgctgtgagcaactggggctaacgctgctgaatttccatcccggtagccatctgatgcaaatcgacgaagacgcctgtctggcgcgcatcgccgagtcaattaacatgacgctggataaaacccagggcgtgacggcggtgattgagaataccgccggtcagggcagcaacctcggctttaagtttgagcatctggcggcgatcatcgacggcgtggaagacaaatcccgcgtgggcgtgtgcattgatacctgccacgcgtttgcggccggttatgacctgcgcacaaccgaggccacaaaaaataccttcgaggagttcgagcgtattgttggttttaaatatcttcgcggtatgcacttaaacgatgcgaaaagcgcgttcggcagtcgcgttgaccgccaccacagcctgggcgaaggcaacatcggccacgatgcgttccgctttatcatgcaggatgtccgcttcgagggtattccaatggtgctggaaaccatcaatccggatatctgggcggaagagatattctggctgaaggcgcatcaaaccccttaa

SEQ ID NO: 670 - DNA, 873 bp, Enterobacter cloacae
gcaaccatgcacattacattgcgtcagctggaagtttttgccgaggtgctgaaaagcggctcgacaacccaggcgtcacaaatgctggcgctctcgcagtccgccgttagcgcggccttgaccgatcttgaagggcaactgggcgtccagcttttcgacagggtagggaagcggctggtggtgaacgaacatggccgcctgctgtatccgcgtgccctggctttactggagcaggcgacggagatcgaacagctgttccgcgaggacaacggcgctattcgcgtctacgccagcagcacgatcggtaactacatcctgccggaagtgattgcccgctaccgccgggattttccgaccctgccgctggagatgagcgtcggcaacagccaggacgtgatcaacgcggtgattgatttccgcgtggacatcgggcttatcgaagggccgtgccacaacgtggatatcattgcggagccctggctggaggatgagctggtggtgtttgcctctccggcctcttctttactccagggcgaggtcacgctggagcggctggcgcaagcgcagtggatcctgcgagagcagggctccggcacgcgtgagattgtcgattatctgctgctgtcccatctaccgcagttccagttagggatggaattaggtaactccgaggccattaagcatgccgtacgccatggtctgggcattagctgtctttcccgacgggtgattgccgaacagctggaaaccggctcactggttgagatccccgttccgctgccgaagctggtgcgcacgctgtggtgcatccatcatcgtcagaaacacctttccagctcgctccagcgttttctgcgctactgcgagatgtaa

SEQ ID NO: 671 - DNA, 1557 bp, Enterobacter cloacae
agctctcttataactgagtatttctgccggaagcaacgcagatcgtctgctacaatcgcgcctcatttattgaatggacagcattttcacatggtttcagaaactaaaaccacacaagcgcccgcgctacgtcgcgcacttaaggcgcgtcacctgacgatgatcgccattggcggctccatcggtacgggtcttttcgttgcctctggcgcaacaatttcggcagccggcccgggtggggcattattctcttatatcctgattggcctgatggtctacttcctgatgaccagcctgggtgaactggcggcatacatgccggtgtctggttcgttttcgacctacggacaaaaatacgttgaggaaggcttcggcttcgctctgggctggaactattggtacaactgggcggtgaccatcgccgttgacctcgtcgcggcacagctggtaatgacctggtggttcccggacacgcccggctggatctggagcgccctgttcctggcggtcatcttcctgctgaactacatctccgtgcgcggtttcggcgaagcggaatactggttctctttgattaaagtggcaaccgtcatcatctttatcgtcgtcggtgtggcgatgatcgttggtattttcaaaggggctgaaccggcgggctggagtaactggacaataggcgatgcgccgtttgccgggggcttctcggcgatgattggcgtggcgatgattgtcggcttctccttccagggtaccgagttgattggcattgcggccggtgaatccgaaaacccggagaagaatattccgcgcgcggtgcgtcaggtgttctggcgtatcctgctgttctatgtgttcgcgatcctgattatcagcctgatcattccgtataccgacccaagcctgctgcgtaacgacgtaaaagacatcagcgtcagcccgttcacgctggtcttccagcacgcgggtctgctctcagcggcggcggtgatgaacgcggtgatcctgacggcggtactgtctgcgggtaactccgggatgtacgcctccacccgcatgctctacaccctggcctgcgacggtaaagcgccgcgtattttctcgaaactgtctcgcggtggcgtgccacgcaacgcgctgtatgcgaccacggtgattgcgggtctctgtttcctgacctccatgttcggcaaccagacggtctacctgtggctgctgaacacctctggtatgacgggcttcattgcctggctgggcattgccatcagccactaccgtttccgtcgcgggtacgtcaagcaggggcatgatctgaataacctgccgtaccggtcaggattcttcccgctggggccgatcttcgccttcgttctgtgcctgattattaccctgggtcagaactatgaggccttccttgcggacaccattgactggggcgccgtcacggccacctatattggcattccgctgttcctgatcatctggtttggctacaaactgacgaaaggaacacgcttcgttcgctacagtgaaatggatttcccggaacgatttaaataa

SEQ ID NO: 672 - DNA, 609 bp, Enterobacter cloacae
aggaccggtaaaatgtcatctcttgattctgaagctaaacccgataatgcaggtcacagcgtactggctttaacaacctctcatagcctggtggttagctcttctgaaacatttcttccagatatgcgcaaagagctcggcattatcgcggatcttgttgagtcctataatgatgaactctgcttgttgaaacacatggctgtccagttcaaaacccacaatcaccagaaactttattcttatctctcaggctacaaccacagtatctctgaagcggatgccttgttcgcggaaaacgctctgagatctgaatactggaaacgcgttatggcactcactgatgttttgcctatcatgtcggatgccaaacgtaacgaatgggataagcagtttacggccgaccgctatattatgccgcctcaggtgatccctgatttcacagctgacgctgtagtaggcacagtcgttgctttgcttaatgaccgcaatcaatttattaaagaaagggtttacgacgtcttccagtctctgagccgcagtcataagacaaacaaagcttttggggttctccacccgcatgatcactaccggagtttgcgagccgtctaa

SEQ ID NO: 673 - DNA, 1173 bp, Enterobacter cloacae
gccgcagtcataagacaaacaaagcttttggggttctccacccgcatgatcactaccggagtttgcgagccgtctaaatacccctggcagaaattaagggtggattttaaagagtctggcatttcaccactgagcgagctccgcgttatatgcgcattcttccgtggcgaacaggtgaaggcgatccataacaccaaatcattggttgaggcgttggtcgaacatgaggggttcagaaaatggatctgcatcgatggcaacagtattcgtttcagggtttacaaaaatggatcaatgcatattgacgtccaccctgatatcgccgagcggcttaacaatattttatcagctatcgtaccgctggcattacctgccgaccgcatggctcatagcaagaaatctttggaggcattccctgtacttaagcagtgcatcgactttgatacccggatgcagctttctgaactaatgtttaaaaatgacggggacaataaatggagttgctggacatctttagggtctctcgccgaacgcaaatcttcgagtgttgccgctgacacccttcggttcttaggggcaacagtaacaaaatacgatgtgacattttcctatgatccgtgtgaggttattcgttacatcggccagataggggagatgcctgatattgtatcgcatcagttttacccttcatcttgccgaatcagcgaatatgtatattccctgctcggtgcaggggaaggggataccctcctggagcctaatattggccatgcggatttgcttaaatcattccctgccggtgtgatcgttactggcatcgagcttgatactttgaattgccttatctcccgggctaagggatacgatacgacagaagctgacttcctcacatggtctaagtctaatcaacagaagaagtttgattatgtcgtgatgaacccaccttttgccgataaccgggccaggctgcatctccaggcagctgcatctcatctcgcagccgggggatctctagcagccgttcttccattatctcttcaggggctcgataaccttctgggggaagaattccggacggaatggatggacgtttttgagaacgagtttgaaaacacgaccgtttcggttcgcatcctgtacgccgaacgtattcaacaagaggaagtcctatga

SEQ ID NO: 674 - DNA, 1188 bp, Enterobacter cloacae
gcagaaaaatgtaacggagcccctatgagtgttttactgacagaacctacacagcaagctaatgacaaggtctttaaaacggcccatgttgccttttcagtagttactggcacaggtcgttacgtcactgggcttaaacagttccgtgatgcaaaccctgaactttgtactgaagtaagtgaccagaaagcatgggctatccacccttcagtaattcaggtcacgccaggcttcaactcccgcgaaatgggaatgggtgacgattactataagctccctgaggttgaagaacacatctacaacatcaagaatgcctacattcgaggtgactatgtagaccctatccgagtacgtgtcattgatggggtaccttttgttcgccaggggcactgccgtttaaaagccgcaatgatggcatgtgatgaagatcatgacatcacaatcctttgcgttgagattaaagaagatgaaattggctgtgagctcgcgaccattgatggtaaccgtggtcttgcgctttctcctgttgcgcttggcgagtcctatcgtcgcctacattctcttgctggctggtcactcgaacgaattgctcaacgtgaaaataaaagcccgacgaccatcagttctcttatccgcctgacaacctgttctgttgttatcaagaaatggattcatgctgacgctatttcgtatgttaacgtgctttcactgatcgatgagctcggtgaaacagaagcaatttcacgtatcaagaagatgatcgcggaacttgagcaggccgatgcgaatggcatcacggtgaaaaaaacccaacatggtcaggtacgagtcagaccttcagacttcaagccagcacggattccgccggttattgccacaaaagccgtagaaggcgtcaaactcatcaccaccagcttattacagaaactgggggatattgaattgccggagatgacagattcaagtgctgacgaagaaatcaacattacgttgaaccgcagtactctggagatgctgagaaatctttcaaaagagatcacagaatcagagaacaagcagcttcgccgtgcggagaatcgtcaggcaaaacttaatggtgagaagccaaaatacccacgtaaaaaaaatgctaagaaggcaggggaagagaccgatcaggatactgacccacagccggacgcagaataa

SEQ ID NO: 675 - DNA, 858 bp, Enterobacter cloacae
atttctctctcaggtatagacactttgactcgacatctcagacacatgccgataatcaaatgggctggtggaaaaacgaaactgatgcctttcatcagccatcactacccacacgatcatagttgccggtgggtagaaccctttataggcggtggtgccgtttttctgaacatgtttgcacaaaatgcattgcttgcagatagcaatccagacttgatcaacctatacaggactattcaaagacagaaaactaactttataaatcaggtccaaaacctagcggataaaacctttgtcgaaaaggactactatgagatgagggaccgtttcaacaaaacctgtatttctggtcaaccgcttcaaagagcggctttgttttactccctgaatcgcctgggctataacggtatgtgccgctataactcagaaagaatctattcagtgccctgggggaaacatacagaactgaagcttgacttcaataaaatagactacctttcatttcgtctttcaggtattgaactgatcaccgctggttttgaggagactctggccgcaaccggcgaaggagatcagatttattgtgatccgccatatgacaaaacaagcaaaactagttttgtcagttacgatggtaaaccgttcagccaaagcgaccacgtgctgttagcaaatatgctcgttgacgctcacagaaaaggcgctgctgttgcgatatcaaatagcctgacaccattcactttgggcctctatgaagagcgtggattcgtcatacacagactcagcgcttaccgatccgtaggaagtaagccaaatacacggaaaacggaaacagaaatactggccgtgctgaaatag

SEQ ID NO: 676 - DNA, 597 bp, Enterobacter cloacae
gactgtataacagttgattgtaagtgcgattttcaaaggattgtcttaataatgcttaaaactttaaacgtgatcactaataataatttttacttttactctctgatagggattttttcggccaatgatgttttagcaaatatgtatcatattaaaaaaataggttccagagacattgcttcatggctgaaagaaacccaggatgaccacgccatagtaatggccggtccggatacagagtcgttaacaaaattaatttgtactcaaagaggctataactacattagctcacgatctaaagttaaagacatgatgcaattttttttaaaagaatataagcccaggaaaaattcagcatatttaaaagcgactaattcgcatatatcaactcaggatatcaaagtgctgatatgggtttcgtcaggcttaaaaccgtgtgatatatcaaagcgttatggcatatccataaagacgataagtcaccataaaagaaacctcatgaaaaaattacagattaaatccactatgcagcttgttgatgtggcatctcagtatagtttactttgcaaacatttaaatacttcgtgtgctttataa

SEQ ID NO: 677 - DNA, 7962 bp, Enterobacter cloacae
atgcgaatgaataaggtttataaagttatctggaatcatagtgcccaaagatgggatgtcgtttctgaactgactggggctaaaaagaaaagtaaatcctccagggtaggtgctgcaatttctcctttggtgttattgacagcgctaaccctcaacccggggtttgcttatgcagatataatgctgcctaataactggctctcctcgaatcagaataatggtgtgggtgcggctgtcgtgaatggcactgaggaaaacattattggtccaggtgtgatatcaggaccatcttcaggcacgtcgtacatgagtattactgatgctcaaaaggcgggttatatcatatccggtgatgacttatctggcttagtctatacggacataggcaaacggaccagaacagttcagtactacgattcgataactggtgctaatcaaacagttatggtctatgacagtggcactttctcggaaagtgaagcagcttctaatgtgactgttccagttttttcccccggggcaaactttttttataaaacgagactcgtaaccgccaaaaatggcgggacggctaatattgatgttaaggcttcatctattggcagctactttaaagattcgcaactggttgtagccgatggcacaaattcgcatgccaactggaattcacaaaacaatttttacttccaggctgcggccagggtgacagatagtgcggtttataacaagacgattaatttctcaaattataccggtagttttacagactgggaggggaaagagcatgttgttaattctgttgcagatttacaaagttataatgattaccttgcagaggcactcaaggatggcaggcttcctccaggacaatatgaagccgagttcaataaagcaattcagtatgaatctaaagattatataatcgataaaacagcaggcggtacaattgattcgtctccttataattctcctgtggggactctggctgttctttctgcaaccaatggaggtaccgttacactctcttcttcggggagacttactggtgttttaccagcgtatggctatggtgcaggcgttgtggccagttctggtggtactggtataaatgaaggtgttattgatgcaacaggtgctgccatgcgtgcctatcaggatggtaccgttataaataacggtaccatttatgtatgggataataatacaaaatataccctccatggtgaggggatgcttgcacacaatgcaaacgctaaagctgttaataatggcgtgattaatgtcagaccatggaagaacagtttcacaccttatggtatcaatacggccatgcttctctcggatggaggagagggtacaaacaacggtgtaataaatattactgctgatgcgtctactcttgataataacggcgccacgcgtgggataagtgtgtctgatggcggcacctttataaatgccggcaatggtaaaatcacggtgggtgtaaacgccgggggaactaaatctcattccgcagttgattcgattgcgattgatattggtaaaggtgccacaaaagttgttaacgagggtgatattatactcggtcagggtgcccagggggattacggtgtttcagcggttgatgccggtacagttaacttcatcaatacagggacaatatcagttgaaggtcaggacagtgcgacccctgctctcaatgccggtattcgctccagtaacagctcaggattagtcaattccggcattatcaacgttaacgggacaaacaactccggcatacttgctgaaaacggcgggagtgttctttctgacggcctgatcaatgtcgggagcgttagcgcaggaagtggttaccggaattatggtgcctgggttgacggagccgcgagcagtgtcgatgtgtctggccagatcaatctgatcgggagtggtgctataggtgcttttgctgacaatgccggttcacttattttatcgggtacaggaagcattgctttcaacgatgcggagcagatcggtttttatgttaatggtaaaggttcatccgtaaacaatacaggttctggcacctttgacgtttcatccagagactcaagtatgtttcgcatagcaggtggcgcctcttttctcggtaatagtgatgcgtcttccacaattaccgtctcgggtgaaaattctctagcgctcgttgtcaccgggtcttccgatcagggagatgtgtcgacaataaatactggcgggatggccatacaactttccggaaatgactcaactggcctcagggtggaagggggagctctaggaacgatagacgccaacacaacaattaatctcaatgctgtttcctcaattgcggctgttgctgacggcaacggctatgatatttccggaaacctgatcaataaggaagataacgcaacttcattaaccgcatcggcacaactcacctcttcccttgatagcgttacaggctacattgcgcgtaatggcgcatcgcttgataatgccggagacatcattttcacaggtagcaaaacaacgggaatgcgtgttgaagagggggctacaggtacaaacagcggcaatattactgtcgaggatggaggcgccgggcttattgccgcatccggtggtaaaaacacagtaataaataacacgggtaatttaattctcaaaggcggtgataacgcaaaccgtaccacaggcattaaggcctccgggccgggtactgtcatcaatatgaatgccggtaatatagagctccagggtcagggtgcagtaggggtagaggtttctgacgaaggaacggtaaaccttattggttctgctgttcctcagttcgctgatgaatccaccgggataaccgaccagatagccttcaggatcaaaggcagtggtgctcagattaacacgtctattgcacctggaacattactcgacgcaaccggaaaggattccatactgttccgtatcgaagatggtgctcaacaggcaggaacgttacagatgaaaacctccggcaccggtagcagcggtatctgggtcacgggtacaggaagcaaagtcgttgccgggtctggaagtgattttcagattctgggggataatgctaagggcctgtacgttaccgggggggctgaagcaacgcttgaacagggtgttagcgtaaaccttgtaggtgacggcgctattgtggctgaggttgatggtaatgcatacggcctcgatggttccgtcacaggtcaaaatacgggttctgttcttactaacgaggcggatataaccaccgcgcttagtaatgcgactggttttataacgcgtaatcagggtttgctcgttaataacggaaatatcgattttacagcgggtaccgataatattggtatcctggtggatgatggccgcttcgaaaattccggtaacagtatcgctgttaatggcgttgcgctgtacataaagggggccaattctcaggttaataacaccactggtggtgacattattgccgttgatggtgaagcggcgatcaaactgggcgccggagcatcgcttgatttagccggagatggttttgacggttctgcaactattgaaggtcgcggcagtgcacacggtattttacttgatacaggcgcgactggtctgaaattgaatggtgccgttataaaggttagtggtttagaaacgacaggtcatggtattgagaaccgggctgaaattgaagggattcagttatccaatggagccaggatcaatgtttcaggcggcggtatcggtattcgcacggctgccccactggcaaagaaaaaccagggcgtaatcaccgtacgaggcgccacagggattgcattccagaaggctgacggttccgcgacagacggtttgtttgatatttcagactcatcagaactatatttcgatgtagaatacggcaccgggattttggttaatactaccgctgatgctgtcgttaaaactaatgcaaatatatgggtttatggagaggatggtggcagtgcgattgtcgtaaaagattcagcttctgaagtagtacaaagtggtgagattttttcagcctctttaatcaacgatgctattattgcatctcgcacctcatcatttattaatgaggggactatttttgcatatttaggaacagcaatttcattctctgatgatgttgattctacattgaaaaatcatggaaacattgatgggaaagtaaagcttaacggaggtaataacacccttataaataacggttctgttggagccttaaccgccggagatggcaacaatacgctgaacttaaatgatggaagttatcttcaggacgcaaccctgggtaatgggaataataccattatcttcagtggtttttccatggcaggcgaaattgttgcggggactggtgagaataccttcattattaaagactcagacgggttgagatttgatttgcttgatggcggtatgggagattcagataaactcatatttgaccacgcacagtattttacgctggattccgcaggtaaaataaagaatatcgagagtgtccggttagataatgactctgatgtcaccatcagggaagcgttactacttaccgacaacggtgccggtccgggctcagttgatattcatgatgacaaaagcgagctgtctgtcaggccttcagcgccgggaggctttacgttcgatcctcgtcttacgggtgaaggcctgctctcagttgaacttgacgcagctgaatctgagttcagtttcagccagaatgttggaaatgcattctcaggtacgctggcattaggaaaaagtaactttgtgctcgacggaataaatactgagagcatcacgaatgcaatgcttatttctgagactgataacacaaccatagtcggagatggtacccagcatatcggtggactgggaattgatggtggtaagttgatttttggtaccgttactcccggagatactgtcgcaagcaacagtattgtaaccagtgaagacggccttctggatatcagtggtaaaggtaccgtacaggttacgcttcccggtgaggtggtgaatgtccggcctgtaccggatacgcagaagaacattctggaacaggatgatgctgaaacactggtcacgcttgtcgaggccaggggcgccgtaaaaggtaccggagccgaactcttacttacagacgaaaatggcggggtcatttctgatagccagagctttgatattacgcaggatggtacgccagttgcccggggtacctacgattacaaactgatgagcagcaaagacggcatcagtggggatggtttatacatcggctatggacttaaatcgattgaactgcaaggtattgcgggcaacgcgctgatcctgacaccgaaggatggcgcccgggggcaggaatctgacctgaatgctcagcttaccgggacaggagacctcgcgatagatgccggaagcaatacggtgacactttcaaacggtagtaacgggtatacaggaagtacccgcgtactgtctggtacgctcaaaatggcaaacgacaatgtgcttggacaaaccgctgacctggctatcaataacggagcagcttttattaccgatgggttcagtcagcacgtcggagccatacagactgaagcaggggccggtatccagcttgatgccggaagcgaactgacaatagattcgacattacgcgcttccggtgaagctgccggtggcgttatagaggattcagctctgtatggtgaagggcgtctcgttgtgtctgatagcagccttgaggtaaaaggacaaaacagcaagtttactggtgatgtgaccctcgaaagtggctctgtcgctgaactggaaaacgcacagggcctcggtagtcttggaacagttctgctttcaggtaacgatgacaccctaaaaatggatatcgtgaaaggcagtaattccagtacatcactgaccaaatccctggcagggaagggaacggttgatattcttaataatactgatctgacgctgtcaggagataacagtaattttagcggtactttcgatattggctcagaagcggctttacatgcctcagatgcgaaacatctcggccagagcgtccttggtaatgagggttcactttaccttacggccaataatgactgggaactcacgaatgaaataaatggagcgggctctttaaccaaacagggctccggtaatttgatcatcaaccgggaattatcctacaccggcgctacccgggttgaatcaggaaccatggtcattggtgataattcaaaggacgcagcaggagtattatccggtacatcggtagtgactgtgaatgccggagcgatgttggcaggtacaggaacaatcgcaggtaatgtcgaaaataaaggcacaatagctgcgctgaactcgctcagtggttattcagatgctggtacaggtaattttacagttggagcactaaataataccggaacattgctccttgcaggttctgaaaccggcaatacccttactgttaatggtgattaccatggggaaggtaagctggttctgaatactgtgctcggcggcgatgactcactgactgataagttgatcgttaagggcaatgccagtggcaaaacggacgtctatgtgactaatgtgggtggcagcggagctcagacccaaaatgggattgaggtcgtgcaggttgatggtcagtctgctgatgatagcttcagacttgcaaagcgtgctgtcggcggagcttacgaatactacctgcataaaggagatatcaatggcgcaggcggcgactggtatctgcgttcagagctgtcaccggccccggaaccagatacgactcccgggcctgatacgacaccagaacctgaaccaaatccgacacctgaaccagctccagctccaactcctgctcctgaaccggatcagcatggtgacaaggtttatcgtccagaggcaggctcatacattgccggaattgctgcgagtaacactttgtttaatacccgcctgcacgatcgtgctggtgaaacgtattacacagatgttcttaccggtgaacaggcagttaccagcatgtggatgcggcatgtcggtggacataatgtctggaaagatggcagttcgcagctgaatacccagagcaatcgttatgtgcttcaacttggcggcgatatcgcacaatggactgacggtaaagaccggttacatctgggggtgatggggggatatggtaatgaaaaaagctctaccacatcatcgttatcacattataagtccagaggcacagtgaatggatacagcctcggaatgtatgcaacctggcagcagaatgaaggcgaagaatcaggagcctacgttgacacatgggcccagtacagctggttcgacaatactgtcaaaggagaacagcttgctcaggagacctggaaatcgagtggcataaccgcttcagctgaagctgggtacacgttcaatgctggtaaattcaagggcagccatggcagcgagtataactggtatatacagccacaggctcagatcacgtggatgaacgtcaggtctgaggatcatcgagagcacaacggaactaaaattagtgcccagggagaaggaaacgtgcagagtcgtgtgggtttaagaacatacctgaagggcaaaagccatcttgattctgaaaaggaaaggacatttgagccctttattgaggcgaactggatccataacacccgttcgtggggcgttagaatggatgatgctcttgtcactcaggacggagccagagatgttggagaaattaaaaccggagtcgaggggcagatatctaaaaatcttaacgtgtggggtaacgtcggcgttcaaataggcgacaaaggttataacgatactcaggcaatgttgggtattaagtacagcttcaaataa

SEQ ID NO: 678 - DNA, 1248 bp, Enterobacter cloacae
cgaaaacctgaccgcgaccgtggtgaaaaaagccgacgacatcgaggcgctgatggcggcggcacgcgtatgagcgtgatcatcgttggcggaggcatgaccggcgctactctggcgctggccatttcgcagttaaccaaaggccagcttccggtgcatcttgttgaggcggttgcgccgcaggcggccgatcatcccggcttcgatgcccgcgccatcgcgctggcccagggaacctgccagcagcttgcgcgcattgggatctggcaggcgatagcggactgcgcgacggccatcggcaccgttcacgtcagcgatcgcggccacgccgggtttgtgacgctggatgcccacgattacctaattgaggcactggggcaggtcgtcgagctgcatgacgtggggctgcggctgttccgtctgttacaggatgcccctggcgttacgctgcactgtccggcgcgcgtcgccagcttcagccgccgtgacgaggccgtcagcgtgacgctggacaacggcaccacgctggaggggcaactgctggtggcggcagatggttcacgctccgcgatcgccacgcagtgcggcgtcgaatggcgctctgaaccctatggacaggcggcggtcatcgctaatgtctctacggctggcgcgcataacggcagggcatttgagcgcttcacggagcacggcccgctggccatgctgccgatgtcgaacgggcgctgctcgctggtatggtgccatgcgcaggatcgggccgatgaggttctctcctggtccgacgaacgtttttgttccgagctgcaaaaggccttcggctggcggcttgggcgcatcacccacgccggaaaacgcgtggcctatccgcttgcgctgacgaccgcatcgcagactgtctcccatcgcgtcgccctggtcggcaacgccgcgcagacgctacaccccatcgccgggcaaggcttcaaccttggcctccgtgacgtgatgagcctggccgagctcctggcccggacgtggagcgaacaacaggattgtggcgcatactcagtgctgagccattaccagaaacgacgccaggcggacaaagcggcgaccattggcgtcaccgacggtttagtccacctgtttgccaatcgctgggcaccgctggttgcgggtcgcaaccttgggcttatggcgatggaactgttcattccggcacgtgacgtgctggcgcagcggaccctgggttgggtcgcgcgttaa

SEQ ID NO: 679 - DNA, 1215 bp, Enterobacter cloacae
ggagtattgaccgtgcaaaatgttgatgtcgccattgtgggcggcggaatggtaggactggcgctggcttgtggtttacagggcagcggcctgcgcgtggccgtgcttgagcaaaaagcgccgcagcctgtggcgcaggatgcaccgccagagcttcgcgtctcggcgatcaatgccgccagcgaaaagctactgacgcaccttggcgtctggtctgaaatcgtggcgctccgtgccagttgctatcacgggatggaagtgtgggacaaagacagctttggccgtatcgcgtttgacgatgaaagcatgggttacagccaccttggacatatcgttgaaaacgcggtgatccaccacgtgctgtggcagaaagcacagcagtgcagcgacgtcacgctgatcgcaccggcgaaacttcagcaggtggcgtggggcgaaaacgacgcgtttatcactcttgaaagtggcgatatgctgactgcgcgtctggtagtgggtgccgacggcgccaattcctggctccgtaacaaagcggatattccgctgaccttctgggattaccgtcatcacgcgttggtggccacaatccgcaccgaagagccgcacggcggcgtggcgcgccagattttccataatgacggcattctggccttcctgccgcttgccgatccgcatctctgctccatcgtctggtccttagagccggagaaagcgcagcagatgcaggagacgacgccggatgccttcagtcaggcgctatgcgtggcgtttgataaccgtctgggcctgtgcgggcttgaaagcgaacgccagacgtttccgttaaccggtcgctacgcgcgtcagtttgccgcgcaccgtctggcgctggtgggggatgcggcgcataccattcatccgctggccgggcagggagtgaacctcggctttatggacgcggctgagctggttgaagagctgcgtcgcctgcatcgggaaggcaaagatattggtcagcatctgtatctgcgtcgatacgagcgcagccgcaaacacagtgcggcgatgatgctggcgggtatgcagggcttccgcgagctgtttgccggagcgaacccggcgaaaaaactgctgcgcgatattggcctcaaactggccgacacccttcccggcgtaaaaccgcagcttcttcgtcaggcaatgggcctcaacgatcttcccgactggttacgttaa

SEQ ID NO: 680 - DNA, 426 bp, Enterobacter cloacae
gccggtcgcctaactatttttatcaggagaacttcaatgagcaatgtgccagcagaactgaaatacagcaaagaacacgagtggctgcgcaaagaggcggacggcacttacaccgttgggatcaccgagcacgcgcaggagctgctgggcgacatggtgtttgttgacctgccggaagtgggcgcaaccgtgagcgcaggcgatgactgtgcggtggcggaatccgttaaagcggcctctgacatctacgccccggtaagcggtgaaattgttgccgtgaacgacgcgctcagcgactccccggagctggtgaacagcgaaccgtatgaaggcggctggatcttcaagatcaaagccagcgacgaagcgcaggttgccgcgctgctggatgcgaccgcgtacgaagcactactggaagacgaataa

SEQ ID NO: 681 - DNA, 1206 bp, Enterobacter cloacae
cgcccgacgttgttttctgccgctggtgagcactggtacttcaccgggtttaacgagccggaagcggtactggtgctgattaaaagcaatgacacccacaaccacagcgtgatttttaaccgcgtgcgcgatctgaccgcggaaatctggtttggccgccgcttagggcaggaggcggcgccggaaaaactgggcgtggaccgtgcgctggcctacagcgaaatcaaccagcagctttaccaactgctgaacggcctggacgtgctctatcacgcgcagggcgaatacgcgtatgcggatgacattgtcttcaccgcgctggataagctgcgtaaaggctcacgtcagaatttgtctgcacccgccaccctgacggactggcgaccgatggtgcatgagatgcgcctgtttaagtctgaagaagagctgaatgtgatgcgccgcgcgggcgaaatcagcgccctggcgcatacccgcgccatggaaaagtgccgtcccggtatgttcgagtaccagcttgaaggcgaaattcaccatgaatttaaccgtcacggcgcgcgcttcccgtcctataacaccatcgtaggcggcggtgaaaacggctgcattctgcactacaccgaaaacgaaagtgaactgcgcgacggcgatctggtgctgattgacgcgggctgtgaatatcagggttacgcgggcgacatcacccgtaccttcccggtgaacggtaaattcaccaccgcgcagcgtgaaatctatgacatcgtgcttgagtctctggagaccgcgctgacgctgttccgccctggcacctccatccaggaggttacgggcgaggtggtgcgcatcatgattaccgggctggtgaagctcggcattttgaaaggcgatgtggacacccttataaccgaaaacgcccatcgtccgtactttatgcacggcctgagccactggctggggctggatgtgcatgacgtcggggcatacggtccggaacgttcgcgcgtgctggagccaggcatggtgctgaccgttgagcctgggctgtacatcgcgccggatgccgacgtgccagaacggtaccgcgggatcggcattcgcattgaagatgacatcgtcatcaccgaaaccggtaacgaaaacctgaccgcgaccgtggtgaaaaaagccgacgacatcgaggcgctgatggcggcggcacgcgtatga

SEQ ID NO: 682 - DNA, 1170 bp, Enterobacter cloacae
aagagaacgtttgcgtcggcccccgatcgcgaggccgacaccgggtttcacggtgaatttttcaacgaggaaaagatggctcaacagactcctttgtacgaacagcacgtgttatgcggtgcccgcatggtggacttccacggctggatgatgccgctgcactacggctcgcagattgatgagcaccacgcggtgcgcaccgatgccggtatgttcgacgtgtctcatatgacgattgtcgacctgcgcggtagccgcacccgggagtttttgcgttatctgctggcaaacgacgtcgccaaactgaagacgccgggcaaagcgctctataccggtatgctcaatgcctctggcggcgtgattgacgacctcatcgtctactacttcaccgaagatttcttccgcctcgttgtaaactccgccacccgcgaaaaagacctctcctggatttcccaacacgctgaaccttacgccattgacatcactgtccgtgacgatctgtcgctgattgccgtacaggggccaaacgcccaggcgaaagccgcgtctctgttcagcgacgagcagcgcaaagccaccgaaggcatgaagccattcttcggcgtgcaggcgggggatctgtttatcgccaccaccggctacaccggtgaagcgggctatgaaattgccatgccaaacgagaaggccgctgatttctggcgtgcgctggtggaggcaggtgtgaagcctgcgggcctgggcgcgcgcgatacgctgcgtctggaagcggggatgaacctctacggtcaggagatggacgaaggcgtctctccgctggccgccaacatgggctggaccatcgcatgggaaccggctgaccgtgattttattggtcgtgaagcgctggagatgcagcgcgagaagggcactgaacagctggtaggcctggtgatgaaagaaaaaggcgtgctgcgcggcgagctgccggtgcgcttcaccgatgccgatggcaatcatcgcgaaggcgtgatcaccagcggaacgttctccccgacgctcggctacagtattgccctggcacgcgtgccggcggggattggcgaaacggcggtggtgcagatccgcaaccgcgaaatgccggtcaacgtgaccaaaccgatttttgttcgcgccggtaagccggtcgcctaa

SEQ ID NO: 683 - DNA, 1035 bp, Enterobacter cloacae
agggtggtgaatatgatcaccattcgtgacgtcgcccgccaggcgggtgtttctgttgctactgtctcccgtgtgctgaacaacagtgcgctggtcagccctgaaacgcgtgaaaccgtaatgaaagccgtgacccagctggggtaccggccaaacgccaatgcccaggcgctggcgacgcaggtcagcgataccattggcgtagtggtgatggacgtgtcggacgccttcttcggcgcgctggtcaaagcggtggatgtggttgcccagcagcaccagaaatatgtgctgattggcaacagctatcacgaggctgaaaaagagcgttatgccattgaggtactgatccgccagcgctgtaacgccctgattgtgcactcaaaagccctgagcgatgaagagctggccgggtttatggagcagatccccggcatggtgctgatcaaccgtatcgtccccggctacgcgcatcgctgcgtcggtctggataacatcagcggcgcgatgatggcgacgcggatgctcatcagcaacggccatcagcgcataggttatctggcttccagccacggtattgaagacgacatgatgcgccgcgagggctggcaaaacgccctgaaagagcagggcattgcgccgctggagagctgggtaggtaccggttcgccggacatgcagggcggtgaagcggcaatggttgaactgctggggcgtaatcttcagctgacggccgtgtttgcctataacgacagcatggcggcaggtgcgcttaccgcgctgaaagataatggcattgcggtaccgcagcatttatcgctgatcggttttgatgatatccccattgcccgttacaccgatccgcagctgacaacggtacgttatcccattgcgtcgatggcgaaactggcgacagagctggcgttacagggggcggctgggctgttagatcctgacgcaacgcattgttttatgccgactttagtacgccgccattcggtcgctatccggcaaactgtggctccgatcactaactga

SEQ ID NO: 684 - DNA, 1179 bp, Enterobacter cloacae
atttacttttctttaacaattggagcgatcatggcgctgcgtatcgcgctcagcggatttgtggttctggtcgtggcgatggggataggacgcttcgccttcacgcctcaggtgccgctgatgatagccgccgggcaactcacgcttaccagcgcggggctggtggcggcaatgaactatctgggctatctggtgggggcatgggatgccatgcgcgcccatcgcttcgttgaaacgcgcctctggcttggcatcaccggtgcggtggcgctgacgctgctctccgcggcggcagagaatgccgtcgttcacggtctgctgcgctttgtgatcggatgcatgagcggctggtcgatggtgctgattgccgcctggaccaacgagcggctggggcagctgggcaaaccgggactcagtgcggccgtctttgccggacccggggccggcatcgccctgagcggcctgctggcggtctatattcaggcgaaatccttgtccgccggggcggcatggcaaatctacggcgtactggcgctggtgctgatcgtactggtggcgcgctacctgccgcgcgcaggtcagcttcatcgccctgataccgcgcctgagccgttgctgctgactgcggatctcaggcgtctggtctggagctacagcctggcagggttcggctatatcctcccggcgacctttttatcgcaaatggcggcggtgcgttttcccggcagcctgtttgcccagtttgtctggccaatatttggcgccgcctcggtggtggggattgcgctcagcattgccctgcggcatacatcaagcgctaaccgcaggctggcgattgttctttggttacaggggattggcgtgctggcggcctggttgctgccgggcataggcggcttgctgacgggtgggctgctggtgggcggcgggttcctctgcgccgtgcagctctctcttctgtacggtcgcgagctggcgccagaccacacgcgttacatggcgggactgctcaccaccgggtatgccattggtcagctggtgggtccggtcacgtcggctctgtcgacctggctcacgcaccgtctggaacctgcgctggggctggcggggatcgcgctgttcgttggcggagcgttagtctggaaccgtcaggctgaaaggcaacagcaattgcaataa

SEQ ID NO: 685 - DNA, 759 bp, Enterobacter cloacae
atactggattatgtgcgtcgcctcacgcacaatgagcgcacacttttgccacaacgagggcaaaagacgccacacctgcaggagaaaagaatgtcatcactcagtaaagaagcagcccttgtccatgaagcgctggttgcgcgcggtcttgaaacgccactgcgcccgcccgtgcaggagctggacaatgttacccgcaagcgtctgatcgccggccatatgacggagatcatgcaactgctgaatctcgatctgagcgacgacagcctgatggagacgccgcaccgcatcgcgaagatgtacgtcgacgaaattttctccggcctggattacgcgaacttcccgaaaatcaccgtcattgaaaataagatgaaggtcgatgagatggtgacggtacgcgatatcacgctgaccagcacctgcgagcatcactttgtgaccatcgatggtaaagcgacggtggcctatattccaaaagatacggtcatcggcctgtccaagatcaaccgcatcgtgcagttctttgcccagcgtccgcaggtgcaggaacgtctgacgcagcagatcctgaccgcactgcaaaccctgttggggactaacaatgtggcggtgtctatcgacgcggtgcactactgcgtgaaagcgcgcggcgtgcgtgatgctaccagcgcaaccaccaccacttcgctgggcggcctgttcaaatcgagccagaacacccgccaggagttcctgcgcgccgtgcgtcaccacaactaa

SEQ ID NO: 686 - DNA, 1176 bp, Enterobacter cloacae
tcagacagggcagggaccatggagcgaaacgtcacgctcgattttgttcgcggcgtcgccattctcggtatcctgctgctgaatatcagcgccttcggtctgccgaaggccgcctatctgaatcctgcgtggtatggcgacatcacgcgtagcgacgcctggacgtgggcaatcctcgatctctttgcacaggtgaaattcctgaccctctttgcgcttctgtttggcgcgggacttcagcttctcctcaaacgcggtacgcgctggatccagtcgcgtttaacgctgctggttatcctcggttttattcacgggctgcttttctgggacggcgatattctgctcgcgtatggtctggtgggcctgatttgctggcggctgatccgcgacgcacccggtgtgaaaagcctgtttaacaccggcgtgatgctctatgtcatgggactggccgtgttattgctgcttggcatgattgccgatgattccaccagtcgttcatggatcccggatgcggccaacctgcaatatgagcagttctggaagctgaaaggcggcatggaagcgatcggcaaccgggccgatatgctcggcgataacctgctggcgctgggcgcgcaatacggctggcagctggcggggatgatgctgatgggtgcagccctgatgcgcaccggctggctgaaaggggaatttagcctgcgacactatcgtcgtacgggtgcagggctggtgctgctcggcgtgatcatcaacctcccggcggtgatgatgcagtggcatctacaatgggattaccgttggtgtgcgttcctgttgcaggtgccgcgcgaactgagcgcgccgttccagaccattggctatgcggcgctgatctatggcttctggccccagctttctcgcctgtggatcgtcagtgcggtggcctgcgtcgggcggatggcgttaagcaattacatcctgcaaacgctgatatgcaccacgcttttctaccgattcggcctgtttatgaaattcgatcgcctgacgctgctggcgtttgttattccggtctggattgttaacgtggtgttttcagttgtctggctgcgttttttccgtcagggcccgctggaatgggcatggcgacagttaaccgctcgtgcttcgggcgtgtcattgcgtaatacatccagataa

SEQ ID NO: 687 - DNA, 966 bp, Enterobacter cloacae
actctgtctgctgtcatggcaagcatgctttttggcgcagcagcacacgcagcggatacccgtattggcgtgactatctataaatacgacgataacttcatgtccgttgtgcgtaaagcaattgaaaaagatgctaaatcagcgccagacgtgcaactgctgatgaatgactcccagaatgaccagtccaaacagaacgatcagattgacgttcttctggcaaaaggcgtgaaagcgctggctattaacctggttgacccggctgcggcaggcacggtgatcgagaaagcgcgcggccagaacgtgccaattgtcttcttcaacaaagaaccttcccgtaaagcgctggacagctacgacaaagcgtattacgtgggtaccgactccaaagagtccgggattatccagggcgatctgattgcgaaacactgggcggcgaacccaaactgggatctgaacaaagatggtcagattcagttcgttctgctgaaaggcgaaccgggccatccagatgctgaagcacgtaccacctacgttattaaagagctgaacgacaagggccttaaaacccagcagctggcgttagacaccgcaatgtgggataccgctcaggcgaaagataagatggacgcgtggctgtccggccctaacgccaacaaaattgaagtggtcattgccaacaacgatgcgatggcaatgggtgcggtagaagcgctgaaagcacacaacaaatccgcgattcctgtattcggtgtggatgccctgccagaagcgctggcgctggtgaaatctggcgctatggccggtaccgtactgaacgatgccaacaaccaggcgaaagccaccttcgatctggcgaaaaacctggccgatggtaaaggtgccgctgacgggactaactggaaagttgacaacaaaatcgttcgcgttccttacgtgggcgtataccagtccaacctgggctga

SEQ ID NO: 688 - DNA, 879 bp, Enterobacter cloacae
aaactctgtattatgcgttttatgaatagtctttcgtataaggagccctgcatggaactgctcgaagagcatcgttgttttgaaggtcgacagcagcgctggcggcacgactccaccacgctgaattgtgctatgacgttcagcattttcctgccccctgcggacaacccaccggtgctgtactggctttcaggcctgacctgcaacgacgaaaacttcaccaccaaagcgggcgcccagcgtattgccgccgaactgggcattgcgctggtgatgccagataccagcccgcgtggcgaggacgtggccgacgatgccggatacgatttgggtaaaggcgccggcttctatctcaacgccacggaacaaccgtgggcgcgccattaccgcatgtatgactacattcgcgatgaactgcctgccctggtgcactctcagttcgcggtcagcgagcgctgcgcgataagcggacattcgatgggtggccacggggcgctgataatggcgctaaaaaatccggggaaatacaccagcgtgtccgcatttgcgccgattgtgaacccaacgcaggtgccgtgggggcaaaaagcctttaggcactatctgggtgaagatctagagaaatggcaggaatgggatagctgcgcgctgatgctggcgagccagtcagaagacgctatcccgatgctggtggatcagggtgatgccgatcagttcctcgccgggcagttacagcctgcggtgctggcggaagccgcgcgccagaaggactggccgctaacgctgcgcattcaaccgggatacgaccacagctattacttcatggcgtcctttattgaggatcatctccgcttccatgcggagcatctgttcaggtaa

SEQ ID NO: 689 - DNA, 663 bp, Enterobacter cloacae
ttagttgtggtgacgcacggcgcgcaggaactcctggcgggtgttctggctcgatttgaacaggccgcccagcgaagtggtggtggttgcgctggtagcatcacgcacgccgcgcgctttcacgcagtagtgcaccgcgtcgatagacaccgccacattgttagtccccaacagggtttgcagtgcggtcaggatctgctgcgtcagacgttcctgcacctgcggacgctgggcaaagaactgcacgatgcggttgatcttggacaggccgatgaccgtatcttttggaatataggccaccgtcgctttaccatcgatggtcacaaagtgatgctcgcaggtgctggtcagcgtgatatcgcgtaccgtcaccatctcatcgaccttcatcttattttcaatgacggtgattttcgggaagttcgcgtaatccaggccggagaaaatttcgtcgacgtacatcttcgcgatgcggtgcggcgtctccatcaggctgtcgtcgctcagatcgagattcagcagttgcatgatctccgtcatatggccggcgatcagacgcttgcgggtaacattgtccagctcctgcacgggcgggcgcagtggcgtttcaagaccgcgcgcaaccagcgcttcatggacaagggctgcttctttactgagtga

SEQ ID NO: 690 - DNA, 666 bp, Enterobacter cloacae
atccagcctgttttccgtcgtcatcactcaaacacaaatgatttcaattatcatttgtgtttacaattctacattcttttgtacaattccaggctcttctccatctcaaagagttcttacaagacaaaaacatacagttctcagggttatcccgatggagtttttttcatttttatacggaatgtacaaatgacaataccacgcattaagctcctggccgtcgccattggcgctgccacatgttcccccttcgttcacgcagccgatcaggacaccgttgtcgtcactgcaacgggttttgaacaaaagatccagaatgcccccgcctccatctctgtgatttcgaaacagcagattgaagataaagcctaccgtgatgttaccgatgccctgagagatgtcccgggtgttgtcgtcactggcggcgggagcagcagtgatatcagtattcgcggcatggcctctcagtacaccctgttcctggtgaacggcaaacgcgtcagtacgcgaagcacccgccccaacagcgacaactcgggtattgaacaaggctggctgccgccgcttgagtccattgagcgcatcgaggtcatccgcggcccgatgtcctcgctttacggctccgatgcgatgggtggcgtcatggacgtcattacccaaaattct

SEQ ID NO: 691 - DNA, 612 bp, Enterobacter cloacae
  unsure (16)
  unsure (17)
  unsure (19)
  unsure (22)
  unsure (24)
  unsure (26)
  unsure (29)
  unsure (39)
  unsure (40)
  unsure (42)
  unsure (63)
  unsure (64)
  unsure (68)
  unsure (77)
  unsure (80)
  unsure (97)
  unsure (98)
  unsure (119)
agggggggggaaggcnnanttncnanccncttattcccnnancccggggcttgggcatcattnnaccnacaccccanttngcccaactcctttcctnnggggctctccccaaagccatnagcgcggcctctcaccagcggttgcaatccacgaaccaacatttcagtggaacttatgccgcaaagtcgaatcaaactcgacgccaacctgaaggattttgaggctcaattagccgcaaccgacaaacaggtgggtaacgagctcgcaccgcttaaaggaaaagggtacttcgtttttcatgatgcctacgggtattacgagaaacattacggtctgaccccgctggggcattttaccgtcaaccctgaaattcagcctggtgcgcagcgtttacatgaaatcagaacacagttggttgagcagaaagcgacatgcgtttttgctgagccacagttcaggccagcggtcgtagaagccgtggccaggggaacatccgtgcgcatgggaacccttgacccgctaggtacgaacatccagttgagcaaagcgagctattcgcagttcctcagccaactggcgaatcagtatgcgagctgcctgaaaggagattaa

SEQ ID NO: 692 - DNA, 1335 bp, Enterobacter cloacae
cgaggaagtgaatacgtgcaacagatagcccgctctgtcgccctggcatttaacaatctgcctcgaccccaccgcgttatgctggggtcgcttacagttctcacattagcggtcgccgtctggcggccctatgtttaccacccgagttccgccccaatcatcaaaaccatcgaactggagaagagcgagatccgctctctgctgcccgaggccagcgagcctatcgatcaggccgctcaggaagatgaagcgattccccaggatgagctggatgacaagatccagaatgaagctggcattcatgaatatgttgtatccactggcgatacgctgagcagcgtcctgaaccagtacggtatcgacatgggcaacatcagccagctcgccgcatccgataaagagctgcgtaacctgaaaattggtcagcaactttcctggaccttaacgcccgacggcgatctgcaacgtttgacctgggagatgtcccgtcgcgaaacccgcacctacgatcgcactgcaaacggtttcaaaatgaccagtgaattgcagcagggcgactgggttaacagcgtcatgaaaggaaccgtcggcggcagctttgtttccagcgcacgcgatgccggcctgaccagcgctgaaatcagctcggtgatcaaagccatgcagtggcagatggatttccgcaaactgaaaaaaggcgatcagttctctgtcctgatgtcccgcgaaatgctggacggtaagcgcgagcagagccagctggtgggcgttcgtctgcgttcagacggcaaagactactacgctattcgcgcggaagacggtaagttctatgaccgcagcggtacgggtctggcaaaaggcttcctgcgtttcccaacggcgaaacagttccgcgtctcctccaactttaacccgcgtcgtctgaacccggtaacgggccgcgtagcgccgcaccgtggcgttgacttcgctatgccgcagggcacgccagtgctggcggtaggagatggtgaagtggtcatggcgaaacgcagcggtgctgctggctattacgttgctattcgtcacggtcgtacgtacaccacccgctacatgcacctgcgtaaactgctggtcaaaccgggccagaaggtgaaacgtggcgatcgcatcgcgctgtctggtaacaccggccggtcgacggggccgcacctgcactatgaagtgtggatcaaccagcaggcggttaacccgctgacggcgaaactgccgcgcaccgaagggctgaccggaaaagatcgcaaagattacctggcgcaggtgaaagaggtgatgccgcagctgcgcttcgactaa

SEQ ID NO: 693 - DNA, 216 bp, Enterobacter cloacae
aaagccggcgtcagtatgcgccggctttttcttttgtgcgcgggcggcagcctcgctacactatccgcatatatttttgcgtcaccagaccctggaacccgcatggaaaccaaaaaaaacaatattgagtacattcatgagtttgaaaaatcttttcgccacccgcgtaactggggcgcctggataggcgtatacgcgtttgctggcatggcgtag

SEQ ID NO: 694 - DNA, 858 bp, Enterobacter cloacae
ctacctgctaccctccgcgatccggtgctcggtaaagtggggcgcctggcagggcgcttgggtaaaagcgcgcgccgacgcgcgcaaataaacctgttgtactgtttcccggataaaagcgacgctgaacgcgaagcaatcattgatgacatgtataccactgcgccgcaggcgatggcgatgatggcggaactggcactgaaagggccggagaagatcgtcgaacgcgttgactggaaagggctggagatcatcgacgagatgcgtcgcaatgatgaaaaggtgattttcctggtgccgcacggctggggggtcgacattccggcgatgttaatggcgtcgcagggccagaaaatggcggcgatgttccataatcagggaaacaaaatctacgatttcgtctggaataccgtgcgccgtcgctttggcggacgcttgcacgcccgaaacgatggcattaagcctttcattcagtcggtacgtcagggttactggggctactatctgcccgatcaggaccatggtcctgagcacagcgagtttgtcgatttcttcgcaacctataaagccacgctaccagcgattggtcgcctgatgaaagtctgccgcgcccgcgtgatcccactgttcccggcttatgacggtaaaacgcatcgcctgagcattgaggtacgtccgccgatggacgatctgctgaccgcagacgatcacaccatcgcacgccgcatgaatgaagaggtggaagtgctggtggggccgcataaggagcaatatacgtggatcctgaagctgctcaaaacgcgtaaacctggcgaaacagagccgtacaagcgtaaagaacttttcccgaagaaatag

SEQ ID NO: 695 - DNA, 771 bp, Enterobacter cloacae
tggtttcaggaaacgcgtaaaagcagtacagtgcattgtaataaaattacaacgatacctggcagagtaccaggcgatctaactgaggagaatgacatggcggtaacgcaaacagcccaggcatgtgacctggtcattttcggcgcgaaaggcgatcttgcacgccgaaaattgctgccttccctgtatcagctcgaaaaagcgggccagatccatcccgacacccggatccttggggtagggcgcgcagactgggataaggaggcttataccaaagtcgtgcgtgaggcgctcgaaacgttcatgaaagagaaaatcgatgaaagcctttgggataagctgagcgggcgtctcgatttctgcaacctggacgtcaacgatgtaggcgcctttacccgtctgggtgaaatgcttgaccaggaaaatcgtgtcactattaactatttcgccatgccgccaagcaccttcggcgccatctgcaaaggtctgggcgaggcgaagctgaacgccaaaccggcgcgtgtagtgatggagaaaccgctgggtacgtcgctggcgacctcgcgtgaaatcaacgaccaggtaggcgagttctttgaggagtgtcaggtttaccgtattgaccactatctgggcaaagagacggttactgaacttgctggcgtggcgttttgccaactccctgtttgtgaacaaatgggacaaccgcactatcgaccacgtggaaattaccgtggcggaagaggtgggcatcgaagcccgttggggtaa

SEQ ID NO: 696 - DNA, 759 bp, Enterobacter cloacae
gcgagttctttgaggagtgtcaggtttaccgtattgaccactatctgggcaaagagacggttactgaacttgctggcgtggcgttttgccaactccctgtttgtgaacaaatgggacaaccgcactatcgaccacgtggaaattaccgtggcggaagaggtgggcatcgaagcccgttggggtaatttcgaccaggccggccagatgcgtgacatgatccagaaccacctgctgcaaattctgtgcatgattgccatgtctccaccgtcagatctgacggccgacagcattcgtgacgccaaagtgaaagtgctgaaatcactgcgccgtattgaccgctccaacgtgcgtgagaaaaccgtgcgcggccagtacaccgcaggttttgcccaggggaaaaaagttcctggctatctggaagaagagggcgcgaacaagtccagcaacaccgagacgtttgtggcgatccgcgtggatatcgacgactggcgctgggccggtgtgccgttctacctgcgtaccgggaaacgtctgccagcaaaatgctccgaagtggtggtctacttcaaaaatccggaactgaacctgttcaaagaatcctggcaggaactgccgcagaacaaactgaccatccgtctgcaaccggacgagggtgtggatattcagatcctgaacaaagtgccgggtcttgatcacaaacacaacctgcaaaccaccaagctcgacctgagctactctgacaccgtccatcattattga

SEQ ID NO: 697 - DNA, 942 bp, Enterobacter cloacae
tatcggctaaatcgaatcaaggtttcatctctttatgaaatcgtttatgccctcatgagcgtcttgttaacaatgaacatgctggaaaaaatccagtttcaactggaacaccttagcaaatccgagcgcaaagtggctgaagttattctcgccgcgcccgctcaggcgattcattcaagcatcgccgctctggcacaggaatcgggcgtcagcgaaccgacggtcaatcgattctgtcgtagtctggacacgcgcggctttcctgattttaaactgcatctggcccaaagtctggcaaacggcaccccgtatgttaatcgcaatgtcgatgaagacgacagcgttgatgcatacaccgcaaaaatatttgaatcggcaatggccacgctcgaccacgttcgccagtctctggacatgagttcagtaaatcgcgcggtcgatcttctcacgcaggccaaacggattgccttctttggccttggctcgtccgccgccgtggcgcatgacgccatgaataagttctttcgctttaacgtgccggtgatttactccgatgacattgtgctgcaacgcatgagctgtatgaattgtagcgaagatgatgtcgtggtactcatctctcatacgggccgcaccaagagccaggtggagctggcgcagctcgcgcgtgacaacgatgcgatggtcatcgccctgacgacggcaggtacgccgctcgcccgggaagcgacgctcgccattaccctggacgtaccggaggataccgacatgtacatgccgatggtctcccgcctggcgcagttgacggtcatcgacgtactggcgaccggttttaccttacgccggggcgcaaaattccgggataacttgaagcgggtcaaggaagccctgaaagaatcgcgttttgataaagaattgcttataaagagcgatgttccctaa

SEQ ID NO: 698 - DNA, 1554 bp, Enterobacter cloacae
cgacgaagtacgatttacggcattcggtcccctcgctactgccttgcgatagatgaaggccgattctatgttcacgcaacaccaaagttgtttcagtcaacggagtattacatgtccagaaggcttcgcagaaccaagatcgtcaccaccttaggcccggccaccgaccgcgataataacctcgaaaagattatcgccgcgggtgctaacgtggtgcgtatgaacttctctcacggtacgccagaagaccataaattacgtgccgacaaagtgcgtgaaatcgcagctaaactgggccgccatgttgctatcctcggtgacctgcaaggtcccaaaatccgcgtatcgacctttaaagaaggcaaagtcttcctcaacatcggcgataaattcctgctggacgccaacctgagcaaaggcgaaggcgataaggaaaaagtgggtatcgactacaaaggtctgcctgctgacgttgtgcctggcgacatcctgctgctggacgacggacgcgtacagctgaaagtgctggaagttcagggtatgaaggtgttcaccgaagtgaccgtcggcggcccgctctccaacaacaaaggcatcaacaaactcggcggtggcctgtctgccgaagcgctgaccgataaagacaaagcggatatcgtgaccgcagcgcagatcggcgtggattatctggccgtctccttcccgcgctgcggtgaagatctgaactatgctcgccgcctggcgcgcgatgcaggctgcgatgcgaaaatcgttgcaaaagtggaacgcgctgaagcggtctgcgatcaggacgcgatggacgacgtgatcctggcgtctgacgtggtgatggttgcccgtggtgacctgggcgtggaaattggcgaccctgaactggtcggtatccagaaagcgctgatccgtcgcgcgcgtcagctgaaccgcgcggtgatcaccgccacccagatgatggaatccatgatcaccaacccaatgccgacccgtgcagaagtcatggacgtggcgaacgccgtgctggatggtactgacgcggtgatgctgtcagcggaaaccgcggcgggccagtatccggcggaaaccgtggccgccatggcgcgcgtctgcctgggtgcagagaagatcccaagcattaacgtctccaagcaccgcctggatatccagttcgacaatgtggaagaagcgattgcgatgtccgcgatgtacgcagccaaccacctgaaaggggtcacggcgatcatcaccatgaccgaatctggccgtaccgcgctaatgacgtcccgtatcagctccggtctgccgatcttcgccatgtcccgtcacgagcgtacgctgaacctgacggcgctgtatcgcggcgtgacgccagtatacttcgacagcaccaacgacggcgtggccgccgcgcacgatgccgtgaacctgctgcgcgacaaaggttatctggtatccggtgatatcgttatcgtgacgcagggtgacgtgatgagcaccatcggctcaaccaataccacccgcgtactgaccgtagagtaa

SEQ ID NO: 699 - DNA, 240 bp, Enterobacter cloacae
aaggagctggctttgaaaaagatttttgtttcagtgttcgcagcggcagttgcgctttcagccctaaccggctgcacgcgcacaagctatgccatccacaccaacgacgggcgtacaattgtcagcgacggcaagcctacagaatcagactcaggcctgctgggctataaagacgcaaatggtgtcaaacagcagatcaataaagccgacgttaaagaagtctctgaaattccgcattga

SEQ ID NO: 700 - DNA, 498 bp, Enterobacter cloacae
agggagccatctatgaacagtcttttaacgctggcgaaggacttagagcagaaatcgaaagtgcagcaacagactaccggcgagatgctgaaagccgcattcagcgagcacgataagtctgtcagaacggaactgaacgaaagcgagaagagaatcagcgccgccatccacgaccacgaccggatgctgtcctcagccatgagccagcgtacgaaagggatgctgcgcatggtcagccagacgtggctgaccatcgtcctggtctccgtgctgctgatagcctcaagtgcgggcattctatggtggcaggggcagcagatactcgacaattacacgaccatccgggagcagaagagcacgcaggccatgctgtccgagaggaacagcggcgtgcagctcacgacctgcggagaggaacgacgccgctgcgtgagggtgaacccggacgcgggacggttcggagaggattcgagctggatgatactggcggggaaatag

SEQ ID NO: 701 - DNA, 213 bp, Enterobacter cloacae
cacatgacggaactggaaaaacagttgctgagcgcattagagcagctacagcaggactactcgaaaaggctggacgagtgggagagcgccttcgcggaatggcggacgatgtgtggtcttatgcaacgggagaacgcagcgctgagcgagcgcgtcacggacttgagcacgcaggtgctgagtttaagcgagcagctgcgccggttgtcgtaa

SEQ ID NO: 702 - DNA, 336 bp, Enterobacter cloacae
attagcgtgatctggcagcgcctgttgaaaatgccggaaacgaagcaggaagccgctcaggcgattacgcggggtttactggccttagcctcgtccggggagctgaaaacgcgtcatgacgtcactgaggcgctggaaagcgcaggttttgaggtggttcgcaccacaaaaagcagcatcagcattgccgacccggacggggggcgaaacatccgactgaagggagccatctatgaacagtcttttaacgctggcgaaggacttagagcagaaatcgaaagtgcagcaacagactaccggcgagatgctgaaagccgcattcagcgagcacgataa

SEQ ID NO: 703 - DNA, 708 bp, Enterobacter cloacae
gtctgtcagaacggaactgaacgaaagcgagaagagaatcagcgccgccatccacgaccacgaccggatgctgtcctcagccatgagccagcgtacgaaagggatgctgcgcatggtcagccagacgtggctgaccatcgtcctggtctccgtgctgctgatagcctcaagtgcgggcattctatggtggcaggggcagcagatactcgacaattacacgaccatccgggagcagaagagcacgcaggccatgctgtccgagaggaacagcggcgtgcagctcacgacctgcggagaggaacgacgccgctgcgtgagggtgaacccggacgcgggacggttcggagaggattcgagctggatgatactggcggggaaatagcacatgacggaactggaaaaacagttgctgagcgcattagagcagctacagcaggactactcgaaaaggctggacgagtgggagagcgccttcgcggaatggcggacgatgtgtggtcttatgcaacgggagaacgcagcgctgagcgagcgcgtcacggacttgagcacgcaggtgctgagtttaagcgagcagctgcgccggttgtcgtaaggctgaacgacatcgaggcacaccgggagcaggagcgcgcagcgcagcaccagaaagcgctggagctggaacgatcgcagcgtcagcaggagtatgacggtccgtcgctgtga

SEQ ID NO: 704 - DNA, 3273 bp, Enterobacter cloacae
aagccgcgcaaggcggcccgtacgtccggtgctcccgaccaaagttacaccggaaaactacttaaaaaaccaaagttcacccaatgggcgctatctctggcccggggatcttacatccaaaaaagaggatctcacatggaatttttctatgtagttaaggctacgcagaaatctggcaaagaagacgcagtgatttggttcactgctaaatcagaagcccgtgccaacctgcagctcgatgtcgagctggaagatgctggtattgaaaccggccgcggtaagaattactcaaaaccggctcgcaccgatttccctgtttacaatgatctgcctgaagaaagcacagtggattacacctggtgcaaacgctacgaactccaggacgatggacgcacctggctaccaaaggctggtgctgtgtctactggagccgtagacaacactgccgcaccggaaccgaccgttaaagtcgaagctaccgtcgagtgtgtcccgcttgaaaaccgcactccagcggtccgttttgccgtccatctgaccagcgacaaataccagtcacatatcactaaagagcagcagctggctgccagcgaaatgtcactggatgaaggcaacacctatctccaaaacctgctacaggcgaagaacgatatccctgaagttgacgaactcagcctgaacgctgaatggaaactggttcaggcgattaagcaggtatttgcgccagatgaagagcacgaagtaaagctgcttgctgctttcatggccgactggttgagagtagatgcaggtgaccgcaatgagttagttagagagtggagaagcggaaagcttacacttctcaaatcagaaagcaccagcgagaccggcgttacaaccgatcaggatccagaacctgataacggtatccagattgacgagaatgatgacgaaaccacacgttatccagtcgttcgtatgccgttccggaagcagctactcgcccagttcaccgccaacgaactgcgccaccacttaacccgcgaagaatacgaaggtatcagcgcgctggaaatggacactgacaacggctacgtccagaacctgctgctggcggcagaaaactgcgaagaggttaagggttacgataccaaagacctgtggcgctacactgaggccattcgcaaggtgttcagccaggagaagcgtcacgaactcgctttggttctccgattcaccagaatctgggcggcgactgattacattgaccgcggcattctcgttcgcgaatgggctgcaggtaatcgcatcagtaatattcagcgcactgattctggtaccaatgcagacggcgcgtatgtaacggatcgcggcgaaggcgcgcaccacactctggacaccctcgatcttgagatcgcatgcgccctgctgcctatggacttccaccacttcgaaataccttcgagcgtgttacgtcgtgccaaagaaatcgtggctaagaaagaagaaccatggaaatcatggagcgccatcctgcgtaatcagcccggcgtactggcggtgaaccgtgcggcaatcttcaatctgatccgcatcgcaccagagaacattcatcacacgccagcggctcatcttgagtttgtgaataaagccatgacggctgagtttaactctgctgtggaggtactgccgttgcctactgctgcagttgagactgaagccccagttgaacaaccacaggttgaaaatctcggcagtggagtgttctccatcgatggcctgatgggtggaaataccgaaccggtcgccgatacctcctcaaatgaagtcgaaaaaacggaaaacgcagcggagaccaccagcgatgtgcagatggaaacggctaagccagagaaagacgaagatgttggttcagtaccaccgagcgaaagcactgatgcagctaattcgcagacagattccgtagcgttggaagaacagcaagcagaaccggtaattgaatacccggcttacttcgagcctggccgctacgaaggcctaccgaatgacgtttatcacgcagcaaacggtattagctcaacccaggtaaaagatgcccgcgtcagcctgatgtacttcaacgcgcgccatgtagctaaaaccatccagcgcacagcatccaaagttctggatatgggaaatctcgtgcacgcccttgcactgcagccggaaaacctcgaaacagagttcagcgttgaacctcagatcccggagggtgcgtttacgaccaccgcaactctgcgtgagttcatcgacgcgtacaacgccagcctgccggcgctgctaagcgctgacgagattaaagcgttgcttgaagaacataacgcatcacttcctgctcaagtgccgcttggcgccagccaggaagaaacggctcaaagctatatggctctccctgctgagtaccagcgtattgaagaaggccagaagcagacagctgctgcaatgaaggcatgcattaaagagtacaacgccaccctgcccgtgccggttaaaaccagcggcagccgtgatgcgctactcgagcaattggcgatcatcaatcctgatttggtagcgcaggaagcgcagaaatcgacgccgctgaaagtctccggcagcaaagcagacatgatccaggcagttaagtcggttaagcccgatgccatatttgccgacgaactgctggatgtctggcgcgacaaccctgacgaaaagattctggttacgcgccagcaactggccacagcgcgggcaattcagtcggcactactggcgcacccgaccgcgggcatgctgctgacacatccaagccgcgccgtagaagtgagctatttcggtttcgacgacgaaaccggattagaagtgcgtgtacgcccggatctcgaaatcgaattggatggcgtgcgcatcggtgctgacttgaaaactatcagcatgtggaacgttaagcaggaaagcctgcgcgctaggctgcaccgggaaatcattgaccgtgactatcacctcagcgcggctatgtattgcgagacagcggcgctggaccagttcttctggattttcgtcaacaaagacgagaactaccactggatcgccatcattgaggcgtccaccgaactgctggaactgggcatgctcgagtaccgcaaaacgatacgcgccatcgcaaccggattcgacacgggcgaatggccagcgccgataactaccgattacaccgatgaactgaacgacttcgacctgcgccgcctcgaagcgctgcgcgctcaggcttaa

SEQ ID NO: 705 - DNA, 1095 bp, Enterobacter cloacae
gggggatttatgcataacactaacgttaccgttactgaccagaacaccgttattaactccaacgtggctttgtttgattcccagtatctgaacgccattagcacgttcgcgcagatcatggcgcagggcactgctaccgttcctaaacacctgcagggcaaccaggccgactgcatggctgtagcgatgcaagcggcacagtggcagatgaatccctttgccgtggcgcagaagacgcacctgattaacggtgtgctcgggtatgaagctcagctcgttaatgccgtcatttcacgcagcggcgtgctggccagccgctttgaatatgaatggtacggaccatgggaaaaggttgttgggaaattccatatccgtaaaggcgacaaaggcgagtaccgcgtcccgggctggaccctggctgacgaagccgggatcggcattattatccgcgcaaccctgaaaggtgaagatcagccaagggaactcgatttgctgctggctcaggcccgaacccgaaactctaccctgtgggctgacgacccacgccagcagctggcatatctggctgtcaaacgctgggccagactgttctgcccggatgtgattctgggcgtttacacccctgatgaactggatgatcgccgagaagaacgagaggtaaaccctgcaccggcgcagcacgttagccttgcagacatttcaggtgacaacgtcactacgactcaaacggctcaggaatcagctcaaaatatttatgcacttgctgatgatttccgtgaccgcatcgaggcggctcaggatgtggatagcgctaaagctctgcgcgcagatattgaaaccgtgaaagcaacactgggttctgccctgttcactgagctgaaaaacaaggccgtgaagcgttattacctggttgatgcacggaacaaagtcgaagcagccatcaattccttgccatcttcagatgagccggatgcagctgcgcggttcgcggaagtagagcgcgttcttgcagcgtcgaaacgccatctgggcgacgaattgcatggtcagttcagcatcaccctggcggatatgaaaccggaatacgtggactaa

SEQ ID NO: 706 - DNA, 216 bp, Enterobacter cloacae
accatgtcgcaggtaatttttaacgaagaatgggttgttggcgcaaggctcacagaaaaaacaggcctgaccgaacgacagattgagaagtatcgccagggctgttgggtggaaggtgtccattttaaacgggtgtctccttctggcgaaaaaaccttgcgtggcacaacctggtacaactatccgagaattaatcagttaataagggatgcgtaa

SEQ ID NO: 707 - DNA, 210 bp, Enterobacter cloacae
ttcttcgccgcctgtgctacctactggcgcaaaaggggaatccagatgtgtaactcaacgaaatgcgggtactgcggcaagacggttaaaccgggggaagtagttaaaagtacccttctctatcgcaacggcgcacagctggcgcgcaaagaaaaagaatactgctctgaacgttgtgcttcgtacgaccagatggcccacgaggcataa

SEQ ID NO: 708 - DNA, 1251 bp, Enterobacter cloacae
gggatgcgtaagatggcggctttgcctacaggtgtagaaatcagaaacaataagatttgtatctggtttatgtaccggggaaagcgttgccgcgaaattctcaaaggttggattaacagcccggcgaacatcaaaaaagccgggaaccttcgggctgtgatcgttagcgaaatcaaccttggagagtttgattacaaccagcgctttccttcatcatccagagcaaaaaaaaccgtaaccactgtttcagttcaaaccttttcagagctgtgtgaactgtggacgagcattaaagaaaccgaaattagcgcgaataccatgcgtaagacgcgcttacaactcggtacgttaatgcacatcattaacggagatacgcctgtttcagctatacgccacagcgacattctgaaatacagaaaggagctgttgaacggtgagacactttacctggcaaatcccagaagtaacaaacagggacgaactgtgcgtaccgtgaacaactatatatcgcttctgtgctcccttcttcggtttgcacacaaatctggctttatcagtggcaaaccctttgaagggatcaagaaactacacaaagggaaagtaaaaccggatcctttaacgaagcaggagtttagtttgcttgcggaatccgagcgtggccaaagcctgaatatgtggacgttcgcagtatatactggcgtccgtcatggagagctcgcagctcttgcctgggaagatattgactgggaaaaaggtacagcccatataaagcggaatcttaatgcgttgggcatgttcggcccaccaaaaaccgaagcaggtaaccgggttatcaccctattagagccggcgcttgaagccttgaaagcacagcgcaagctgacagcactacagcctaaaaccgaaattgtctttaatcatcgcgagtatggcgcagtggaaaatcaaagcctgcgattcgttttcataccccggatgcgcaaaggagaacagaaagcctactactctttatcgagcatcggtgcgagattcaacgcagctgtaaaacgtgctggtattcgccgccggaatccgtaccatacgcggcatacttttgcctgctggcttttatctgccggcgctaacccgtctttcatagccagccagatggggcatgaaaacgcgcaaatggtttatgaagtctacggtgcgtggattgaagaaatgaatggcgaacaggtgctgatgcttaacaataagctggcacgctga

SEQ ID NO: 709 - DNA, 252 bp, Enterobacter cloacae
agccatggcgcgctggcaggcacacaggtgagcgccttaatcacgcttaccccgctgtttacgctgttattttcagatttattatcaatggcctggcccgatgtcttcgtcaagccgatgctcaacctgttgggttatctcggtgcgtttgtcatggttgcgggcgcgatgtattccgccattggtcatcgtctctgggggcgttggcgcaaaaatgaagcggttgtaatagtcccccgctcaggcgaatga

SEQ ID NO: 710 - DNA, 1191 bp, Enterobacter cloacae
gttacggagagtaaaatgaagtttgttgatgaagcgacgatcctggtcgtggcaggtgatggcggtaacggttgtgtaagcttccgccgtgaaaaatatattcctcgtggcggtcctgacggcggtgacggtggggacggtggcgacgtgtggctggaggcggatgaaaacctcaacacgctgatcgactaccgtttcgaaaaatctttccgcgccgagcgtggccagaacggccagagccgcgactgtaccggtaaacgcggtaaagacgtgacgatcaaagtgccggtgggtacgcgtgtcatcgatcagggtacgggcgaaaccatgggtgatatgaccaaacacggtcagcgcctgatggtggcgaaaggcggctggcacggtctgggtaacagccgtttcaaatcgtccgttaaccgtaccccgcgtcagaaaaccatgggtaccccaggtgataagcgcgacctgcaactggaactgatgctgctggcggatgtggggatgctgggcatgccaaacgccggtaaatcgacgtttatccgtgcggtctctgcggcgaaaccaaaagtggcagattatccgtttacgacgctggtaccgagcctgggcgttgtccgtatggataacgagaagagcttcgtggtcgctgacatcccgggtctgattgaaggggctgcagaaggcgccggtctgggtattcgcttcctgaagcaccttgagcgttgccgcgtactgttgcacctcatcgacatcgatccaatcgacggttccgatccggttgaaaacgctcgtatcattatcggcgagctggagaaatacagtgaaaaactggcgcaaaaaccgcgctggctggtattcaacaagatcgacctgatggacaaagcggaagctgaagcgaaagctaaagcgattgccgaagcgatgggttgggaagataagtactatctgatctctgccgccagccaggttggcgtgaaagatctctgctgggatgtgatgacctttatcatcgagaatccggttgttcaggcagaagaggcgaaacagcctgaaaaagtcgaattcatgtgggatgactaccaccgccagcagctcgaagagctggaagcggaagaagatgatgaagactgggacgatgactgggatgaagacgacgaagaaggcgtcgagttcatctacaagcactaa

SEQ ID NO: 711 - DNA, 366 bp, Enterobacter cloacae
atatttatagcgcactctgaatcatacgaggatgtgcgcggaagcggagtttatatgtacgcggttttccaaagtggtggtaaacaacaccgagtaagcgaaggtcagaccgttcgcctggaaaagctggacatcgcaactggcgaatctgttgagttcgctgaagttctgatgatcgcaaacggtgaagaagtcaaaatcggcgttcctttcgttgatggcggcgttatcaaagctgaagttgttgctcacggtcgtggcgagaaagttaaaatcgttaagtttcgtcgtcgtaaacactatcgtaagcagcagggccaccgtcagtggttcactgatgtgaaaattactggcatcagcgcctaa

SEQ ID NO: 712 - DNA, 843 bp, Enterobacter cloacae
gtaaggttttctcggtccggtaacggattaaagccccgcaacgtgttgcggggctttttacattggaaacccggaaaattttctgtagggaaaacgggcatgaagcagcaggccggcattggtattcttttggcgctcactaccgcaatgtgctggggtgcgctgccaattgcaatgaagcaggtactggaagtcatggagccaccgacggtggtgttttatcgcttcctgatggcaagcataggcctgggcgccattctggccgtcaaaggtaagctgccaccgctgcgcatctttcgaaaaccgcgttggctggtgttactggctatcgcgacgggcggtctgttcggtaacttcattctgttcagctcttccctgcaatatcttagccctacagcgtcacaagtgattggtcagctttcaccggtcggcatgatggtcgccagcgtattcatcctcaaggagaagatgcgcggcacgcagatcatcggggcaagtatgctgctttgcgggctggtgatgttctttaacaccagcctgattgagatttttacccgcctgacggattacacctggggtgtcatttttggggtgggcgcagcaacggtctgggtgagttatggcgtcgcgcaaaaggtgttattgcgccgtcttgcctcacagcagatcctctttttgctgtacactttgtgtacactggcattattgcctttagcgaaaccgggtgtaattacccagctcagcgactggcaactggcgtgcctcattttttgtgggctgaatacgctggtcggttatggcgcgctggctgaagccatggcgcgctggcaggcacacaggtga

SEQ ID NO: 713 - DNA, 480 bp, Enterobacter cloacae
caaatgcaagctattccgatgaccttacgtggtgccgaaaaactgcgcgaagagctggattttctgaaatccgtgcgtcgccctgaaatcatcgccgctatcgcggaagcgcgtgagcatggcgacctgaaagagaatgctgaataccacgcggcgcgtgagcagcagggtttctgtgaagggcgtattaaagatatcgaagcaaaattgtccaatgcacaggttatcgatatcaccaaaatgccgaataatggccgtgtgatttttggttcaaccgttaccgtgctgaacctggacaacgacgaagagcagacctatcgcatcgtgggtgatgatgaagctgacttcaaacagaacctgatttcggtgaactcgccaattgctcgtggcctgattggcaaagagcaggacgatgtggtcaccatccgcacccctggtggtgaagtggaatacgaaattattaaggttgaatatctgtaa

SEQ ID NO: 714 - DNA, 258 bp, Enterobacter cloacae
atggcacataaaaaggctggcggctccacacgtaacggtcgcgattcagaagctaaacgcctgggcgttaagcgtttcggtggcgaatccgttctggcgggtagcatcatcgttcgtcagcgtggcaccaagttccacgcgggtaccaacgtaggttgcggtcgtgaccacactctgtttgctaaagcagacggtaaagtgaaatttgaagttaaaggcccgaacaaccgtaaatacatcagcatcgttgctgagtaa

SEQ ID NO: 715 - DNA, 1095 bp, Enterobacter cloacae
agatcgcatcaaaaccgtacgcggcgtgggttaccgtctggagagccagaaatgaacagtatgcgccggcgattaatggtgttgctggcggttattctgctattttttcaactcattagcgtagtctggctgtggcatgagagccgcgagcagatcggttttctggtgaacgaaacgttgtccgctaaagcacgcaacaaccatgtcgaaaaagagatccgcgaagccattgcctccctgctggtcccttcactggtgatggtcggttttaccctgctcttctcattctgggcagtcacatggatcacccgaccactcaacaaacttcgcgccagccttgcgaaccgttcggcggataatctgactcccctgccgatgtattctgatatggaagagataggcgcagtaaccacgtccctcaaccaactcctcgcccggctggaccacactattcaacaggaacgcctgtttaccgccgatgcggcacacgagttacgtacgccgctggcggggattaggctccatctggaactgatggctcagtccggttccccgcaggccacgccactgataaaccggatcgatcagctgatgcacacggtggaacagctgctgatgctggcgcgtgccggacaggcgatggccagcggccattacgataccgtgaactggactgagtcgatcattgctccgcttagcctggagcatgaagccaaagagcatacggtattatggccggcccacagcacgctgacggtacagggggacgccgtcctgttacgtctgatgctaaggaaccttctggagaatgccgcccgttacagcccggcaggcacaatcattgaagtggcattaacagcgacggaggggggtacccgggtgagcgttaccgatcaggggccgggtattgatgaggcgcaccgccagtcgatcaccgaacctttccgacgtctcgaccagcgctacggcggcagcggccttgggctgagcatcgtacagcgtatcgtacagctccatcatggtcatttaacgctggagaacggcgctgagggcggcctcatcgccagctgttggttaccgacgaaaataggataa

SEQ ID NO: 716 - DNA, 375 bp, Enterobacter cloacae
  unsure (29)
  unsure (30)
tacattaatcgcggatcctgccagccccnngtggtgaaaacaatgaaccgttttcaatcccaacgtaagcaaaaatatacgatgaatctgagtactaaacaaaaacagcaccttaaaggtctggcacatccgctcaagcctgtagtgatgcttggcaacaatggtttgaccgaaggggtgcttgccgagattgaacaagcgctggaacaccacgagctgatcaaggtgaaaatcgcctctgaagacagagacactaaaaacctgatcgtggaagccatcgtgcgcgaaaccggcgcctgtaatgtacaggtcatcggtaaaacgctggtgctctatcgcccatctaaagagcgcaaaatctcgctgccacgttaa

SEQ ID NO: 717 - DNA, 669 bp, Enterobacter cloacae
ctagcgatgaaactactgatagttgaagacgatctgttattgcaggaagggttagcgctggcgctgggcaatgagggctacgccctggattgtgccgccacggccgctgaagcagatgccctgatccagagcggtgaatacagcctggtgatcctggatttgggactgccggataaagacggcgcgacgctgctctgccagtggcgtcgtcgcggagtggagaatcccgtattgattctcaccgcccgcgatgccattgaagacagaattaacgggcttgattctggcgctgacgattatctggtaaaacccttcgcccttgccgagctacaggctcgcgtacgggcgttgatccgccgctatcagggccacagcgacaacctgctgacggacggggatattaccctcaatctgcaaactcagcaggtgctgcgccagtctcagcctgtggaagtgaccccaaaagagttcgctctgctgacgcgcctgatcatgcgcagcgggcagaccgtgcaccgtgaaacgctgcaacaggacatctactcctggcaggacgatccaggatcaaacacgcttgaagttcatattcataatctgcgccgcaagctcggtaaagatcgcatcaaaaccgtacgcggcgtgggttaccgtctggagagccagaaatga

SEQ ID NO: 718 - DNA, 1443 bp, Enterobacter cloacae
cgcgagattatgcgattttccagttttatcatcggattgactaccagtataacgtacaccgttcaggccgcgaatgttgatgagtacattaatcaactgcccgccggcgcgaaccttgccctgatggtgcagaaggttggcgcgcaggctcccgagattgactatcacagtcaacagatggcgctgcctgccagtacccagaaggtgatcaccgccctcgccgctctgctccagctcgggcctgacttccgttttactaccacccttgaaaccagaggtaacgttgagggtggcgaactgaaaggcgatcttatcgcccgttttggtggcgatcccacctttaagcgccaggatgaccgcaacatggtggcggtactgaaaaaatccggcgtaacaaaaattgatggcaacgtgctgatcgacacctccattttcgccagccacgataaagcgcctggctggccatggaacgacatgacgcagtgttttagcgccccgccagccgccgccatcgttgaccgtaactgcttctccgtatcgctttacagcgcgccaaaaccaaatgacttagcgtttatccgcgtggcgtcttactacccggtcacgatgttcagccaggtgcggacgctggcgaaaggctccccggaggcacagtattgcgagctggacgtggtaccgggcgatctcaaccgctatacgctcaccggctgcctgacccagcgggccgatccactcccgctggcctttgccattcaggatggcgcaggttatgccggtgccatttttaaagatgaactgaagcaggcgggcataacctacaccggaacgctgctgcgccagacgcaggtgaatgagccaggcacggtgattgccagcaaacagtccgcgccactgcatgatttgcttaagattatgctgaaaaagtcggataacatgattgccgacacggtattccgcatgatcgggcacgcgcgctttggtgtgccgggcacctggcgggccggttctgatgccgtacgtcagatcctgcgccagcaggcgggtatcgatctgggcaatacgatcgccgttgatggttccggtttatcgcgtcataacctgatctcgccggccaccatgatgcaggtgttgcagtacattgctcagcatgacgctgagctaaactttattacgatgctgccgcttgccggacacgacggttctcttcagtaccgcgcgggccttcacgctgcgggcgtggatggcaaagtttcagccaaaacgggttccctgcaaggcgtttacaaccttgccggtttcatcacgaccgccagcggacaacgcatggcatttgtgcagtatctttccggctatgccgtcgaaccggctgaccagcgcaatcgccgtattccactggtacgtttcgaaagcaggctctataaggacatctaccagaataactag

SEQ ID NO: 719 - DNA, 696 bp, Enterobacter cloacae
tgcatggtgtctggctggccgagcgaggaatgtctgatgaaatactcactgatttacgctgacccagcctggctttatgacaacaaagccagtaacggtgcagcagaagatcactacgacacgatgaaactgatcgacatgaagcgcttgccggtttgggacctggctgccgatgatgcagttctggctatgtggtttaccggaacccatacccgagaggctatcgagctggctgaagcgtggggctttaaggtccgcacgatgaagggctttacctgggtaaagttcaacccactggcagagaagcatatcaacaaagcacttcaggcaggccgtgtggaagatttttacgacttcctcgacctgctgaacgcacagacacgcatgaacggtggtaactacacccgagccaataccgaagacttgttgatcgccaccagggggaatggacttgaacgcaagtgtgccagcatcaagcaggttatctacagcccactcggtgagcacagccggaagccggcagaggcgcgtttccgtctggagaagctttacggtgatgttccacgcatcgaactattcagccgttgcggtgcgcctggctgggaccactggggaaatcaatctgaattaccagctgttgagcttataccggcagttgccgttcccatgaaaaaacagcaggagcgcgccgcatga

SEQ ID NO: 720 - DNA, 768 bp, Enterobacter cloacae
agtgaatggcggaagggtagagatatcgataaccaagcatcaaccagcaatgggggtaatggtgtgagagccatactgacacctgaaattgcgccaatgtctggggtggttctgttccggcctggtaacgaactgctctggctattccgtcagggaagggtagttattgagcaaccatctgaagccatccagcatctgccatctggattaatccctgaagcccaccagcccctgactgacgatgccaacatgaaggctattttcgttaacgagagggtcattcagcgagctggtgggttgagtagccttgatgcctggctggagagaaaatttgaatgccagtggcctcacactgactggcatgccactgactttacggtaatgcgccacgctccggggagcattcgtctttgctggtcgtgtgataaccatttacgtgagcaaaccactgaaagactggcaggaattgccatgcagaacttggtaaaatggctgctggaaagggtaaatattgatttaggtttcagccctgaacacactctttcgcttcctgagttctgctggtggatggtacgtaatgatctggctgaccttgttcctgaatcagtggcgagtaaagcactcagaatcaagccagaacagcacagttcagtgatgagggaaagcgacattgtaccgtcattaccggctacgcaaatctttcaggagaaggcaaaaaagatagtggcggtgaaggtcgatcctgaaacgccggatctttcatgctga

SEQ ID NO: 721 - DNA, 531 bp, Enterobacter cloacae
cgttgcagtaacaccgtaacccagcaatcagcatttcgtaactaccaaaggaaaaacaacatggtagagccaagtctgaaagaagtagttaaagcgatgtgcaaagcgtacccaggaggccgtgaagctatggccggtgctcttggcatgtcagtaacgcagttcaacaacaacctgtatgagaagaatggttgccggttcttcgaagtgaacgagctggaggccatggaagacatctcgaatacgtccctcctggcggattactttgcccgtcgccgtggcgcgctgctggtggacgttcctcaacttgaagaccttgatcgtgtcgacctgtttgatcgtgccatgagaacgtcagcagcgcgtggacgtgttgataccgtgatccagagagctctcgaagatggagtaatcgaacgtcatgaagctgaagaaatcaacgaatatcaccgccgtcatctggcagcgcgtgaagaagagatccgcgcgattgtcgcgctgtttagccgtaagaaaagccaaaaaaagtga

SEQ ID NO: 722 - DNA, 570 bp, Enterobacter cloacae
ggatggaatcttcaaatccagcttcaagaacaccgagtacagcaaagtcccggcgggcttcagaggagcgaactcatgagtcttctgaaagatattcaaattttcatcgccgctaatcctggcttaacgaacaaagagattgcggcatcaatgccacagtacgacgttcatgctgttcagcgcggtgtatgccatctggtcaaactgaatcgcgcaacccgccagcataacggcaagtgctaccagtattttgccaaagcaccgggtggggaggttggcgaggggcgttctgcactgaaaatcaaccgggctgataaaccagctgtaccagaacaggaagaaggtctaaatccggctgtgaccacaatgatggataaggctcaaggcctgtttgaaaaagggctctaccagcgggcagccacgattctgatggatgccttcaatcgctctaagaacgaagagcagcggatgaagatactgattgagcgtcagcgttgcctgagcatggcgccgaaagtgaaagcaccctctgatgcatggtgtctggctggccgagcgaggaatgtctga

SEQ ID NO: 723 - DNA, 417 bp, Enterobacter cloacae
atggctgaaaaaacagggagtgacgttatgaaactggtgctcccgttcccgccgagcgtaaacacctactggcgcgccccaaataagggaccgctaaagggccgccatttgattagcgccaaaggcagggcataccaaagcgcggcctgtgtcgccattgtcgagcagcttcgcttccttcccaaaccttcaacggcacctgctgccgtcgaaattatgttgtacccaccagatgaacgccgccgcgacatcgacaactacaacaaggctctgtttgatgcgcttacgcatgctggcatttgggaggatgacagccaggtgcagagaatgctggtggaatgggggcctaaagtgaatggcggaagggtagagatatcgataaccaagcatcaaccagcaatgggggtaatggtgtga

SEQ ID NO: 724 - DNA, 456 bp, Enterobacter cloacae
agcgaaatacggcgaccagttaacgctgctgtttcggtttttagatcgtgcgctggcaatcggcgtattagcatgaaaagtggagataacatgcgtgatattcagatggtattggtacgttggggtaattggtcaaaatacaaaatagaagcagatgtaggttattctccgattgcagcagggtttaaggggcttcttccagagagtggagctatgcctaagtgtacagaggacgatgcccttattattgatagttgcctcgctcggttgaaattgaagcgtcccgatgaatacgaacttatctttgatcattacgtaaagggtgtttcgaagcgaggaatcggccgtaaacttaagttatctgaagggatggttcgaattaaattccagatggcagaggggttcgttgaaggttgtttagctatgttagatatcaggttacaaatggacgagtaa

SEQ ID NO: 725 - DNA, 936 bp, Enterobacter cloacae
aggacgaccatgagcctgttaatgccatcccgcccgatagtgattaaccctgaccttgcgtacagcattgggctgaacgaggccattgcgttgcagcaggttaattactggctgaaagaaaccacctccggactggagcgtgacggcgtgcgctggatttataacacaacagagcagtggctggagcagttcccgttctggtctgaatccaccctgaagcgcacattcacccgcctgaaaaaccttggcgtactcaaagttgatcagctgaacaagtctcagcgcgacatgaccaactattacacgatcaactacgaaagtgagcttttagatgaggtcaaagtgaccaaatcgaagagttcaaaatgcactcttccatcaggtcaaaatgaaccgatggaagaggtcaaagtggaacgttccatcgggtcaaaacgaaccgctctcatcaggtcaaattgcactgatgttcttacagagaatacaacagagaatactacagatattaaaaaacctatttgtccggttgcaccgcaaccagacagtgatgtgttgatcaccgatcaggctaaacaggttttaacccatctgaaccatgtgaccagttcgcgttatcaggtttcaacaacctcgctgcaaaacattcgcgcccgaatcggggagggcttcaccgttgaagaactgtcgctggtggtggactactgcaatgccaagtggagcgacgatttaacaatggcgtcctacctgcgcccgcagacacttttccagccaacgaagtttccagcttacctgaagtccgctaccaactgggcgaatgccggaaggccagcgcgtgttaacgggaagtgggagcgtgaggatggaatcttcaaatccagcttcaagaacaccgagtacagcaaagtcccggcgggcttcagaggagcgaactcatga

SEQ ID NO: 726 - DNA, 375 bp, Enterobacter cloacae
gcttataccggcagttgccgttcccatgaaaaaacagcaggagcgcgccgcatgaaacctgaattaacgccgcgtcagaatgaagtgtttgaagctatcaaggttcatatcgaaaaggctggcttcccacctacgatgttggagcttgcaggattaattggctgcgcatcaccgaatgctgctgtagcgcacgtgaagtcacttaagaaaaaaggttacatcactgttgctccaggtgcagccaggggcattaccgtcgtcaaaacggaatgggatgcagatccagtgacgatcatcaaaggcctgctttccggtggagataaggccagagataacgctgttgaatggctgaaaaaacagggagtgacgttatga

SEQ ID NO: 727 - DNA, 216 bp, Enterobacter cloacae
tgcaataacccggcagatgacccccaccacttgataggccacgggcagggtggaatgggtaccaaagcgcatgacctgtttgtgataccgctgtgcagagcgcatcacgacgagttacacgctgatcccgtggcatttgaagcgaaatacggcgaccagttaacgctgctgtttcggtttttagatcgtgcgctggcaatcggcgtattagcatga

SEQ ID NO: 728 - DNA, 1446 bp, Enterobacter cloacae
attacgccacagacgcagaattttgactttttcctgttacttaatatcagcatcgccgccatcgtcgccgccaatgcgacacatctgacgcctgtcatcagtaccttcacgcgttttttcttcgcctcctggggggtgctgaacctcggtattatctggcggctggatgagttgatgttcatcgtgctcatgctgaatctgctttacggcttcgcaatttaccgccatgcgttaacttcccatgcgttctttattcagcaagcgctgctggaggaaaaaagctcacggctggcggaacagtttcgtcaggccaaagaggacgcggagcaggcactgctggataaaaatcagtttctgaccaccgccagccacgatttgcgccagcctgtgcatgctatgggctttctgatcgaagccatcctccatcgaaaccgggacggcagcctgacgccacagcttcttgaccttcagcagagcgttcgctcggtacatttaatgctcaactctctgctcgatctcagcaaaatagaatccgggaatgtcctctctgccccgaccaaagtggatatcggtgctctgctcgactcggtcatcacgctgtttcgtgaagaggccaacagccgcgcgcttaggctgtgcatccggcggcctaaacgccatatctacgtgatgggcgatccgctactggtgcgacagtccctgatcaacctgattcaaaacgcccttcgctacacgctccagggcggggtgctggtcgccatccgaccgcgcggtgacgagtgtatggtggaggtgtgggacacgggagtcggtatcgccgatgaagagaagggcaaaatcttctcaccttactaccgccccgagctggcatggaagatcgacagcgccggacacgggctgggactggccgtcgttgcccgttgtgccaagctgatgaaggtgaaatacgggatgcaatccattgaagggaaaggctcacgcttctggatgcgctttacccaatatgctggcgaagatagcgtgctggataccccgcccgccgctgataacaccgccacgccggtacgctatgcgccgctgcacggttcctgcctggtcgtcgatgacgacccgctggtgacgtctgcctgggagagcctgatgagcgtctggggaatcgacgtacgctgtgcggcctccgctgaagaagcgtttgccataatcgacgacggctttacgccgttcgccgtgctgtgcgaccagcgcctgcgatccggcgaaagcggcttcgatatcctgaaagcgctttttgaacgtctgccggatatgagcggcgcgatagttagcggcgaatttaattcaccggttctgctggaggcggagcaggaggggtacctggtactccgcaagcctctggagccagctaaactgcatgcgctgctgacgcagtggttggggtgtcgttaa

SEQ ID NO: 729 - DNA, 1386 bp, Enterobacter cloacae
cccgggaggtgcgtcatgtctgagatgatgatgccctgctcttatgaggctgagcaggccgtactgggcggactgatgcttgataacgaccggtgggatgaggtgatactgcaaatctccccggaagatttgttttcccggccgcaccgtatggtcttccgcgtgatggccgagctggccggagaagggctaccactcgacctcatcactattacggaacggctggagaacagaggcgaccttgaacagtgtggcggctttgcttatctggctgaaatgagtaaaaacacgccgtctgcagccaatatcctggcttacgccggggtggtggcggagaaaagccgtctgcggcagctgatgacagtgggtaacagtcttctttccgatgtgcaggccccgaaagccagctcggcgggcattcttgagtcggccgaaggtaagctgtttaacattgccgaacagggagccatgcagctcaacagtgagaccggtgttaacgaagcgctggataaactgctgacgcagctggaaagcatgtccgccagtgacggtctcaccgggacaccgacagggttcagtgaactggacgcgatgacctgtggtctcgagcccggcgatctggccctgctggccgcccgtccttccatggggaaaacgtcgctggccatggccgcctgcacagcggccgtgagcgcaaaacctgacgatcacgtctttgtgttcagtcttgaaatgccctcagagcagctgatgatgcgcctgctggcgatggaaggccgggtggaactgtcccggcttcgcagcggcaacatggatgatgaagactgggctcgcgtgtccgaggcaaccggtcgcattattgagtggaaaaaccgtctgatcattgatgataccagttaccagaccccggccacactgcgcgcccgcgcccgacgctatgtccgcaaatacggcagaccctctctcatcatgctggactatctgcagcttgtccgctcccccgagcaggaaaaccgcacgcaggaaatagcggaaatttcccgctcgcttaaggcgctcggtaaagagctgggctgtccggtactggcgctttcccagctcaaccgcctggtggagcagcgggccgataaacgccccaataatggtgacctgcgtgactccggtgcgctggagcaggatgcggacctcatcatgtttatttaccgggatgaggtttataaccccggcacccctgatgccggggtggctgagatcattgtcggcaagcagcggcaggggccaaccggcacggtaaaagtcaaatttgacgggcgttacaccctcttttcggagtttcaggaaggcagctatgacttcggttaccgcagcgggaggaaacaggcatga

SEQ ID NO: 730 - DNA, 888 bp, Enterobacter cloacae
agagtgtgcaaaatgaaaatacttcccgttatctctcccaaaggtggagaaggcaaatccacgtttgctgcttaccttgccggttttcttgccgatgccggcctgaacacccttcttgtggatgcagactattcccagcccacagccagcagtatcttcgccctggaggatgaatcccctttcggtctctatgaactgctgatgcagatggtcagtgaccatacgcaatgcatttcgcagaccgccataaaaaatctcgatgtcatctactctaacgacccggacgaactgttgccgaccgcgatgctccacgccgcagacggccgtctgcgcctgcgtaacatacttcagcatcctttctttaaccgttatgacgccattattgtggattcgaaaggcgcaacaggcgttatgactgagctttccctcctgtcctctaccggtaatgtgatgggcattgttaaacccatccttccggatgtccgtgaatttatccgcggctcccttcacatgcttacccgcctgaaaacctatgaaaattacggtatccgccttcctgatatttccattctcgtcaactgtatcgaaaacaccctgcttgaccgtgaagcgatggacggtcttgccgccatcattaacgaaaaacattacgacgcctctgcgctgggcaaccgtgacgtttatcgtttactcgatacccgtatcgaggcgctggatattttcaaactggggcacgtaaagcagcagcccgtgcatcgtctggaatacaaaacgcgccgcaaaggtccggccgcagcggtcaccatgcacgacctcgcgtgtgaactgttccctgagtggcagagccatttcagtgacgttctgacccgggaggtgcgtcatgtctga

SEQ ID NO: 731 - DNA, 1725 bp, Enterobacter cloacae
cttcggttaccgcagcgggaggaaacaggcatgagccgtaaaagttctaatgtgggggctgccatgctgcagcccggacgccagtcgcaggcggccggcaatatcagcgtcatgccggcggctgaaatgcccatggtcctgacgctcgaccagttaagcccgaatcctgataatccgcgaacatcacgcaatccgcgttatgacgatatcaaggcttccatccgttcgcgcgggctggacaccgtgcccaaagtcacccgtgacccggatggtgagcccgatatgtacatcttcagcgacgggggtaatacacgttatcagatcctgtcagaactgtggcaggaaaccggagaagaccggtttttccgcgtccatgtgttgttcaagccgtggccgggacggctgcagtgtgttattggccatctggcagagaatgaagtgcgcggggagctgagttttattgaaaaagcgcaggggatccacaaagcccgctctatatatgaagagcagatgggaaagacggtttcgttgcgtcagttgtcagagctactgacccatgaaggtttgccagtccattactcaacagtcagccgtatggaagatgcgctgaaatatctttatccgtggatcccagacctgcttgagtccgggctcggcaggcctcagataacggcgctgctggcgctccggcatgatgctgaacgcgtgtgggatgagttttgcctgatttcagacacaggcgacaaatccttcagcgacgtttttggccagtgttgtggccgtttcaactcaccggaactgtggtctcttgagatgtttcgcgatgaattaattggtgatttactgcatgcgctgccccatccggagctggattatgaccgctggatgatggaactggatcctaaagaacgtaaccgcagacatcacttcggcgatccagaaccggtgtccatccctcccgcaaacagcctcgtcaccgctgactctgcaggtcaggccacaccggcgcagaagtctgttgaggtcgtgcagcctttctccagtccacgtcgtgaaatctcaggagagccggtaacgcccgccccggataataccccacctgaaaaactggataaacagcacccccggcatgaggttcagcccgatatgtacggtgccgcgccggtcatttcaggcgagagcgcggatgttagcgggctggttaccctctccgatgggtacggagaagagaatggtggagaagagggcaatggcgaggatggcctgctttctcttttaacaccagaacctgaagttgtcctgcaggatgacgcgccggtgactaatgacagcatctggcatgtgccggcccatcaggacgatatcgaacacctgcagaataccgcttttcgtctggcctgggagctgggtgaggtccttggctgcgaagatgaaattcttcctcaacgcgacaacgacatgtctgccggttacgtcggggcaggtgagatgtgttctgaagccgccgcatttctgctgggcctgaccggcgaagcgcctgcgctgcatcctgcggcaggagtgtgtggcctgccggagcttttcaccggcggcccgggtgagggggaagcacctgcactgacagatgaagatgctctgaaactgctgcgcctgctgcgcgttatgcgccgtcttcgggagctgcaacgtggtctgacgtacggggaggataacagtgatgaataa

SEQ ID NO: 732 - DNA, 804 bp, Enterobacter cloacae
cagcatgacagcctgtttaccctgcccccgtacgcgggtgcagtactaagcatactgacagttcagaacggccgtgatggcggccgaaaaggaaaaataatgagtctgcctgcagaaagcctgattgcttatacgctggataaaatgaatgcccgccttgcggccagtccccggcgggatgatggcaggatacgtaacggcctgctgtttaccggaaatgtgcatgattccattccccgccggctgttgctcgacacgcggttgtcaccgctggacaagatgggctggatgatgatccggctgtatgcacaaaataatgagggggcggttttccccagctatgacgaactgcagttgcagcttgcctcacccggaaaggggaaagcctcaagggaaacggtaagccgcgtcctgctgatgctgcgaataaccggctggctcagcctctgtaaacgcgtgcgggatgataaagggcgggtgcgggggaatatctatgctcagcacgatgagcccctgacgttcagcgatgcggaaatgctcgacccccgcttccttgatgtggtggcggatgcctgcctgagtaaaaaccggactatcagccagaatgcccgcgaagtgctcgacgatataaaaaacgaccccaccatgcgccattatcgcagccatcttgcgctgatcgaatcgcgtctggacagcccacagtctcccagccagatggcgaaacatcatcaccgaataccctgtcccgcaccgggttcggaaaccgcacgtcttcactacgagatgcgcatccgcactgattgt

SEQ ID NO: 733 - DNA, 855 bp, Enterobacter cloacae
actggctcgcgaggccttcccggagaaaagtgggtgtggctttacctttggcgacggttgccacgggtcagacagcaaattcaacctgttcaacagccgccgcatcgacgcgatggatgtgaccagcaaaacggagccgcaccaatgattgaactcgtcattgtttcgcgtctgctcgagtaccctgatgctgcgcttgtgcagcatcaacaggaactctttgatgcactcgcgtcatctgaaaacctggataaagaggatgcccagaagctgggcgttttcctccgcgatctgctggcgcgcgatcttcttgatgcgcaggcggactacagccagctgtttgaccggggtcgtgccacgtctctgctgttgttcgaacacgttcacggtgaatcccgcgaccgtggtcaggcgatggtggatctgatggcccagtacgagcagcacggtttgcaactcgacagccgcgagctgccggatcacctgccgctgtatctggaatatctggcgcagttgccgaaagaggaagcgctgggcgggttgcaggacattgctcccattctggcgttgctcggcgcgcgtctccagcaacgtgagagcagctatgcagtcctgtttgatctgctggtgaaactggctaacgcctcggttgacagtcaaaaagtggcggaaaaaatcgcggatgaagcccgggacgataccccacaagcactggatgccgtctgggaagaagagcaggtgaaattctttgctgaccagagctgtggcgaatctgaaatctccgcgcatcagcgtcgttttgccggagcggtggctccgcaatatttgaatatctctaacggaggacagcactaa

SEQ ID NO: 734 - DNA, 1557 bp, Enterobacter cloacae
ccaggtacaggagagcgtaaaatgaaaattcgttcacaagtcggcatggtgctgaatctggataaatgcatcggctgtcatacctgctcagtcacctgtaaaaacgtctggaccagccgtgaaggtatggagtacgcctggttcaacaacgtggaaagtaagccgggcaccggcttcccgaccgactgggaaaaccaggagaagtggaagggcggctggatccgtaaaatcaacggcaaactgcaaccgcgcatgggtaaccgtgccatgctgctgggtaaaatcttcgctaacccgcatctgccgggcatcgatgattactacgagccgtttgattacgactatcagaacctgcacaacgcgccggaaagcaaacaccagccgatcgcacgtcctcgctcgctgatcaccggccagcgcatggacaaaattaccagcggtccaaactgggaagagattctgggcggcgagttcgaaaaacgcgccaaagaccagaacttcgagaacatgcagaaggcgatgtacggccagttcgaaaacaccttcatgatgtacctgccgcgcctgtgcgaacactgccttaacccggcgtgcgtggcgacctgcccaagcggcgccatctacaagcgtgaagaagatggcattgtgctgatcgaccaggacaagtgccgcggctggcgtatgtgcatcaccggctgcccgtacaaaaaaatctacttcaactggaagagcggtaagtctgagaagtgcatcttctgctacccgcgtatcgaagccggtatgccgaccgtctgctcagagagctgcgtaggtcgtatccgctacctcggcgtgctgctgtacgacgcggacgcgattgaaaatgccgcaagcaccgagaacgagaaagatctgtatcagcgtcaactagacgtcttcctcgatccaaacgatccgaaggttattgagcaggcgctgaaagacggtattccgcagagcgtgattgacgccgcacagcagtctccggtgtacaaaatggcgatggactggaagctggccctgccgctgcacccggaataccgcacgctgccgatggtctggtacgtgccgccgctgtctccgattcagtctgcggcggatgcgggtgaactgggcagcaacggcattctgccggacgtggaaagcctgcgtatcccggttcagtatctggccaacctgctcaccgccggggatacccagccggtactgctggcgctgaaacgtatgctggcgatgcgtcacttcaaacgtgcggaaaccgttgacggcgtgaacgatacccgcgcgctggaagaggttggtctgaccgaagcgcaggcgcaggagatgtaccgctatctggcaatcgctaactacgaagatcgtttcgtggtgccgagcagccaccgtgaactggctcgcgaggccttcccggagaaaagtgggtgtggctttacctttggcgacggttgccacgggtcagacagcaaattcaacctgttcaacagccgccgcatcgacgcgatggatgtgaccagcaaaacggagccgcaccaatga

SEQ ID NO: 735 - DNA, 3840 bp, Enterobacter cloacae
  unsure (1546)
tcgttatcaattctcaccatctttcatagcgttaccttcgctgcaaatcagcaatgtcgatttagagagccacaggctccacacaggagatacccgatgagcaaatttttggaccggtttcgctacttcaaacagaagggtgaaacttttgccgatgggcacggccaggttctggataccaaccgggactgggaagacggttaccgtcaacgctggcagcatgacaaagttgtccgttctacccacggcgtaaactgcactggctcatgtagctggaagattttcgttaaaaacggtctggtgacctgggaaatgcagcagaccgattatccgcgtacccgtccggatatgccgaaccacgagccgcgtggctgcccgcgtggggccagctactcctggtatctctacagcgcaaaccgactgaaatacccgctgatgcgtaaacgcctgatgaaaatgtggcgtgaagcgaaagtgcagcacagcgatccggttgatgcctgggcctccatcattgaagatgccgacaaagcgaaaagcttcaagcaggcgcgtggtcgcggtggtttcgttcgctcttcctggaaagaggtgaacgagctgattgcggcttccaacgtctacaccgtgaaaacttacggtcctgaccgtgtggcaggcttctcgccaatcccggcgatgtcgatggtctcttacgcctccggcgcgcgctacctgtcactcatcggcggaacctgcctgagcttctacgactggtactgcgacctgccgccagcgtcgccacagacctggggcgagcagaccgacgtgccggagtccgctgactggtacaactccagctacatcatcgcctggggctctaacgttccgcagacccgtaccccggatgcgcacttctttaccgaagtacgttacaaagggaccaaaaccgttgccgtgaccccggactacgccgaaatcgccaagctgtgcgacctgtggctggcgccgaaacagggtaccgatgccgccatggcgctggcgatgggccacgtcatgctgcgcgaattccacctcgacaagccaagccagtatttcactgattacgtgcgtcgctacaccgacatgccaatgctggtgatgctcgaagagcgtgacggctattacgccgcaggccgtatgctgcgtgccgcagatctggtggacgcgctgggtcaggaaaacaacccggagtggaaaacggtcgcctgcaacagcaacggcgagctggtggcgccaaacggctctatcggcttccgctggggcgaaaaaggcaaatggaacctggagcagcgtaacggcaccacgggtgaagagacggaacttcgtctcagcatgctgggcagccaggatgagatcgccgatgtcggcttcccgtactttggtaatgaaggttccgagcacttcaacaaggttgagctgcaaaacgttctgatgcacaaactgccggttaagcgcctgcaactggcggacggttctactgctctggtcactaccgcctacgatctgaccatggcgaactacggcntggagcgcggcctgaacgatgaaaactgcgcgaccagctatgatgacgtgaaggcttataccccggcctgggcggagcagatcaccggcgtgccacgcgcgcagatcacccgtatcgcgcgtgaatttgcggaaaacgccgacaaaacccacggtcgctccatgatcatcgtcggtgccggtctgaaccactggtatcacctcgatatgaactatcgcggcctgatcaacatgctgatcttctgcggctgcgtcgggcagagcggcggcggctgggcgcactacgtgggccaggaaaaactgcgtccgcagaccggctggcagccgctggcgtttgcccttgactggcagcgtccggcccgtcacatgaacagcacctcctacttctataaccactccagccagtggcgctacgagacggttaccgcccaggaactgctgtcgccgatggcggataaatcccgctacagcggccacctgattgacttcaacgtgcgcgctgagcgtatgggctggctgccgtctgcgccgcagctgggcacgaacccgctgcgcattgcggaagcggcgaagaaagcgggcatgtcaccggttgactacaccgttaaatccctcaaagacggctcaatccgcttcgcggcagaacagccggagaacggtaaaaaccatccgcgtaacctgttcatctggcgctctaacctgctgggttcgtccggtaaaggccatgaatacatgctgaaatacctgctcggtaccgaaaacggtattcagggtaaagatctcggcaagcagggcggcgtgaagccagaagaagttgaatggaaagacaacggtctggacggcaagctggatctggtggtaacgctggacttccgtctgtccagtacctgcctgtactccgatatcgtgctgcctaccgccacctggtacgaaaaagacgacatgaatacgtcggatatgcatccgtttattcatccgctgtctgcggccgttgacccggcatgggaatcaaaaagcgactgggaaatctacaaagacatcgcgaagaaattctccgaagtctgtgtagggcacctgggcaaagagaccgacgtggtgacgctgccaatccagcacgactccgctgccgaactggcgcaaccgctggacgtgaaggactggaaaaaaggcgagtgcgacctgatcccaggcgtaaccgcgccgcacattattccggttgaacgtgattacccggcaacgtacgagcgctttacctctatcggcccgctgatggaaaaaatcggtaacggcgggaaagggatcgcctggaacacccagagtgaaatggacctgctgcgcaagctcaattacaccaaagcggacggcccggcgaaaggccagccgatgctgaacacggcgattgatgcggcggaaatgatcctgaccctggccccggaaaccaacggccacgtggcggtgaaagcctgggcggccctgagcgagtttaccggtcgtgaccatacgcacctggcgaagaataaagaggaagagaaaatccgcttccgcgatattcaggcccagccgcgcaagattatctccagcccgacctggtctggcctcgaagatgaacatgtgtcctataacgccggatacaccaacgttcacgagctgatcccatggcgcacgctttctggccgtcagtctctgtatcaggatcaccagtggatgcgtgacttcggtgaaagcctgctggtttaccgtccgccaatcgacacccgctccgtgaaagcggtgatgggtgcgaaatcaaacggtaaccctgagaaggcgctgaacttcctgacgccgcaccagaagtggggtatccactccacctatagcgacaacctgctgatgctgaccctgtcgcgcggggggccaatcgtctggatgagcgaagcggacgccaaagatctgggtatcgaagataacgactggattgaagtgttcaacagcaacggtgccctgacggcacgtgcggtggtgagccagcgtgtaccggccgggatgaccatgatgtaccacgcgcaggaacgtatcgttaacctgccggggtctgagatcaccgaacagcgcggcggtattcacaactccgtgacccgtattacgccgaagccgacccacatgatcggtggttatgcccagctggcctacggctttaactactacggcaccgtaggatcgaaccgcgatgagttcgtggtggtacgtaagatgaagaatattaactggttagatggcgaaggtaatgaccaggtacaggagagcgtaaaatga

SEQ ID NO: 736 - DNA, 273 bp, Enterobacter cloacae
  unsure (206)
  unsure (256)
  unsure (261)
cggaggacagcactaatgcacttcctgaatatgttcttctttgacatttacccgtatatcgcgggcaccgtattcctggtgggaagctggctgcgttatgactatggccagtacacctggcgtgctgcctccagccagatgctggatcgtaaagggatgaacctggcgtcaaacctgttccacatcgggattttggggattttcgnccggtcacttcctggggcgctgaccccgcattggtatagccacccggcantggangagttgcaatcg

SEQ ID NO: 737 - DNA, 897 bp, Enterobacter cloacae
tacgccgcactggaaaaccgagcgggtgagggtggcatgatctggcatctcttcttccagccgtttattgagtacggctttatgcggcgcgcgctggtggtttgcctggcgctctccgtcagtaccactgcgctgggtgtattccttcagctgcgtcggatgagcctgatgggggacgccctttctcacgccattttgccgggtgtcgcggtgggctatctgctcagcggaatgtcgctgttggcaatgactgtcggcgggtttattgccggtatcgccgttgcgctggtggccgggctggtcagccgccgtacacctcttaaagaggatgccagcttcgcggggttttacctgggttccctggcgctgggcgtcacgctggtgtcgctgcgcggttcaaatgtcgatctgcttcatcttctgtttggctccattctcgccgtggatagcgcgtcagccctgttcgtgacgggggtctgcatgttcacgctcctcacgctggcgattttttatcgtgggctggtcagtgaagcgttcgatacagcttggttgcaggtgaacgcgcgctggctgcccgggatgttacacggtctgtttctggcgctgctggtgctcaacctggtggccggttttcaggtactcggcacgttgatggccgtcgggctgatgatgttacccgccgtggcggcacgctgctgggtgcgcacactgccagggttacttttgatggcgggtatcagcggtattttttgcgcgtggctgggcttaagtctttcctgggcagtgagtctgcccgccgggccctccattgtgctgaccgccagcgcattgttctttatttcagttttatttggcacgcgcagcaggctggcggatagcctgcgggcgcttttttaa

SEQ ID NO: 738 - DNA, 633 bp, Enterobacter cloacae
aataagcgtctctctggccggtgcgcccgcatcggcttttttctgaagccccctcgtaaaacccgacgcgcatccccatatttgatgagaaagtgctatcttgtgctgcatgtttttctaaggcctggagcgagaatgactgaccatgaattgatgcagctaagcgaagtggtggggctggcgctgaaacagcgcggcgcgactctcacgaccgcagaatcctgcaccggcggctgggtggcgaaagcaattaccgatattgctggcagttccgcctggtttgaacgcggctttgtgacctacagtaacgaggctaaagcgcagatgattggcgtgcgtgaagctacgcttgagcagcatggcgcggtcagcgaaccggtggtgatcgagatggcgattggcgcgctgaaagaggcgcgcgcagattacgctatctccatcagcggtatcgcggggccggacggcggcagcgacgtgaagcctgtcggcaccgtctggtttggctttgccacctcaaaaggtgaagggatcacccgccgggaatgcttcagcggcgatcgcgaaagcgtgcgtcgtcaggcaacggaatacgcgttaaaaacgctctggcaacaatttctacaaaacacttga

SEQ ID NO: 739 - DNA, 588 bp, Enterobacter cloacae
cttgatttcaggataattatgagcaagagcaccgctgagatccgtcaggcgtttctcgattttttccatagtaagggacaccaggttgttgccagcagctccctggtaccgaacaatgacccgactctgctgtttaccaacgccgggatgaaccagttcaaggatgtgttccttggtctcgacaagcgtaattattcccgcgccacaacctcacagcgttgcgtgcgtgcgggcggtaaacacaacgatctggaaaacgtcggttacaccgcgcgccaccacaccttcttcgaaatgctgggtaacttcagcttcggcgactacttcaaacacgacgccattcaatacgcgtgggaactgctgaccggtgaaaactggttcaatctgccgaaagagcgtctgtgggtgaccgtgtatgagaccgatgacgaagcgttcgacatctgggaaaaagaagtgggtatccctcgcgaacgtatcatccgtatcggtgacaacaaaggcgcgccttacgcgtctgataacttctggcagatgggcgacaccggccctgtcttctaccacggggctggcaggatccgcgcttaa

SEQ ID NO: 740 - DNA, 759 bp, Enterobacter cloacae
gatatccatgtccctgttttctctctcatcctcgcttcggctgctgctggcgctggtgctcattctgtttctcggcctggccgtgcgctgggcggtggcgttgccatgatcgtgatgaacgacctggtggcgggttacgatcgccagcccgttacgcgcgcgctgtccggcgtgattgaacgcgggagcatgaccgccatcgtcggggccaacggctgcggcaaatccacgctgctgaaaacgctcgccggctttcttccgcccgtcagcggtacgtttcgctggcaggggagacgtccggtggtgggctggctggcgcagcgtcacgcgctggaggcgcaatttcctctgaccgtgcaggacgtggtgagcatgggctgctggccagcaatctctctgtttgccggttttcgtcgggatgcccgcatgcgcattgccggcgcgctggagcgcgtggggctggagtccatggcgttctccactattgatgaactttccggcgggcaattccagcgcatgctgtttgcccgcgttttagtgcagcaggcaccgctggtgatgctggacgaacccttcactggcgtcgatgaagcgacctgcaacgtgctgatggatctgatgctggagatgtatatgcaggggcagactctgctggcggtactgcacgacagcgaacgcgtctcgcgccacttcccacaaacgttgcggctggacgctgatacgccgcactggaaaaccgagcgggtgagggtggcatga

SEQ ID NO: 741 - DNA, 516 bp, Enterobacter cloacae
atcgacaggttttttatgagtgaaccgacatcacgccgaccagcctactcacgcttgctggatcgggccgtgcgtattcttgccgtgcgtgaccatagcgaacaggagctgcggcggaaactgtcagcgcccgtcatgagcaaaaacggtccggaagacattgatgccaccgcggaagattatgaccgcgtggttgcctggtgctacgagcatcactatctggatgacggccgttttgccgctcgctttcttgccagccgtggtcgtaaaggctatgggccagcgcgtatccgccaggagctgaaccagaaaggcgttgcccgtgaatcgattgaaaaagccatgcgcgaaagtgaaattgactggtgcgaactggcgcgtgagcaggcggtacgaaagtacggtgagccgctgccgcgtgaattttcagaaaaagttaaaatccagcgctttttgctctaccgcggcttcctgatggaagatattcaggatatctggcgtaattttaccgattga

SEQ ID NO: 742 - DNA, 912 bp, Enterobacter cloacae
cctgcgggcgcttttttaacgcaaggggaaacgatgaaacgtacagggttagccgtggcgctcgcgctcggcatgatgacgcacggcgtaatggcgaaaacgcttaatgtggtgaccagcttttccatcctgggagacatcacgcagcaggttggcggcgatcgtgtgaaggtgacgacgctggtggggccggacggtgatccccatactttcgaaccctcgcccaaagacagcgcggcgctgagtaaagctgacgtggtggtggtcaatgggctggggctggagggttggctcgaccgtctggtgaaagcctctggattcaaaggccagctggtggttgcttcggacggcgtgaaaacgcacacgctggaagaggacggtaaaaccgtgaccgatccgcacgcgtggaacagcgcggcgaacggcgcgctgtatgcgcaaaatattctctcagggctggtgaaggccgatcctgaagatacggcggcgcttgaagctaccggtaaaccctatattgcgcagctctctcagctggacggttgggctaaaaagcgtttcagcgacatcccacaggcgaagcgcaaagtgctgaccagccacgacgccttcggctatttcagccgcgcctacggcgtgacgtttatggcgccgcaggggctgtcgtctgagagtgaagccagcgcggcgcaggtagcggagatcatcaaccagattaaagctgacggcgtgaaaacctggttcatggaaaaccagcttgacccgcgtctggtgaagcagattgcgaccgccacgggcgcccagccgggcggtgaactttacccggaagcgctgtccgcgaagggcggcgtggcggacacctacgtcaaggcgtttcgccacaatgtggacaccctcgctaacagcatgaaataa

SEQ ID NO: 743 - DNA, 1095 bp, Enterobacter cloacae
agcgcagttgcttctcccggcatgacaggagtaataatggctatcgacgaaaacaaacagaaagcgttggcggcagcactgggccagatcgaaaagcaattcggtaaaggctccatcatgcgcctgggtgaagaccgttccatggatgtggaaactatctccactggttcgctttctcttgatatcgcactgggcgctggcggtttgccgatgggccgtatcgtagaaatctacggtccggaatcctcgggtaaaaccaccctgacgttgcaggttgttgcggcggcacagcgcgaaggtaaaacctgtgcgtttatcgatgccgagcacgcgctggacccggtctatgcccgtaaactgggcgttgatatcgacaacctgctgtgctcccagccggacaccggcgagcaggcactggaaatttgtgacgcgctggcgcgctcaggtgcggttgatgtgatcatcgtcgactccgttgcggcgctgacgccaaaagcggaaattgaaggtgaaatcggtgactctcacatgggcctcgcggcacgtatgatgagccaggcgatgcgtaagctggcgggtaaccttaagcagtccaatacgctgctgatcttcatcaaccagatccgtatgaaaattggtgtaatgttcggtaacccggaaactaccaccggcggtaacgctctgaaattctacgcttctgtccgtctggatatccgccgtatcggcgcggtgaaagagggggataacgtagtcggtagcgaaacccgcgtgaaggttgtgaagaacaaaatcgcagcaccgttcaaacaggctgagttccagatcctctacggcgaaggtatcaacttcctcggcgagctggttgacctgggcgtgaaagagaagctgattgaaaaagcgggcgcatggtacagctacaacggtgacaagattggtcagggtaaagctaatgctatctcctggctgaaagagaacccggcggcggcgaaagagattgagaagaaggtgcgtgaactcctgctgaacaaccaggactctaaacctgatttcgtggtcgacggcgcggatgctgaagaaaccaacgaagacttttaa

SEQ ID NO: 744 - DNA, 240 bp, Enterobacter cloacae
ccctttctgggttttgtggcgcgtctggttcgttccgcgatgctggtgcttctgtgcgtggatttttttcgttccgcccgcgcgtgcgggttgccggggtggttcttcgtgctgcgcttcgcctttcccttcgccttgatcccctccttttccgtgctcgggctggcgctgggcgatctgctgttcggggctgtcctttccgaaaccgtgtttgcctggccgggaatgggagcctgggtg

SEQ ID NO: 745 - DNA, 330 bp, Enterobacter cloacae
tttaattttaaggtcaattattacggaggaactatgatccattcatttaaagacagacggcttgaaaagttcttccgtaatggaaaaacaacggcaggtattccttctgaaattattaacgcgattctgtgtcgacttgaaacgctggataatgtccagagtgagcgggagttattatccaacagcttgcgttatgaacgcttaagaatgacgtcaaaccgttattcctccattcgagtaaactctaagtatcgattattctttgaatggaatgatggcgcacataatgttcatttgtctgcacatgactataaatcgctcatccattaa

SEQ ID NO: 746 - DNA, 1260 bp, Enterobacter cloacae
ggatggctgatgagcacgatttctacggatttaattgcacggatctacgcagcctccgaattgccgttgagcaacgacgagctttatcgcgaagtgcagcgtgaaactggcatgtcggatgccgaattgcacgaactgaaagaatttgggtcagataaaaccagaaccagcggcgtcaaacacaaagtacgctggtttcagcagactcttcggcaggccggagtcatcgaacgcgttccagaaaaacggggcgtctggagatactcctctaagacgaaaacaaacctacacgagtcatgggaaaagctctgtgttgtcggtttctcaacttctcttggggcatcggtttttggaaacgcctatgccttcttcagcaatatcacagagcaaattcatctttgcctgacctcgccgccttacctccttcgaaattcaagagactacgggcatggcggggggcgtggcgagcaggtttatattgactggcttctgcgtatcctcgaaccgatcgtgaaacagcttgtacccggcgcaagtgtggcattgaatatcactcaagatagctttaataggggcaggccttcacgttctctgtatctggagcgtctgacactggcattatgtgacaagctggggcttgagctcatggacaggcttcagtgggtgaatcgcagtaagcccccatcgccaacgcactgggcatgtaagcaacgagtgcagctctgctcatcgtatgagcctgtgctgtggtttaccaatgatgcgagtaaggttcgttcaaacaacttacgtgtactgcaaccgcattcagagcagcatcttaaattgcaggcagcaggcggtgaaaatcgcacgaccttttatggtgatggggcgtaccagcttaaaagcggatcctttggaaataaaacagaaggaacgatccccaaaaatactttgttttacggcaatagctgcgctgatacgagattttgccattccattgcccgcgagctaggttttccgctgcatggtgcaacgtctcctaccaggcttgcagcgtttctgattgagtttttgacagagccgggagatcttgttgtagatcccttcgctggcctgcataaagttcccatcgcagccgagcgacttggcagacgttggctggcgacggacaaaatcatggaatggctggcgatttcccgaaacctttttacggccgcaccgggatataagagtaaccccatgctggacgagctcgccgaactgtatcgggcttaa

SEQ ID NO: 747 - DNA, 816 bp, Enterobacter cloacae
tgcgggactatcaaaaatggaggctggccagtgagctactcaatcaaaattgggaaacacagcatcgagctggcgggctatgccggtaaggttgttgcgccaaatactcagatggccgctttattccgtggtatggcgggcgaactcaccaacctgaggacaacggcgcagcaggccgaagctgaggcggatttgctggacgttatccgcaacgatccggatctgaacgaacaggcaaaaaaccgcagggcaggtgaagcccgtaacccggacacgctcaaagactttacccgcggggtggcagccgtaagcgagcaggccgcaaatattctcgattacctgaagaacaggctcgctccggttaatccactggcacctgatgatgttcagggattcatgcgtgacagcgagatgcgccaggcattcgcccgactggatcgccgcagccaggaaaaaatgctgctgtcgatgcacagtggaaagcatcaggagctggcggacgccttactaagggcgcacgctgtgtgttcgggactcgatacggaacagctaaaacgtctcggcttctcccgtattgcatcagagaacgggcaggtgattagcgcggttgccgatctggtcgacgcggtaaggaaggacgtcacacaaattacagctgtccgaacctggtataacaatctcgtttacggaaagaacgacgatccatcagaagttctgccccgcatgaccggccttgatcagttaagcgaacatgtcagcgcgatgctcaaaggcagccagcggcagacacattcagaagagaagcaggccgcctga

SEQ ID NO: 748 - DNA, 585 bp, Enterobacter cloacae
cccgggaaaactaacatgactatcaaaaatgcccgtgccgggcagggttttgctcaccctgaaaacagcagcgatgatatttcggtcattaaatttgaggatgcaaaagtacgtattgttaagatcttgggcgagccatggtttgtagcggcagatgtatgcgcagctctggaaatagctgatcacaaggttgctttgcgacgtcttgatgatgatgaaaagggggagtgtttaatacccacgcctggcggaaagcagactatgcgaactgtatgcgagtcaggattctacaaactgatctcacgtagtcgtaaggcgattactcccggcacctttgcgcaccatttcagtaattgggtattccgtgaggtcattccctcaattcgtaaaactggcttctatggagtgccgttcgtgttcctgaacgacttcagccggcgcatggctgcttaccagcaggaggccagcaaacgcggatataaattgcagcaatgtaagggtgtaaaagaggctcttgagcgggaagagattcagttgtggcttaagtatcagcccgagctattgaaggaaaatggcgatgaataa

SEQ ID NO: 749 - DNA, 1881 bp, Enterobacter cloacae
atttgtttcttccgcgccggtcgccggcgaaaaagatatcgatcggattatgcgggtacagggcatcgaacgaattcgggttatgcgggaaatcatcagggagcgagggaacagaaaatgaagaatgcaccaaaccttaaaaagcagccggcggatctcatggaggagtcaattatctttgccggagccgatgcctggacgttcgccaaagcatggcaggaaatgaacccgattggtgacaccgtgccgccggtcgtgctggataaaaagcagctggcagagctggagaatatccgcattgtggatgatggccggctctatgcccgggtttgccgcggcgggcatctgaccgaacggcagataaccattctcgcgacaaagctggcggtggccggcgtggagcgcgcgcaattctactctgaaggttatcagcttctggaggactggacgccgcaactgccgcgcctcaaagccgatgcgcaagccggcaaaagcatggtgatcggcaaaccgctgacggatgtaaacctccgcgacctggctgataacgaaaaggcgctcatactggccgcgcgttacaccggcattgcgatcaatgaaaacaacgagggcgtgtacgtctaccgtgccggcatctgggagaaaacgtctctgctcgagctgagccgcgaaatggtggctatctacaacgagaacaaaaccaacttcagcaagcgcgcgatcaacaacgttatcgacgccctgaaaattgttatcccggtaatgggagagccgcggcgcagcctgatcccctttgctaacggcgtctacgatatggaaaccggcgttttctccgaacacagccaggataactggctgacaaaccacaacggcgtgagctacacgccggcggtgccgggcgaaaacctccgcgaccacgcgccgaacttccataaatggctaagttacgcatcagatagagacgcaattaagatgcagcgcatcgctgcggcgctctttatggtgctggcgaaccggtacgactggcagctgttcctcgagataaccggggagggcggcagcgggaaaagcgtctttacccatatcgccacgatgctggccggcgcgcataacaccgccagcgggaacatggcggcgctcgacagcgcgcgtgggcgggcgcagttcgtcgggaaaagcatgataacgcttcctgatcagcctaaatattcaggtgagggcaccgggataaaggcaatcactggcggggatgcggtggagatcgacccgaaacacgagcaccagtacaccgcggttctgcgggcggtggttgtggccacgaacaacacgccgatgattttcaccgaacgcgccggcggcgtttcccggcgccgcgtaattttccagtttaaccggcgcgtcagcgaagaggataaggatcccgacctggcagaaaaaatatccgctgaaattccggtggttgttcgccggctgctggcgaactttgcgaacccggaaaaagcgcgggcgctgctgctggagcaacggaacagcgaagaagcactggaggtgaagcagaaaacggatccgctgtatgccttctgcgctcaccttgagcggctggctgattgtgcgggaatgatggtaggaaaccgcaatccgcctcactatccgcgaatttatctctatcacgcttatctggcattcctggaggccaatggtttcgacaaaccgctgacgctgaataaattcgcagaggggatggaaagcgcgatgagggagtttaatcacgagtaccgtaaggaacggagggcccgtggcatggtgactaacgttgaactttcggaaagtgcggaagactggttacctcagacgcatcctgtagccggtcataaagaatga

SEQ ID NO: 750 - DNA, 393 bp, Enterobacter cloacae
aaaacacaatacttgtttttcgaggattacgctttgatagatctatggttaaaatcaaagcgtttctttttcgaagaaaaacttttgttttattatctctcccggctgaaaaatagattgtttaccctttcatcatctactcgcgtctacttaagcgcatttaggaataaaggagtaaacatgtctaaagccctcattcgcttacctgaagttcaacgtcgtactggctatagtaaggcttggatttatcgccttcttaaagagcgtaaattcccccaatctgtaaaaataggttctcggtcgatcgcgtttgttgaaagtgagattgatgcgtggataacccaacggattgaagagcgagatgctttactcgtcagaagaccacaactgtaa

SEQ ID NO: 751 - DNA, 975 bp, Enterobacter cloacae
ccgctgtacaaggtatactttggcgattttcactgttttgagccagtcatgaagctgatacgcggcatacataatctcagtcaagccccgcacgggtgcgtgctgaccattggtaatttcgacggcgtgcatcgtgggcatcaggcgctgttgcagggattgcgtaaagaaggcgaggcgcgaggcctgcccgtcgtggtgatgattttcgagcctcagccgctggagctgtttgcaggcgagaaatcccccgcgcggctgacgcgtctgcgtgagaagttacgctacctggcggagtcaggggtggactacgtcctgtgtgtacggttcgaccgtcgttttgccgcgctgaccgcacaaaattttgtcagcgacctgttggtcaggcagcttggcgtgcagtttctcgccgtgggcgatgatttccgctttggcgctggtcgtcagggcgatttcttgttattacagaaggctggcctagagtacgggtttgacgtcaccagtacaatgaccttctgcgagggcggcgtgcgcgtcagcagcacggcggtacgtcaggcgctggcgaacgatgaactggacacggcagaaacgctgctgggtcacccgttcacgatttcaggtcgcgtggtccatggcgatgcgctgggccgcacgataggtttcccgacggcgaatataccgctgcgtcgtcaggtctccccggttaaaggggtctatgcggtggaagtggcaggactgggcgagaagcctttctacggcgtcgccaacattggcacacgtccaacggttgccggtgtgcgtcaacagttagaagtacacctgctggacgttgtaatggacctgtatggtcgccatatagatgtgatactgcataaaaaaatacgcaatgaacagcgattcgcttcgctggatgaacttaaggcgcaaatcgcgcgagatgaattaacggcccgcgagttttttgggctttag

SEQ ID NO: 752 - DNA, 2862 bp, Enterobacter cloacae
aaccggcttaactgcctacgtgataaatacggaaccgagaatctgatgagtgactataaatcaaccctgaatttgccggaaacagggttcccgatgcgcggcgatctcgccaagcgtgaaccgggaatgctggcgcgttggaccgatgatgacctgtacggcatcattcgtgcagccaaaaaaggcaaaaaaaccttcattctgcatgatggccctccatatgcgaatggcagcattcatattggtcactctgtaaacaagattctgaaagacattatcgtgaagtccaaaggacttgcgggatatgactcgccttacgttccgggctgggactgccatggtctgccaatcgagctgaaagtggagcaagagtacggtaagccgggtgagaagttcaccgccgcagaattccgcgcgaagtgccgcgaatacgcagccacccaggttgacggtcagcgcgctgactttatccgtctgggcgtactgggcgactggtcgcatccgtacctgaccatggatttcaaaaccgaagccaacatcatccgtgcgctgggtaaaatcatcggtaacggtcacctgcacaaaggcgcgaagccggtgcactggtgcgtggactgccgttctgcgctggcagaagcggaagtagagtattacgacaaaacctcgccttctatcgacgtggcgttcgaagcggtcgatcaggattcgatcaaagctaaatttggtctgcctggggtaagcggtccagtctcgctggttatctggacaactaccccgtggacgctgcctgctaaccgcgcgatctccctctctggcgagtttgagtatgcgctggtgcagattgatggccgtgcggttatcctggcgaaagacctggtcgaaagcgtactgaaacgcgcgaacatcaccgattacaccgtgctgggcaccgtaaaaggcgacgcgctggaactgatgcgcttcaaacacccattcctggacttcgacgttccggcgattctgggcgaccacgtaacgctggacgcgggtaccggtgcggtacataccgccggtggccacggccctgacgactacaacatcagcctgaagtacggtctggaaatcgccaacccggttgggccggatggctcttacctgcctggcacctacccggcgctggacggcatcaacgtcttcaaagcgaacgacattattgtcgacatgctgcgcaccagcggcgcgctgctgcacgttgaaaaaatgcagcacagctatccgtgctgctggcgtcacaagacgccaatcatcttccgtgcgaccccgcagtggttcgtcagcatggatcagaagggcctgcgcgagcagtctctgaaagagatcaaaggcgtgcagtggatcccggactggggccaggcgcgtatcgaatccatggtggctaaccgtcctgactggtgtatctcccgtcagcgcacctggggcgtgccgatgtcgctgttcgtgcacaaagagacgcaggaactgcatccgaacaccctggaactgatggaagaagtggcgaaacgcgttgaagttgacggcattcaggcgtggtgggatctcgacgcccgcgacatcctgggcgcggacgcggacaactacgagaaagtgccggataccctggacgtgtggttcgactccggttcaacccatgcctctgtggttgacgtgcgccctgagttcgccggtcacgctgccgacatgtatctcgaaggctccgaccaacaccgcggctggttcatgtcatccctgatgatctccaccgccatgaagggcaaagcaccttaccgtcaggtactgactcacggcttcaccgtggatggtcagggccgtaagatgtccaagtccatcggtaacaccgtttcgccgcaggacgtaatgaacaagctgggcgcggacatcctgcgtctgtgggtagcctctaccgactacaccggcgaaatggcggtgtctgacgagatcctgaagcgtgctgccgacagctatcgtcgtatccgtaacaccgcgcgcttcctgctggcgaacctgaacgggttcgatccggtaaaagatatggtgaagccagaagagatggtcgtgctcgatcgctgggcggtaggctgcgcgaaagcggcgcaggaagatatcctgaaagcgtatgagtcttacgatttccacgaagtggtgcagcgcctgatgcgcttctgctccatcgagatgggctcgttctacctcgacatcattaaagaccgtcagtacaccgcgaaagcggacagcgtggcgcgccgcagctgtcagtctgcgctgtaccacatcgcagaagcgctggtgcgctggatggcgccgatcatgtccttcaccgcggatgaaatctggggttacctgccgggcgaccgtgagaagtatgtcttcaccggcgagtggtatgaaggtctgttcgatctctccagcaccgaagcgatgaacgatgcctattgggacgagctgctgaaagtgcgtggcgaagtgaacaaggttatcgagcaggcgcgcgctgacaagaaagtcggtggctctctggaagcgacggtgaccctgtacgcggagcctgagctggccgcgaagctgaccgcgctgggcgatgaattacgatttgtcctgttgacctccggtgcgaaagttgcggattatgccgaggcgtctgctgatgctcagcagagcgaactgctcaaaggactgaaggtcgcactgagcaaagccgacggtgagaaatgcccgcgttgctggcattacactaccgatgtcggtcaggtggcggaacacgcagacatctgcggacgctgtgtaagcaacgtcgccggtgacggcgaaaaacgtaagtttgcctga

SEQ ID NO: 753 - DNA, 549 bp, Enterobacter cloacae
cgcgtagcgatcccggcctacagaatttgtggcccccgtaggcccggtaagcgtagcgccaccgggcaacaggtgacccaaaacaagcgagcaatttgcatgtctaaatccgtacagagcaacagcgcggttctcgttcactttacgctgaagctggatgacggctctacggccgaatccacccgcaacaacggcaaaccagccctgtttcgtcttggcgatacctccctgtctgaaggtcttgagcagcagcttctcggtctgaaagagggtgagaaaaaagccttttcgctggagccggatgccgcgtttggcgtgccaagtccggatctgatccagtacttctcccgtcgtgagtttatggacgcgggtgaaccggagatcggggcaattatgctctttaccgctatggacggcagcgaaatgcctggcgtgatccgcgaaatcaacggcgactcgattaccgttgacttcaaccatccgcttgccgggcgcactgtccattttgatgtagaagtgctggagatcgatccggcactggaggcctga

SEQ ID NO: 754 - DNA, 510 bp, Enterobacter cloacae
gtttgcctgatgagtaaaactctctgttcaacaggactgcgctggctgtggctggtggtagtggtgctgattattgatttgggcagcaagttcctgatcctccagaatttcgctctgggggatacggtcccgctgttcccgtcgcttaacctgcactacgcccgcaactacggtgcggcgtttagtttccttgccgacagcggtggctggcagcgctggttcttcgcgggtatcgctatcggtatctgcgtcgtgctggcggtgctgatgtaccgctcgaaggccacgcaaaagctgaataacatcgcctacgcgctgatcattggcggcgcgctgggtaacctgtttgaccgcctgtggcacggctttgtggtcgatatgatcgacttctacgtcggcgactggcacttcgcgacctttaacctcgccgatagcgcaatatgcgttggtgcggcgttaatcgtgctggaaggcttcttgcctaaaccggcagcgaaagagcaggcgtaa

SEQ ID NO: 755 - DNA, 987 bp, Enterobacter cloacae
aagtgctggagatcgatccggcactggaggcctgaaatgcagatcctgttggctaacccgcgcggtttttgcgccggtgtagaccgcgctatcagcattgttgaaaacgcgctggagatttacggcgcgccgatttacgtgcgtcacgaagtggtgcacaaccgctacgtggtcgacagcctgcgcgagcgcggtgcgatttttatcgagcagatcagcgaagtgccggacggcgcaattctcatcttctccgcgcacggcgtctcgcaggcggtacgcaacgaggcgaaaaaccgcgatctgaccgttttcgatgccacctgtccgctggtgaccaaagtgcatatggaagtggcgcgcgccagccgtcgcggtgaagagtcaattctgattggtcacgccggtcacccggaagtggaaggcaccatgggccagtacagcaacccggaagggggcatgtatctggttgagtcaccggaagacgtctttacgctgaatgtgaaaaacgaagcccgactgtcgtttatgacccagacgacgctttccgtggacgacacctcagacgtgattgacgccctgcgccagcgcttcccgaaaatcgtcgggccgcgcaaagatgatatctgctacgcaaccaccaaccgtcaggaagccgtgcgcgcgctggctgaacaggcggacgtggtgctggtggtcggctcgaaaaactcctctaactctaaccgtctggccgaactggcgcagcgtatggggaaagcggcgtttttaatcgacgacgcaacggacattcaggaagcgtgggtgaaaaacgcggtctgcgtcggtgttaccgcaggcgcttcagcgccggatattctggtgcagaacgtcattgcccgcttgcaagagctgggcggtggcgaagcggtgccgctggaaggccgcgaagagaacattgtctttgaagtgccgaaagagttgcgtattgacgcgcgagaagtggaatag

SEQ ID NO: 756 - DNA, 384 bp, Enterobacter cloacae
  unsure (276)
aaaatgactaatcgagcgattcctttacctgatgaacaagccactttagatctcggcaagcgcgtggcgcaggcctgtcagggggcgaccgtcatttatctgtatggtgatttaggcgcgggtgaaacaaccttcagccgtggctttttgcaggcgttaggccataacgggaacgtaaaaagcccgacatacacgctggtggaaacgtacacgcttgaaaatatcatggtggtccactttgatttatatcgtcttgccggacccggaagagccggnaatttatggggatccgcgattactttgccaacgacgccatctgcctggtggagtggccgcaacaaggtgcgggtgtgctgcctgacccggatgtcgaaattcacttag

SEQ ID NO: 757 - DNA, 1368 bp, Enterobacter cloacae
ccggttgagcgtagggataacgggatgattaatcgcgttaaaggttgggtgctggctgccacggtcctgctgtgcgcgcaggtcggggcggccagcctctcggatattcaggtgtcgaatggcgatagccaggcccgcattacgttcagctttatgggcgatcctgaatatgctttctcacaaatcgacagccgcagcgtggcgctcgatattaaacagaccggggtgatccaggggctgccgctccagttcagcggcaacaatctggtgaaaagcatccgttcgggaacgccgaaggatacgcagtctctgcgtctggtggtcgatctcaccgaaaagggcaaaacgaaggcggttaagcagcaaaacggcgccaattatacggtggtctttaccattaatgctgatgttccgccgccgccgccaccgcctgcacctgttgtagcaaaacgcgtggaagcgccggtttataccccaaggccgtctgagccagcccgtaatccgtttaaatcacaaaatgaccgacttaccgccgtgaccagcagcaacacggtgacgcgtccggcggtcagcgcgcggcgaacaccggtcagtggcgacaaagtgattatcgccatcgacgccggacacggcgggcaagatcctggcgcgattggcccgggcggcacgcgggagaaaaacgtcactatcgccattgcccgtaagctgcgtgcgcttctgaatgacgatccgatgtttaaaggggtcatgacccgcgacggagattactttatttcagtgatgggacgctcggatgtggcgcgtaagcaaaacgccaacttcctggtgtcgattcacgcggatgctgcgccgaaccgtaacgccaccggcgcgtcggtatgggtgctgtcgaaccgtcgagccaacagtgaaatggcgaactggcttgaagagcacgagaagcaatctgaactgttaggcggggcaggcgatgtgctggcaaacagccaggccgatccgtatctcagccaggcggtactggatttacagttcggtcattctcagcgcgtcgggtatgatgtcgccactaacgtactgagccagctgcaaagcattggatcgctgcataagcgtcgcccggagcatgcaagccttggtgtcctgcgttcgccggatatcccgtcgattctggtagagacgggctttatcagtaaccatggtgaagagcgtttactgggaagcgacagctatcagcagcaaattgccgaagcgatttataacggtctgcgtaaatactttgacgcgcatccgcttcagtctgcgccgcagggcggggcagcccagacggcaagcgccgcgctgccgggtgaaatgaccgcgactaattaa

SEQ ID NO: 758 - DNA, 1818 bp, Enterobacter cloacae
ggagagttcatgccgattcaggttctaccgccgcagctcgcgaaccaaatcgccgccggtgaggtggtggaacgccctgcgtcggtggtgaaggaactggtggaaaacagcctcgatgcaggggcgacccgcattgatatcgatatcgaacgcgggggcgcaaagcttattcgcattcgtgataacggctgtggcatcaaaaaggacgaactggcgctggcgctggcgcgtcatgccaccagtaaaattgcctcacttgacgatctggaagcgattataagcctgggttttcgcggcgaagcgctggccagtatcagctccgtttcccgcttaacgttgacctcccgcacggccgaccagcaggaagcctggcaggcctacgccgaagggcgcgatatggacgtcacggttaaacctgcggcgcacccggtaggcaccacgcttgaagtgctggatctcttctataacacgcccgcccggcgcaagtttatgcgaaccgagaagaccgaattcggacatatcgacgagatcatccgccgcatcgcgctggcgcgctttgatgtcaccctcaacctcagccataacggtaaggtgatgcgccagtatcgcgcggtggcggagggtggacaaaaggagcgtcggttgggcgccatctgcggcacaccgtttctggaaaaggcgctggccattgagtggcagcatggcgatctggccctgcgtggctgggttgccgatccgaacgccagcagcgccgcgttcgcagaaattcagtattgctacgtcaacggccgcatgatgcgcgaccgcctgattaaccacgctattcgacaggcctgcgaagataagctcggcgccgatcaacagcccgcctttgtgctttatctggagatcgacccgcaccaggttgacgttaacgtgcaccccgccaagcacgaggtgcgtttccaccagtcgcgcctggtgcatgatttcatctaccagggcgttgccgctgtattgcagcagcaggcagagccagagttgccgctggcaaaagaagagcccgcgccgcgcccactgccggaaaaccgcgtggcggccgggcgtaaccattttgccgaaccggcggtcgcgcgcgagccggctgctccacgtttatccccggcgggcaacgcgccgcgaccaaccggtgccaactatcccaacgctcagccgggctaccacaaacagcagggggcgctgtaccgcaaactgctggatacgccggcggtggagcataaagagcacatcacggtttcaaccccctctctggatgggcatagccagagttttggtcgggtattgaccattattgctcccgacatggcgttgcttgaacgcgaaggtaaactgctgttgctggcgctttccgtggcggagcgctggctcaaacaggcgcagttaaccccgggggtgaatgccgcctgcgcgcagccgctgttgatccccgttcgcctgaaaatatcccctgaagaaacaggggttttgcggcgcgtgcagacgcaactggccgaaatggggattgaaatcgtactggacgcgcagcatgtgacaattcgcgcagtgcctttacccttacgccaacaaaatttacaaaacttgattcctgaactgataggctacctggcgcagcaaacgacgtttgatgccgccgataccgcgcagtggatcgcccgccatctggccagcgagcatgcaccgtggagtatggcgcaggcgattaccgttctggcggaggtggagcgcctctgtccacagctggtgaaagcgcctgccaggtggtttgttacaacctgttga

SEQ ID NO: 759 - DNA, 324 bp, Enterobacter cloacae
ggaaaagatagaatggctaaggggcaatctttacaagatccgttcctgaacgcattgcgtcgggagcgtgttccagtttctatttatttggtgaatggtattaagctgcaaggtcagattgagtctttcgatcagttcgtgatcctgttgaaaaacacggtcagccagatggtctataagcacgcgatttctactgttgttccgtcccgtccggtatctcatcacagcaataacgctggcggcggcactggcagtaactatcatcacggcagcaacgcgcagggttcttcaacaccagcgcaggacagcgaagaaaccgaataa

SEQ ID NO: 760 - DNA, 1692 bp, Enterobacter cloacae
cgcgctatccactccatctcgccgtggtattgtttgtccagccatgcctggagcttaggctcactggcagagaggtcggtgtcagtaataccgaccttctggaagcccagttcagcaccccactgttttattttttgcgctaattcattgagatcgaggggctgtgacatgacggaccatactgtgaagaaaaacctcgcaagtataccacattccatctggcatgcggatgacctccgtcgggccgagaaagaggccgcagatagcctcggcattaccctttacgaactgatgcagcgcgcgggcgaggcggcgtttaacgtggcgcgcacggcttatccggatgcctcgcactatctgatcctgtgcgggcacggcaataacggtggcgatggctatgtggtggctcgtcttgcggtggcggcggggctgcgcgtcaccctgatggcgctggagagcgacaagccgctaccggaagaggctggcatggcgagagaggcctggctgaatgcggggggcattattcatgcgcctgatattatctggcccgaggatgtcgacgtgattgttgatggtctgctggggacgggactgatgcgcgcgcctcgcgatgacgtcgccgcgctgattacgcgcgctaatgcgcaccccgccccggtggtagcgctggatattccctccggcctgatggcgcaaaccggcgcgacgccgggcgtgtcgattgaggcggcgcacaccgtgacctttatcgccctgaagccggggctgcttaccgggaaagcgcgggatgtcgtgggcacgttacaccacaacgccctggggctggaaaactggctgatcggacaggatacccacatcacccgctttgatgcctcccagcttgcacagtggctaccgccgcgtcgtcccacctcccataagggtgaccatggccgactgctgattattggtggcgatcatggcacggcaggtgcgattcgaatgaccggagaggccgcgttgcgcagcggcggcggattaatacgcgtgctgacccgcagcgaaaacattccgcccattattaccgcgcggccggagctgatggtccacgagcttaccccgcaggcgattgaaaagggtcttgagtgggcggacgtggtggtcattggtccgggcctgggtcagcaggagtggggtaaacaggccctgcaaaaggccgagaattttcgtaaaccgatgctctgggatgccgacgcgcttaaccttctggcaataaacccggataagcgtcacaatcgcattctgacgccgcaccccggcgaagccgcacggctgcttaactgtagcgtggcagaaattgaaagcgatcgcttactttcagcccaacgtctggtaaaacgttacggaggtgttgccgttttgaaaggggcgggaaccgttatcgccagcgatgatgcgatgggcatcgttgatgccggtaatgcaggcatggcgagcggcggcatgggcgatgtactctctggcatcattggcgcattgctcggacagaaacttcccctttatgatgcagcctgtgcgggctgcgtggcccacggtacggcggctgacaggctggctgctcgttacggaacgcgcggtatgctggccaccgatcttttttgcacgctgcggcgtgttgttaacccggatgtgattgacgtagaaaatgactaa

SEQ ID NO: 761 - DNA, 225 bp, Enterobacter cloacae
  unsure (34)
tttatatcgtcttgccggacccggaagagccggnaatttatggggatccgcgattactttgccaacgacgccatctgcctggtggagtggccgcaacaaggtgcgggtgtgctgcctgacccggatgtcgaaattcacttagattaccaggcacaagggcgtgaggcacgcatcagtgcggtttcctcatcaggctgttccttactggcgcgtttagccggttga

SEQ ID NO: 762 - DNA, 954 bp, Enterobacter cloacae
aacatgactgatgtaagtaaggcgagcctgccaaaggcgatttttctaatggggccaacggcctccggcaaaacggcgttagccattgagttacgtaaagttttgccagtagagttgattagcgttgattcagccctcatctaccgagggatggacatcggcacggcgaagcccaacgcagacgaactgcgtgcggcaccgcaccgtttactggatattctcgacccggcacaggcttactccgcggcagattttcgccgcgacgcgttagccgagatggccgagattaccgccgcgggacgcataccgctgttagttggcggcacgatgctctactttaaggcgctgctggaggggttatcgcatttgccatcggccgatccggaagtgagagcgaagattgagcggcaggcggcagagcaggggtgggacgttttgcacaggcaactggaagagattgacccggttgccgcagcgcggatccacccaaacgatccgcaaaggctttcccgggcactggaagtttttttcatttcgggtaaaactttaacggaactgacgcaaacgtcaggagacgctctgccgtatcaggtgcatcagttcgccatcgccccggcgagccgtgaactgctccatcaacgaattgagcagcgttttcatcagatgttggcttcagattttgaagcagaagtgcgggcgctttttgcccgtggagatttgcatacggacatgccttccattcgttgtgtggggtaccgccagatgtggtcgtatcttgaaggcgagatttcatacgatgaaatggtttatcgaggtgtttgcgccacgagacagttagcgaagcgccagatcacctggttacgcggttggaagggggttcactggttagacagtgaaaaaccacaacaggcgttaaacgaagtgattgaggttattggtgatatcgctgactga

SEQ ID NO: 763 - DNA, 372 bp, Enterobacter cloacae
agaggtttacgcttgtttgaccgttatgacgccggtgagcaggcggtgctggtacacatctatttttcgcaagacaaagatatggaagacctccaggagtttgaatctctggtctcttccgccggtgtcgaagcaatgcaggtgattaccggtagccgtaaagcgccgcacccgaagtattttgtaggtgaaggtaaagcagtaaaaattgcggatgccgtaaaagcaaccggcgcatctgttgtgctgtttgatcatgcgctgtctccggctcaggaacgtaacctggaagctctctgcgaatgccgtgttatcgatcgcacggggttgatcttagatatttttgctcagcgtgcgcgtacccacgagggt

SEQ ID NO: 764 - DNA, 1251 bp, Enterobacter cloacae
agggtaatgccgaggctatctgcggcctctttctcggcccgacggaggtcatccgcatgccagatggaatgtggtatacttgcgaggtttttcttcacagtatggtccgtcatgtcacagcccctcgatctcaatgaattagcgcaaaaaataaaacagtggggtgctgaactgggcttccagaaggtcggtattactgacaccgacctctctgccagtgagcctaagctccaggcatggctggacaaacaataccacggcgagatggagtggatagcgcgtcacggtatgatgcgtgcccgcccccacgagctgttgccgggtacgctgcgcgttattagcgtacgcatgaactatctgcctgctaacgcggcctttgcgcgcacgctaaaaaatccttcgctgggttacgtcagccgatacgcgctggggcgtgattaccataaacttctacgcaaccgtctaaaaaagctcggggaaaccattcagcagcactgtgtttcgctgaattttagaccctttgtcgattctgcgcctattcttgagcgcccgatcgccgaaaaagccgggctcggctggacaggtaagcactcacttatcttaagccgcgacgcgggctcattctttttcctgggtgaactactgattgatttacctctgccggtagacagtccggtggaagaaggttgtggccgctgtgtggcctgtatgaccatctgcccgacgggcgcgattgtcgaaccgtataccgttgatgcgcgccgctgtatctcttatctcactatcgagctggaaggcgctattccagaggagtttcgtccgcttattggcaaccgcatctacggctgtgatgactgtcagctgatttgtccgtggaaccgttattcacagttgacggacgaagaagacttcagtccgcgcaaggcgttacatgccccgcagttgatcgaactgttcgcctggagcgaagcctggttcctgaaggtgacggagggttccgccatacgtcgtatcggccacctgcgctggctgcgtaatgtggccgttgcgctggggaatgccccgtgggatgaagcaaatcttcaggcgctcgaaagccgtagaggtgagcacccacttcttgatgagcacatagaatgggcgattgcgcagcaaattgagaagcgaaatgcaggcgtggttgaagtgcagttaccgaagaaacagcgcctggtcagggtgattgaaaaaggactgccgcgggatgtgtga

SEQ ID NO: 765 - DNA, 273 bp, Enterobacter cloacae
agactcgatggcctgtggcagctggttggcttctatctgggctggcttggcggtgaaggcaaaggccgtgcgctgggcgtaggcgaagtgaaattcaccggtcaggttctgcctaccgcgaagaaagtcacctaccgtatccatttcaaacgcatcgttaaccgccgcctgattatgggcctggcggacggtgaagtgctggtagatggtcgcctgatctataccgcgaacgacctgaaagtgggtctgttccaggatacctccgctttctga

SEQ ID NO: 766 - DNA, 450 bp, Enterobacter cloacae
ataggtatcgtaatcgcccgggtaagtcaccagcttgccgcggtcgaggtcgacaatgcgcgtggccatattgcggatgaacgaacggtcgtgggagatgaagataatggtgccgttaaaggttttcaggaacccttccagccagtcaatcgcttcgatatccaggtggttcgtcggttcgtccagcagcagcaccttaggcccgctcaccagggcacggcccagcgccgctttacgcagccagccgccggagagcgccgacagctccatatccgcttccaggccaagctgggccagcacttcattaatgcggttttccagctgccacagaccgtggtgatcgagcatctcctgcacttttgccagctcgttgagattcttgtcgctcgggtccgtcatgaccagatgcgaaatctcgtggtaacgcttgaggtattccgcctgctctga

SEQ ID NO: 767 - DNA, 315 bp, Enterobacter cloacae
gtcaccagcttgccgcggtcgaggtcgacaatgcgcgtggccatattgcggatgaacgaacggtcgtgggagatgaagataatggtgccgttaaaggttttcaggaacccttccagccagtcaatcgcttcgatatccaggtggttcgtcggttcgtccagcagcagcaccttaggcccgctcaccagggcacggcccagcgccgctttacgcagccagccgccggagagcgccgacagctccatatccgcttccaggccaagctgggccagcacttcattaatgcggttttccagctgccacagaccgtggtga

SEQ ID NO: 768 - DNA, 1257 bp, Enterobacter cloacae
tctatgtgtgaccagcaccatgccgatcggcatatattatgctcgcaatgcgatatgctcgtggcgttgccagagcttggtcacggacataaggctgcctgcccgcgctgcggcgctacgctgacgaccgagtgggacgcgccaaggcagcgtcctacggcttatgcgctggcagccttattcatgttactgctctccaatctcttccctttcatctatatgaaagtaggtgggatgaccagccaggtagatttactggaaattcctggcgtgatgttctcggaagattacgccagccttggcaccttctttcttctgttcgtgcagatcgtcccggctttttgcctggtcgtcattctgctgctggtcaaccgcgtcaggatgcccactgtccttaaaatcaaactcgcgcggatccttttccagctgaaaagctgggggatggcggaaatttttctcgcgggtatcctggtcagcttcgtgaagctgatggcctacggcgatgtggggattggcagcagctttattccgtggtgtctgtattgcgtgctgcaactgcgcgcgttccagtgcgtggaccgacgctgggcctgggacgatattgccccggcgccgacgctctcgcagacggtaaaggtgggcgtaccgggtatccgtcaggggcttcgctcctgctcgtgctgcaccgccgtgctgcccgcggatgtcgaggtgtgtccgcgctgtgaaacaaaaggtcacgtccggcgcaaaaatagcctgcaatggaccatggcgctgctggtgacctctgtcatgctctatctgcccgccaatatcttgccgatcatgatcaccgatttgctcggcgacagaatgccctcgaccatactggccggggtgattttgctgtggagcgagggatcttaccctgtagcaggcgtcatattcctcgccagtattatggttccgaccttaaagatgattgccattgcctggctttgctgggatgcaaaagggcacggtaagcgagacagcgagcgcatgcatctgatttatgaggtcgtggaatttgttggccgctggtcgatgattgacgtgttcgtgattgcggttctctcagcgctggtgcgtatgggggggctgatgagtatttatcccgctatgggagcgctgatgtttgcgttggtcgtcattatgaccatgtttgcggccatgaccttcgaccctcgtttatcgtgggatcgtgagcccgattcaagccatgaggaagagtaa

SEQ ID NO: 769 - DNA, 231 bp, Enterobacter cloacae
ccttcgaccctcgtttatcgtgggatcgtgagcccgattcaagccatgaggaagagtaagagcatggaaaataagagtggagaggctaaagtgcagaaggtcagaaactggtcgccggtgtggattttcccccatcgtgaccgcgctgatcggtgcatggatcctgttttatcattacagccatcagggaccggaagtcacgctaattaccaccaatgcagaggggattga

SEQ ID NO: 770 - DNA, 579 bp, Enterobacter cloacae
gagggcgaaacaatgaaaaaatggctaatcatcgcaggcgcactggtattaacggcctgtagctttggaagcgataacaaaagctactaccagctgccgttaagcgcccagtccggtgcgcagagcagcacctcgcagggcagccgtctgctgtgggttgaacaggttgccgtgccagattacctggcgggcaacggggtggtctaccagaccagcgatgtgcagtacgtaatcgccaacaataacctgtgggccagcccgctggatcagcagctacgcaatacgctggtggcgaatctgagcagccagctccccggttgggtcgttgcctcgcagcctctgggaagcgatcaggacactctgaatgttaacgtgacgggattccatggccgctatgatggtgccgttgttatcagcggggagtggctgctgaatcaccagggtcagctgattaagcgtccttttcatcttgaactcaagcagcagaaagatggctatgacgaaatggtgaaagtacttgcgcagggatgggcacaggagtcggctgctatcgcaagagagatttcccgcctgccataa

SEQ ID NO: 771 - DNA, 2025 bp, Enterobacter cloacae
cgggtggttcagggtggtgtccattttgagggcgacacgcggcttatttaccagagcctgatgtggagccgtctggcgtcgcgcatcatgctgccgatgaaagagtgcaaggtctacagcgatcttgatctctacaccggcgtacagatgatcgactggacagagatcttcaccccggacgccacctttgcggtgcatttcaacggcgtcaacgatgagatccgcaacagccagtacggtgccctgcgcgttaaggatgccattgtggactgcttcacgcgtcgtaataaagaacgtccgaacgttgaccgtgaaaacccggatctgcgtatcaacgtctggctgaacggcgatacggccagtatttcccttgatctgagcggcgcaggcctgcatctgcgcggttatcgcgatcgcaccgggatggcgccgatcaaagaaacgctggctgccgctatcgtgatgcgctccggatggcagcctggtacgccgctgctcgatccgatgtgcggttccggtacgctgctgattgaagccgcgatgctggccaccgaccgtgcgccagggctgcaccgcggccactggggcttcaaaggctgggcacagcacgatgaggccatctggaaagaggtcaaagacgatgcgcagacccgcgcccgtaaagggctggcggaatacacctctcacttttacggttcggacagcgatgcacgggtgattgaacgtgcgcgcagcaacgcccgtcgtgccggtatcggcgagctggtcaccttcgaggtgaaagacgtggcgaacctgaccaacccgttgccaaaaggcccgtacggtacggtgatcagcaacccgccgtatggtgagcgtctggacagcgagccggcgctgattgcactgcacagcctgctgggccgcaacatgaaagcgcatttcggcggctggaacctctccctgtttagcgcctcgccggagctgctgagctgcctgcaattgcgtgccgatcgccagttcaaggcgaaaaacggcccgctggactgcgtgcagaaaaactaccatctggcagagatagcggcggatagcaaaccgtcaggcgtggcggaagattacgccaaccgcctgcgcaaaaacctgaagaaatttgagaagtgggcaaagcaggaaggcatcgaatgttatcgcctgtacgacgctgacctgccggaatacaacgtggcggttgaccgctatgcggactgggtagtggttcaggaatacgccccgccgaaaactatcgatgcgcaaaaagcgcgtcagcgtatgctggatgtgattgcggccaccttcgcggtactcggcatttcgccaaacaagctggtgctgaaaacccgtgagcgtcagaaaggcaaaaaccagtatcagaagatgggcgagaagggtgacttcatcgaagtgggcgaatataacgcgcgcctgtgggttaacctgaccgactaccttgataccggtctgttcctcgaccaccgtatcgcccgccgcatgctgggccagatgagcaagggcaaagacttcctgaacctgttctcctataccggcagcgccagcgttcatgcggggcttggcggcgcgcgtagcaccaccacggtagatatgtcacgaacttatctggagtgggcagagcgcaacctgcgtcttaacggcttaaccggtcgtcagcatcgcctgttacaggccgacgtgctgggctggctgcgcgataccgacgagcagtttgacctgatctttatcgatccgccgaccttctctaactccaagcgtatggaggatagctttgacgttcaacgcgatcacctgcgcctgatgaccgacctgaaacgcctgctgcgtaaaggcggcaccattatgttctcgaacaacaagcgcggattccgcatggatcacgacggcctggccgaactgggactgaaagcacaagaaatcagccaaaaaacgctgtctcaggactttgcccgtaaccgtcaaatccacaactgctggctgatctccgcggtctga

SEQ ID NO: 772 - DNA, 1908 bp, Enterobacter cloacae
atgtctttaattagtatgcacggcgcgtggctctctttcagcgactcaccgcttctcgataatgcagagctgcatatcgaagataacgagcgcgtctgtctggtgggccgtaacggcgcaggtaaatcgacgctgatgaaaatcctcaaccgtgagcaggggctggatgacggccgtattgtttacgagcaggatctgatcgtctctcgtctgcaacaggatccgccgcgtaacgtcaccggcagcgtttacgattttgtggccgaagggatttcagagcaggcggaatacctcaagcgttaccacgagatttcgcatctggtcatgacggacccgagcgacaagaatctcaacgagctggcaaaagtgcaggagatgctcgatcaccacggtctgtggcagctggaaaaccgcattaatgaagtgctggcccagcttggcctggaagcggatatggagctgtcggcgctctccggcggctggctgcgtaaagcggcgctgggccgtgccctggtgagcgggcctaaggtgctgctgctggacgaaccgacgaaccacctggatatcgaagcgattgactggctggaagggttcctgaaaacctttaacggcaccattatcttcatctcccacgaccgttcgttcatccgcaatatggccacgcgcattgtcgacctcgaccgcggcaagctggtgacttacccgggcgattacgatacctatctactggagaaagaagagaacctgcgcgtcgaagagctgcaaaacgccgagttcgaccgcaagctggcacaggaagaggtctggatccgtcagggcatcaaagcccgtcgtacccgtaacgaaggccgcgttcgcgccctcaaggcgatgcgccgcgaacgtagcgaacgccgtgaagtcatggggagcgccaaaatgcaggttgaagaggcgtcccgctcgggcaagattgtcttcgaaatggagaacgtgaattattcggttgacggcaaagtgctggtaaacgatttctccgctcaggttcagcgcggcgacaaaattgcgctgatcggcccgaacgggtgcggtaaaaccacgctgctgaaactgatgctcggtcagctccaggccgacagcggtcgtatccactgcggtaccaaactggaagtggcgtacttcgaccagcaccgcgcagagctggatccagaccgtacggtgatggataacctcgctgagggcaaacaggaggtcatggttaacggcaagccgcgtcacgtgctgggctaccttcaggacttcctgttccacccgaaacgcgccatgacgccggtgcgcgcgctgtccggcggtgagcgtaaccgtcttttgctggcgcgtttgttcctgaaacccagtaacttattgattctcgatgaaccgactaacgatctggatgtcgaaacgctggaactgctggaagagttgattgatggttatcagggaaccgtgatgctggtcagccacgatcgtcagtttgtcgataacaccgtgaccgagtgctggatcttcgaaggcgaaggacgcatcgggcaatatgtaggcggctatcatgacgcgcgtggacagcaatcacagtcgctggcgcaaaaacaggcgaagaccaaaaatgtcgctgaacctgttgttgcaaaagcagaaactgtcaaaaagtctcctgctaaaatgagttataacttgcagcgcgagctggaggggctgccgcagcgtctggaagagctggaagctgcactggaagcactgcaaatccaggtcgctgatgcgtcattctttacgcagcctcacgactatactcagaaagtattggctgaactctcccaggctgaacaggcgctggaagaggcatttgagcgctgggagtaccttgagtctctgaaaaacggcgcataa

SEQ ID NO: 773 - DNA, 1656 bp, Enterobacter cloacae
ggaagagtaagagcatggaaaataagagtggagaggctaaagtgcagaaggtcagaaactggtcgccggtgtggattttcccccatcgtgaccgcgctgatcggtgcatggatcctgttttatcattacagccatcagggaccggaagtcacgctaattaccaccaatgcagaggggattgagggcggaaaaaccaccatcaagagccgcagcgtggatgtgggtgtcgtggaaagcgcgaccctgacggatgatttaacccatgttgaaatcaaggcccgcctgaatgctggcatggaaaaactgctccatgaagattctgttttttgggtagtgaaaccgcaggttggtagagaagggatcagcggcttagggacgctattgtccggggcttatattgaactccagcccggcaacaaaggcgcccagccagcaaactatcagctgctggattcaccgccgcttgcgccaccggatgcaaaagggatccgcgttattctggacagtaaaaaagcgggccagctctcgccgggcgatccggtgctgttccgtgggtatcgcgtcggttcggttgaaacaagcaccttcgatccgcaaaaacggaccatcagctatcagctatttatcaacgcgcctaatgaccgcctggtgaccagcaacgttcgcttctggaaagacagcgggatcgcggtagatctcacctctgcggggatgcgcgttgagatgggttcactcaccacgctgtttggtgggggcgtcagttttgacgtgccggaaggtatagatctgggacaaccggtggcggagaaaaccgccttcagactgtttgacgatcaaaaaagcattcaggatgcgctctataccgatcacatcgactacctgatgttctttaaggactctgtacgcggcttgcagccaggggcgccagttgagttccgcggtattcgtctggggacagtgggacaagtgccttactttgttccgggactcaagcagatgcttgatgatgattatcgtattccggtgctgatccgcattgagcctgagcgtttgattaaccagataggcgaggaccaggatattggggagcatatcagcgacctgctgaatcgcgggctgcgcggctcgctgaaaaccggcaacctggtcacaggggcgttgtatgtcgatatggacttctatccaaaagcgccacctatgacgggagtccgtgaatttggcggctacaaaatcattcctacggtcagcagtggcctggcgcagatccaacagcgcctgatggaaacgctggataagatcaacaatctgccgctgaatccaatgcttgaagctgcgacgggatcactgcatcagagccaggcaacgatgctacgtctgcaaaccacgctggataatatcaacaagatcaccgctaaccagtccatgcagcagctgccgcaggatatgcagaaaacgttgcgcgaactgaatcgtagtatgcagggcttccagccgggctcagcggcctacaacaagatggtggcggatatgcaacgtcttgatcaggttttacgcgagctacagcccgttctgaaaacgctcaatgaaaagagcaacgcactggtgtttgaagcgaaagacaaaaaggatcctgagcctaagagggcgaaacaatga

SEQ ID NO: 774 - DNA, 399 bp, Enterobacter cloacae
gtgttttattttagtaacactacccgatgtttttattgtgatgaaaataatatttctcgtcccgaagatgcaatagaagtatctgagcaggatgttcataaatattcagggcaaaacccgcagtggatgttaccgaacgtatcagaaggcggaaagatggaatggattgatgatatatccattgataaacgtactgcgcgttatgaaataaataagcaggagaaggagcgcttgcttaaccgtaccataaaagagcgttacacgcttgaggttatcggtcaaacgtccgtgctttcagttgaacaaagcacgatgatgcagagtttgtcagcttatatcaatgaactaaatcaggtcgatttatatgcggataatcccgtatggccaatacatccttag

SEQ ID NO: 775 - DNA, 1074 bp, Enterobacter cloacae
gaggtaaatatgactaccgattttttacacggtgtgagaactattgaatatgacgacggaacagaagaaatttcaactgtaaccgtatctgttattggcattgtgggaaccgctccagactcaacggcggcaacttgtgcgtctcttgttaccggtagcgaattaacaaataataaaatcacatggcaggctgaagacgctggaatcaagggtaatagctttagcgttgaaatagtaccgggtgatgtttatccggctaatacaaaatgggggggcgatgtaaattactccactatttatcattactcaattaaacctgatggctccttaaagctttcggtcaggatgccggttgattctgatggtaagaaattaatgaatgcggaacttattacaagcatttgggatatggttcccccgcttgataattactgccggattaaagccattatttacagcacttctaacgataatggtaaagtgatgtacatgtcggaaactaatcttgcgggcggggcagacgaggcctttccgctcaacgttccgaccgtcattgccggtagtacaacgaaagccgcgaagctcggtgcaaccggaacgctacccgcagatattaacgatatctttaaccagaccagggcgcttatcgtcgttgtacgcgttgctgatgatgcggatgcttcaaagctacagcaaaacgtgatcgcgggattaaacactcttccgagttccgggcaactgaatgaagttatgccgcgtatcattatcgcccctgactttagcgctaccgaccccgtggccgtacagatagaagtgatcgcaaacaaggttcggggcgtgggttatatagactcgccatcgttcgctactgctaaagatgtggccttgcgccggcagagttacggaaagcgcgtcgaaatcttacgcccgcgcgtgtttactaccagttcagcgggtagcacgtcacgcgcatattcagcgagcgcggcgggcctacgttgtccaattgataacaagaaaggcttttggtggagtaagtccaatcaacaaatcatggggcgtgacagcacttga

SEQ ID NO: 776 - DNA, 582 bp, Enterobacter cloacae
actcgccatcgttcgctactgctaaagatgtggccttgcgccggcagagttacggaaagcgcgtcgaaatcttacgcccgcgcgtgtttactaccagttcagcgggtagcacgtcacgcgcatattcagcgagcgcggcgggcctacgttgtccaattgataacaagaaaggcttttggtggagtaagtccaatcaacaaatcatggggcgtgacagcacttgagcaggttgatgaatatatcatcggtgacgatacgtgtgttgtgaacctgctgaataaaaatcaggtgagtacgattgttcgcagaagtggtttcaagcactggggaaactatctctgcagcacagatccgccatgggcttttgaatgcgttcggcgtactgctgatgttattgaagattcgattgcagataccgtcgaaaacgagtttattgaccgtcctattgatttgcacctcggcgatgacatcatcgaaagtattaacggttttattcgttatctcttcgacatcggcgctattaatggcggtaaggcgtggcttgatcctgaactgaatactaaagaaagccttgccgggtaa

SEQ ID NO: 777 - DNA, 525 bp, Enterobacter cloacae
aaaggtattaaaatggcagaagctaatgtatatcgcgcccacgcattatgggtgcaaggtcgtctcgtttgcggttgcgagtcatatactccggtggatatgaaaatcatcgaagatgaattcaaaaccggctcaatggacatggcaatgacgctggatggcggcatggaaaggatgggtgccagttttaaagttaaaggctcggatgttgatgtgatgtcgatgttcggatttattccgggtgtacgaacgcgcttcgaaatccgttcggcatttgtaacgaactccggtgaaaccatcattcgtaaagatttttatgaaggacccatcactggcatcactgacgatgaagagggaactgattcaaaatctggagtcggtcaaacagtgaccattgcgccgaattattttaagcgcatccagggtgataaagaaatttacgagattcacccggcaaaaatgattcgtcgagtgaatggggttaacgttctcggtgaaattgccagcggtttaaaaatctattaa

SEQ ID NO: 778 - DNA, 1539 bp, Enterobacter cloacae
gggagctatgtaaaaaagatggctatttctcaaaactttagatcgactgtaacttttgggggtcgcgtagacccctcttttcgtcgaggaagtgacgaactgaaaggagctatcaaagaagcaggtcaatcggtcagccagctaacgaagcgccaggaaaagttaaaacagcaaatggccagcctgaaacttgctggcaaagatgtctctgctcttattaagcagtatgaaaagctgtcccggcaaatagttaatgctacagaagaccaggagaagttgaaccagcagctaaaacgccaggaacgtctggataaatggaagggccgtgcagccgccgtgccaaaatgggccggtaaagctgcgtggggcgcggcaaaagggctggctttcagctcactggctccagccgcgatgttcgccggtgctatccagatgaactctgaaacgtcggaaaagctcggtctggcaaaaagttatggcgtcggtatcgataagtacggtgcgtgggaaaatattgccaaaaaagctgggctgaacggtgagaacgtcggggatcttgctgaagaactgacaaataaaatcggcgaaaaggataacgagaagaccttcaacccgatgctggctcaaatcaatctgagtaagcgcagaatggcaggctggagccgtgaaaagcagttcgatgaagtcatgagccgaatttcccggatgaaagatgagaaacaggcggccagtcttgctgaccagctgatgggaggtgaagcgaataagatcatgacgtatatgcgcatgaccgggaagacgtgggaacagacgatggctaaagccaaaaagtctaatctgctgactcaagaaggtgctgaaggtgcagccagggcacattttgcagttactaatctgtggggagctatcacgtccgggctgtcagatacactgggtaaaatcggcggtgagctggagccggatattaaccgcttcaaagagagcacaatcagctggtttaaggagaaccagggcgcgtttgttgaagggatcaggaactggataaaaccggacgaaagcggaaggacggggccgcagcgcttgttcgataccgtcaaaaagttcggggaggggctactcgagctgggaaaaattgtctgggccgtggcgaaaaagctcgcatggattcttcccgatgatgaaaaaaaccaggcgaaaatcgatgagtttgttaaaaacggaaacagctatgaaggagcaaaatcgctcgcagacgagtacgggctggaagactggttcaaagagaactatacgccggaaaaagtcgctgccgctcagcaaaaagctgcaggcgagggagagacaccggcagcgctggcgaaacgtcaggccagccagcccgtaggatatgggaactactctccacgcgttgaaatcaatgtgcaggcgctgcctggtcagtcagctgaggaagtcggtcagtcgacgtatgccgcgtttaaagctggcctgccgactgcacctggcggttcgggcgctatgtacgatattccggggtaa

SEQ ID NO: 779 - DNA, 219 bp, Enterobacter cloacae
tttatggctattacatatacaacgagagatggagatcgtctcgatactatctgtttaaaaatctacggcaaaactggaaaaaccacagaggaggttttatatcaggtcgctaattacggagtagtcgatatgtgcgcagtcttccccgcaggtaaagaaattgttttgccagaaatatcgtccgagccaatagttgaggctacgcaattatgggagtga

SEQ ID NO: 780 - DNA, 309 bp, Enterobacter cloacae
cgctcggtgagagcggcttttcagtacgactacagctggaataaatcgatggcaagaatctcaggaatttatgcaaacgggtttggggagccggttgccggtgtctgtattttgctgacagcaagggcaacaagcagcggtgtcgtgatggcaactactgcgaaccaggttacgggggaagatggtagttatggtttcgatcttcgccccggtgtttatgttgtaacagccaacggtttgtacttgggtgtgattacagtcagcgatgatagccaggatggaacgctgaacgattatctcgtcatatga

SEQ ID NO: 781 - DNA, 906 bp, Enterobacter cloacae
aagttagttatggtgatagtgtgccacaacaccagacaaacacgaaggagattcatcatgatcgcgattaccggcgcaaccggccagcttggccaacacgttattgaagaactgctgaaaaccgttccggccagccagatcgtggctattgtgcgtaacctggcgaaagccgaagcgttgcgtcagcaaggggtcgttgtgcgtcaggcggattacaccgatgaagccgcatttaccaccgcgctgaacggcgtggataaactactgctcatctcctccagcgaagtgggccagcgcgccgtacagcaccagaacgtgataaacgccgccaaagccgccggggtgaaattcatcgcctataccagcctgctgcatgctgacaaatccccgctgggtctgcacgttgagcacgtcgaaaccgaaaatgccctggcggcctccggcgtgccttacgccctgctgcgcaacggctggtacaccgaaaactacctggcaagcgcgccgccagcgctggaacacggcgtgtttatgggggccgcaggcgaaggcaaaattgcctctgcgacccgtgcggattacgcggcggcggcagcgaaagtgatttctgaagagggtcatgccggcaaggtgtatgaactggcgggtgataatgcctggacgctgagcgaactggctgcggaactgagcaagcagagcggtaagccggtaacgtatcagaacctcagcgaagccgatttcgccgctgcgctgaagggcgttggtctgcctgccgggctggcggaaatgctggcggactccgacaccggcgcgtccaaaggcggcctgttcgacgacagccataccctgagcaagctcattggccgcccaaccacaccgctggcggaaagcgtcaaagccatcctgtag

SEQ ID NO: 782 - DNA, 843 bp, Enterobacter cloacae
cccacaaggaggctcactgtgcaaggcgtaccggaacagttcactgatgagagagacagcgcgcgctttcgccatctggcgcagctgccgggcctggagctttatcacgcccatatctctgactacgccttcgagccgcacactcatgaagccttcggtatcggcaccatcgaaaccggtgccgaacgcttccgctatcgcggtacccagcatcttgccgcggaaaaatccgtcgtgaccatgaacccggacgagatccacaccggggaatccgccactgaaggcggctggcgctaccggatggtctacatcgaacccgacctgctggaagaggtcactggcctgcgtcactggtggtttagcgacgtcacgcgtcacgatccgctgcgctcgcaacagataggccagttgatttatggcctgtggcacacggacgatccgctggcgcagaaggggctgctactggatttgattcagacttttcagccgctggcccaccatgcgccggtggtgcaggaggccacgcaccgcttcgaacgcgttcgcgactacctgcacgacaactatatgcgctcgctgaccctggacgagctggctaacgttgtctcgctcagcccgtaccattttcagcgccagttcaaagcccatttccacgttacgccccaccagatgctgatggccatccggctgtggcgcgccaaagcattcctcacccatggcatgcctgccgccgaggtggccgccgcgaccgggctgaccgatcagtcgcacctgacccgcgccttcacccgtcgctacggcatcacacccgtgcgctaccagaaacaggttatgccgcgctaa

SEQ ID NO: 783 - DNA, 984 bp, Enterobacter cloacae
atcaagatggatggaaaaatgattagcggcgtgttgtatgccctgcttgcgggtttgatgtgggggctgatttttgtcggcccgctgattgtgccggagtacccggcaatattgcagtcgaccggacgttacctggcgctggggctgattgccgtgccgctggcgtggctggggcgcacgcgtctgcgtcagctgggccgccaggactggctcaccgcgctggcgctgaccatgatgggtaatctgatctactacgtctgtctggcgagcgccattcagcgcaccggtgcgccggtgtcgaccatgattatcggcacgctgccggtggtcatcccggttttcgcgaacctgctttacagccagcgtgacggaaaactggcgtggtcaaaaatggcgccggcgctggtctgcattgccgtggggctggtgtgcgtgaatattgccgagcttcgccatggtctggaaaatttcagcgtgtggcgttacggttcagggatctttctggcgtttatttcggttgtctgttgggcctggtatgccctgcgcaacgcacgctggctgcgggaaaacccggataagcatccgatgatgtgggccacggcgcaggcgctggtcaccctccctgtctcgttgctgggctatgtgggcgcgtgtgtctggctgggtagccagcaaccggcatttaccctgcccttcggaccgcgcccgtgggtattcgtcgggttaatggtcgccattgccgtgctctgttcgtgggtgggcgcgctgtgctggaacattgccagccagaagctgccgacggtgatattagggccgctgattgtctttgagacactggccgggctgctctataccttcctgatgcgccagagcgtgccgccgttgctaacggcctgcgggatcgcgctactggtcgttggggtggtgattgcggtgagagcgaagccggaaaaaccgatggtcgttccggcgtcggaggggtga

SEQ ID NO: 784 - DNA, 699 bp, Enterobacter cloacae
aatgcatcttatatttctgatgatgaggtaactgctatggccttccgcgaccaacccttaggcgagctggcgctctccatccctcgcgcttctgcgctgttccgtaaatatgatatggattactgctgcggcggtaagcaaacgctggcgcgcgcagcgtcgcgtaaagagctggatgtagaggctatcgaagcggagctggctcagctggctgaacagcccgtcgacaaagactggcgcactgcgccgctggctgaaatcatcgaccatatcattgtgcgttaccacgatcgtcaccgcgagcagctgccggagctgattttacaggcgaccaaagttgaacgcgttcatgccgataaaccttccgtaccgcgcggcctggcgaaatatctaaccatgctgcacgaagaactttccagccacatgatgaaagaggagcagatcctcttcccgatgatcaaacagggcatgggcagccaggccatggggcccatcagcgtgatggaaagcgaacatgatgacgccggcgaactgctggaagtgattaaacacaccaccgacaacgtcacaccgccgccagaggcgtgcaccacctggaaagccatgtacaacggcattaacgagatgatcgacgatctgatggaacacatcagtcttgagaataacgttctgttcccgcgtgcattagcgggggaataa

SEQ ID NO: 785 - DNA, 417 bp, Enterobacter cloacae
cttttagtaagtacgtacaaaaaggtaagtatgaaaacaacaataccaacgctcagcgagcaaatgcgcgatggcaacctctttgcggaacagtgcccgtcacgggaggtgctcaaacacgtaaccagccgctggggcgtgctgatcctggtggcgttacgtcaggggacgcatcgcttcagcgatctgcgccgcaagatgggcggcgtcagcgagaagatgctggctcagtctttacaggcgctggaacatgacgggtttgtcgatcgcgtgtcgtatccggtcgtgccgccgcatgtggagtatagcctgacgccgctggggcgggaggtaagcgagaaggtggccgcgctggccgactggattgaggtcaatacgccgcaggtgatggcgaatagggacgagcgtgcggcatga

SEQ ID NO: 786 - DNA, 1662 bp, Enterobacter cloacae
aaaaggcaacgcatgtttaaacgtataaaagtcattactcttttgatttcggtgcttcttgtgctcggcatcatgcagctgatctccgctggcattttcattaatgcactcaataacgataaagagaacttcaccgtttctcagctttccagccagaacgtcgctgagtttaccgacgcctggatcagcctgaaccaggcgcgcgtcaccctcaaccgcggcatgctgcgcctgcaaagcagcatggcgtcgcagattaacggcgggcagctgaacgagctggtcaataccgcgaaaaacctgctggccgatgcccagacccattacgataaatactatgcgctgccggaaacgccgggtatggacgagcacctggccgatcgcctggaagagcagtaccgcgtctactccgccacgctgacgcaaatgaacgttctgctggggcagggcaatctggaagatatgttcaaacaaaatgccgaacagaagcagaccgcgatgcaaaaggtttatcgcgagtggcgtgaggcgcaggccgcgctgaccgccaaaggtatccaggacaatgaaagcgactacaaacgcattctgtggatcctttctgcggtgatgctgctggtgatcgcggtgattatttccagctggattgcgatgcgccgcgtgctgctgctgccgctggaagaggtgatcaaccatatccgcgccattgccgcaggggatttaacccagccgattcaggctgagggtaaaaatgaaatggcgatcctggcgcgcaacgttcaggagatgcagactgcgctggccaacacggtgggcgtggtgcgtgaaggcgcagataccatctacaccggcgcgggtgaaatctcggcgggcagcaacgatctctcctcccgtaccgagcagcaggccgcttctctggaagagacggcagccagcatggaacagttaaccgctaccgtgaagcaaaacgccgataacgcgcgtcaggcgtcacgcctggcgctggacgcctcctccaccgcgaagaagggtggtaacgtggtggaaggcgtggtgcggacgatggacgaaatcgccaccagttccagcaaaatcgcgcaaattactaacgtgatcgacggcattgctttccagaccaatattctggcgctgaacgcggcggtagaagcggcgcgcgcgggcgagcagggacgtggcttcgcggttgtcgcgggcgaggtgcgtacccttgcccagcgcagtgcgcaggcggcgaaagagatcaaagcgctgatcgatgattccggcgagcgtgttaacgcgggctctcagctggtgaatgaggcgggcgcgacgatggcggagatcgtcaatgcggttacgcgcgtgacggacatcatgggtgagattgcgtcggcctccgacgaacagagccgcggtatcgaccaggtgggtcaggcggtggcggagatggatcgcgtcacccagcagaatgcctcgctggtggaagagtctgcggcggcggcggcggcgctggaagatcaggctgcacgcctgaacgacgcggtggcagtgtttaagatcacccgcaatcaggcggtgaaagccgcgccggtaaagacctatgcacctaaagcgcagcccgtcgcggcggcgtctgaagcgaactgggaaacgttctga

SEQ ID NO: 787 - DNA, 720 bp, Enterobacter cloacae
gacgacgagcatatggatggatggcagcgcgcctttgtcctgcatagtcgtccctggagcgaaaccagcctgatgctggacgtcttcacggaagagtccggtcgcgtgcgccttgttgccaaaggcgcacgttccagacgttctaatctcaaaggtgccttgcagcctttcaccccactgctggtccgctttggcgggcgaggggaagtcaaaaccctgcgcagtgctgaagccgtttccctcgcgcttcctctttctggtatcacgctctacagcggtttgtacgtcaacgaactcatctcacgggtgcttgaacatgagacccgcttctctgaacttttctttgattacctgcactgtatccagtcgctcgctggcgcaaccggcactcctgagcctgtgctgcgtcgtttcgagctggcgctgctcggtcaccttggatacggtgttgattttctgcactgcgcggggagtggggacgaggtagaagataccatgacctatcgctatcgtgaggaaaagggctttattgccagtgtcgtcgtcgataacagcacctttaccgggcgccagctcagagcactgtatgaacgcgagttcccggacgccgacaccctgcgtgcggcaaaacgctttacccgaattgcgctcaagccgtatcttgggggcaaacctttaaagagccgcgaattattcaggcagtttatgccgaaacgctaa

SEQ ID NO: 788 - DNA, 753 bp, Enterobacter cloacae
acaaaaataccgaggattgtcatggctgaattactgttaggcgtcaacatcgaccacattgccaccctgcgcaacgcgcgtggcacggcgtatccggatccggttcaggcggcgtttatcgccgagcaggctggggcggacggcattaccgtccatctgcgtgaagaccgtcgccacatcaccgatcgcgacgtgcgtatcctgcgccagacgctggataaccgcatgaatctggagatggcagtaacggaagagatgctgacgattgcctgcgatacgaagccgcatttctgctgcctggtgccggaaaaacgacaggaagtgaccaccgaaggcggtctggatgtggccgggcagctcgacaaaatgcgcgatgcctgcaaacgcctggcggatgccggtatcttggtttcactgtttatcgacgccgatttcacccagattaaagccgctgccgacgtgggcgcgccgtatattgaaattcacaccggctgctatgccgatgctgaaaacgacgcagcgcaggcgaaagagctggagcggatcgccaaagcggcaacctacgccgcgagcctgggactgaaggttaacgccggtcacggcctgacctatcacaacgtaaaagccatcgctgccctgccggaaatgcacgagctgaacatcggccacgctatcattggccgtgcggtgatgagcggtctgaaagacgcggtttccgagatgaagcgtctgatgctggaagcgcgtcagtaa

SEQ ID NO: 789 - DNA, 435 bp, Enterobacter cloacae
agacgtctgaacgttgataccatcgcgggcatcgtgcgcaagcatctgccggaagcgactcatcacttccctgaagactacatcaccgatcgctctcagcgttttatggcgtctgaaatcatccgtgagaagctgatgcgtttcctgggcgctgaactgccgtactctgtgacggtggagatcgagcgtttccagagcaacgagcgcggcggttacgatattaacggtctgatcctcgttgagcgtgaagggcagaagaagatggtgatcggtaataaaggcgccaagatcaaaactatcggaatcgaagcccgtaaagacatgcaggacatgtttgaagcaccggttcacctggaactgtgggtgaaagtgaaatctggctgggccgatgatgagcgtgcgctgcgcagcctcggttacggcgaagatcagtaa

SEQ ID NO: 790 - DNA, 936 bp, Enterobacter cloacae
tgcgtttattatgaattaaaaattccagaggtaaataacatgaatctaggctctcttgtttctgaaacgcgtaacccgcaaaccatggatcttgatgcactgtccacgctggagctggtaaaccgctttaatcaacaggataccctcgtcgcgctggcagtcaaagagacattgcccgaggtggcgaaagccgtagacgccgctgccgacgctctgaaagcaggaggacgcattatttatatgggggcgggtaccagtgggcgcctcggtgtgctggatgcctcagaatgtcccccgacgtttggcgttccgcacggtctggtcgttggcctgattgccggtggccccggcgcgctgctgaaagcggtggaaggggcagaagataataaacagcttggggaggacgatctcagggcgctgaacctgaccgcgcaggatctggtcgtcgggctggcggcttctggtcgtacgccgtacgtcattggtgggctggaatacgccagacagacgggatgtaccacggtggccatctcctgtaacccgggttcgccgattgcgcaggtggccgccattgccatctctccggtcgtcgggccggaagcgctcaccggctccacgcgcctgaaatccggaaccgcacagaagctggtgctcaatatgatctccaccggcgcgatggtgaaatttggcaaggtctaccaaaacctgatggtggatatgcaggccaccaacgtcaagctggtggacagagcctgccgcatggtgatggaagcgacaggcgccagtcgtgaagaggcggaaaaggtgcttcagcagaccgatcacgatgtaaaacccgccattctgatgatattaaccgggctggatgcagccgcggccagagccaggcttgaagcccatcacgggtttttacgggcggcattagaacatcaataa

SEQ ID NO: 791 - DNA, 1374 bp, Enterobacter cloacae
gaggcgtttatggacaaaacagcagcgctcgccagcgacatcctgcttgggatcggtggggaaaaaaatattcagcgtctggaaaactgcatgacgcgtgtacgcgtcgaggtgtacaacgacgaaaagcttgatttaacgcgcctgaagcagctccccggcgtgagcgggtacgttaaacaggggcaacagcaccagctgattgtcggtccgggcaaagcggcgcaggtggttgatgccatgcgcgccctgatgacgggcggtgaaacggctcccgcctttgacgacgcggaacgcaccaaagcgcaggcgaaagccaaatacaaagcccccatgagcgatgcgctgcgccagctggcaaacgtctttattcctcttatcccggcgtttatcgcgtcggggctgatcaccgggattatcaatatcctcaagcgtccggatattgtcgggaatttcgccacccagtatccgaacctgctgggtattctggcgattttcggcagcgcggtgtttgccatcatgaatattctggtgggggtgaacacggccaaagtgttcggcggctcgctggcgatgggcggcgtaatggcgggtatcctctccagcccgcagctggcgcagattacgctgtttggcgaggcgcttcagcctggccgcggtggggtgattgccgtgctgctggtggtcattctgatgtgctggattgagaaaaagctacgcgagttgctgccaggctcgattgaactgatcctcaacccgctgctgaccacattgattaccgggagcgtggcgattgtggcgctgcaaccgttaggcggcgcgatctctgaagccatcgcccacggcgcgtctctggcgatcgatcgcggcgggctgctggtgggggccgtgctgtccgggaccttcctgccgttagtgctgaccggtctgcatcaggggctggtgccgattcacgtcgaactggtacaggcgcacggctataacgccctgctgccgatcctgtcgatggctggcgttgggcaggtcggcgcggccatcgcggtgctgatgaaaacccgcaacgcgcgtttaaaaaaggtcattaaaggggcgctgccggtcgggttgctcggtatcggcgagccgctgattttcggcgtgaccttgccgctgggtaagccgttcctggccgcctgtctcggtggggcggtgggcggggcgttaatcagctactggaaagtggcgaccgtcattaccttcgggatctccgggttaccgctggcattaaccatcgtgaccggaaaagtgatgctctatctgttaggctatctggtagcggtgatcgccgggttcctgtttacctggctgttaggattcaacgacccagaggagtaa

SEQ ID NO: 792 - DNA, 639 bp, Enterobacter cloacae
ggtttggccagtcacgagcgtcgcgttgtcttttttgatctggatggaacgctgcatcagcaggatatgttcggcacctttatgcgctacctgctacggcgccagccccttaacgcgttgctggtattacccctgttacccgttattggcatcgcgctgctggtgaaaggccgtgcagcgcgctggccgatgagcctgctgctctggggatgcacgtttggtcatagcgaagcgcgcctcaagcagctcgaacaggattttgcgcactggtttcgcgggcacgtcgccgcgtttcccgtggtacaggcgcgcctgaccagctatctcgacgccaatgatgccgatatctggctgattactggctccccgcagacgctggtggagcaagtctattttgatacgccctggctgccgcgcgtaaatcttatcgccacgcagatcgcgcgcggctacggcggctgggtgctcaccctgcgctgcctcggacatgaaaaagtggtgcagctggagaaacgcatcggtacgccgctgcgtctttacagcggctacagcgacagcaagcaggacaacccgctgctctatttttgccagcaccgctggcgcgtcacgcctctgggcgaacttcagcaactcgaatag

SEQ ID NO: 793 - DNA, 564 bp, Enterobacter cloacae
tcttatctgtaccggctgtgtataatgccgcccgcttttcgactggagtatcagcccttgtccaaccctgaacacaatcatgaatactggatgcgccatgcgctggcgctggctcagcgcgcctgggaagagggcgaagtgcccgtgggcgcggtactggtccataacaatcaggtgattggggaagggtggaaccgtccgattggccgtcacgatcctaccgcgcatgctgaaattatggcgctgcgtcagggcggactggtgctgcaaaactatcgtctgcttgataccaccctgtatgtcacccttgagccgtgcgtaatgtgctccggggcgatggtgcacagccgaatcggtacgctggtgtttggcgcgcgggatgaaaagacgggcgctgctggttcactgatggacgtacttgggcatccggggatgaaccaccaggtgaaaactatcggcggggtacttgcaccagaatgttcgggtctgttaagtgacttttttcgaatgcgtcggcagcagaaaaagcaacaaaaggcagaattgaaaccgcagggtgattaa

SEQ ID NO: 794 - DNA, 543 bp, Enterobacter cloacae
cgccggtcacggcctgacctatcacaacgtaaaagccatcgctgccctgccggaaatgcacgagctgaacatcggccacgctatcattggccgtgcggtgatgagcggtctgaaagacgcggtttccgagatgaagcgtctgatgctggaagcgcgtcagtaatggctattctgggcttaggcaccgacatcgttgaaacagcccgcattgaagcggtgatcgcccggagcggcgatcgcctcgcaagacgcgtgctgagcgataacgaatgggctatctgggaggcgcatcagcagccggtgcgctttctggcaaaacgtttcgcggtaaaagaggcggcggcgaaagcgttcggcacgggcattcgtaacggcctggcgtttaaccagtttgaagtgtttaacgatgagctgggtaagccacgtctgcgtttatggggcgaggcgcttaagctggcggaaaagctgggcgtggcgcacatgcacgtaacgcttgcagatgaacgccactacgcctgtgcgacggtgattatcgaaggttaa

SEQ ID NO: 795 - DNA, 288 bp, Enterobacter cloacae
tgcagaccggtcagcactaacggcaggaaggtcccggacagcacggcccccaccagcagcccgccgcgatcgatcgccagagacgcgccgtgggcgatggcttcagagatcgcgccgcctaacggttgcagcgccacaatcgccacgctcccggtaatcaatgtggtcagcagcgggttgaggatcagttcaatcgagcctggcagcaactcgcgtagctttttctcaatccagcacatcagaatgaccaccagcagcacggcaatcaccccaccgcggccaggctga

SEQ ID NO: 796 - DNA, 891 bp, Enterobacter cloacae
ttcgtatttgcgcgggtaatcacattttcgccaggagaccgtatgaactgtttaattcgtattcgccagcgctacgcagggtttgcccagagtgacaaaaagctggcggattatttactttcccagcccgatcgcgcgcgacacctcagctcccagcagctggcaggcgaagccggggtgagccagtcgagcgtggtgaaatttgcccaaaagataggctataaaggctttccggcgctaaaactggcgatcagtgaagcactggtaagcaaccctaatccgcagtcaatgccggtgcataaccagatccgcggcgacgatccgatgcgtctggtcggcgaaaagctgatcaaagagaacgtggcggcaatgcatgccacgctggatgtgaacacggaagagaagctgctggaaagcgtagccatgcttcgcgacgcgcggcgtattgtattgaccgggatcggtgcctccggactggttgcgcgtaactttggctggaagctgacaaaaatcggctataacgccatcgttgaacaggatatgcacgcgctgctggcgaccgtgcaggccatggatcctgacgatttactgctggccatctcctattccggcgagcgccgtgaaattaatatggctaccgacgaagccctgcgtgtaggaggaaaaattctggccattactggcttcagcccgaatgcgctccagcagcgggccacccgctgtctgtataccatcgccgaggaacaggccactcgcagcgcggcgatttcgtcgacgagtgcgcagatgatgctgacggacctgctgtttatggcgctggttcagcaggatctggagcgtgcgccagagcgtattcgtcacagcgaagagctggtaaaaaaactggtttga

SEQ ID NO: 797 - DNA, 819 bp, Enterobacter cloacae
  unsure (12)
  unsure (16)
  unsure (18)
  unsure (23)
  unsure (33)
gctaccgtgagngaananattgngtctttgaanaaagaccctgtgcgtctggaagagaaatatctcggtcacggggacgattttgattacgttgacacccgcaccttcctgcgcgcggtggacagcgtgctgccggacctgcaaccgctgtttgagaagtacgcccaggagattgactggaagctgctggcggcaatttcctaccaggaatcgcactgggatgctcaggccacctcccccacgggcgtgcgcgggttgatgatgctcaccaaaaataccgcccagagcctcggcatcagcgaccggaccgatgcggaacagagcatcagcggcggcgcgcagtatttacaggatatgatggcgaaagtgccggagacggtcccggaaggggagcggatctggtttgcgctagccgcctataacatggggtatgcgcatatgctcgacgcgcgggcgctgacggcgaaaaccaaaggtaacccggacagttggtcagatgtaaaacagcgcctgccgctgcttagccagaaacagtggtaccagaagctgacgtatggctatgcgcgcggccatgaagcgtatgcctacgtggaaaatattcgtaagtatcagataagcctggtgggatatctgctggagaaagaaaaagaggcggccgaggcgcaacagctggctgaaagctatccggtggtcgcaccggaagagcttaatcaccctgcggtttcaattctgccttttgttgctttttctgctgccgacgcattcgaaaaaagtcacttaacagacccgaacattctggtgcaagtaccccgccgatag

SEQ ID NO: 798 - DNA, 306 bp, Enterobacter cloacae
gcgtataatgcccgccctgtttgtgatgtttctgagaatttcctgatggcgctgttaatcaccaaaaaatgcatcaactgcgatatgtgcgaacccgaatgcccgaacgaggcgatttcgatgggcgacagcatttatgagattaacagcgaccgctgcaccgagtgcattggccactatgagacgccgacctgccagaaggtgtgccccattcccaatacgatcttaaaagatccggcacatgtcgagaacgaagaacagctgtgggataagtttgtcctgatgcaccatgcggacaaaatttaa

SEQ ID NO: 799 - DNA, 1548 bp, Enterobacter cloacae
cagaacgcagattttttcggaacaaatctcgcaaatttcttgcctgacggtgctttttgttcggactgctcaccccaatcgtttaccatagagacgtcaacttttaacaggatgagattactggtgtctgactctgccgcgcgcccgacttttttgttccatgattacgaaacctttggcacccatccggcgctggaccgaccggcgcagtttgcggctatccgtaccgatgacgaatttaacgtcatcggcgaacccgaggtgttttactgtaagcccgccgatgactatctgccgcagccgggcgcggtgatggtgacgggcatcacgcctcaggaagcgcgggataaaggcgttagcgaagcagaatttgcccgtcgcatccacgacctgttcacggtgcccaatacctgcgtggtgggttacaacaacatccgttttgacgatgaagtgacgcgcaatatcttctaccgcaacttctacgatccgtacgcctggagctggcagaaccgtaattcacgctgggatttgctggatatcatgcgcgcctgctatgcgctgcgcccggaggggattaactggcgggagaatgacgacggcttgccgagcttcaggctcgagcacctgacgcgggccaacggcattgagcacagcaatgcccacgacgcgatggcagacgtttacgcgaccatcgcaatggcgaaacttgtaaaaaccgcgcagccgcgcctgtttgagtatctgttgagccatcgcagcaagcaaaagctgatgacgctgattgacgtgccgcagatgaaaccgctggtgcatatttcagggatgttcggcgcgtggcgcgggaacacaagctgggtggcgccgcttgcctggcatccggacaaccgtaacgccgtcatcatggtggatcttgccggagatatctccccgctgcttgagctcgacagcgacaccttacgtgaacggctctatacgccgaaagaggcgctgggtgacctgccagccgtaccggtaaaactggtgcacattaataagtgcccggtgctggcgcaggccaacacgctacgcccggaagacgccgaccggctggggattaaccgtcagcactgcctcgataacctgaaagtgctgcgcgacaacccgcaggtgcgcgagaaagtcgtcgccatttttgccgaagcagagccgttcgtgccgtctgagaatgtggatgcgcagctttataacggcttcttcagcgacgccgatcgcgcggcgatgaatatcgtgctgcaaaccgacccgcgtaacctgcccgcgctggatatcaccttcgcagataagcgcattgagaagctgatgtttaattatcgcgcgcgcaactatcccggcacgctggatgaagcagagcaggagcgctggttacagcatcggcgcagcgtgtttacgccggagtttcttaatagctacgcccaggagctggagatgctttacggtcagtatgaagggaatgctgagaagcaggcgctgctgaaagcgctgttccagtatgcgcaagagattgtctga

SEQ ID NO: 800 - DNA, 1167 bp, Enterobacter cloacae
agcacaaagtgggataatcctgcgaaacgcagggtttttcagccgggcgcgatccacccggctgaaaacacagtacaattgtggtttgccgtagagctggagacgggtgtgcgccccgacaagtcattaaccccttttgaaattcggttatacaaacattatcgcgtggtgcacggttgccgcattgcgctggcgtttgtgttgaccttcgtactggttcgtttgctggatatcccggaagggacgtggccgctgatcacgctggtggtggtgatggggccgatctcattctgggggaacgtggtcccgcgcgctttcgaacgtataggcggtaccgttttaggctcagcgcttgggcttatcgccctgaagctggagctgatttcatttccgttcatgttgctgtggtgcgcggtggcgatgtttctttgcggatggctgaccctcggcaagaaaccgtatcaggcgctgctgattggcattacgctcgcggttgtggtcggcgcacctgcgggcgatatgaccaccgcattgtggcgaagcggggacgtgatcctcggctcgttgctcgccatgctgtttaccggcatctggccgcagcgcgccttcctgcactggcgcattcagatggcaaactacgtcacggcatttaaccgggtctaccaggccgggttttcgccgaatctgattgagcgtccgcggctggaaaagcatctgcaaaaaatcctcaatgatgtggtcaaaatgcgcgggttaattacgccagcaagcaaagaaacccatatccagaaagccatctttgaagctattcagacggtcagccgtaatctggtctgtatgcttgaactgcaaatcaatgcccactgggcctcacgccccagccatcttctgatgctcaacgcgcatacgctgaaagagacgcagcagatgacgcaacaaaccctgctgaccatcgctcatgcgctctatgaaggtaacccgcagccaatacgggcgaacagcgagcggctgaacgaaatcgtcgccgagctcaaacagctgatgaatgagcgccagggcgacaatgtggcggaaacgcccatccatggttatgtctggctgagtatggagctggcgcggcagctggagttgttatcgcagctgatttgccgggctctgcgcaaataa

SEQ ID NO: 801 - DNA, 384 bp, Enterobacter cloacae
aacggttgctttaacgaatccgaatctcacattatcaggggtgtaaaaatggaaactaccaagccttcgttccaggatgttctggagttcgtccgcctgttccgccgcaaaaacaagctacagcgcgaaatccaggacgtagagaagaagatccgtgacaaccagaaacgtgtcctgctgctggacaacctgagcgactacatcaagccaggtatgagcgttgaagctattcagggcatcatcgccagcatgaagagcgattatgaagatcgcgttgatgactacatcatcaaaaacgctgagctgtccaaagagcgtcgcgacatctccaagaagctgaaagtgatgggcgaaatcaaaaacgtcgacgcgaaaggcgagtaa

SEQ ID NO: 802 - DNA, 930 bp, Enterobacter cloacae
  unsure (100)
aaccgcctgctggatgttctgattattcctggaggcgctggaaaaaggaggggagcttgcccgccgcatagggcgaagctctataaaacccgttcggttntgagctacaccgtgcaaaagctcgagagcgatgttaatatccaaatcgttgaccgcaccgggcatcgcgcgcgtttcacccgtacagggcagatgctgttggaaaaagggcgtgacgtgctgcatacggttcgcgagctggataaacaggccgttaagtttcaccaggtctgggaaaatgagctggtgattggggttgatgatacattccctttgtccgtgcttaccccgctcattgaggcgttctatcagcgccacagcgtcacccggctggtttttatcaatggcgtgctgggcggtttctgggaggccctgacgcagggcagggcggatatcatcgttggcgcggtgcatgagcctccccagttgagcgaatttggttttgcgcggctgggtgttctggagcaggtttttgccgttgcgcctcatcacccgctggcgaatgaaccggagccggttacccgacgcgtcattaaaaactatcgtgccattgtggttggagacagttctcgccccgagtgcggcatttcatcgcagatgctggatgagcaggaggccatcaccgtttttgattttaaaaccaagctggagctgcaaataagcggcctggggtgcggttaccttccccgttatttagcgcagcggtttattgacagcggagcgctggtggaaaaacaagttttagcgcagagcagtaacgaatcggtatgggtgggctggaatgaacagaccgccgggcttgccagcgcctggtggcgagacgaaattttagcaaatagtgctatcgcgacagtttacactcaggcagatgatggtaaatcaaccagttag

SEQ ID NO: 803 - DNA, 1182 bp, Enterobacter cloacae
cctgaggatataccgttgaaacgccgtctgtttattgctgtttctttactcgcttcgagtatttcatccgcgctggctgccgagccgctggatttttcacctcagccgcctgccatccaggctggctcctgggtattgatggattacaccacgggtcaaatcttaacggcgggcaacgaacatcagcagcgcaatccggcgagcctgaccaaacttatgacggggtacgttgtcgatcgcgccattgatagccaccgcatcagccccgatgacattgtgacggtcggacgtgacgcctgggcaaaaggcaattcggtctttgacggttcgtcgctgatgtttctgaaggaaggcgatcgggtttccgtgcgcgatctcagccgcggcctgattgttgattccggcaatgatgcctgcgtggcgctggcggatcacgtggcgggcggtcagccgcagttcgtcaggatgatgaatgactatgttgaaaaactgaacctgcgcgatacccacttcgaaaccgtacacgggctggatgcaccgggtcagcacagctccgcctacgatctcgccgtgctttcccgggccatcattcacggcgagcctgagttctaccacatgtacagcgagaagagcctgacctggaacggcatcacccagcagaaccgcaacggcctgctgtgggataagaccatgaacgtggatggcctgaaaacgggacacacctcgggcgcgggctttaacctgattgcctcagcggtggacggtcagcgtcgactgattgcggtggtgatgggggcagacaccccgaaaggacgtgaagatcaggcgcgcaagctgctgcactggggacagcaaaattttgatacggtgcagatcctgcataacggtaaaaaagtgggaaccgagcgcatctggtacggcgataaagagcagatcgcgctgggcacggatcaggacttctggctggcattacccaaatcggaagtgccgaacatcaaggcgaaatacgtgatggataaaaaagagctggaagcgccgatcgccgcgcatcagcgggtaggggagatccagctgtacgatcgtgacaaggtggtcgcgcactggccattggttacgctggaaagcgttgaaaagggtgggcttttctcccgtcttggcgattatctgcatcataaactctga

SEQ ID NO: 804 - DNA, 1371 bp, Enterobacter cloacae
aggagaataactatgtcgcataacgcaactccaaacacctctcgcgtggaattacgtaaaacgcttacgttgattccggttgtcatgatgggccttgcctatatgcaaccgatgacgctgttcgatacattcggtatcgtttcaggcctcacggacggtcatgtgccgacggcttacggctttgcactgattgcgatcctctttaccgcgctcagctacggtaaactggtgcgccgttatccgtctgccggttccgcctacacctatgcccagaaatccatcagcccgacggtaggctttatggtgggctggtcttcgctgctcgactatctattcgcgccgatgatcaacattctgctggcaaaaatttattttgaagcgctggtgccatcgattccatcctggatgttcgtcgtggcgctggtggcctttatgacggccttcaaccttcgcagcatcaagtccgttgccaactttaactccgttatcgttgtgcttcaggttgtactgattgccgtgatcctcggcatggtgatttacggtgtgttccacggtgaaggcgcgggcactctggcgagcagcaagccgttctggtctggtgatgcgcatgtgatcccgatgattaccggggcgacgattctgtgcttctcctttaccggttttgatggtatcagcaacctgtctgaagaaacgaaagatgcagagcgcgtaattccgcgtgcaatcttcctgacggcgctgattggtggcctgatctttattttctcgacctatttcctccagctgtacttcccggatatctctcgcttcaaagatccggatgcttctcagccggaaattatgctctatgtggcgggtaaagcgttccaggtcggcgcgctgatcttctccaccatcaccgtactggcgtccggtatggccgcgcatgcaggcgttgcgcgtctgatgtacgttatgggccgcgatggcgtattcccgaaaagcttcttcggctacgtgcatccaacttggcgtaccccggcgatgaacatcattctggtcggtgcgatcgcgcttctggcgattaactttgacctggtgatggcaacggcgctgattaactttggtgcgctggtggcgtttacctttgttaacctgtcggtgatctctcagttctggatccgtgaaaagcgtaacaagacgctgaaagaccacttccagtatctgttcctgccgatgtgtggtgctatgaccgtgggcgcgctgtgggttaacctggaagagagctcaatggtgcttggcctgatttgggcaggtatcggcctggtttacctggcctgtgtgacgaagagcttccgcaacccggttcctcagtacgaagacgtcgcgtaa

SEQ ID NO: 805 - DNA, 525 bp, Enterobacter cloacae
tctcgattctgctttacagtgtatatatatacagtaataaacggaggcagcatggactacagcatcaggcagcaacagaaacgtacgattgcaggctttcatctcgtggggccgtgggaaaagacggtcaagcagggatttgaacagctggtcatgtgggtagatggtcgtcatattcagccgcaggagtgggtggccgtttattatgacaatccggatgacgtgccggcagaaaagctccgctgcgttaccgccgtaacggtagtagacgttttcactattcctgaaaacagcgaaggggtgatgatgaccgaaattgctgccggagagtatgctattgccgccgcgcgcgttgaaaatcatgatttcgctactccatggtatcagttcttcaactccctgctggaagacagcaaattccagattgcagcaaaaccctgcttcgaacgctatctgaacgatggcaatgctgacggctactgggatattgagatgtttgtaccggtagagcacaaagtgggataa

SEQ ID NO: 806 - DNA, 195 bp, Enterobacter cloacae
tcaaagaaccatctgatgatgaagctgaactccggaatgagctgcgatttttgccagtcttcacttttggagaacccggtaaaggtatccaggaagaacaggatcgcggccacaatgagcacgcctcgcaacgcgccgaaacagatgccgagcaccctgtccgttcctgacagaccggttttctcgaccagctga

SEQ ID NO: 807 - DNA, 819 bp, Enterobacter cloacae
gctaaaaggttcgcttggcgagctgaagcaaatctccggcctgagcggtgtggtgatgaactacagcgccaactgatagaaattatcccctcaccatggccctctccccaaaggggcgaggggtcggtttactccctctcccttgagggagagggccgaggtgagggggaggcagacgttcacagaaacgtcaacggtgcggtggcgttgagcattttttcagcgccttttttatttacgcgtgggaaggaaatccctacgcaaacgttttctttttctgttagaattcgccccgaactggatgacagggcgtttaatcgtgggacacatatggtctggattgattacgccatcattgcggtgattggtttttcctgtctggttagcctgatccgtggctttgttcgtgaagcgttatcgctggtaacctggggttgtgctttctttgttgccagtcattactacacttacctgtctgtctggttcacgggctttgaagatgaactggtccgaaacggaatcgccatcgcggtgctgtttatcgcgacgttgattgtcggcgctatcgtcaattacgtgataggtcagctggtcgagaaaaccggtctgtcaggaacggacagggtgctcggcatctgtttcggcgcgttgcgaggcgtgctcattgtggccgcgatcctgttcttcctggatacctttaccgggttctccaaaagtgaagactggcaaaaatcgcagctcattccggagttcagcttcatcatcagatggttctttgactatctgcaaagctcgtcgagtttcttgcccagggcataa

SEQ ID NO: 808 - DNA, 1551 bp, Enterobacter cloacae
accctgagatgtggcttaacgaggaaaagacgaatgtgcggtattgtcggtatcgccggtttcatgccggtaaaccagtcgatttatgacgcgttaacggtgcttcagcaccgtgggcaggatgctgcgggtatcatcaccattgatgcaaacaactgcttccgtttacgcaaggcgaacggcctggtaaacgatgtatttgaagcccgccatatgcagcgtctgcaaggtaatatggggatcggtcacgttcgttatcctactgctggcagttccagcgcctctgaggctcagcctttttacgttaactccccgtatggcatcacgcttgcccacaatggcaatctgaccaatgcccacgagctgcgtaaaaagctgtttgaagagaaacgtcgccacattaacaccacctctgattctgaaatcctgctcaatatctttgccagcgagctggataacttccgccattatccgctggaagcagacaacatttttgctgccgttgccgcgactaatcgccagatccgtggcgcgtatgcttgcgtggcgatgatcatcggtcatggcatggtagccttccgcgatccaaacggcattcgcccgctggtgctcggcaaacgtgatctcggcgatggccgttccgagtacatggttgcctccgaaagcgtggcgctggatactctgggcttcgaattcctgcgtgatgtcgcgccaggcgaagcggtctacatcactgagaagggccagctgtttacccgtcagtgcgccgacaatccggtgagcaacccgtgcctgttcgaatacgtttacttcgcgcgtccggactcgttcatcgacaagatttccgtttacagcgcgcgcgtcaatatggggacgaagctgggcgagaagattgcccgcgagtgggacgatctcgacatcgacgtcgtcatcccaatccctgaaacctcctgtgatatcgcgctggagattgcccgtattctggacaagccgtaccgtcagggcttcgtgaaaaaccgctacgtgggccgcacctttatcatgccgggccagcagctgcgtcgtaagtcagtacgtcgtaagctgaacgctaaccgcgccgagttccgcgacaagaacgtgctgctggtggacgactctattgtgcgcggcacgacgtctgagcagatcatcgagatggcgcgtgaggccggggcgaagaaagtgtatcttgcctccgcagcgccggaaattcgcttcccgaacgtgtatggcattgatatgccaaccgctaacgagctgattgctcacggtcgtgaagtagacgaaatccggcagatcatcggtgccgacggtctgattttccaggatctgaacgatctgatcgacgcggtgcgcgccgagaacccggatattcagcagttcgaatgctcagtattcaatgggatctacgtgacgaaagacgttgaccagcagtatctcgactatctggattctctgcgtaacgacgatgcgaaagccgtccagctgcaaaacgatctcgaaagcttagagatgcacaacgaaggttga

SEQ ID NO: 809 - DNA, 759 bp, Enterobacter cloacae
cgtgcggcccctcccgttccgggaggggaaaagacacggttccaccactcacgagacgacagggcacgcggtatgctgtacggattttctggcgttattttacagggcgcgcttgtcacccttgagctggctatcagctccgtggtgctggcggtgctgataggcctggcgggcgcgggggcaaaattatccgccaacagaccgctggcgctgatatttgaaggctataccacgctgattcgcggcgtgccagacctggtgctgatgctgctgatcttttacggcctgcaaatcgcacttaacggcgtaacggatgccatcggcatggagcagatcgatatcgacccgatggtggccggtattattacccttggttttatctacggtgcctatttcactgagactttccgcggcgcttacatggccgtgccgaaagggcatattgaagcggcgaccgcctacggttttacctcctcacaaacgtttcgccggatcatgttcccggccatgatgcgctacgcgctgccgggcatcgggaacaactggcaggttattctcaaggcaacggcgctggtctccctgctgggtctggaagatgtggtgaaggccacgcagctggcaggtaaaagcacctgggaaccgttctattttgcggtggtttgcggcctaatctatctggtctttacgaccgtctccaatggtgtgctgcttctgcttgaacgtcgctactccgtgggtgtgaagagggctgacctgtga

SEQ ID NO: 810 - DNA, 464 bp, Enterobacter cloacae
gccggccagggaagacagccgcgcggtcgttggatccttcgggcctggggacgaacaataacatcgagattgatccggtgccggaagaacagcataagcctgttgagaagccgaaaccggtggagaagccgcagccgaaaccgcagcgggataaagcggccgagcaactggcagccgcttcagaaacgccaccgcaggcaaaacaggacgcggcccctaccggcaaagcatatgtcgttcagctcggtgcgttgaaaaatgcagataaggtcaatgagatcgtgagtaaactgcgcggcgcgggataccgtgtttatacttcacccaccacgccggtacagggtaaaattacgcgtatcctcgtggggccggatgcgtcgaaagataagctaaaaggttcgcttggcgagctgaagcaaatctccggcctgagcggtgtggtgatgaactacagcgccaactga

SEQ ID NO: 811 - DNA, 987 bp, Enterobacter cloacae
ttcgctttttccttttttctctttccggttcgttcggcagacctgctatctttcaccattaaggcagtatcgcaacgttttattaacatatttaacgtcgtagttttatcccgacgacaatgtggcataagacctgcaagagcagcctgcaacacaacacacaacataaaccataataaaatcacggttcttgagggtaaatgtatgaagaagacggttctggctctgtctttgctcgtgggcttgagtgcggcagcaagtagctatgcagcgcttccacagacagttcgtatcggtacagacgcaacctacgcgccattctcctccaaggatgcgaaaggcgacttcgtggggtttgatatcgatctgggaaatgagatgtgcaaacgcctggaagtgaaatgcacatgggtgggcagtgactttgacgcgctgatcccgtcgctgaaagccaagaaaattgatgccattatctcttctctctccatcacggaaaaacgtcagcaggagattgccttctctgagaagctctacgctgccgactcacgtctgattgccgcgaaaggctcgccaatccagccgaccatcgactcgctgaaaggcaaacatgttggcgtgcttcagggctcgacccaggaaggtttcgccaatgcaaactggcgcgagaagggcgtcgatgtggtggcttaccagaaccaggatctgatctactctgacctggcggcaggccgtctggatgccgcgtttcaggatgaagtcgccgcgagcgaaggcttcctgaaacagcctgcgggtaaagagtacgcctttgccggcccgtcggtaaaagacaaaaaatactttggcgacggtaccggtattggcctgcgtaaggatgataccgagctgaaagccgccttcgacaaagcgtttaatgagctgcgtaaagacggtacctacgacaaactggcgaagaaatacttcaatttcaacgtctacggtgattaa

SEQ ID NO: 812 - DNA, 216 bp, Enterobacter cloacae
actggtccgaaacggaatcgccatcgcggtgctgtttatcgcgacgttgattgtcggcgctatcgtcaattacgtgataggtcagctggtcgagaaaaccggtctgtcaggaacggacagggtgctcggcatctgtttcggcgcgttgcgaggcgtgctcattgtggccgcgatcctgttcttcctggatacctttaccgggttctccaaaagtga

SEQ ID NO: 813 - DNA, 612 bp, Enterobacter cloacae
aatcctgcacagtctgccctgaaatcagcaagggcgaaaatcatgaaacgactcattgtagggatcagcggtgccagcggcgcgatttatggcgtccggctgttacaggtgctgcgtgacgttgcaggcgtagaaacccatctggtgatgagccaggcggcgcgtcagaccctctctcttgaaaccgatctctctctgcgcgacgttcaggccctgtctgacgttgtccacgatgcccgcgatatcgccgccagcatctcttcgggctcgtttaaaacggccggcatggttattttgccctgttcgattaaaaccctttccggcattgtaaacagctataccgacacgctggtgacgcgtgcagcggatgtggtgctgaaagagcgtcgtcctctggtgctctgcgtgcgggaaacgccgctgcacctgggacatctgcgtttaatgacgcaggcagccgaactgggggccgtgattatgccgccggtccccgcgttctatcatcgtccgcaaacgctggatgatgtcatcaaccagaccgttaaccgcgtgctggatcagttcgatatcgacctgccggaagatctctttacccgctggcagggggcgtga

SEQ ID NO: 814 - DNA, 804 bp, Enterobacter cloacae
gacagtttgttgaggacagatatgaaaaaactggtgttgtcactttctctggtactggctttttccagcgccaccgcggcattcgcagcaattccgcagaaaattcgtattggaactgacccaacctatgcacctttcgaatcgaagaatgcgaagggagaactggtcggttttgacatcgatctggctaacgagctgtgcaaacgcattaaagtgcaatgtacctacgttgaaaacccgctggatgcgctgatcccgtccctgaaagcgaagaaaattgacgtgatcatgtcctccctgtccatcactgaaaaacgtcagcaggagattgccttcacggacaaactctacgcggcggactcacgtctggtggtggcgaaatcctctgacattcagccaacccttgaatctctgaaaggcaaacgcgtgggcgtgttgcagggtactacgcaggaaacctacggcaacgagcactgggcgccaaaggggattgaaattgtctcttaccagggccaggaaaacatctacgcagacctgacggcaggccgcattgatgcagcattccaggatgaagtggcggcaagcgaaggtttcctgaaacagcctgtgggtaaagattacaagttcggcggtccgtccattaaggacgaaaaactctttggcgttggcaccggtatgggcctgcgtaaagaagacaacgaactgcgtgaagccctgaacaaagcgttcgccgagatgcgcgcggacggcacctatgacaagctggcgaaaaagtacttcgattttaatgtttacggcggctaa

SEQ ID NO: 815 - DNA, 717 bp, Enterobacter cloacae
cctgtgattgagattattcaggagtactggaaatccctgctttggacggatggctaccgctttactggcgtggcgatcacgctgtggctgctgatctcctcggtggtaatgggcggcattctggcggtgtttcttgccattggccgcgtgtcgaacaataaatttattcagttccctatctggctgttcacctacgtgtttcgcggtacgccgctgtacgtacagctgctggtgttctattccgggatgtacacgcttgagatcgtaaaaggcactgaaatgctgaatgcgttcttccgcagcggtctgaactgtacggtgctggcgctgaccctcaatacctgcgcctataccaccgagatcttcgccggggccatccgttctgtgccgcacggtgagatcgaggcggcgcgcgcgtacggcttctcgtccgtgaagctctaccgctgtattattctgccttcggcgctgcgtattgcgctgccggcctacagcaacgaagtgattttaatgctgcattcgacggcactggcgtttaccgccacggtaccggatctgttaaagattgcccgcgatattaactctgccacctaccagccgtttacggcgtttggcattgcggcagtgctctatttgatcatttcttacgtcctgatcagcctgttccgtaaggctgaaaaacgctggttgcagcatataaaaccgtcgacgcactga

SEQ ID NO: 816 - DNA, 927 bp, Enterobacter cloacae
ttatacctaagcgcggcacctgccagcctccgtggtgaagacctgcaaaagcgactgcgccgtaacgtgggcgaagccattgcagacttcaacatgattgaagaaggcgatcgcatcatggtctgcctgtcgggcggtaaagacagctacaccatgctggagatcctgcgtaatctacagcaaagcgcaccggtgaacttttccctggtcgcggttaacctcgatcagaaacaacctggcttcccggagcatatcctgccggagtaccttgataacctgggcgttgagtacaaaatcgtagaagagaatacctacggcattgttaaagagaagatcccagagggcaaaacgacctgctcgctctgctcacgtttgcgtcgcggcattctgtaccgcaccgcaaccgaactgggtgccaccaagattgcgcttggccatcaccgggacgacattctgcaaacgctgtttctgaatatgttctacggcggcaaaatgaagggaatgccaccgaagctgatgagcgacgacggcaaacacatcgtgatccgcccacttgcctactgccgcgagaaagacattgagcgtttctctcaggccaaagccttccctatcattccgtgcaatctgtgcggctcacagccgaacctgcaacgtcaggtcattggcgacatgctgcgtgactgggataaacgctatccgggccgcatcgaaaccatgttcagcgccatgcagaacgtggtgccttcgcacctcgccgacgttgaactgttcgatttcaaagggattaaccacggttcagaagtggtgaatggcggggatctggcgtttgatcgcgaagagatcccgatgcagcctgctggctggcagccagaggaagaggatgcgcaattcgatgaactgcgcctgaacgtggtagaagtcaagtaa

SEQ ID NO: 817 - DNA, 1164 bp, Enterobacter cloacae
tgccaaccaaaatataatgccccaggaaaacgtatgctaagaaatattagtgtcagaacgttcattgtctatttccttttatgtgtatttttggtaagtgatggagttatagcgctattttcacgaaattcttcgctttttattgcagtcataattgtacaattcatcgccttatttttgctttgggcgtacatgacaaaatatcttgtgacgccgatcaatacggtgaaaaaaagtattgaagaagtgacgtcaggcaaacttggcgtgtcgatacctgaatttggcaacaattgtgcaggacgcctgatcccggggattaatagtctctccagcaacattgcaacgctggtccgtgagatccgcgcctcctcgcaaactgcgatgaccctgtcagatcaactctcttcacgcagcgcgcagctttccgtcaaaacagaacagcagtcagcttcgctggtgcaaacggcagccagcatggaagagatggctgcaagtacaaaaaataatgccgacaatacccgtttagccagcgaacaggcgaatctcgcgacgttgcaggcgcgtaaaggcggagagttaatggggcaggtcgcgaacaatatgcagtcgattaccgactgcgcccagcaaatgacagagattatctcgctgattgacggtatcgcttttcagaccaatattctggcgcttaacgccgccgttgaagcggcaagagcgggcgaccatggtaaagggttttctgtggtcgcgggtgaagtgagaagcctggcgcatcgtagcgccgaagcggcaaaaaatattaagtcattgattgaagtcaccagccataacgtgacgcagggcgttaacgtggtctctgaagccgaaaaaaacatgcatgacattgttaccggttcgggcaatgtgagcagactgatggatgaaatttccgcctcaacatcagaacaggaaaaaggtatttcacaaattacgcaggcattgtctgagcttgaacgcgtaacgcagagcaacgtgtcgatggttgaagaactcaatggatcgtcagatgtgctgcgcaatcaggtgattgagctccagacacgaacacgtaatttccgtctggaaaatgagctccaggctgacaatgcgttaagaagccgcgaatgggcggtgaattcctga

SEQ ID NO: 818 - DNA, 999 bp, Enterobacter cloacae
aacggtggaggcgctgtggagagcatcaaagggtctgaggttaacgtacctgacgcagtttttgcatgggtgtttgatggacgtggcggcgcaaggccgcttgaagatcaggatcatatcgacaacgaacatccatgctggctgcacctcaactacacgcacccggacagcgccgagtggctcgcgtccacgccgctattgcccaacaacgttcgggatgcgctggcgggagaaagtctcagaccccgcgtcagccggatgggtgaggggacgttaattacgctgcgttgtataaacggcagtacggatgagcgtccggatcagctggtggccatgcgtgtttatatggatgaacggctgattgtttccacccgccagcgaaaagtgctggcgctggatgacgtcattaacgatctgaaagagggcacggggcctacggattgcggcagctggctggtggatgtgtgtgatgcgctgaccgatcatgccagcgagtttatagaagaacttcacgataaaatcatcgatctggaagataacctgctcgatcagcaaattcccccacgtgggtttctggcgttgctgcgtaagcagctcatcgtgatgcgccgctatatgaccccccagcgcgacgtttatgcgcggctggccagcgaacgcatgagctggatgaacgacgatcagcgccgcagaatgcaggatatcgctgaccggctcggacgtggtttggacgagattgactcatgtattgccagaacggcagtcatggcggatgagatagcccaggtgatgcaggagtcgttagccagaagaacgtacaccatgtcgctgatggcgatggtctttttaccgagtaccttcctgacggggttgtttggcgtaaacctcggagggatccccggcggtgaatatcactatggcttcaccacgttttgcgtcatgttagtggttttgattgggggtgttgcatggtggttgcatcgtagtaaatggctgtaa

SEQ ID NO: 819 - DNA, 1401 bp, Enterobacter cloacae
ctgcaatcattactacgagagtatattgtgaccgctttttccacgctgaacgttctgcctgaagcccaactggctaacctgaatgagttgggctacctcactatgacccctgtccaggccgccgcgctgccggctatccttgaaggccgtgacgtgcgcgtgcaggcgaaaaccggcagtggaaaaacggctgcattcgggctaggcctgttacaacacattgatgcaaccctgtttcagactcagtccctgatactctgcccgacgcgcgagctggccgaccaggtcgcgggtgagctgcgtcgtctggcgcgttttttgcctaacactaaaattttaacgctctgcggcgggcaaccgtttggtgcgcagcgcgattcccttcagcacgcgccgcatatcattgtggcaacgccgggccgtctgctcgatcacctgcaaaaaggcaccgtttcactcgatgcactgcaaacgctggtgatggatgaagctgaccgcatgctggatatgggcttcagcgatgcgattgacgaagtgatccgctttgcgccagccacgcgtcagacgctgctcttttctgccacctggcctgaggcgattgcggcgatcagcgggcgcgtgcagaagaacccgctgaccattgaaattgatactgtcgatgcgttgccggcgattgagcagcagttcttcgagacatcgcagcagggcaaaattccactgctacaaaaattgctgagccaacaccagccagcgtcctgcgtggtgttctgtaataccaaaaaagactgtcaggcggtgtgcgatgccctgaatgatgccgggcagagcgcattatcgctgcatggtgatctggaacagcgcgatcgcgatcagacgctggtgcgtttcgctaacggcagcgctcgcgtgctggttgcaacggatgtggcggcccgtggcctggatattaaatcgcttgagctggtggtgaatttcgaactggcatgggatccggaagtgcatgtccaccgcatcgggcgtactgcgcgtgcgggtaacagtggtctcgccatcagcttctgcgcacctgaagaggcgcagcgcgctaatattctttcggaaatgctgcaactgaaactcaactgggtgaataccccagataatatcagcatcgctccgctggcggcggaaatggccaccctgtgcatcgacggcggtaaaaaggccaaaatgcgtcccggtgacgttctgggggcgttaacaggggatatgggtctcgacggggcagatattggcaagatcacggtccaccctgcgcatgtctacgtagcggttcgccagtcggttgcgcataaggcctggaaacagttgcagggcgggaagattaaagggaaaacctgccgcgttcgactgctgaagtaa

SEQ ID NO: 820 - DNA, 522 bp, Enterobacter cloacae
catttatttcttttaaagaaagggattgctatggccgattcattccagaatgaggtgcccaaggcacgcataaacttaaagctggctctgcatacaggtggcgcgcaaaagaaaatcgaactgccacttaaactcctcaccgtcggtgatttcagtaatggaaaagagaatcgcccattatcggaaagggagaaaattaacgtcaataaaaataacttcaacagcgtactttcggaatttaacccggaagtgaatctgacggttcctaacacaatggccggggatggctcggaagaaagcataaaactgaatttctccgatattaaggatttcgaacctgaacaggttgcccgccagatcccccagctccgcgccatgctggccatgcgtaatttattacgcgacctcaaatccaatctccttgataacgctactttcagaaaagaactcgagaaaattctcaaagacccggcgctgtctcaggaattacgcgacgaaatgagtgcactggccccgaaataa

SEQ ID NO: 821 - DNA, 657 bp, Enterobacter cloacae
acaggagctgtaagcatgtttactggtattgtgcagggcactgccaaagtggtgtccattgatgaaaaaccgaatttccgcactcacgtggttgagctgcctgaatatatgctcgacggcattgaaaccggggcgtcgatagcgcataacggctgctgcctgacggtgaccgaaattaacggtaatcagattagctttgatttaatgaaagagacgctgcgcatcactaacctgggtgagctggtggtaggagatatcatcaacgttgaacgcgcggcgaaattcagcgatgagattggtgggcatctgatgtcgggccatattatgaccaccgcagaagtggcgaaaatcgtgacctcggaaaataaccgtcaaatctggttcaaggtgcaggatccgtcattaatgaaatacatcctttataaaggatttattggcatcgatgggattagtctgaccgtcggtgaagtgacgccaacgcgtttttgcgtgcatttaattcctgaaacgctgcaacgtactacgcttggcgcaaaaaaattggggcagcgcgtaaatatcgaaattgatccgcagacccaggcggtcgtggataccgttgagcgcgtgctggcggcgaaagaggcggcgataataaagaccgtggaagaagaataa

SEQ ID NO: 822 - DNA, 1332 bp, Enterobacter cloacae
ataaagcgcagcgccagcagccaggcggcatcgcggacccacagcatgcccagacagcctgcggcaaaaatcgccagccccaacaacaggacgggtttacggccaaaacgatccgagagcggcccccacagcaattgcgcaaaagcaaaaccggcgaggaacaaactcaaactggcgctgatggcggcggcaggggtttgcaaatcttcctgcatcgcggcgaacgcgggcagatacatatcggtcgccaaaaagcccagcacgcttaagccgccgagccagactaaaaatcctttcctgggttgcactttttttctcctgaggaggcaggtgtacgttggcgcagagtgtagggagtgcaaagcggcttgtgaaacgctaatatttggcgggtgcattcaaaaaatttgcaggctaaagatgtggtcagattattcccttgaagtggttgatgccgtggcgcgtaacggcagctttaccggcgccgcccaggagttgcatcgcgttccctcggcgatcagttacacggtgcgtcagctggaagcgtggctggcggtgccgctgttcgagcggcgtcatcgcgacgtggagctcacgcctgccggagcgtggtttttgaaggaagggcggtctgtcatcaaaaaaatgcagatcacccgtgagcagtgccagcagatcgccaacggctggcgcgggcatctcgctatcgcggtggataacattgttaagccggagcggacccggcagatgatcgtcgatttctatcgtcatttttccgacgtcgaactgcgtgtttcgcaggaagtgttcaacggcgtctgggatgcgctggcggacggcagggcggagatggcgattggtgcaacccaggcgatcccggttggtgggcgctacgcgtttcgcgacatgggcatgctgagctggacctgcgtggtcgcgcgcgatcacccgctggcagcgctggaagggccgctgagcgatgacacattacgcaactggccctcgctggtgctggaagatacctcccgctcgctgcccaagcgcattacctggttgctggataatcagcgccgcgtggtcgcgccggactgggagtcgtcagccacctgtctgagcgcggggctgtgcgttggcatggtgccggtgcattttgcgcgcccgcgcatcgacgcgggagagtgggtggctctgacgctggaaaaccccttcccggatgccgcatgctgtctgacgtggcagcaaaacgacgtctcgcccgccatggcctggctgctggattatctgggagacagcgaaacgctgaaccgggagtggttgcgggaaccagcatag

SEQ ID NO: 823 - DNA, 837 bp, Enterobacter cloacae
ttctgtgccgggttatggcacggtatccggagtctcttcatgaaaatcaattttcccctgctggccctggcgattggcgcctttgggattggcaccactgaattctccccgatggggttattgcctgttatcgcccggggggtggacgtatctatccctgcggccggtatgttaattagcgcctacgcgatcggcgtgatggtgggcgcgccgctgatgacgctgctgctttcgcaccgtgcgcgccgcaacgcgctgattttcctgatggcgattttcactctcggcaatgtgttttccgcgatttcgcccgattacaccactctgatgctttcgcgcattcttaccagcctcaaccatggcgccttcttcggactgggctcggttgttgctgccagcgtggtgccaaaacataagcaggccagcgcggtagccactatgtttatgggcctcaccatcgctaatatcggcggcgttcccgccgccacctggctgggagaagccatcggctggcgtatgtctttcctcgcaaccgccggactgggcgtggtcgcgatggttgcgctgttcttctcactgccgaaaggaagtgctggagaacgtccggaagtacgtaaagagctggcggtgctgatgcgtcctcaggtgttgtccgcgctgctcaccacggtgctgggggccggggcgatgtttacgctctacacctatatctccccggtgctgcacgacataacccacgcaacgccactctttgttaccgcgatgctggtgctgattggtgtcgggttctcgactggccctatatcggtgttcaccacgcggacgggtccacgtacg

SEQ ID NO: 824 - DNA, 327 bp, Enterobacter cloacae
ggacgcatcagcaccgccagctctttacgtacttccggacgttctccagcacttcctttcggcagtgagaagaacagcgcaaccatcgcgaccacgcccagtccggcggttgcgaggaaagacatacgccagccgatggcttctcccagccaggtggcggcgggaacgccgccgatattagcgatggtgaggcccataaacatagtggctaccgcgctggcctgcttatgttttggcaccacgctggcagcaacaaccgagcccagtccgaagaaggcgccatggttgaggctggtaagaatgcgcgaaagcatcagagtggtgtaa

SEQ ID NO: 825 - DNA, 1395 bp, Enterobacter cloacae
ctacaatacaaaggtgttcacgtgcagaagtatatgatcgaagcgcgtcagttattggcactggcaataccggtgatcgtcgcgcaggtagcccaaaccgcaatgggatttgtggatacggtaatggccggtggttacagcgccaccgatatggccgccgtggcgatcggaacctcaatctggctcccggccattctgtttggtcacggcctgctgctggcgctaacgcccgtcatcgcacagcttaacggctccggtcgacgtgaccgcgtggcccatcaggtgcgccagggcttctggctggccgggttcgtctccgtcctgattatgatcgtcctgtggaacgccgggtatattattcgcgccatgcataatatcgacccggcgctggcggataaggcggtcggttatctgcgcgccctgctctggggcgcgcccggctatctgttcttccaggtggcacgtaaccagtgtgaagggctggcaaaaaccaagccgggcatggtgatgggctttatcggcttgctggtgaacattcccgtgaactatatcttcatttacggtcattttggcatgccggaactcggcggcgtgggctgcggcgtggcgacggcagcggtgtactgggtgatgttcggaagcatgctcacctacattaagcatgcgcgatccatgcgcgacattcgcaacgacaccacctttagcacgcctgactggtcgatgttgacccgcctgacacagctgggtctgcccattgcgctggcgctgttctttgaagtgacgctgtttgccgtcgtcgcgctgctggtctcgccgttagggattattgatgtggcaggccaccagatcgcgctgaacttcagctctttgatgtttgttctgccgatgtcgctggcggctgcggtgacgattcgcgtgggcttccgtctggggcaaggttctacgctggatgcgcaaacggctgcccgcaccgggctgggcgtcggcgtctgcatggcggtctgtaccgccctctttaccgtgctgttgcgtgagcaaattgccctgctctataacgacaacccggaggtagtaactctggcctcgcacctgatgctgctggcggccatttatcagatctctgactccatccaggtcattggcagcggcgtgctgcgtgggtataaagatacgcgttccatcttctttatcacctttattgcctactgggtgctgggcctgccgagtggttacattctggcgctcacggatctggtggtggatcgcatggggccagccggattctggatgggctttatcatcggcttaacgtctgcggccattatgatgatgctgcgcatgcgtttcctgcaacgtcagccctctacggttattttgcagcgcgctgcacgttaa

SEQ ID NO: 826 - DNA, 1032 bp, Enterobacter cloacae
catttaatggcaacaattaaagacgtagcaaaacgcgcaaacgtttccactacaaccgtatcacatgttattaacaaaacgcgtttcgtcgctgaagagacgcgtaatgccgtctgggcggcaatcaaagaactgcactactcgccaagtgccgtcgcccgcagcctgaaggttaatcacaccaaatcgattggcctgctggccaccagcagtgaagcggcctattttgctgaaatcatcgaagccgttgaaaaaaactgcttccagaaaggctataccctgattctgggcaatgcgtggaacaacattgaaaaacagcgcgcttacctgtcaatgatggcgcaaaagcgcgtcgacggcctgctggtaatgtgttctgaataccctgagtcggtcctttccatgttggaagagtatcgccacattccgatggtagtcatggactggggcgaggcgcgcgcagacttcaccgactccgttattgataacgcctttgaaggcggctacatggcggggcgttatctggtagaacgcggtcatcgtgaaattggcgtgatcccgggtcctctggagcgtaacaccggtgctggccgtctggccggtttcatgaaagcgatggaagaggcgctgatcaccgtgccggaaaactggattgttcagggcgacttcgagccggagtcaggctatcgcgccatgcagcagatcgtctcccagccgcatcgccctaccgcggtgttctgcggcggcgacatcatggcgatgggcgcgctatgcgcggcagatgaactcggcctgcgcgtcccccaggatatctcggtgatcggctatgacaacgtgcgcaacgcccgcttctttaccccggcgctgaccaccattcaccagccgaaagattcgctgggtgaaacggccttcaacatgctgctggacaggatcgtcaacaagcgtgaacagtcccagtccattgaagttcacccgcgcctgatagaacgccgttccgttgcggacggtccgttccgcgactaccgtcgttaa

SEQ ID NO: 827 - DNA, 1290 bp, Enterobacter cloacae
atgcacccgccaaatattagcgtttcacaagccgctttgcactccctacactctgcgccaacgtacacctgcctcctcaggagaaaaaaagtgcaacccaggaaaggatttttagtctggctcggcggcttaagcgtgctgggctttttggcgaccgatatgtatctgcccgcgttcgccgcgatgcaggaagatttgcaaacccctgccgccgccatcagcgccagtttgagtttgttcctcgccggttttgcttttgcgcaattgctgtgggggccgctctcggatcgttttggccgtaaacccgtcctgttgttggggctggcgatttttgccgcaggctgtctgggcatgctgtgggtccgcgatgccgcctggctgctggcgctgcgctttattcaggcggtcggtgtctgtgccgctgcggtgacctggcaggcgctggtaaccgattactaccccgcctcgcgcactaaccgtatattcgccaccattatgcccctggtcggcctgtcgccggcgcttgccccgttaatgggaagctggatcctggcgcatttcgactggcaggccattttcgccacgctctttgctattacgctggtcctgatgctgcccgcgttcgggcttaaaccggcgcataaaaaagagacgcatccggacgcgaagcccatcacctttacctctttactgcggtcgaaagcctatcgcggtaacgtgctgatttatgccgcctgctctgccagcttctttgcctggctgaccggttcgccgttcattctgcatgacatgggctacagcccggcggctatcggcctgagctatgtaccacagaccatcgccttcctggtgggtggctatggctgtcgcgccgcgctgcaaaaatgggaaggccaacagatgctgccctggctgctggtgctgtatgcgctaagcgtgattgcgacctgggctgtcggctttattcccggcgccgggcttgcagaaattttgattccgttctgcgtcatggcgatcgctaacggggccatctaccctatcgttgtagcccaggcgttgcgtccatttccgcaggcgacaggccgcgctgccgcgctgcaaaataccctgcaacttggcctgtgcttcctggcaagtctcgtggtctctgcgttgattgcaaccccgctgctcaccactaccagcgtgatgctgatcaccgttgcgctggcgggattgggttatcgcatgcagtcctccgcgcttcgcgagcagaatgacaatgcacaaaccgaaacgtcgcacgcctga

SEQ ID NO: 828 - DNA, 1173 bp, Enterobacter cloacae
tcacagcaaggtgatggagaagctatgagttcatcgtgtatagaagaagtcagcgttccggacgataactggtcccggatcgtcagtgaactgttgggacgtgcgggcattacgattaatggctcatccccctccgatccccagataaagcatcccgattttttcaaacgcgtgttacaggagggatcgttagggctgggtgaaagctatatggacggctggtgggagtgtgagcggctggatatgttcttctccagcgtattacgcgccggtcttgaaaaacagctccctcgtcatttcaaagataccttacgtatcgcctccgcccgcctgttcaatctgcaaagtaaaaaacgggcatggatcgtcggtaaagagcattacgaccttggcaacgatttgttcagccgtatgctcgatcctttaatgcagtactcctgcggatactggaaaaaagcgacgaccctggaagaggcgcagcaggataagctgcaactgatctgcgataaattgcagttacagcccggtatgcgtgtgttggacatcggctgtggctggggtggtcttgcctggtttatggcaaaaaattacggcgtcagcgtagtcggcgtcacgatttcggctgaacagcagaagatggcgcaggaacgctgtctgggactggatgttgatattcggcttcaggactaccgcgacctgaatgagcagttcgatcgtattgtttccgtaggtatgttcgagcacgtggggccgaagaactacaagacctactttgaggtcgccgatcgtaacctgaagcctgacggaattttcctgctacacaccatcggctctaagcgcaccgataacaatgtggacccctggatcaacaaatatatcttcccgaatggctgtttaccctctgttcgccagattgcgaacgccagcgaaccgcattttattgtggaagactggcataacttcggcgcagattacgacacgaccctgatggcctggcatgaacgtttccaggctgcatggcctgaaatcgccgacaactattcggaacgattcaaacggatgtttagctattatctgaatgcctgtgcgggcgcgttccgtgcgcgggatatacagctgtggcaggtggtgtttagtcgtgggattgagcacggcttgcgggtggctcgctga

SEQ ID NO: 829 - DNA, 1091 bp, Enterobacter cloacae
gcgcgctgggcggcaccatcggcggcgtattcggcctggtgggcggcttcatcggcggtttcttcagcgcctaagcgagaagcacgttgtacgcatggcccgcattgccgggccatttttttatttcagccacggatcattatgttttcgctctttcagtataaaaaacagggtaagacccctgttattcgccagcatgaatttaccgaatgtggactggcctgcctggcgatggtgttggggcactacgaccaccatgtctccgtcagccagctgcgccgggagatttccgtttccgccgatgcgggaacctcaatggcggaattgatgacccttgccagcgataaaaatatgtctggccgggtgcttaaaggcgaaatcactgaaatagaaacgtctgagctgccgctcatcgccttctggcgcggcaaccatttcgtggtcatcgtgaagatcgacagccgcagcgtgaccgttcacgacccggccagcggcgtgcgtcgttaccgtctgaaagaggcggaaaaactcttttccgggtatgtgcttgagcttaagcccacgccgtgcttcgaaaagaaatccccggatgaaacgctcacgcttggccgtttagccaataaatctccgagcctgttccagcgccagctgctgctgtttgtgctctgtatttttactctcatcaccatgctggcaagccccacctacgtgcagctgattatggatgaggccatttcccgcagcgacagcgatctggtgatcctgctcaccgcgatcttcgctatcgtctttatctttgaagtcatcggtaaattcctcaagcagctgcttgagatcctgatgcgtaacattgcctatgacgatttaagccagtccgtgcgccactacatgctgcgcacccagaccagctggttccgctcgcgcccgccgggcatcgtgctggctattgagaaatcgctccacgcctgcgcggagttcatcagcaatggttacgtgcaaattctcttttccagcctgatcgccgtcaccagcctgctgtttatgctgctgtataacgttcaaattgcgctggctgacaatgctgctgatgg

SEQ ID NO: 830 - DNA, 624 bp, Enterobacter cloacae
atgaacaaactgaacgctatcgttctgggctccctgctgtctgtttctgccctgagcgcagttaatgcagcagaaacgacggcttctgccacatggcaggcaaccgcgaccaaagacagcgaatccgatctggttgttacgccaacgcgtgctctgaactttgtttacagcgccaacaccaaatctttcaacaccgacaccggtctgtttgatgtggctatccgtggcgatcactctacggcgaccagcttcaaactcgaagctatcctcgacgattcaaacaacacgctgttcagcgtgggtggtgaagcgaccaagctgaaagtgggtgcgcgttggggcggaaacgacctgggctctatcggtggcaccgtgggggcgaaatcaaccgcatggaccacgctggttgattcctcttctaacaccggcgtctcttctggcctgtggaacctgaccaccagcgcaggcgcggcggcagataccgaaattaccggccaggacaaattcgtcttctacgttgactccgctcaggacaatgccggtacggcgaaagagttcaaagacctgaccaacagcctgtgggaagggaccgtgtctgttgcgttccgcgcaacctggggctaa

SEQ ID NO: 831 - DNA, 687 bp, Enterobacter cloacae
ggaaatagcatgtttaacctcaaatccgccttcttatttttattatttatctcttcctccgcgctggccattaatgtgggaaaagtcaccaccattatttctgcggatgctgactccaccgccaaggaaataaaaaacgaagcagacagcgtgcgcattgtttctgttcgcgcacagcggatcagcagcccaatggatgaagggatcgtcattaatccggagaaagtggacgaactgttgctgacgcccacgcgcatggtgatgcccgccggtaccagcaatatcgtcaaattttactatcacgggaacgccgataacaaagagcgttactaccgcattaccttcacggatgaaggggtaagcgaagaggtggacagcggttcgccaaaaaacggcaccgggatgacgcgcgcggtggtgagcaccattctggtggttcagccccgggataagaagattgatttcgtctatgtggcgggaaaaataaccaataaagggaacacctcgtttcgcgtcaatgcgaccgggacctgcctgaagccgaatccggaatcccccggcacgccgtgtagcaaaaacttctacctgatgccagagacctcgcgcgctatcgaggatatcaacgttacggataaccattttcatctcggaatatgggacctgaaacagttcattcctgttaagtaa

SEQ ID NO: 832 - DNA, 2601 bp, Enterobacter cloacae
ggatgcatggtgaaaaataaattagtgttgccggtgatgatggcttgcgcatccggcacgctgcccgcgcttgcgcatgcagcctcaagctccgtggttatcgctaattaccgttttcccgactcgctttatgcactgctggagcaggggatcaaaattcccgtctatctggtgaatacgcgtccacactcagcacaacaagggaaccacgaaggcacggcgagtgaatatgttcgtatcggtgacgtgacgctctttgcaaaagatctgaagctggggctgagggacgttcaggtccaggagtctgataacggcattcgtctgtcaaaagagatgcgggcgttactgcaaagcattaacgataagcagtttgatgaccagatgcgtattccggttagcgcgggttcggcgttcgaactggatcagaaaaaaatgcgcctgttgctgaatctgtcgcagagcgactacggggtgaatattcgcctgcgtgaggtggatattgatgcgccggagtctgacgacctgagcggcacgttctcctacaacctcggggcgtatcacaccgagagcggctacggtgacagctggtcgtcgggctatctgaacgcgagaaactggatctcaatgggcgtcgatcatgtgctgatcgatggctctggctacgtcaacgagagcagcagcgatacccagatgaacgcggttatgtgggagcgcgactatcaggggatgcgctacgccgcaggcatgctgaacggctgggcgatgcagtctctggcgagcgtcagcgggatttccggcggtgaagtctacggcgtttccatgggcaaccaggccaactcccgcaaacgcgataacacgctctctctgacgccggtggtggtctatttccccacggcgggcgaggcccgtattcgtcgtgacgggcagcttatcggcattcagcgctttgacgtcggcaaccatgaaattgacaccagcagcctgccctacgggatctacagcatcgaagttgaggtggtgagcggaagccgcaccgtgtcgcgtaacatgtacaccgtaaataagccgttctccagcaacgtgtcggaaacgctgcgctggcagatgtggggcgggatgtatagccgcgataaatccgtcgtcaattataaaaaatacgcgaaacgcaaaaacgagcaggacaacacctacaactacgattacgacaccaaacataaagacaccatgtcgctggtgggagcctcgttcagcaagcgcagcgggatggtcgactggaacgcctccacctacatgatgcgggaacacatcgtcagcgagctgtgggcctccctgaacctgacgggctatttctcggtgaatacccagaccatggccgcctccgacggaacctatcgcgccaactatggggcgaatctcagcctgccgtggcagatcggctcggtgtggtactcccatgaacagctctccagtggcaagttcctcgatatctatgagagcaagggcaatacctggggcgcctcctttagcctgccgtcgttcggtctgccctcggcgggcaacctgagcctgatgcgccaggaggacgacctctatcgctataaacgctatcagctggactactcccaggggttatacgccggtcgctacggtacggcgcgcctgcgggtgggaatgtcgcgcaacaaatacgacgggtattacgaagagaaagatcgttacgtgatgctcgatttcgctataccgctcggcaataccgtgtcggttggcgtttcccacaatcgcgataccggcacggcgctgaacgtcagcgccagccgccagtttgaaggcgattacctgaaatcggctaccgccaacgtctcgaaagcctttaacagccgccaggatcgcagcgtaagcggcggcggcagcgtgaacttcgacacgccgtggaacagcaacatcctcagcgtccagagcggcatgagtaaaggctggaactccacgctgaccagtgacggcagcgtgggctggtccaaagaggccatcgccgccgggaaaggcaccgaaagcgcaggggtgattgtcagtaccggtctcaaatctgatgaagcgctgaccctgaagcttaacggccgggcagaacgcatcaaaggggataagacctggctgtcgctgccggcataccaggcttatgacctggaagtgatgaacagtgaaaccggtacggaaagctatgagattggcgcgaatgcgcgtcgccatatcacggtttatccgggcaataccgtggtgatgaagccgcaggtgaagaaaatcgtcactctgtttggtcgtcttgtggatgcaaacggggccccgattggcgccatgcagatcaaaaaccacgtcgggctgacccggacggaaaacgacggacgcttcgtgatcgacgttgataagaacaaccctgtcctgagtatcgccacgccggacgacagcgtctgcgaagtgcgcctggacatcgagtctaaccgcggtgcgctgtggcttggggacatctcctgcgacaaaggcgatttcgtctggcaggaagcaaaaggaacgcaggaacgtgacgatgaaaaagatattcgctcttaa

SEQ ID NO: 833 - DNA, 828 bp, Enterobacter cloacae
gctatgcgcggatccttcgcccttgtggtgaagattacaatgctttatgaagtcgacaccggtatgatcatgattaatggagaggaagagtcatccattaagttatctaaccaggcgggtcgtctgctttatgaacttatcatcaataatggtaaaactctcgacagagacgacctgataaagaaggtctgggaggatcatggtttctctggttcttcggtgagtctgaatgttgccataagtgaaatcagaaaagcatttcgtacattaggatgcgaccctttactgataaaaacgatacgtggcaagggatttagccttgccgcgcatattgaacaccacacggtcaggccgccggttgtttcaacgcttagtgaacaatctgcctctgaatcattcgatacgctagcgcataagaaagatgccgatccgcctaaacaattaatatcgctgcacagactctttatttctctctgcaccttattactgattaccgttatcggcaccgctgttttactgttgcaccaaagggattcctatgccgagagcctgaaagattctgatatgcatctgctcggtaaagtggaccggtgtacggtatacctgatcgataagaatatgtatcagccgcgacagcactactttaatcacgtaaaagaggtcatcgccagtcaacatatcgactgtcaacatcaggttgcagatgcttactattccaggtttaaaaagtcgcagatagaaaattatttcctggccatctgttatcagcaggacagtatcgacgattataagaactgcatttcttacagaagcctgaccgggagttaa

SEQ ID NO: 834 - DNA, 1740 bp, Enterobacter cloacae
gtatcgccacgccggacgacagcgtctgcgaagtgcgcctggacatcgagtctaaccgcggtgcgctgtggcttggggacatctcctgcgacaaaggcgatttcgtctggcaggaagcaaaaggaacgcaggaacgtgacgatgaaaaagatattcgctcttaatttactgctgatgagcgcggcggcccaggcgcaggagctgccctatttcgccattaataacccggacaataacggtacgggaaacagcgcggggctgtttagtctgaacagcacgtcgaccgcgtttttacacggttcgcgcgagtggccgaccctgagtgcgaaaacgaataacggtatcgccacttacatcccggacaacagcttcaacggcccggcaggcagcgcgttaactatcgacttttcggtgaccggttccagcgcttctccgttctttaaagggacggcgtgttcctcgtcctgcggcaacacggggtacaccccgacgaccagctataccgacacgtcgatggtggttaagccgccggtgatggagcccggcacgtcatacgggcgctgggtactgggcgatccgttctttaactatttgctcaacgccgcgccaggggatgaagtgaccatcacctccacgccgcaaatcagctccatcaacaaagtgaccaccaccaatacgcttcacaaggtgggcacgctgaccatgaccaactccagagcgcttaacctgggtattgacccgatcagcggcgaggtgacgattgtcgatggatcaacgggggccacctgcaccaagtacacccgtaacacggtctctggcgtcctgtgcgacctgctcgaatacacatttgttggggaagatatctccggttacaacggagggctggcgctcacctcttcccgcgtcaacagcgtgctgcaatcgcacatgagcggcggcaccgggcttgccgccgagctgaccttcgatgaaaacacctggtacagtatctccggcggtatcctgagcgatacgcgtgtcctggcgaacaccttccttgcagcgccgcagaaaaacggcggcaaagcgtaccttaaaatctttttgccgaaagcgttaattctgagcgtggcgcaggcgggggacggcagcaacattggcaatatcgtcagcctgtgtctgacgcccggcaacagctcgctggcggcggatttctgcttccagccggggggcggcctggtgattaacccgatcgaacccgggctggaaattgtgccagacaacccggattacaccctcgatcctgacggtctgggcggctcagggaaaggcattatcggcgaagcgcccattgagatcccctacaccatcacctacagcggggcgcaaaaagatgcggcgattgcggtcacggtaaaagtcaccgggcctacccaaagcctgaatggggtggactactgcgcctttagcggcaacggctttacggttcccattccgggcaacgtgctggtggggaaaagccagacgctgatggcgcacaactgtaaaggcgaagtactgtcgatcccggcgccggccacccatgcggaagagtgggacaaaatgagttccggcgtgaccgatatgtggctctggaaaacaccgctgatcctccagttcgttatggataatccggtatcgaaaaccacctatgacggaaatagctggtttggtgaagtgaccgcgcagggaagaatagatgttagcgcatcctggaattaa

SEQ ID NO: 835 - DNA, 660 bp, Enterobacter cloacae
tcaaccatgactggaaaattcctggctatttttgcaataaattgcttcatttccacaggggcaaatgctttaattatcgaaagtctgaatattgattttcttcccgaaagagaagttgtttttcagccgataaaaaacgataccagcgagcgtcagaattataccgtgtcgcttattcaggtagacgttcctaaagagaagggaaaagaaaccgaaataaaagacggcgaagtcatgtattcgcctaagcaattaacgctggggagcggtgaacgcgcgggttttaaattttattataccggcccgcatgacaacaaagagcgatactatcgcgtaaaattcaccgagacgccgctccaggcaaaggttatcacgcgcaaaggccagcgcatccagtcggatgtggtggtctcgcttgaggctattttgattgtccgcccatggacacgacattttgattatgcgtttagcaacggggtggtgagtaataccgggaatacctattttaaatatgtttcctcggtcgggtgcagtacgcaatacaacaattcaaaatatattccaccggggcaacggctggaaatagataatgccgggcaggctgcaaggcggatgattatttatggcaataaaatcattccgctgaccacctgcccgtag

SEQ ID NO: 836 - DNA, 1071 bp, Enterobacter cloacae
gaggagccgatgatgaaaaacacaacctatcttaccgatgaggatcgctggcaggccgtactggcccgcgatccgcgtgcggataaccagtttgtctttgccgtgcagacgaccggcatttattgtcgtccgtcctgtcgcgcccgccacgcgctgcgtaaaaatgtctgcttttatcctgatgctcaccaggccgcgcaggcgggtttccgcccctgtaagcgctgtaggccggaccagggcgacccaatggcacagaaaaaggccaacattgcgctggcctgtcgactgcttgaacaggatgcctcgctgaacctggaggcactggcgcagcaggttgccatgagtccgttccatttccaccgcttgtttaaatccgtcaccggcatgacgccgaaagcatggcagcaggccgcgcgtgaacaacgcctgcgcagcctgcttgcacagggcggtaaaatcaccgacgccgtactggccgctggctttccggacggcagcagttactaccgtaaagccaacggcgcgctgggcatgacggcaaaacagtaccgcaacggagaggctgcggtccgctatgccatcagtgactgctcgctgggccgctgtctggtggcggaaagcgagcgcgggatctgcgcaatactgctgggtgatgacgacgccgggctgacggctgagctgctgtcactgtttccgcttgccgtccgtgaaccgatggaaggcgcatttgccgggcgtgttcgtcaggtgattgcctctgtcgacagccgcgcgacgtcgctgacgctgccgctggatatccggggtaccgccttccagcagcaggtctggcaggcgctgcgggctatcccctgcggtgaaacggcaagctatcagcaggtggcaaaggccattggtaaacccaatgccgtacgtgccgtggcgggggcctgcggtgccaacaaactggcgatagtcatcccctgtcaccgcgtggtgcgtaacgacggtgcgctgtcgggttatcgctggggcgcagcgcgtaaggtgctattgttgaaacgtgaggcgaacaacccggaggaataa

SEQ ID NO: 837 - DNA, 1668 bp, Enterobacter cloacae
tttttcttgtccggattgctctgcatgcaactacttcttcttgtctggcggcagtatcgctggccttttatcgcggtgatggcgttaagccttgccagcgcggcgctggggatcggcctgattgccttcattaacgtgcgtttgatcgaaatggtcgacacgtcactctccgtcctgccggaatttctgggtttactgctgctgctgatggcagtcacgctcgggtcacagctggcgctgaccgcgctcggccaccacttcgttttccgtctgcgcagtgagttcatcaaacggatccttgatactcaagtggagcgcatcgaacagctgggaagtgcttctctgctggcggggctgaccagcgatgtgcgcgccattaccatcgcctttgtgcgcctgccggagctggtgcaggggatcatcctgacctttggctcggcagcctatctcgcctggctctccagcaaaatgctggcggtaacggcgctgtggattgttattaccatctggggcgggttcctgctggtatcacgcgtctataagcacatggcggtgctgcgcgaaacggaagacaagctctataacgattaccagacggtgctggaagggcgtaaagagctgacgctgaaccgcgagcgcgccgaacatatcttcaaccatctctatatcccggatgcgcacgaatatcgtcatcacattattcgcgccgatacgttccacctgagcgccgtgaactggtccaacatcatgatgctgggcgcgattggcctggtgttctggatggcgaacagcctggggtgggcggataccaacgtggcggcaacctactccctgacgctgctgtttttacgcacgccgctgctgtcggccgttggcgcactgccgacgctgctgagcgcacaggtggccttcaacaagctgaagaagttcgaccttgcgccgtttaaggctgagttcccgcgcccgcaggccttcccgaactggcaaacgctggagctgcgtaacgttaccttccgctatcaggataacgccttctcagtggggccgatcaacctgaccattcaccgcggcgaactgctgttcctgatcggcggtaacggcagcggcaaatccacgctggcgatgctgctgacgggcctctaccagccgcagtcgggtgaaattttgctggatggtaaagcgctgagcgcggagaaaccggaggactaccgcaagctcttctcggcggtatttaccgacgtctggctgttcgaccggctgctgggaccggaagggcagcaggcggatccggcgctggtggagaagtggcttgcgcacctgcaaatgtcgcacaagctggagcttcaggatggcaaaatcctgaatctcaagctgtcgaaagggcagaagaagcgcgtggcgctgctgctggcgctggccgaagagcgcgacatcatccttctggatgaatgggccgccgatcaggacccgcacttccgtcgcgagttttatcaggtcctgctgccgctgatgcaggcgatgggaaaaaccatttttgccatcagccatgacgatcactacttcattcacgccgaccgtctgctggagatgcgcgacggcaagctgagcgagctgaccggcgatgagcgcgatgcggcgtcacgggacgcggtggcgcgtacggcctga

SEQ ID NO: 838 - DNA, 1035 bp, Enterobacter cloacae
ttatgcccggttcctggcagcctcgtaggtgaagacgatctgtacggtaaagtggatggcctgcactatttctctgatgacgacagtgcagacggcgaccagacctacatgcgtctgggcttcaaaggcgaaactcaggttaacgaccagctgaccggttacggccagtgggaataccagatccagggtaactctggtgagaacgaaaacaactcatggacgcgtgtagcgttcgcaggtctgaaattcgctgatgcgggttcattcgactatggtcgtaactacggcgttgtttacgatgtaacttcctggaccgacgttctgccggaattcggcggcgatacctacggttctgacaacttcatgcagcagcgtggtaacggcttcgcgacctaccgtaaccaggacttcttcggtctggttgatggtctgaacttcgcgttgcagtaccagggtaaaaacggcagcgcaagcggcgaaggccagaccaacaacggtcgtgaggcactgcgtcagaacggtgatggctacggcggctctctgacctatgatctgggcgaaggcttcgctatcggtacggcagtcaccagttctaaacgtactgctgaccagaacgctgcgggctactacggtgaaggcgatcgcgcagagacctacaccggtggtctgaaatatgacgcgaacaacatctacctggctgcacagtatactcagacttacaacgcgacccgtgcgggcgacctgggctgggctaacaaagcgcataacttcgaagtggttgcgcagtatcagttcgacttcggtctgcgtccatccgtggcgtacctgcaatctaaaggtaaggacctggaaaacggctacggcgaccaggatctgctgaaatatgttgatgttggcgcgacttactacttcaacaaaaacatgtccacctacgttgattacaaaatcaacctggttgatgagaacgacttcactcgcgcagcaggtatcggtactgacgatatcgtcgcgctgggtctggtttaccagttctaa

SEQ ID NO: 839 - DNA, 393 bp, Enterobacter cloacae
ccaatggatatgacttttttacgcgccagcgttctggcgacttttttactcctgaccgcgtgtgactcttccacacagcccgcaaaaatcgacgcacccgccgcgacggtgctggaagggaaaaccatggggaccttctggcgcgtcagcgtgatggatattgataaatcccgcgctgaagaattacgcggtaaaattcaggcgcagctggatgccgacgatcagctactctctacctataaaaatgactcggcgctgatgcgtttcaatcgctccagccagcacctcgctgtggccggtgagcgaagcaatggccgatatcgtcacggaagccatgcgcgtgggaaacaaaaccaacggcgcaatggatgtgacggtggggcccgttggtga

SEQ ID NO: 840 - DNA, 618 bp, Enterobacter cloacae
aacctgtggggatttggccccaacaagcagccggtgactacaccggatcaagccgccatcgacgacgcccgcgcgcgtacagggttacagcatctggcggtgatctcccagtatggtcagcaatacctgcaaaaagatattcccgacctgtttgtggatctctccacggtaggcgaggggtatgctgcggatcatctcgcggccctgatggcgcaggaaggcattccgcgttatctggtttccgtcgggggcgcgctcgtcagccggggcatgaacgccagcggcaggccgtggcgagtggccatccaaaaaccaaccgatcagcaaaacgcggtgcaggcgattgtcgacatcaacgggcatggtatcagcacctccggaagctaccgcaactattacgagctggatggcaaacgtatctcgcacgtgattgatccgcaaaccggacgcccgattacccataacctggtgtccgtgacggtgatagccccaaccgcgctggaggcggatgcctgggataccggattgatggtgctcggcacggagaaggccaaagaggtggtgcgtcaggaagggctggccgtctatatgatcactaaagaggctgacgggttttaa

SEQ ID NO: 841 - DNA, 672 bp, Enterobacter cloacae
ggcgaacaacccggaggaataatgctcgatctttttgctgatgctgaaccctggcaggagtcgctcgcgccgggggcgacgatcctgagacgcttcgcgctttcccgcgcggcggcgctgttcgacggcattaaagccgtcaccgcccgttcgccgtttcgccatatggttacgccaggcgggtataccatgtccgtggcgatgaccaactgcggcgaactgggatgggcgacgaatgagcggggctatgtatatgccgcgtacgatccgctgacggatcagccgtggccgccgatgccggaggcgtttcaggcgctgtgtcacgatgccgccgtggcggccggctatcctgattttcgacccgatgcctgtcttattaaccgttatgccgttggggcaaagctctccttgcatcaggataaggacgagccggacctgcgcgcgccgattgtctcggtatcccttgggctgcccgctgtctttcagtttggcggcctgcggcgcaacgacccgctcaaacggctgatgctggagcatggcgatgtggtggtctggggcggggaatcacggcttttttatcacggtattcagccgcttaaaccaggcgatcacccggtggcgggggcgtttcgctacaacctcacgttccgccaggcagcgtacagagaataa

SEQ ID NO: 842 - DNA, 1440 bp, Enterobacter cloacae
ttgatgtcggtattaaagaaaaacagcgccaggcagcgtgaccaggagcgtgcgcggctcatctggctcctgacgaccgataaagcggtcacgtcaacgttattgggtaagctaaccctggctgagcaatatgatgtcggcacgctggccgacgatattgctgaggtaggtgcgctggttgcacatttaccacctccggatctggcggacaccctggaggcattgccttccgaggagcgccacgccctgtggcggctggtgcaggatcacgagcgcggtcaggtgctgctggaagcctcggaaaacgtctgggatgaccttatcgatgagatgagcgaccgggacattcttgacgcactgcaaacgctggatatcgatgagcagatttacctcgttcagcatcttccgcgcaacctgaccggacgcctgctggcttccctgcctgccgaagagcgggcgcgcgtgcgtcaggtgatgcactacgagaaaaacagcgtcggcgcgatcatggagtttggcgtcatcaccgtgcgtccggacgtcaccctggggacggtgcagcgctatcttcgtcgcctgggcagtatgccggacaacaccgataaactgttcgtcacctcgcgggataaaaccctgctcggggagctggagctgaaaacgatcctgctgaacagcacccagcagcgggtgagtgaggtcatggaaaccgagccgatggtcttctcgccggaagacgatgccgaaaaagcggcgcgtactttcgaacgtgatgacctggtgagcgcggcggtggtggattcggtgggcaagctgatggggcgtctgaccatcgatgagatcgttgacgtggtctatgaagagaccgataacgacctgcgtgcccttggcgggatcagtgccgaagacgatgttcatgcctccgtcggcaaggccgtcaaaacccgctgggcgtggctcgccatcaatttatgcaccgcgttcgtggcgtcccgcgttattgacggcttcgaacataccatttcccagctggtggccctggcgtcgctgatgccgattgtggcggggatcggcgggaacaccggcaaccagactatcaccatgatcgttcgcgccctggcgctggaaaacattcagccgggtaatttttcgtggctgattttcagggagatgggcgtcgcgctgattaacggcctggtctggggcggcatcatgggcggcattacctggtggctgtacgatgatatggcgctgggcggggtcatgatgctggcgatggtgctgaacctgctggtggcggcgatgatgggcgtgattatcccattgacgatgacccggctggggcgcgaccccgcggtggggtcgagcgtgatgatcaccgccattaccgataccggcggtttctttatttttcttggactggcgacgatttttcttctctag

SEQ ID NO: 843 - DNA, 204 bp, Enterobacter cloacae
agcgcatcagccgcgccatacccagcgcgccgaacaggatctgaatcatgcctgccatcaccaccgcgggcagaatgtactgtacgccgtgttgatggaccatcgggccaatcaccagcgcgacggaacctgccgccgccgtcaccatggccggacgcccgccgagcagggaaagggcgaaacagagcaccacggaggcgataa

SEQ ID NO: 844 - DNA, 977 bp, Enterobacter cloacae
ctgccgtgctcttttcttctggccgtggggctgaacgccgtctcgctggcggcgaaggctgacgcaccaaaagagcaggaaacggatgtccttttaattggtggcggcatcatgagcgccacgctgggaacgtatcttcaggaattagagccgaactggtccatgaccatggtcgagcgcctcgatggcgtggcacaggaaagctctaacggctggaacaacgccgggacggggcactcggcactcatggaactgaactatacgccgcagaaaaaggacggttccattagtatcgagaaggcggtagagatcaacgaagcgttccagatctcacgtcagttctggtctcaccaggtgaacagcggtgtgttgcacaatccgcactccttcatcaacaccgtaccgcacatgagctttgtgtggggcgatcaaaacgtcaacttcctgcgcgcgcgctacgctgccctgcaacagagcacgcttttccgcgggatgaaatactctgaagatcacgctcaaatcaaagagtgggcgccgctggtcatggaaggccgcgatccgaaccagaaagtggcggcgacccgcactgaaattggtactgacgttaactacggtgaaatcacccgtcagctggtggcctctctgaagaaaaaagagaactttaacctgcaactcagctccgaagtgcgtggtttcaagcgcaatgcggataacagctggagcgtgaccgttgccgatctgaaaaacaacgaagccgagcatgtgattaaggccaagttcgtgtttatcggtgcgggcggcgcggcgctgaaactgttgcaggagtccggtattccggaagcggacgactacgccggcttcccggttggcggccagttccttgtgtcggaaaacccggaagtggttaaccgtcatctgccgaaagtgtccggtcaatattcgactacgaggcggcaagaccgcgtaaggttggaagc

SEQ ID NO: 845 - DNA, 1401 bp, Enterobacter cloacae
atattgtttaaaggttacgaaattattgtaattgtgaaatttaatgatggattgtttgtagggttttggcagacaggctggcacccgacgattttcctggctatgatgctgcactttgtgatcgcgcgcacggaagcctgcccctaccagcgaattgttatgtcattaccccactcgtctttacctcaagaaggccatgtcgccactgttttacgttcgcctcaccgtctgatgcgcgaaaccctggccggtgtgattaccgcgctggcgctgatcccggaagtgatttcgttttccgtggtcgcgggcgtggatccgaaagtgagtcttatcgcctccgtggtgctctgtttcgccctttccctgctcggcgggcgtccggccatggtgacggcggcggcaggttccgtcgcgctggtgattggcccgatggtccatcaacacggcgtacagtacattctgcccgcggtggtgatggcaggcatgattcagatcctgttcggcgcgctgggtatggcgcggctgatgcgctttattccccagtcggtgatgaccgggtttgttaacgcccttggcatcttgattttctttgcccaggtgccccatttctggagccgaagcccgctgattgtgggcctgttcgtgctgacgctgctgattgtgctgtgggtgccacgctatatcaaaagcgtgccctccccgctgattgccattgtgctgctgactttgttcaccgtcaccagcgggcaaattctgccgacggtaggggatgaaggctccatgagcggcggtttgccgggctttacgcaactgctggtgccgctcaatctggaaaccctgagcattatctggccgtgcgcgctaagtatcgctttcgttggcctgctggaatccttactgacggcaaaactggtggatgaactgaccgcgaccccctccagtaagcgtcgcgagagcatcggtctgggcgtggggaatattatggccgggttctacggtggcattgcgggctgcgcgatgattgggcagaccatcgtaaacgtggagatggggaaaggcagaagccgtatctccacccttgcggcgggtatcgtactgctggtgctggttacggcgctcagcgaggtgatggccaaaatcccgatggcggtactggcgggtattatggccattgtggccgtcaagacctttagctggcatagcgttcagcccggaacgctgaaaaacgcgccggtggctgaaaccgtcgtgatgctggtgacggttgtggcaacggtttacaccggcaacctggcgattggcgtgctgggcgggattgtgatgatgttcatcctccctgcccgacttaagcaaaaagcactggctagagaagaaaaatcgtcgccagtccaagaaaaataa

SEQ ID NO: 846 - DNA, 606 bp, Enterobacter cloacae
attatgggtattttttctcgttttgccgacatcgtgaacgccaacatcaactcgctgctggagaaagcggaagatccgcagaagctggtgcgcctgatgattcaggagatggaagacacgctggttgaagtacgctccacctccgcccgcgcgctggcagagaaaaagcagttaacacgtcgtatcgagcaggcgactgcccagcttaacgagtggcaggaaaaagcggaactggcgctgcgtaaagataaagaagatctggcccgcgctgcgctgattgagaagcagaagctgaccgacatggttgccacgctggaacacgaagtgacgctggtggatgatactctgacgcgtatgaagaaagagattggtgagcttgaaaacaaactcagcgaaacccgtgcacgtcaacagggcgctggcgctgccccaccagggctgcaagctcgtcccgcgacgtgcgtcgccaactggacagcggcaaactggatgaagcaatggcgcgtttcgaatcgtttgaacgtcgtatcgaccacatggaagcggaagccgaaagccacagcatcggtaagcagaaaaccctggatcagcagtttgctgacctga

SEQ ID NO: 847 - DNA, 255 bp, Enterobacter cloacae
gcgtgccgcatcgttagacaaggagtacacatgagcgcgctttttctggctatacccctgaccattttcgtgctgtttgttctgcccatctggttatggctgcactacagcaaccgctcttcacgcggtgagctgtcgcagagtgaacaacagcggctggcgcagctctctgccgaggcaaataaaatgcgcgaacgtattcaggcgctggaagccatcctggacgcggaacacccaaactggagggaacggtaa

SEQ ID NO: 848 - DNA, 615 bp, Enterobacter cloacae
ttaccgcttaatgaaggaagtcccatggctacaaaacgtcgtgctgaaacggcccaggaaaatcgcgagaaaatgattcaggcggcgcggaaggcatttgctgaaaaaggctatgccgcagcgtcaatggatgaactcacggcaagcgtggggttaacacgcggcgcgctatatcataatttcaacgacaagaagggattactggcggcggtggtcgcgcagatagacagcgaaatggcagcaaacgcgaaagcgattgccgccgccgccgatgatgactgggagcgactgctggcggagggcatcgcctatatcaaaatggcgctcgttccggaagttcagcgtatcgtccttcttgacggcccggctgttctgggcgacccggcgcaatggcccagccagaacaactgccttgagtcgacccgtcagaccatcgaaaaaatgatggagtgcaacgtaatcaaaaagatggatgccagagtcgcagcccatctgctgaacggcgctgcgctgaatgcggctctgcttattgccgcgagtgatgaaccgcagaagacccttccgcatgccatagaggtgtttactctgctggcaagcgggttacgcaacggctaa

SEQ ID NO: 849 - DNA, 294 bp, Enterobacter cloacae
aaacaaactcagcgaaacccgtgcacgtcaacagggcgctggcgctgccccaccagggctgcaagctcgtcccgcgacgtgcgtcgccaactggacagcggcaaactggatgaagcaatggcgcgtttcgaatcgtttgaacgtcgtatcgaccacatggaagcggaagccgaaagccacagcatcggtaagcagaaaaccctggatcagcagtttgctgacctgaaggccgatgatgaaattagcgagcaactggctgcgctgaaagccaaaatgaaacaagacaaccaataa

SEQ ID NO: 850 - DNA, 429 bp, Enterobacter cloacae
aatgcgcgaacgtattcaggcgctggaagccatcctggacgcggaacacccaaactggagggaacggtaatggctggactgaatctgaataaaaaactgtggcggatcccacagcagggcatggttcggggcgtttgcgccgggctggcgcactatctggatgtcccggtaaaactggtgcgtgtggtcaccgtattgtcgattttcttcggtctggcctttattacactggtggcatacatcattctgtcgtttgtactcgatcctatgccggaaggtgagctgaatgctgagaacacgccaaccagcagagatctcctgaacgcggtggatgaacagctgagcgcaggggagaagcgattgcgcgagatggaacgttatgtcacctccgatacctttacgctgagaagtcgttttcgtcagctttaa

SEQ ID NO: 851 - DNA, 237 bp, Enterobacter cloacae
gagagaacttacatgaaacaaaactggcaacaggccggtcagaaggtaaaacccggcctgaaaatcgcaggtaaactggttctgatgacggcgttacgttatggcccggccggtgtggcgggttgggcgatcaagtctgttgcccgcaagccggtcagaatgatgctggcggtcgctctggagccgctgttacagaaactggcaaaacgcgtttcccggcgctacctgtcacgctag

SEQ ID NO: 852 - DNA, 996 bp, Enterobacter cloacae
ggagtggttaatttcatcatggctgaatataaagataatttgcttggcgaagccaacagcttcctggaagtgcttgaacaggtttcgcgcctcgcgccgctgaataaaccggtgctgattatcggtgagcgcggaacgggtaaagaacttatcgctaaccgcctgcactttctgtctggccgctgggacggcccttttatttcccttaactgcgcggcgttgaatgaaaatctgctcgacaccgagctgtttggtcatgaagctggcgcctttaccggcgcacaaaaacgccatcccggacgctttgagcgcgccgatggcggaacgctctttctcgacgagctagcgaccgcgccgatgctggtgcaggaaaagctgctgcgcgtcattgagtatggcgaactggaacgcgttggcggcagtcagccgctccaggttaacgttcgcctggtgtgcgctactaacgccgacctgcccgcgatggtggcagaagacaaattccgcgccgacctgctggacaggctggctttcgatgtcgttcagctgccgccgctgcgggagcggcgcagcgatatcatgctgctggccgatcaatttgccattcagatgtgccgggaactgggtctgccgctctttccgggcttcagcgaacgggccaccgggaccctgctcggttaccactggccgggcaatattcgtgaactgaaaaacgtggtggaacggtccgtttaccggcatggcagcagcgagaccgaactggacaacattattctcgatccgtttcgtcgcgaggataaacagcccccggctccggcgacgcgccagcaggatccggcgttgccgctcgatttacgccagttccagcatcagcaggaaaaaaacttgctcgagcagagcctgaaagaggcgaaatataatcagaaacgggcggctgaactgctgggcctgacctaccatcagttaagggcattgctcaaaaaacatcaaatgcgctga

SEQ ID NO: 853 - DNA, 990 bp, Enterobacter cloacae
gaaagaacaagaggtgaagaaaccatgattatatttaccttgcgtcggctgctgttactgctggtcaccctgttcttcctgacctttgtcggctttagcctgagctactttacgccgcacgccccgcttcagggctcatccctctgggacgcctggctgttctggtttaatggcctgctacactgggattttggcgtgtccagcattaacggacagctcatctccgagcagctgaaagtggttttcccggccaccatggagctgtgtgtactcgcctttggctttgccctcatggtggggatcccggtggggatgctggcgggcatttatcgtaataagtggcaggataaattcatcagcgcgcttgccttaattggcttttccatccctgttttctggctggcgctactgcttaccctcttcttctcactgacgttaggctggctgccggtatctggccgttttgatctgctgtataacgtgcaaacggtgagcggcttcgccatcgttgacgcctggctttctgattcagtctggcgcgacgaaatgatcgtgagcgcgctgcgccacatggtgctgccggtgctcacgctggccgtcgcgccgacgaccgaagtaattcgcctgatgcgtatcagcactatcgacgtcttcgatcaaaactatgtgaaggccgccgccacgcgcggactgtctcgcctgacgattctccgtcgccatgtgctgcacaatgcgttgccacccgtaatcccacgtcttgggctgcaattttcaaccatgctgacgctggcgatgatcaccgagatggttttcagctggccgggccttggacgctggatgatcaacgccattcgccagcaggattacgcggcgatctctgccggcgtgatggtgattggctccctggtcattattgttaacgttgtttccgatattttgggtgccatggccaacccattgaagcataaggaatggtatgccttacgataa

SEQ ID NO: 854 - DNA, 1041 bp, Enterobacter cloacae
cctgctgggcgacgggatccgccgcgcaatcaatgcgggggtgcaataatgccgttactcgatatccgcaacctcacaatagaaattaaaacgggcgaaggctgggtcaaggccgtggatcgcatcagtattacgctcgcagagggcgaaatccgcgggctggtgggcgaatcgggttcggggaaaagtctgatcgccaaggccatttgcggcgtggcgaaagacaactggcgggtgaccgccgatcgtatgcgcttcgacgacatcgatctgttgcgtctctccccgcgcgaacgccgcaaactggtgggccataacgtctcgatgattttccaggagccgcaatcctgtctcgatccgtccgagcgcgtcgggaaacagctgatgcagaacatccccggctggacctataaaggccgctggtggcagcgtttcggctggcgtaaacgtcgtgccattgagctgttgcaccgtgtcgggatcaaagaccataaagacgcgatgcgcagtttcccctacgaactgaccgacggtgaatgccagaaagtgatgattgccatcgccctggcgaatcagccgcgtctgctgattgcggacgaaccaacgaacgcgatggagccaaccacccaggcccagattttccgcctgctcacgcgtctgaaccagaataacaacaccaccattttgctgatcagtcacgacctgcaaatgctgagcaagtgggcggataaaattgatgtaatgtattgcggccagacggtagaaaccgcgccaagtgaagacctggtgacgacgccacatcatccctacacgcaggcgctgatcagggcgatcccggactttggcagcgcgatgccgcacaaaagccgtctgaatacgctgcctggcgcgataccgctgctggaatcgctgcccattggctgccgtctgggaccacgttgcccgtatgctcagcgtaaatgcattgaaacaccgcgcctgacagggccgaaaaaccatctgtttgcctgtcatttcccgctgaacatggagagagagtga

SEQ ID NO: 855 - DNA, 1761 bp, Enterobacter cloacae
gggcattgctcaaaaaacatcaaatgcgctgacattatcagcacttacccccagacatttttacgaagcaggcgtaagtgcgatacactttgcagatcgaatctaaaaaccttaaaaactatgcgcctggttttatcgtccctgtttgcactcggtctgttcagcaatctggcctttgctgcgcccgatcgcgctgtgccccctgatatccgagagagtggtttcgtctattgcgtcagcgggcaagttgatacctttaacccacaaaaagcggggagcggcctgattgttgatacgctggccgcacagctctacgatcgcctgctcgacgtcgatccttatacctatcggctggttccggagcttgctgaaagttgggaagtgcttgataacggcgccacataccgctttcgtctacgcgatgatgtcgcctttcagcacactccgtggtttacgccaacccgtaaactcaacgcggatgacgtggttttcaccttccagcgcatattcaaccgcaatcatccgtggcataacgttaatggcgggaacttcccctatttcgacagtctgcaattcgcggactcggtcaaaagcgttcgcaaactggataaccgtacggttgagtttcgcctgacgcgcccggacgcctccttcctctggcatctggcgacgcactacgcctcggtcatgtcagccgaatacgcagatcagctgacgaaaaaggatcgtcaggaacgtctcgatcgtgagcctgtgggcacaggtccgttccagttagcagagtaccgcgccggacaatacattcgcctgcaacgccacgatcgtttctggcgcggcaaaccgctgatgccgcaggtcattgtcgatctgggttcaggtggaacaggccgactctccaaactgctgaccggcgagtgcgacgtgcttgcctggcctgcggccagccagttgaccattttgcgcgacgacccacgcctgcgcctgacactgcgcccgggaatgaacatcgcttatctggcgtttaacaccgataagccgccgctgaataatccggccgtgcgccatgcgctggcgttagcaatcaacaatcagcgtctgatgcagtcgatttactacgggaccgcggaaaccgccgcctctattcttccgcgcgcctcctgggcctatgacggcgaggcgaagattaccgaatataatccggcgaaagcgcgcgaacagcttaaagcgctgggggcagaaaacctgacgctacagctgtgggtgcccaccagctctcaggcgtggaaccccagtccgcttaaaacggctgagctgttgcaggctgatatggcgcaggtgggcgttaaggtgatcatcgtgcctgtcgaaggccgtttccaggaggcgcgtctgatggacatgaatcacgacttaacgctggctggctggtccaccgacagtaacgacccggacagcttcttccgtcctctgctgagctgtgcggcaatcaactcccagaccaactacgcccactggtgtaaccgggaatttgatgccgtgctgcaaaaagcgttggcgtctcaacagcttgcctcacgcattgaggcctatgatgaagcgcaaaatattctggccagagaacttcccgtgttgccgcttgcctcttccctgcgcctccaggcctaccgttacgatattaaagggctggtactcagcccgtttggtaacgcctccttcgcgggcgtcacccgtgagaaagaacaagaggtgaagaaaccatga

SEQ ID NO: 856 - DNA, 906 bp, Enterobacter cloacae
agcataaggaatggtatgccttacgataacgtctacagcgaaaagcgcacgcccggtgcgctacgtaccgtgtggcgtaatttttacggcgacaccacggcgatgatcggcttttacggctgcattggcctcgtgttgctgtgcgttttgggttcgtggtttgcaccgtatggcatcgatcagcagttccttggttatcagcttttaccgccgtcgtggtcgcgttacggggaggtttcgttcttcctggggactgacgatctcggacgtgacgtgctaagtcgtttactgagcggcgccgcacctacggtaggcggcgcgttcgtggtcaccctggctgccgcgatctgcggcctggcgctgggcatttttgccggctcaacccacgggctgcggtcggccgtgcttaaccatattcttgataccctgctctctattccttcactgctgctggcgattatcgtcgtggccttcgcggggccgcacctcacccatgcgatgttcgccgtctggctggccattctgccgcgcatggtgcgttcggtttacagcctggttcacgacgagctggaaaaagagtatgtcgtcgccgcccgtctggatggcgccaccacgtttaatattttgtggtttgccgtgctgcctaacattgccgccgggctggtgacggagatcacccgcgccctgtcgatggcgattctggatatcgcagcgctgggcttcctggaccttggcgcgcagcttccctccccggaatggggcgccatgctcggcgatgcgctggagctgatttacgttgcgccgtggacggtcatgctgccgggcgcggccatcatggtgagcgtgctgctcgttaacctgctgggcgacgggatccgccgcgcaatcaatgcgggggtgcaataa

SEQ ID NO: 857 - DNA, 825 bp, Enterobacter cloacae
acatggagagagagtgaaatggtcgaaaccttactggaagtacgtaacctgagtaagacctttcgctatcgcaccggcctgtttcaccgtcagaccgtcgaggcggttaaaccgctgagctttacgctgcgcgaaaagcagacgctggcgattatcggtgaaaacggctcgggcaaatcgaccctggcaaaaatgctcgcgggcatggtcgagccaagcggcggtgaaatactgattgacgatcatcctctggaatttggggactactcttttcgcagtcagcgcatccggatgatttttcaggatccgtcgacgtccctgaacccgcgccagcgtatttcccagatcctggatttcccgctgcggttgaataccgacctggagccggaagcgcgtcgcaaacggattgtcgaaaccctgcgtctggtaggcctcctgcccgaccatgtcagctattacccgcacatgctggccccgggccaaaaacagcgtctcggtctggcccgcgcgctgatcctgcgcccgaaagttattatcgccgacgaagcgctggcgtcgctggatatgtcgatgcgttcgcagctcattaacctgatgctggagttacaggaaaagcaggggatctcttatatttacgtgactcagcacctgggcatgatgaaacacatcagcgaccaggtgctggtgatgcaccagggagaagtggtcgagcgcggcagtaccgctgacgtactggcctccccgctccatgacctgacaaaacgcctgattgccggacactttggtgaagcattgacggcggacgcgtggcgtaaagatcgttag

SEQ ID NO: 858 - DNA, 435 bp, Enterobacter cloacae
gcaagactcagttcgcctttcaatcctgcaagacttaacccggtatcgggaaaagtgagtccccataatggcattgattattccatgcccatgaacacgaaaatagtcagcgtcatcgacggaaaaatcacccgggccgaatacaacagtaccatgggatattttgttgaagtaacgggaaaagccggtgttaaaactcgctatctccacctcaataaaatactcgttactaaaggggccagggttacacggggaggtgctattgcgttatccggtaacagcggacgttcatccggtcctcatctgcattacgagctggtcatcaataacaaccctgttaactctctggcgttccgggcagcggcacccgctgataacaaactcgaacagcatgcctttgcgcatgccagagactacgaacgatacctggactga

SEQ ID NO: 859 - DNA, 1341 bp, Enterobacter cloacae
ccgtcaggcgcatatgccaggtgttttgattttttagcggaaaattgtatggcttctttaaagataaaatatgctgcaataattatcagcagcctcatagcaggggggctgatatcggttactgcctggcagtatgtaaactcagcacaaaagacagaaaaaacagaacaaaaggcaccggaacgaaaggtgcttttctggtatgacccaatgaaaccggataccaaatttgataaacccggaaaatcgccctttatggatatggacctggtgccaaaatatgctgatgacagtggcgataaaagcagtggcgagatccgtatcgacccaacccaggttcagaatctgggattaaaaacgcaaaaagtcacgcgaggaatgctgaattattctcagacaatcccggctaatgtcagctataacgagtatcagtttgttattgtgcaggcgcgttctgacgggtttgtcgaaaaagtctaccccatgacgattggcgatcatgtgaagaaggggacgccacttatcgatattaccattccggactgggtggaagcacagagtgaattccttctgttatccagcaccggtggtacttccacgcaaattaaaggcgttctggaacggcttcgcctggcaggtatgccggaagaggatattcagagactgcgttctacccggagcattcagacccgttttaccattaaagcacctattgatggtgtcattactgcatttgacctgcgcaccggcatgaatatttcgaaagataaggtggtggctcagattcagggaatggacccggtctggatcagcgctgcagtgccagaatctatcgcctatctgctgaaagatacgtcgcagtttgaaatttcggtaccggcttatccggataaaacattccatgtcgaaaaatggaatattcttcccagcgtggatcagacaacccgtacgcttcaggtccgtctccaggtttctaataaggatgagtttctcaagccgggcatgaatgcctatctgaaactgaataccagaagccaggagatgctgctgataccaagccaggccgttatcgataccggcaaagaacagcgcgtgattactgttgatgatgaaggcaagtttgtgccgaaacagatccacgttctgcatgagtcacagcaacagtccggcatcggctccggcctgaatgaaggcgataccgtggtggtcagtggcctgttcctcattgactctgaagccaatattacgggcgcactggaacgtatgcgccaccctgaaaaaacagaaagcagtatgccagcaatgtctgaccagcctgtaaatatgcattcagggcactga

SEQ ID NO: 860 - DNA, 2496 bp, Enterobacter cloacae
cataccctgaagacagaagatgcttcggtatgcataaggagagttactgtgaaaaatgacaatgcagtgcaacacaacaaccagactgcttctgagcagacattatccccggacgagggccacgtattgcataaggtgagagatcccgtgtgcgggatggccatcctgcccgacagggcgcacagcagcattcgataccaggaccatcaactttatttctgctccgccagctgtgagagtaaatttaaagcccatcccgatcgtaatcttaccgaagatgccagtgaacattcccatcaccatcaccacgatcatcacgaagtcagccctgatcagataaaacagcctcaccaccaggcggaaaaagagaattctgaaggtgtgtggacatgtccgatgcacccggagatacgccgcagtggtcccggaagctgtcctgtctgtggaatggcactggagccgctcgtagctacggcatccacggggccgagtgatgaacttcacgacatgacaagacgcttctggctggggttgttgctggcgtttccggttctggtactcgaaatgggatctcatctgtttcccgagttgaggaatacagtaccgccacagtacaacacatggctgcagctgcttctggcctcccctgtcgtgttgtggtgtggctggccattcttcgcccgggccggaatgtcgttacgtaaccgctccctgaatatgtttacccttgttgcaatggggaccggcgtagcctgggtttacagcgtcattgcaaccgtcttcccctcctggtttcctgcatcgttcagaaacatggatggcctggtggccgtttattttgaagccgcagcagttattacggtgcttgttctgctgggacaggttcttgagctgcgggcacgggaacaaacctcaggcgccattactgcgcttctgaaccttgcccccaaaaccgccagacggctggatcatgacggtcatgaaacggatattaatgcggaagatgtcctgcctggcgataagctccgcatcagacctggagagagtattccggtcgacggtatcgtgatcgaaggcaaaacaaccgttgatgaatcgatggtgaccggggaatctatgccggttaccaaaacggagggtgaccctgtcatcggggggaccattaatcagacagggagtctcatcatccgtgcagagaaagtcggtgatgaaacaatgctctcacgaattgttcagatggtcgctgatgcacagcgttcgcgtgcccccatccagagaatggctgacagcgtttcaggctggtttgttcctctggtgatacttatcgcggttgttgctttcgtgatctggtctgtctgggggcccgagcccaggatggcgcacggtctcattgcggctgtgtcggtcctgattattgcctgtccctgcgcgctggggctggccacgccgatgtcgataatggtgggggtgggcaaaggagcccaggccggggtgttaatcaggaatgccgaagcccttgagcgtcttgaaaaagtggacacgctggttgtcgacaaaacaggcacgctcacggaaggttcgcctacggtgacagggattatcagtctcaatccgggtggggaaacatctcttttgcgtgtaacagccgcagtggaaaaaggctcgcagcatccgctgggtatggcagtagttaaagcagcacaggaaaaggggatcgcaatacccgcagtcactcatttcgatgcaccgtcgggtaaaggtgtctcaggcgatgtcgaaggtcaacgggttgttattggtaatgaactggctatgcaggaaaacagtatagttattgataatcaaaaggccgttgcggatacgttgcggatggaaggcgctaccgttatctatgtggccacagacggggaccttgcaggcctgatagctatctcggatcccgtgaaaacaaccacgccggatgcgcttaaagctttgcgtcaggcggggatccgcatcgttatgctcaccggggataaccagcttactgctgaagcagtcgcacggaaactgggaatagatgaggttgaagccggaattctgccggatggcaaaaaagcagtgataacccgactgaaagagtctggccatgtggttgcgatggccggagacggtgtgaatgatgccccggcgctggcagcggctgacgtgggtatagccatgggaacgggtacagatgtggcaattgaaagtgccggagtcacccttctcaaaggcgacttgatgatactgaacagggcccgtcatctgtcagagatcaccatgaaaaatatccgtcagaatctgttttttgcatttatctacaacgcacttggcgtgcctgtggctgcaggtctgctttatcctgtgtatggaatactgctgtcgccagttattgcggcggcggccatggctctttcctccgtcagcgtcattgtgaatgcgttgcgtctgaaaagtgtcaggctcgggaaataa

SEQ ID NO: 861 - DNA, 573 bp, Enterobacter cloacae
gggtctgtgtttggctcgggtccgttccatcccgtggtgaagagacgcggatctcagctgaaagcggctgatgccaatattggcgcaccgcgagcggcctttttcccctcaattaccctgaccagtggtctttccgcaagcagtacggagctgtccagcctgtttacgtcaggaagtggaatgtggaattttatccctaaaattgaaattcctatatttaatgctggcaggaataaagccaatctgaagctggctgaaattcgccagcaacagtcggtggttaattacgaacaaaaaattcagtcagcctttaaggatgtttccgacacgcttgcgctgcgcgacagccttagccagcaacttgagtcacagcagcgttatcttgattcacttcagataactctccagcgtgccagaggattgtatgcaagtggtgctgtcagttacatcgaagtgctggatgcagaacgttccctcttcgctacccagcaaaccattctcgatcttacctattcccggcaggttaacgaaattaatctgtttaccgcgctgggtggcggttgggtagagtaa

SEQ ID NO: 862 - DNA, 381 bp, Enterobacter cloacae
atttatttaattaatcaggaaattaaaatgcgtaattcacttaaagccgttttatttggtgccttctctgtcatgttttctgccggtcttcatgctgaaacacatcagcatggcgatatgaatactgccagtgatgcttcggtacagcaagttatcaagggcaccggtgtcgttaaagacattgatatgaatactaagaaaatcaccatttcgcatgaagcaattccagcggtgggctggcctgcaatgaccatgcgctttacttttgttaatgcagacgatgctattaatgccctgaaaacaggcaaccatgtcgatttctcgtttattcagcagggcaatatctccttactcaaaagcattaacgtgacgcagtcctga

SEQ ID NO: 863 - DNA, 3177 bp, Enterobacter cloacae
atatgcattcagggcactgaggagacgacgatgattgaatggattatccggcgctctgtcgccaaccgtttcctggtcatgatgggggccctgtttctcagcatctggggcacatggacgattattaacacgcctgtcgatgccttgcctgacctgtcagatgtgcaggtcattatcaaaaccagctatcccggccaggccccgcagattgtagaaaaccaggtcacctatccacttaccaccaccatgctgtccgtgcctggcgcaaaaaccgtgcgtggtttttcacagttcggtgattcgtatgtgtatgtcatttttgaagacggcaccgatctgtactgggcccgttcccgcgtgctggagtacctgaaccaggtacagggaaaactgcccgccggtgtgagttctgaaatcggtccggacgccacgggggtgggctggatatttgaatatgcccttgtcgatcgcagcggaaaacacgacctttcagaactgcgttctctgcaggactggttcctgaaatttgagctgaaaaccatcccgaacgtggctgaggtcgcttcggttggcggcgtggtgaaacagtaccagattcaggtcaatccggtaaaattgtctcagtatggtatcagcctgcccgaagtgaaacaggcccttgaatcgtctaaccaggaggccggtggctcatccgttgaaatggccgaagctgagtatatggtccgtgccagcggttatcttcagagcattgatgattttaataacatcgtcctgaaaacaggcgagaacggcgtgccggtttatctgcgggatgttgcccgcgtgcagaccgggcctgaaatgcggcgtggtattgccgagctgaacggccagggcgaagtcgctggcggcgtggtgatcctgcggtcgggtaaaaatgcacgcgacgttatcacggcagtgagggataaacttgagacgctgaaggccagcctgccggaaggcgttgaaatcgtgaccacctacgatcgcagccagctcatcgaccgggcgattgataacctcagttccaaacttctggaagagtttatcgtggtggccatcgtctgtgccctgttcctgtggcacgtacgttctgccctggtggcgattatctctctgccgcttggtctgtgtatcgcctttatcgtcatgcacttccagggactgaacgccaatatcatgtcgctgggagggatagcgattgccgtcggtgcgatggtggatgccgccattgtgatgattgagaatgcgcataagcggcttgaggagtgggatcatcagcatccgggtgagcagattgacaacgccacccgctggaaggtgattaccgatgcctccgttgaagtgggacccgcactgtttatcagcctgctgatcatcaccctgtcctttattcctatctttaccctggaaggtcaggaaggacgtctgtttggcccgctggcattcacgaaaacgtactccatggcgggcgcggccgcgctggccatcatcgtcattccgattctgatgggattctggatccgggggaaaattcctgcagagaccagtaaccccctgaaccgggtactgatcaaagcgtatcatccattgctgttgcgggttctccactggccaaaaacaaccctgctggttgcggccttgtccattttcaccgttatctggccgctgagccaggtgggcggtgagtttctgccgaagattaacgagggcgacctgttgtatatgccgtcgaccctgccgggtgtctctccggctgaagctgcagcgctcctgcagacgacggacaagttaatcaaaagcgttcctgaagtggcctctgtatttggcaagaccggtaaagcagagaccgccacggattccgcaccgctcgaaatggttgaaaccacgatccagctcaaacctgaggatcagtggcgtccaggcatgacgattgacaagattattgaagaactcgacaggaccgtccgtttaccggggctggcaaacctctgggtgccgccaatccgtaaccgtattgatatgctctcaaccgggatcaaaagcccgataggtatcaaggtgtccggaacggttctgtccgatatcgatgcaacggcgcagagtatcgaagcggtcgccaaaaccgtacccggcgtagtgtctgctctcgcagagcgactggaaggcgggcgctacattgatgtggatatcaaccgggaaaaagcctcccgctacggaatgacggtgggcgatgtgcagctgttcatctcatcagccatcggcggcgcgacggtaggggaaacggttgaaggcgtggcccggtacccgattaatatccgctatccgcaggattaccggaacagcccgcaggccctgaaacagatgccgatcctgaccccgatgaagcagcagatcacgctgggcgatgttgcggatattaaggtcgtttccgggccgactatgctgaaaacggaaaatgcccgtccagccagctggatttacattgacgcgcgcggcagggatatggtgtcggtggttaatgacattaaaacggcgatcagtcagaaagtgaaactgagaccgggtaccagcgtgtcattctccggacagtttgaactgcttgagcatgccaacaagaaactgaagctgatggtgccgatgacggtgatgatcatcttcatcctgttgtatctggcattccgccgggttgatgaagccctgctgatcctgatgagcctgccgttcgccctggttggcgggatatggttcctgtactggcagggcttccatatgtctgtcgcaaccggaacggggtttatcgctctggccggggtggcagcagagtttggcgtggtcatgctgatgtatctgcgtcatgccattgaagcgcacccggaattgtcccgtaaagagacgttcacaccggaaggccttgatgaagccctctatcatggtgccgtactgcgtgtccggccgaaagccatgaccgtggcggtgatcattgcgggtctgctgccaatactctggggaaccggtgcaggttcagaagtcatgagccgtatcgcggcacccatgattggtgggatgatcacggctccgctgctgtccctgttcattattcctgccgcctacaaattaatctggctgcgcagacataaaaaaagcgtgtcctga

SEQ ID NO: 864 - DNA, 402 bp, Enterobacter cloacae
cttcccccattacgcggattggccactcgtggtgaagacgatgacggtgcgaaatgcgggcgttgtggccacgaattatttgatggcgatgtcattaacgcgacgggtgctacgctggacaaactcctcaaggacgatctgcctgttgtggtcgatttctgggcaccgtggtgcggcccctgccgtaactttgcgcccatcttcgaagacgtggctgaagagcgcagcgggaaaatgcgttttgtcaaagtgaataccgaagcggaacgtgaactcagcgcccgttttcgcattcgcagcattccaaccattatgattttcaaaaatggtgaagtgatcgacatgctcaatggtgcagtaccgaaagcgcctttcgacagctggttaaacgaatccctgtaa

SEQ ID NO: 865 - DNA, 2715 bp, Enterobacter cloacae
ggcagaaagcgtttaaaatcatcaggtcgcttgcattcacaggaggcctgcatgagccagagagggttagaagcgctactccgtccgaaatccattgccgttattggcgcctcgatgaaaccggaccgcgcagggtatctgatgatgcgcaatctgctggctggcggatttaacggcccggtcatgcccgttacgcccgcttataaggcggtacagggggtgctggcgtggccggacgtgcaaagtttaccgtttgttcccgacctcgccgtgctctgtacgcatgcgaaacgaaacctcgaattgcttgagtcgctcggtcagaaaggctgtaaaacctgcattattctttcctcgcctcctgaacagcagcccgaactgctggcctgcgccagccgctaccagatgcgcattcttggtccaaatagcctcggtctgcttgcgccctggcaagggctgaatgccagtttttccccggttccgatccgtaaaggcaaactggcctttatttcgcagtcggctgcggtatccaataccatcctcgactgggcgcagcagcgtgagatgggcttttcctatttcattgccctcggcgacagcctggacattgacgtcgatgagctgttggatttcctggcgcgtgacagcaaaaccagcgctatcctgctctaccttgaacacctgagcgacgcccgtcgttttgtgtcggcgtcgcgtagcgcatcacgtaataaaccgattctggtcatcaaaagcgggcgcagccccgcggctcagcgcctgctacattcccgttccgggatggatcccgcatgggatgcagcgatccagcgcgccggtttattgcgggtacaggatacgcacgagcttttttccgccgtcgaaacgttaagccacatgcgccccctgcgcggtgaaaagctgatgattgtcagcaacggtgcagctcccgccgccctggcgctggacgagctctggctacgcaacggcaagctggccacgctgggtgaagagacgctccagcgcctgcgggatgcgttaccgggaagcgttgttcccgataatcccctcgatttgcgcgatgatgccagcagcgatcgttacattaaggcgatcacgattttgctggatagccaggactttgatgcgctgatgattatccattcgcccagcgcggttgcgccaggcagcgaaagtgcgcgtgcgctgattgaggcggtccgaaaccatccccgcggcaaatacgttaccctgctgaccaactggtgcggcgaattctcctcgcaggaggcacggcgtctgtttagtgaagccgggttgccaacctaccgtaccccagagggcaccattaccgcgtttatgcatatggttgaataccgccgcaaccagaagcagctgcgtgaaacgcctgccctgccgggcaatctcaccgcaaattcggtggatgtgcacaggcttttgcagcaggccatcgaagagggcgccacttctcttgacacacatgaggtacaacccattcttggcagttatggaatgcaaaccctgcccacctggattgccggcgacagcgctgaggcggtacatattgctgagcagattggttatccggtcgcgctgaagctgcgctctcccgatattccgcacaaatcggatgtgcagggcgtcatgctgtatctgcgcaccgcgacagaagtacaacaggccgcggatgccattatcgatcgcgtaaaaatgacgtggccacaggccaggatccacggcctgctggtgcagagcatggccaaccgtgcaggtgcgcaggagctgcgcgtggttgtcgaacacgatccggtttttggtccgctcattatgctgggtgaaggcggcgttgagtggcggccagaagaacaggcggttgtcgcgcttccccctctgaacatgaacctggcgcgttatttaattattcaggccatcaaaagcaaaaaaatccgcgggagaagcgctctgcggccgcttgatatcgccggattaagccagtttctggtgaaggtctccaacctcattgttgactgtgcggagatccagcgcctggatatccacccccttcttgcctccggaaatgaatttaccgccctggacgtgacgctggatattgcgccctatatcggtgacccggaaagccgtctcgccattcgtccttatcctcttcatctggaagagtgggtggagatgaaaaatggggagcgggcgctgtttcgccctatcctgccggaagacgagccgctgctgcgggcgttcatctcgcaggtgacgaaggaagatttgtactatcgctatttcagcgaaatcaatgaatttacccatgacgatttagccaatatgacccagatcgactacgatcgagaaatggcgattgtggcggtccgccgttccggagcgggagaggagatcctcggcgtgacgcgtgccatttccgacccggataatgtggatgccgagtttgccgtactggtgcgttccgatcttaagggtttggggttgggcagacggctgctcgaaaaactcattggttatacgcgcgatcacggattgtcacgcctgaatggcattactatgccaaacaatcggggtatggtgacactggcgcggaagctcggttttgacgttgatatccagctggatgaaggcattgtctctctgtccctcagcctgacttcgacggataaacaagagtaa

SEQ ID NO: 866 - DNA, 783 bp, Enterobacter cloacae
acgaatccctgtaacattcgcggggcatatcttgtgccccgttctctcctctgcgaaaatggggtttttcctgccttttcgcccatgactgataacgctgtacttcaattacgcgccgagcgccttgcgcgcgccacccgcccttttctggcccgaggcaatcgtattcgccgctgccagcgctgccttttaccgctgaaagtgtgtctgtgcgaaacgcttgcaccgagcgaggcgaaaagccgcttttgtctggtcatgttcgataccgaaccgatgaagcccagcaacacagggcgtttgatcgccgatattctgcccaacaccgcagcgtttcagtggtcgcgcactgagccacctcaggctctgctcgacctggtggcaagcccggactatcagcccatggtcgttttcccggcatcatatgcaggcgaacaacgtcaggtacttacggcgccaccatccggtaagccgccgctgtttattatgctcgacggcacctggaccgaagcaagaaagatgtttcgcaaaagcccttatcttgatgcgctgccggtgatttccgtcgatctgtcgcgtgtttcggcctatcgcttgcgtgaagcgcatgccgacggtcaatattgcaccgctgaagtcgccatagcgctactggatctggcgggcgatacccaggcggccggcgcgctgggcagtcacttctcctgcttccgcgaacgttatcttgcgggaaaaaccgttcataagggtagtgtcacagcaactgaggcagaaagcgtttaa

SEQ ID NO: 867 - DNA, 1377 bp, Enterobacter cloacae
acagagaagaaacgcactgtgatgttgtcaaaatttaagcgtaataaacatcaacaacaccttgctcaactaccgaagatttctcagtcagttgatgatgtagagttcttttatgctcccgctcatttccgggagacgcttcttgaaaagattgccagcgctacgcgacgtatttgcattgtggcgctctatcttgaacaagatgaaggtgggcgtgcgatcctgaacgcgctctatgaagcgaaacgtcagcgtccggaactggatgttcgcgtgctggttgactggcaccgtgctcagcgtggccgtattggtgcggctgcctcgaataccaatgctgactggtattgccgcacggcccaggaaaatccgggtattgatatcccggtgtatggcgtaccggtgaatacccgtgaagcgcttggcgttcttcattttaaaggatttatcattgatgacagcgtcctttatagcggcgccagcctgaatgatgtgtatctccatcagctcgataaataccgctacgatcgctaccatctgatccgcaatccgcagatggctgacatcatgttcaactgggttgataaaaacctggttcatggtcggggtgtgcaccgtcttgacgatcctcatcgtccgaaaagcccggaaatcaaaaacgacgttcgctccttccgccaggaactgcgcgatgcggtttatcgttttcagggtgatgccagtaatgaagaactgtccgttacgcctctggtaggcctgggaaaatccagcctgctgaacaagaccatctttcatttgatgccgtgcgctgagcataagctcaccatctgcaccccgtacttcaaccttcccgccgttctggtgcgtaatatcattcagctgttgcgtgatggtaaaaaggtggaaatcattgtcggggataaaacggcaaatgactttttcattccggaagatcagcctttcaagatcatcggcgcactgccttatctctatgagattaacctgcgccgcttcctgagccgtttacagtactatgtgaacacggaccagctggttgtgcgtctctggaaagatgaagacaacagctatcacctcaaagggatttgggtggatgacgagtggatgctgctgaccggtaataacctgaacccacgcgcctggcgtctggatctggaaaacgccatccttattcatgatcctcagcatgcgttagccgcgaaacgcgatcgtgagctggagcttatacgcacgcataccaccgtggttcgtcattatcgcgatctgcaaagcatcgctgattatccggtgaaagttcgcaagctgattcgccgtctacgtcggatccgtatcgaccgcctcatcagccgcattctgtaa

SEQ ID NO: 868 - DNA, 423 bp, Enterobacter cloacae
ttcgccgtctacgtcggatccgtatcgaccgcctcatcagccgcattctgtaatacacgggccctgtcatcgacggggctttttttatggagtctgttaatgcgtacgcctttcctgataatccctcttttcctgaccggttgcagccatatggctaatgataactggtcgggtcaggataaagctcaacactttctggcgtctgcaatgttgtccgctgcgggtaatgagtatgcgctgcaccaggggtatagccgggatcgaagtgccacaatgggcctgatgttctccatcagcctgggggcatcaaaagaactttgggatagccgcccctcgggaagcggctggagctggaaagattttgcctgggacgtagccggggcaacaaccggctacgccgtctggcagatggcgcattattaa

SEQ ID NO: 869 - DNA, 1377 bp, Enterobacter cloacae
cgattcgttttaaatccggttttactgtttgtgggcaatggcccgcaatgtgagacaggggattttaaaatgacagaaaccgtagccagtgcagatacggataacacaagtttagcaggcaaggatactcgccgtcgggtttgggcaattgttggagcctcatcggggaaccttgtagagtggtttgatttttacgtctattcattctgttcactctactttgcgcatatctttttcccatcagggaacaccacaacgcagcttctgcaaaccgcaggcgtttttgccgccgggttcctgatgcgtcccattggcggatggctgttcggcaggatcgcggacaggaaagggcgcaagacatccatgctcatctctgtgtgcatgatgtgcgtcggctcgctggtgattgcctgcttgcccggatatgacacaatcggaacatgggcaccggcgttgctgttgctggcacgtctgttccaggggctgtcagtgggtggcgaatacggcaccagcgcgacatacatgagcgaagtggctgttgaagggcgcaaaggtttctatgcatcattccagtatgtaaccctcattggcggacagctactggcgttactggttgtggtgatccttcaacaaatccttagcgatgaagatttacgcgcctggggctggcgcatcccgtttgccctgggggccgccctggcggttgtggcgctgtggttacgccgtcagcttgatgaaacctcccagcaggaggtcagggcgctgaaagaagccggttcgatgaaagggttgtggcgtaaccgcaaagcatttttgatggtattaggctttaccgccgcaggctcgctaagcttctataccttcaccacctatatgcaaaaatatctggtcaacacgacgggcatgcatgctaacgttgcgagtgtcgtcatgacggtggcgttactggtctttatgctcattcagccgattgttggcgcgctgtcggacaaaataggtcgccgcacctccatgctgatctttggtggcatgctcaccctggggactgttccgcttttgacggcgctacagcatacaacctctccgtatgccgctttcgctttgattatggtggcacttattattattagtttttacacggcaatcagtggcattttgaaagcggaaatgtttcccgcacaggtgagggcgctgggcgtaggcctctcttatgcggtcgctaacgccctgtttggcggatcagcagaatatgtcgcgctatccctaaagtcatggggcagtgaaacgaccttcttctggtatgtcaccatcatgggggcgctggcgtttattgtctccctgatgctgcatcgtaaaggaaaagggatccgcctttaa

SEQ ID NO: 870 - DNA, 441 bp, Enterobacter cloacae
gggggtctagtgcggtcctgccagtcccgtggtgaagacctggagctacatcttgaacaacttttccttgaacatggtcttactcagttcgcgacacagtccgtgactgaagggaataaaaaaccagacttcctttttccatcttctgatgcataccatgacaaagcatttccggacgaaaaactccatatgcttgcggtaaaaacgacatgcaaggatcggtggagacaagtgttgaatgaagcagacaggatacaaaacatccatctctttacgcttcaggaaggagtgtcattggcgcaatttaaagaaatgcagcaagaacgggtcacactggttgttccctcttccctgcacaaaaaataccctgaagctgttcgtccagaattgatgactctgggacattttattgccaggctgatcggcatctacgctgcataa

SEQ ID NO: 871 - DNA, 1557 bp, Enterobacter cloacae
agcagggtatctggttttttatcgcagttaacgcctcccgctgccagtctgacttcttatacgcagctgccggagagccccatgacctggaaaaacacagccgagcaaaacgccatcattgagtggaagggcactcatcttgtggtaaacgcttttgccggcacaggaaaaaccaccacgttagttagctacgctgaagccaatccggaaagcaggatgctttaccttgcctacaaccgcgctgtgcgggatgaagctgaacgcaggttcccctataacgtagagtgtaaaacgtcacatcagctggcatgggcacggttcggcaagcatttccgtgaccggctgacagccagtctgcgcattacggatgtggccagaaagctcaacacccgccactggccgctggccagactggcactcagcgggctgaacatgttcctctgcagtgcagaccccgagccagggctgatacacctgccgtctgaggatgatcgccacggtcttgatgcaggtaaaattctgggggcaatccagatcctctggtatgaaatgagtcgtactgattcagtctttcccgttacacacgatacctacctcaaaatgttccagctttctcagcctgacctgtcaaaacgctgggacaccatcctcttcgatgaggcgcaggacgccaatccggtgaccagtgcgtttgtactgaatcagccctgccgggttatcctggtcggcgaccgttaccagcagatttaccggtttcgcggggcggataacgcgctcaatgcccggcaactggcgcaggcagatcggttgtggctgacagcgagttttcggtttggccctgaggtggcgcgtgtggccaacatcctgcttgaacgtgccggagaggaaaagcgcgtggcaggtaacggggggcaggatgctgtcgtcagcgaccttcctgcaggggctgagcacattactgtactgagccggacggtgtccggcgtgatcggcagtgccctgacggcgagccttatggagaaaaaggtcttctgggtcggggggattgaaggctacaaaacggaggagctggaagacctgtactggttttccgccgatatgcctgaaaagatgcagtccccgcgcctcagccgggactaccgggattttgatgagtactgctcaatagccaaagccacccaggacgtggagatgaaccaggccattcgtctgctggatgactttttcccccttccgcaaaagctggccattatgcgtcgtcaggtcgtcagtcatgaaaaagaggctcaggtcacggtttcaaccgcccaccgtagcaaggggctcgaatggtcggtggtaatgctgagtgaggatttcaccgacattaccgatccgcttctttcgcaggaagagcggcaggatgagactaacctgttgtacgtggctgtcacccgggcaagaaagacgctcgttctgaacgaactgatgcgctggctcagcgaagccggcgagggcgatgatgagaacgatgccgttatgcccgacgacacgggagaaatttccgggactgaataa

SEQ ID NO: 872 - DNA, 1644 bp, Enterobacter cloacae
  unsure (253)
  unsure (264)
gcagccctgtaccaggagaacatcatgctcagcagaatccggaccctgaggtctctgttttcaaaaggcgaaccagaagcagtacatcatatatccacagtcacgcctgtcggctaccacgccccacgtggtgccggtatgctgtgcgccagcccgctacgaaaaacctgcctgcagcagatatgggagaactgctctctgcccgcagacatctatcagcgtctctatttagcgcctcttaatggtttattanccagggtacanaatgtgccggccacgcagaagggaaggtggtcacagtcagccggcttcggcgatcttacgctgcagttcacgacctgtgcggtcaggctggcaaaagggtatatgtttccacccggcgcggcaccagaagagcaggcagaacagaatgtgatgtggaatgcggtgattatctggtcggcgctgttctggcacctgctttttctggcgactctggagggggagttgcttgacggtaaaagctggcttccgggaatgaccattccggactcaccttaccgttttcggttccgggaggctgagaacgcatcagcgtttgctgcccttgccgccgggcaacttatgccgacagaggcgacgggctggctggcagagaatcccgaagcactgtgcaaccttgccggcgcactctggaatcagcatccgggcatgccattgatacgcggcctgatgaagcaagccgctgaaaaagtggaatcgccttcgctggggatatcaggggcaaatgagaaagttgatactctcgcagagccggccctttcagtttcgcgaacgtcgtctgatcgagagaccgaattacaaccctcatcagaagcaaaacttaaaacggcattgccagaaattgcagatttgcagggaactctacttgcatcttctattgcaccggtgccgatggctgatgacggcaatctcgtcagcaatgaaaaggcaggcgagattacggaatgtgatccaaatgaaacagaaatggctgatacagagatgctgctaagccttttcagtgcaatatcagtgcctgatatgaccgggactgaagcatgtgatgaagattcttcagtcaatgccagagcagaaaatgagccagaattttccccccttaatgaaatatcccctgaagctgataagcatgagataaatcagacagcagcagaaaactctttccccgaacctgatactgaggataacatcccattacactctgttaacattgatatgcaaaaaacagtgaaaaaagaacaggctggcactgaatttctcaggtggctttctgaggggatcaagagcaagcgaatcgatattaatcagcctgattcgagagcgcatgcagttgcagggttcatctttctccgggtaccggacatattttatctttacatcagagaaagcggatcagagctgagcagggattccctacagcaggaatttgagaagctgcatattcacagggtgcgccggggagagcgttttattaaagcaaaactgtaccattcgcccggtaaagaaggcacgtttagacctgtaagtggatatcttgtcaagactacacaccttttcagaggggcgtcttcccctgaagacagcgggcttctgtctttcctttga

SEQ ID NO: 873 - DNA, 1404 bp, Enterobacter cloacae
ttaggacatctgaacccgatgatgattaatgaggcacaagcgcaggcaactgcggccagcggcagcggagacggacggtatccgtcggggctgtgcgcgggtgctgaaatcataccggcggcagatgagcaaacgaaagcggagccgctgacgatggaggcggtgataacgagggaaaacctgatgctggcgtaccagcgcgtggtggaaaacaaaggcgcggcgggggtagataacctgagcgtggcggagttgaagccgtggctgaagcgacactggccgggcatcaggcaggcattgatcgacggaaactaccagccgcgggcaatacgcagaatggacatcccgaagccggacggtggcgtgaggacattgggcatcccgacggtggtggaccggctcattcagcaggcgatagcgcagcggttaagcgccatcgtggataaagacttctcagactccagctacggcttcaggccgggccgcagcgcgtggcaggcagtgcaacaggcacagcgctacgttcgcagcggaaagcgatgggtggtggacatggatctggagaagttctttgaccgtgtggatcaccggctgttgctggcccgcctggcccggaagatacgggacaggcggctgctgaggctgatccgccgttacctgaaggcggaaatggtcaaaggcggtgaaagagagaagcggcgcgaaggaatgccgcagggcggcccgctctcgccgctgctgtcaaacatcctgctggatgaactggataaagagctggagcgtcgtggacacagcttctgccgctacgcggacgactgcaatatctatgtgagcagccggaaagcgggcgaacagatactggaagcggtcagggagttcgtggagagcaaactgaagctgaaggtcaatgagcagaagagcgcggtagcgcgtccgtgggagcgaaagttcctgggatacagcgtgacgtggcacaaacagacgaggctgaaaatagcggcggcaagcgtggggaggctgaaggataaaatccgcagcctgacgacgggtaaccgcagccgctcagtcaaagcgacgatcgatgaactgacgccattgctgcgcgggtggataagctacttcagactgacggaagtcaggggaatactggaggagctggacggctggatcaaccggaagctgcgctgccagatgtggcggcagtggaagaggccgcgaagccgggccagaatgctgcaaaaggcaggactggggagggacagagcgatgctctcagcctataacggtcacggagcgtggtggaactcgggagccagtcatatgaatcaggcgataaagaggtcgtggttcagaggactgggcttaatatcactgctggaacatcacaggcagttccagcgttaa

SEQ ID NO: 874 - DNA, 204 bp, Enterobacter cloacae
actcagacgaacaggccagccgccgagatactgccagaacttggacagctcagcaggaggcaaattgctgcgctggttgaggttgccccttatgacagagacagtggtcgaatgaaaggccgtcgggttatctggggtgggaagagctggccttcgatccattttgtttatggctgtgctttctgttgtacggttcaatcctaa

SEQ ID NO: 875 - DNA, 1596 bp, Enterobacter cloacae
actgcagacccccggtgttgcaaaacagatgtttgtttatggttcgatggggagccaaaaaagcgaacaaatctcaaccactggttaaatatccagataaatttattttatctgggtcaaatgagtgatatggtgtcaccaatgagacccactggaggtgctatgtctgaatttgaattgcttgcgcaggatctcctgcagaaatccgaagaagaagaaaaactgcagcaagaaaaagacaaagagctgattgcaaaagttcttgaaatttatgatcaaaaatacgtggcagaactgctcaggaaagtaggcaataatgactggagcagggaaacgataaaccggtggattaacggaaagtgtgggccaaaatcattgacctctgctgaggaaattctactcaggaaaatgctgccagaacctccgaagcatcaccctgactacgcatttcgttttatcgatttattcgcgggcatcggcggtattcgcaaagggttcgaagaaattggccgtcattgtgttttcaccagtgaatggaacaaagaggctgtacgaacttacaaggctaactggtttaacgatgagctggaacataaatttaacctcgacattcgtgaagtcactctgagtgacagagaagacttgtcggaaacagctgcctataagcatattgacaaagaaattcctgatcatgatgtgctgttggcaggattcccctgccagccttttagcctcgcaggtgtcagcaaaaaaaattcattaggaagagctcatgggtttgaatgtgaagctcaggggacgcttttctttgatgttgcgcgtattattaaagccaaaaaaccggcgattttcgtccttgagaacgttaagaacctgaaaagtcacgataaaggaaaaacctttaaagttatcatggaaacactggatgagctcggttacgaagttgctgatgccggtgtctcaggttctgatgatcctaaaattattgacgggaaaaatttcttacctcagcacagagagcgaattgtattagtcggtttccgccgagatcttaaaattcacgatggatttacccttcgcaacattcataaattctacccacaaaatcgtccaacatttggagagttactggatcctgcagttgacagtaaatatattttgactccgaaactctgggaatacctgtataactatgccaagaaacatgccgcgaaaggcaatggttttgggttcggactcgttgatcctacgaatgtgaatagtgtggccagaactctctctgcacgctaccacaaagatggctctgaaatactgattgacagaggttgggataaagcgaaaggggaattagatttccgcgacgaagaaaaccaaagccggcggccacgaaggttgacgcctcatgaatgtgcccgcctaatggggtttgaaaaagtcggtggcaaaccgttcaggatccctgtttctgatacccagtcttatcgtcagtttgggaactctgtcgttgttcctgtatttgaagctgttgccagattgcttgaaccttacattggtaaagctgttgctgtgcgtacaaacaaagcaaaaaccaaataa

SEQ ID NO: 876 - DNA, 306 bp, Enterobacter cloacae
aaggccgtcgggttatctggggtgggaagagctggccttcgatccattttgtttatggctgtgctttctgttgtacggttcaatcctaaaatgaagcattactatcaggggctacttgaacgaggcaaggtaaaaaaagtcgcactcacagcatgcattcgaaaatttattacaattctcaatgcgatggtgcgtgactggaaaatgtggagtgctgaactgcagacccccggtgttgcaaaacagatgtttgtttatggttcgatggggagccaaaaaagcgaacaaatctcaaccactggttaa

SEQ ID NO: 877 - DNA, 1383 bp, Enterobacter cloacae
gcaactattgacacacacatgaaggcaaaagcgatattactcgcctctgtcctgcttgtaggttgccagtcacaaaacggcagcaacgtacaacagcacgcacagagcctttctgcggctggtcaaggggaagcagggaagtttacgagtcaggcgcgatggttggacgatgggacatccttcgcgcaggaacaagacttgtgggcctctattggcgacgagctaaagatgggaattccggaaaacagccggattcgcgaacagaaacagaagtatttgagaaataagagctatctccacgatgtaacattacgggcagagccgtatatgtactggatagccgggcaagttaagaaacgtaacatgcctatggaactggtactactacccatagtggagagcgcttttgacccgcacgcgacgtctggcgccaatgcagcaggcatctggcagatcattccgagcacagggcgaaattatggtttaaagcagacccgcaactacgatgcgcgtcgtgatgttgtcgcttcaacgacagccgctctcgacatgatgcaacgtctgaacaagatgtttgacggcgactggttattgactgtcgcggcgtataacagtggtgaaggtcgtgtactgaaggcaatgaaagcgaataaagcgcgtggaaaatccacagacttctggtcgctctcactgccacaggaaacaaagatttacgtaccgaaaatgctggcactgagtgacattctcaagaacagcaaacgttacggtgtacaactgccaacaccagacgaaagtcgtgcactggcgcgtgtccgcctcagcagcccggttgatattcaacaggttgccgatatgacgggtatgtcggtaagtaagcttaaaacctttaatgcaggtgttaaaggctccacgctgggtgctagtggcccacgctatgtgatggttccgcagaaacatgcggaacagttacgagagtctttagcttcgggtgaaatcgcagccgttcagtccacgctgatcgctgatacgtcgcctgtaagcagccgcagctataaggtgcgttcaggtgatacgctttcaggtattgcatcacgtcttggcgtgaatgcgaaagatctccagcagtggaataatctgcgcggatctggtctgaaagtgggtcaaacgctgaacgtaggtgcaggtagcagcgcacagcgtctcgctaaaaacagcgatagcattacctatcgcgtacgtaaaggcgactcgctgtccagtattgctaagcgtcacggcgtaaacatcaaagatgtgatgcgctggaacaacgatactgacaacctgcaacctggcgaccagctgacgttgtttgtgaaaaacagcgctacgccagattcctga

SEQ ID NO: 878 - DNA, 306 bp, Enterobacter cloacae
tcgctcaggctggcgctcgcgcgccccggaatactggagggtaccagcagcaggctggctaccatagcaatcacgcccaacagcgataccgcgaggaaggtttctcgccagccaaaatgttgcccaataaacgttcctaacggcacgccggtgaccagcgcaacggttaagccgccaaacataatcgcaatggctgacgccgctttctcttttggcaccaggctggttgcaatcgtggaaccgatggagaagaagacaccgtgcgcgaggccagtcagcaaacgggcaatgaccagcgtggtgtag

SEQ ID NO: 879 - DNA, 927 bp, Enterobacter cloacae
aattttgcggatgatgcaataatgaaagccacatcggaagaactgactatctttgttgccgttgttgaaagcggcagcttcagccgtgcggccgaacagctcgggcaggcgaactccgccattagccgctcggtgaaaaagctggagatgaagctcggggtgagtctgcttaataggacaacgcggcagctcagcctgacggaagaaggtgaacgttattttcgacgcgtgcagtccgttttgcaggagatggcggcggcagaaacggaaataatggaatcgcgcagcaccccgcgcggattgctgcgcatcgatgcggctacgccggtcgtgcttcattttttgatgccgctgattaagccctttcgtgagcgctacccggagatgaccctgtctctggtctcctcggaaacgtttatcaatcttattgagcgtaaagtggatgtggcgatccgcgccggaaccctgacggattcaagcttacgcgctcgccctctgttcaccagctatcgcaaaatgatcgcgtcaccgcaatatattgcagagcatggcaaaccggagaccgttgaggagctgaagcagcacctgtgcctgggctttacggaacctgtctcgctgaacacctggcccgtagcctgtcatgacggacaacttcatgagatcacctgcggactttcgtctaatagcggagaaacgctgaaacagctttgtcttgaaggaaatgggatcgcctgtttatcagactatatgattgataaggaaatagctgcgggtcagcttgtagaactgatggctgacaaacgcttacctgtagagatgccttttagcgcagtgtattacagtgacagagcggtaagtacgcgcatacgcgcttttatcgacttccttagcgaacatataaaaacagctcccggaggagctgtgtga

SEQ ID NO: 880 - DNA, 192 bp, Enterobacter cloacae
atccttatcgcggatcctgccagcctcgtggtgaagacactccccgtaattctgaaaaatgaacgacaaattaatttatttttaagaactgatgatgttgatttaattaataaaattaatcaagaaacaaatttgttacaacctgaagcgcgatttgcatggttaaggtcaaagaaagataacttcagataa

SEQ ID NO: 881 - DNA, 819 bp, Enterobacter cloacae
cgattgaggaatcatatgactatccctgcactgggtctgggcacttttcgcctgaaagacgatgttgttattgcatctgttaaaaccgcactcgagttgggctatcgtgctattgatacggcgcagatttatgataacgaagctgccgtaggccaggccatcgaagagagtggcgtaccgcgcgacgaacttttcgtcaccactaaaatctggattgagaatctcagcaaacacaagctgatcccaagcctgaaggaaagtctgaaaaagctgcgtactgactatgttgatctgacgctgatccactggccatctcctgatgatgccgtctctgtggaagagtttatgcaggcgctgctggaagcaaaagagcaaggcttaacgcgtgaaattggcatctctaacttcaccatcccgttgatggaaagggccatcgccgcagtgggtaaagagaatattgctaccaaccaaattgaactctctccttacctgcaaaaccgcaaagtcgtggactgggcgaaacagcatagtattcacatcacctcgtacatgacgctggcatatggtaaggcgctgaaagatgaagtgattgcgcgcatcgctgagaaacacaatgcgacagccgcacaggtgatcctggcatgggcgatgggtgagggctatgccgtgatcccgtcttcaaccaaacgtgaaaacctggcaagtaacctgttagcgcgggatctccagcttgatgatgaagataaaaacgcgatcgctgcactggaatgcaacgatcgtcttgtcagcccggaagggttagcaccagactgggattaa

SEQ ID NO: 882 - DNA, 873 bp, Enterobacter cloacae
cctaaaatccctataacattagaaccagtccgttttccgggctggttcatgttacagaggtcgtttccaaaagtgcgaaaaaatacctatgccatgcgttatgttgccggaatgcccgcggagaggatcttgcctccggggtcgtttgcgagcctgggtcaggcattaccagcgggcacgccattaagcagtgacgaaaaaattcgcgtactggtgtggaacatctttaaacaacagcgtgcggagtggttatccgtacttcaaaattttggtaaagatgcgcatctggttctgttacaggaggcgcaaaccacgcctgagctggtcaggtttgcaacgacaaactatcttgcagccgatcaggtgcctgcctttgttctgccacagcatccttctggggtgatgaccctttcagccgcacatccggtctattgctgcccgctgcgtgaacgtgagccgatcctgcgtctggcaaaatcggcgctggtcacagtctatccgttgcccgacacccgtctgctgatggtggtaaacattcatgcggtgaacttcagcctcggtgttgatgtgtacagtaagcagttacttcccattggcgatcagattgctcatcacagtgggccgatcattatggcaggggacttcaatgcctggagccgtccgcgtatgaacgcgttgtaccgcttcgcgcgtgaaatgtcgctgcgtgaagttcgttttaacgatgaccagcgcaagaaagcgtttggccgtcctcttgatttcgtcttctatcgtggtttgagcgtacacgatgcgtccgttctggtgacgcgcgcctccgatcataatcctctactagttgaattcagtcccggcaaacctgataaataa

SEQ ID NO: 883 - DNA, 1191 bp, Enterobacter cloacae
agagacggagtatttatgccactggcgcttcttgccctgacgatcagtgccttcgcaattggcacgaccgaatttgttattgtaggacttgttcccaccattgctgaacaactcgccatttcgctgccttctgccgggctgctggtatctatttacgctttaggcgtcgctgttggggcgcctgtgctgaccgcattgactgggcgctttgcgcgtaaaaaactgttagttgccctgatggtgctcttcaccgccggcaatattctggcgtggcaggctccggactacaccacgctggtcattgcccgtttgctgactggcctcgcgcacggtgtcttcttctccatcggttccacgattgcaaccagcctggtgccaaaagagaaagcggcgtcagccattgcgattatgtttggcggcttaaccgttgcgctggtcaccggcgtgccgttaggaacgtttattgggcaacattttggctggcgagaaaccttcctcgcggtatcgctgttgggcgtgattgctatggtagccagcctgctgctggtaccctccagtattccggggcgcgcgagcgccagcctgagcgatcaggttaaggttctcacacacccgcgcctgctgctgatctatgccgttacggctctgggttatggaggtgtgttcactgcgttcaccttccttgcaccgatgatgcaggagctggctggtttttctccgggcgcagtgagctggattttactgggctacggtatctccgtcgcaatcggcaatatctggggcggcaagcttgcagataagcatggtgcggtaccggcgctaaaattcattttcgccgcgctggttgtcctgctgatgattttccagttcaccgcgtcgatacaatacgccgcgctggtaaccgtgttggttatgggaatattcgcgtttggtaacgtaccgggattgcaggtctatgttgtacagaaagccgaacgctatacgcccaatgcggtggatgtcgcatccggcctgaatatcgccgcattcaatatcggcatcgcactcggatcggttatcggcgggcagacggttgaacacgttggattaacccaaacgccatggattggtgcggtaattgtgcttgtcgctttcctccttattggtctgagtggacggcttgataaacccgctcgcgtcgcgcttggataa

SEQ ID NO: 884 - DNA, 786 bp, Enterobacter cloacae
aaggacagcaacatgacaacaacacactcccatcatgacaacgtcgataaacagttcggttcgcaggcaagtgcctacctgagcagcgccgtgcacgcctctggccgcgacctggtgcgtctcggcgagcggctcgccgcgtttcctgacgcgcacgtgctggacttaggctgcggggcggggcatgccagttttaccgccgcagagcaggttgctcaggtgacggcgtatgacttatcgagccagatgctcgatgtggtcgctgaagcggcgaaagcgaaagggctgaataacgtcacgacgcgccagggctacgctgaatcattaccctttgaggatgcatcgtttgaggttgtgattagccgttactctgcacaccactggcatgatgtggggcaggcattacgggaagtgaaacgcgtactcaaaccgggcggaatcttcatcatcatggacgtgatgtctcccggacatccggtacgaaatatctggctccagacggttgaagcgctgcgtgatacctcgcacgtgcaaaactactccagtggagagtggcttacgtttatcaccgaagccggcttgatttcacgctcattgataaccgaccgtttgccgctggagtttgcgtcatggattgcgcggatgcgcacccccgaggcattaactcaggcgatccgattgtaccaggagagcgcctctgctgatgtgaaggcgtactttgagctgcatgacgatggttcgtttactagcgacaccattatggctgaagcgcaaaaagcaggataa

SEQ ID NO: 885 - DNA, 1011 bp, Enterobacter cloacae
ccaggctgtcgcctgagtaaggagtcaatgatgtcctctgttactacatccggagcgccgaagtcggctttcagttttggccgcatctgggaccagtacggcatgctggtggtctttgctgccctcttcgtcgcctgcgcgatttttgtgccgaacttcgccacgttcatcaatatgaaggggctggggctggctatctccatgtcaggcatggtggcctgcggaatgctgttctgcctggcctccggtgattttgacctgtcggtcgcctcggtgattgcctgtgcaggcgtcaccactgccgtggtgatcaacatgaccgaaagcctgtggatcggcgtgctggccgggctgctgctcggcgtgttgagcggcctggtgaacgggtttgtcattgcgcgcctgaagattaacgccctgattacgacgctggcgaccatgcaaatcgtgcgcggtctggcctatatcatctccgacggcaaagcggtcgggatcgaagacgagcgtttcttcactctgggctatgccaactggctggggctgcctgcgccaatctggctgacggtaggctgtttgatcctgttcggtttcctgctcaaccgcaccacctttggccgaaataccctggcgattggcggcaatgaagaggcggcgcgtctggcgggtgtcccggtcgtacggaccaagatcattatcttcgtgctttccgggctggtatcggcggcggcggggattattctggcgtcgcgcatgaccagcggccagcctatgacctccattggttatgagctgatcgttatctcagcctgcgttttggggggcgtttccctcaagggcggcatcggaaaaatctcatatgtggtggcggggatcctgattctggggaccgtagagaacgccatgaacctgctcaatatttctccgttctctcagtacgtcgtacgcggcctgatcctgctggcagcggtgatcttcgaccgttacaagcaaaaagcgaagcgtaccgtctga

SEQ ID NO: 886 - DNA, 914 bp, Enterobacter cloacae
cctgctcaactattaaccatagttgaccccctgaccggcccgccagttttgttgacgggccggttgctaaatggcgagcaccgtcacactgtctatacttacatggctgttttgttcactgtaaggaggattagggtggctgacttgttaaccgcaccgcctgtattgcccggaaaatttgctttcttttttgacctcgacgggacgctcgccgggattgaaccgcatccggatgacgttgttgtaccggacacggtgttagagaatttgcagcagctctcccgacagaacgagggggcactggcattgatttcagggcgctcaatggccgagctggacgtgctcgccagtccttatcactttccgctggccggtgtgcacggagcggagcgccgcgatatccatgatcaactgcatatagtttcactccccgacacgctgattcagacgctgcatgcgcaactctcttcggctctggaaatgcttcccggtacggaactggaagccaaaggcatggcttttgcgctgcactaccgtcaggcgccccatcatgaggcggcgatattttcgatagcaagaagcgtggccgaagcccatccggagctggcgttacagccgggtaaatgtgtggtcgagattaaaccggcaggaattaacaaaggcgctgccattgcagcgtttatggcggaagcgccgttcaaagggcgtacgccagtcttttttggggatgacctgaccgacgaggccgggttcagggtggtaaaccaggcccagggcatgtctgtcaaggttggatctggtgaaaccattgccggatggcggctggaaaatgtcgccagcgtctggcagtggatatctgacgtcgctaaccagcaacaactcttcaccacggactgcagacccgcgcatatgat

SEQ ID NO: 887 - DNA, 420 bp, Enterobacter cloacae
aaagcatgtgggcaaactactgcacaacgtttaaagacgtcccaccgggtgcgatgttctgataaaaaaacctgcttcggcaggtttttttatgtctgcggacgacgagagggagatggaagggcgtctgttttgctactatggcggcctttgaataaggagaaccccatgtcacaaaacctgagcgccgatcaggaactggtatctgacgtcgtcgcctgccagctggttatcaaacaaatccttgatgtgattgacgttatcgcgccggttgaggtacgcgaaaagatgtcgacccaactgaaaaacatcgatttcaccaaccatcctgctgcggcggacccggttacgctccgcgcgatccagaaagcgattgcgctgattgaactccgcttcacaccgcagggtgagtcacactaa

SEQ ID NO: 888 - DNA, 609 bp, Enterobacter cloacae
cgcgagaaaatgaaacgatgttttacattgtttcattcgttgaggtttatgatggctaacgttgcggtgctgctggcacctggttttgaagaagcagaagcaattatcactattgatattctgcggcgtttacagattgaggtggagacgctggcctgcgcggagtcccgtgcggtagtgagttaccataatatccccatggtggctgacagtacgttaacggagcgcattaataggctgtatgacgcggtcgtgttgcccggtgggccgcaggggagcgtcaatcttgctgctaaccaggaggtgatccgctttgtttccgcgcatgacgagcacggcaaacttatctgcccgatctgctctgcggccgcgcgggtgctgggcggtaacgggctactgaaggggcgccgctacgtctgttccggcgatctgtggcagagcgttgatgatggagtatatgtagatgcgccggtcgtggaggataataacctcatcagcggcaaggggctggggcacgcttttgactttgcgctgacgctctctgctcgtttgttgggtgtcgactcccccgtgcgcgatcatgctgaacacatctattaccgctggtaa

SEQ ID NO: 889 - DNA, 1554 bp, Enterobacter cloacae
ggggccagacgtacacactacaggaatcacggagtcgttatgcaacagtctgatccgtatctctctttccgcggcatcggtaaaacgttccccggtgtaaacgcgctgaccgatatcagcttcgactgctatgccggccaggttcacgccctgatgggggagaatggcgcgggaaaatccacgctgctaaaaattctcagcggcaactacacgcccaccaccggcacgctggctattcgcggcgaagaggtggcctttgccgacaccacggcagcgttaaatgcgggcgtcgccatcatctatcaggagctgcatctcattcctgaaatgaccgtggcggagaacatctatctgggccagcttccgcataaaagcggcgtggtcaaccgctcgctgctcaattatgaagcgggcttgcagctcaagcaccttgggctggatgtcgatccgcaaacgccccttaagtatctctccatcggccagtggcagatggtggaaattgccaaagcgctggcgcgtaacgccaaaattatcgccttcgatgagccaaccagctcgctctcggcgcgtgaaatagaaaatctctttcgcgtgatccgcgagctgcgcaaagagggccgcatcattctgtacgtttctcaccgtatggaagagatttttgccttaagcgatgccatcaccgtgtttaaagatggacgctacgtgcgcaccttcaccgatatgcagcaggttaatcacgatcagctggtgcaggcgatggtcggacgcgatctgggggacatttaccactggaaaccgcgcgagtatggcccggagcgtctgcgtctggataacgtcaaagccccaggcgtgcgcacgcccatttcactctcggtgcgcagcggcgaaatcgtcgggctgtttggccttgtgggggcagggcgcagcgagctgatgaaagggctgtttggcgggacgcgcataacccagggccaggttttcgtcgacgggaaaaaggtcgatattcagaagcctgcgcaggcgattaacgcggggattatgctctgcccggaggatcgaaaggcagagggcattattccggtgcactcggtgcgcgacaacatcaacatctctgcccggcgcaagtttatccgcgcgggatgtctgattaacgacggctgggaggcgagcaacgcggatcaccatatccgttcgctgaacattaaaacccccggcgctgaacagctgatcatgaacctgtccggcggtaaccagcaaaaagccattctggggcgctggctatcggaagatatgaaggtcattttgctggatgaaccaacgcgcggtattgacgtgggggcgaaacacgaaatctataacgtcatctatgaactggcaaaacgtggtgtggcggtcctgttcgcctccagcgatctgcccgaggtgctgggcgtcgccgaccgcattgtagtgatgcgtgaaggcgaaattgccggtgaattgctgcatgaacaggcgaatgaacaacaggcgttgagtctcgccatgcctaaagttagccaggctgtcgcctga

SEQ ID NO: 890 - DNA, 1041 bp, Enterobacter cloacae
gttgttcgccattattccctacagataagaatgcttaagctggagtttaccatgcacaaatttactaaagcgctggcggccatcggcctggctgccgttatgtcacaatccgctatcgctgaaaatttaaagctcggttttctggttaaacagcctgaagaaccgtggttccagaccgaatggaaatttgctgataaagccggaaaagatttgggatttgaggtaattaaaatcgccgtacctgacggtgagaaaacgttgaacgccattgatagcctggcggccagcggtgcgaaaggtttcgttatctgtacgccggatccaaaactggggtcagcgattgccgcgaaagcgcgcggttacgacatgaaagtgattgcggtggacgatcagttcgtgaatgccaaaggcaaaccgatggataccgttccgctggtaatgatggcggccactaaaatcggtgagcgtcagggccaggagctctataaagagatgcaaaaacgcggctgggatgtcaaagagactgccgtgatggcgattaccgcagacgagctggacaccgcccgtcgtcgtaccaccgggtccatggacgccctgaaagcggctggcttcccggaaaaacagatctacaaagtcccgaccaaatccaacgatattccgggcgcttttgatgcggcaaactccatgctcgtccagcatccggaagtgaagcactggctggtggtggggatgaacgacaacaccgtactgggcggcgtgcgtgcaacggaaggccagggctttaaagcaccggacgtgatcgggatcggcattaacggcgttgacgccgtgagcgaactgtctaaagcgcaggcgaccggcttctatggctcactgctgccaagcccggatgtccacggctataaatccagcgaaatgctctacaactgggtgaccaaaggggctgaaccgccgaaattcactgaagtgacccatgtggtgctgatcacccgcgataacttcaaagaggagctggcgaaaaaaggactgggcggtaagtaa

SEQ ID NO: 891 - DNA, 540 bp, Enterobacter cloacae
cggacatcaagtcccacagtcaataaggatatgagaatgactacccatacgatgatgcaaaaactgaatgcccagatgaacctggagttttatgcttcaaatctgcatctgcatttgagcgcgtggtgttccagaaaaagcctcaacggcactgccaccttctttcgtactcaggcgcaaagtaacgtcacgcacatgatgcgtgtctttaactttttgaaagctgtcggggcaaaccctaccgtcaaagagcttgaaacgattgaagataattacacttctctggaagaactgttccagaaaacgctcgaagagtatgagcaacgctgtgcgaagctgagcaaactggctgatgaagccaaagcgcaacaggacatcattaccctcacgtttttacgcgatatggacagagagcagcagcaggatggcatgctgctgaagacgctcgcagatgaaatccgcaacgcgaaacgtgcggggatttgtctggagcagacggaccgccatcttctcgacatagctaccgtgcaacaccactaa

SEQ ID NO: 892 - DNA, 1356 bp, Enterobacter cloacae
cgagggagcatcatgatcaccattgagtttattgtcattatcctctgcctgctgataggcacccgcttcggcgggatgggcctggggctgataagcggtatcggcctgtttattttaagttttgtctttggtctgcaacccggtaaaccgcccgttgacgtgatgctcacaattctcgccgtcatcggctgtgcggccacgctacagaccgccggtggccttaatgtaatgatgcagtttgcagagcgcctgctgcgtaaacatccccaacacatcacccttctcgcaccgtttaccacctggatgttgaccttcctctgcgggaccggtcacgtcgtctacaccatgtttcccattatcgcggatatcgccctgaaaaaaggcattcgcccggaacggccgatggcggtggcctcggtggcctctcagatggcgatcaccgcctcccccgtttccgtggccgtcgtttcgctggtctcgattctgggtgcgcagcacggcatcggtcacgcgtgggggatcctcgaaatcctcgccgtttccgtaccggcctcactgtctggcgtcgccattgcggcactgtggagcctgcgccgggggaaaaacctcgcagacgatactgaatttcaggaaaagctgaaagatccgaaacagcgggagtttatctatggaggaacggagacgttgatggatcagcgtttcccgaaacaggcctactggtccacgtggatcttcttcgccggaattgccgtagtggtcctgctgggtgcgctgcccgagctgcgtccggcgtttgagatcaaaggcaaaatgacggccctgtcgatgaaccttgtcattcaaatgatgatgctgatcgccggggccatcatgctgatgacctgcaaggtgaatgcgtcggccatttcaaacggggcggtatttaaggcggggatggtcgcgattttctcggtgtttggcgtggcgtggatgagcgataccttttttcaggcgcatctcgacgagctaaaaatggcgctggagggggtggtgaagagtcatccctggacgtatgccatcgtgctgttcctggtatcaaaactggtcaacagccaggctgcggccttgaccgcggtcgccccgatggggttgatgctgggcatcgatccgaaaatgctggtggccttcttcccggcatcctacggctactttgtgctgccgacctatccgagcgatctggcctgtatcggattcgatcgctccggtaccacccgcatcggtaaattcatcatcaaccacagctttattctgccggggctgattggcgtcagctgtgcctgcgtggtgagctatctgctggtgcagacgttcttctga

SEQ ID NO: 893 - DNA, 1266 bp, Enterobacter cloacae
gcgggcaggaagagaatgagtgaaaacgtatccggcaaagagagccgtggattatcgcctgcggcgctgctggtggccggtgctttctttatggagtttctggacgggacggtgattgccaccgcgctgccggacatggcaaaaagcttcggtgtacaggccgtggatctgaatatcggcatcagcgcctacctgatcaccctggccgtgctgatccccgccagcggctggatcgccgaccgcttcggcgcgcgaaaagtgtttgccctcgcgctggcaatcttcacgctggcctcggtattttgcggcctgtccaccacgctcgatcagttcgtcgcgatgcgcgtccttcagggcatgggtggcgcgctgatggtgcccgtgggtcgcctggccgtgctacgcaccacgccaaaacatcagctcatcacggcaatcgccaccctgacgtggcctgcgctggtcgcgccgatcatcggcccgccgctgggtgggttcattaccagctatgccgactggcgctggatcttctttattaacgtgccgctggggataatcgccattttgctggcactgcgcatcattccagacctgcatgaagatacgcgccgaccgtttgatttaccgggttttgttgtcaccacccttgccatggtgagcctggtttatgcgatggagttgatgggcgcagagcctctgcgaacaggattaaccgccacgctgtttatcgtcggtatcgtcgcgttaagtctggcactgcgtcactttaagcggacaacctggccgatgatcagactcgatgcgatgcaggtgccgacgtttcgcgtcaccctgtatggcggatcgctgtttcgcgcctccatcagcgcggttccgttcctgttaccgctgatgttccaggtcggctttggcatggacgcgttccattcgggcctgctggtgctggcggttttcgttggcaatctcaccattaaaccggcgacgacgccgcttatccgcagcctggggtttaagcggctgttgctgattaacggtgcgttgaatgtcctggcgttgctggcctgcgcgtttctgacgccgcagacgcccgcgtggctcgtcatgctgatcctctatctgggcggcgttttccgttcgattcagtttacagccatcagtacgctggcttttgcggatgtgccatcggtgcagatgtgctatgccaatattctgttttcaaccgcaacgcagcgtcttgaccacggggctggggcatccgcgtgcggg

SEQ ID NO: 894 - DNA, 240 bp, Enterobacter cloacae
ctcaccctgcggtgtgaagcggagttcaatcagcgcaatcgctttctggatcgcgcggagcgtaaccgggtccgccgcagcaggatggttggtgaaatcgatgtttttcagttgggtcgacatcttttcgcgtacctcaaccggcgcgataacgtcaatcacatcaaggatttgtttgataaccagctggcaggcgacgacgtcagataccagttcctgatcggcgctcaggttttgtga

SEQ ID NO: 895 - DNA, 636 bp, Enterobacter cloacae
tctccaagccgtggtgaaaagcccctggatattagctcaacgcactacctggatatcaaccatgcggatattgtggcgcgtatcgatttaaccgaatgggaaaccaacccggaatcgacacgctacctgaccttccttaaaggtcgcgtgggccgcaaagtggccgatttctttatggacttcctcggcgccagcgaagggctgaatgccaaagcgcagaacaaaggtctcctccaggcggtggatgactttacggctgaggcgcaacttgataaatctgagcgtcaaaacgtgcgtcagcaggtttacagctactgcaacgagcagttacaggccggggaagagattgagctggagtcgctgtccaaagagctggcaggcgtcagcgaagtcagcttccaggaatttaccgcggaaaaaggctatgagttggaagagagcttcccggcggatcgcagtacgctgcgtcagctgacgaaatttgccggtagcggcggtgggttaaccattaactttgatgccatgctgctcggggaacgtatcttctgggacccggccaccgacacgctgaccattaagggcacgccgccgaatctgcgcgaccagcttcagcgtcgcacttcaggcggtaagtaa

SEQ ID NO: 896 - DNA, 717 bp, Enterobacter cloacae
aaagatttcatgcgacttgataagtttatcgctcagcaactcggcgtaagccgcgctattgccgggcgtgaaattcgcgccagccgcgtaaccgtggacggcgacattgtgaaagacagcgcttttaaactccagcctgagcaccaggtggagtatgacggcaacccgctgacccagcagaatggcccgcgctacttcatgctcaacaaaccggaaggttacgtctgttcaacggacgatccggatcacccgacggtgctctacttcctcgacgaacctgtggcgcacaagctgcatgcggcagggcgactggatattgataccaccggcctggtgctgatgaccgatgacggccagtggtcgcatcgcatcacctccccgcgccatcactgtgagaaaacctatcgggtgacgcttgagtctccggtctcggatgacacggcagagcagttcgcaaaaggcgttcagctgcataatgaaaaagatctgaccaaaccggcggtgctggaaatcatcactccaactgacgtgcgcctgaccatcagtgaaggccgctatcaccaggtgaaacggatgtttgccgccgtgggcaaccacgttgtggggctgcatcgtgaacgtatcggcgcgattgaactcgatccagacctggcgccaggggaatatcgcccgctgacggaagaagagattgccagcgtcgggctgccttcacgctaa

SEQ ID NO: 897 - DNA, 1215 bp, Enterobacter cloacae
attcaggagaactcagtgaccaccaggccacactcgtcgtttaaaattgtatttatccttggcctgctggccatgctgatgccgctgtctatcgatatgtatctgcccgcgctgccggtgatttccgcgcagtttggcgtaccggcaggcagcgcgcagatgacgctcagcacctacattcttggttttgccctcggtcagctcttttatggcccaatggccgacagcctggggcgtaaacccgttattctgggggggacattgatatttgccgcggcggcggtggcctgcgcgctggcgcagagtatcgatcagctgattgtgatgcgtttcttccatggcctggcggcggctgcggcaagcgtggtaattaacgcgctgatgcgcgacgtctacccgaaggaagagttctcacgcatgatgtcgttcgtcatgctggtcacgacaattgcgccgctggtcgcccccatggtgggcggggcggtgctggtttggttcagctggcatgcgattttctggatcctggcgattgccgcgctgctggcctcggtgatgatcttcgtctttatcgatgaaacgctgccggtcgagcgacgtcagaagttccacgttcgcaccacgcttggcaactttgcctcgctgtttcgccataagcgtgtgctcagttatatgcttgccagcggcttcagctttgccggaatgttctcgttcctgagtgcggggccgtttgtgtacatcgaactgaaccatgtgtcaccccagcattttggttactacttcgcgctgaatattgtgttcctgtttgtgatgaccattatcaacagccgctttgtccggcgggttggggcgctgaatatgttccgcgccgggctgtggatccagttcgtgatggctatctggctggtattgagcgcgttgctgggcgtcggtttctgggcgctggtggtgggcgtggcggcgtttgtcggctgcgtgtcgatggtttcatccaacgcgatggcggtgatcctcgacgaattcccgcatatggcgggtaccgcctcgtcgctggcaggaacgttccgtttcgggattggcgcgatagtcggggcgctgctctcgacggcgacgtttaataccgcctggccgatgctgtgggcgattgccctctgcgcgacctgctccattcttttttatctttacgccagccggccgcgaaagacggcgcataaatga

SEQ ID NO: 898 - DNA, 372 bp, Enterobacter cloacae
agtaaatttgcttccggggatctgaacgtgaatacattacaactctccattgtccatcgcttgccccagagctatcgctggtcgacgggttttgcaggttcgaaagttgaaccgattccgcaaagcgttgccggggaggataattgcctggtggcgctcaaactgctcagcccgagcgatgaaaatgcgtggccggttatggaacgtctcagccaggcgctgacggacatcgaagtggacagctccgtgctggaatgcgaaggtgagccgtgcctgtttgttaacagccaggatgagtttgccgccacctgtcgtctgaaaaacttcggcgtggccattgccgagccgttctccggtcaataccctttctga

SEQ ID NO: 899 - DNA, 399 bp, Enterobacter cloacae
aaaagaatggagcaggtcgcgcagagggcaatcgcccacagcatcggccaggcggtattaaacgtcgccgtcgagagcagcgccccgactatcgcgccaatcccgaaacggaacgttcctgccagcgacgaggcggtacccgccatatgcgggaattcgtcgaggatcaccgccatcgcgttggatgaaaccatcgacacgcagccgacaaacgccgccacgcccaccaccagcgcccagaaaccgacgcccagcaacgcgctcaataccagccagatagccatcacgaactggatccacagcccggcgcggaacatattcagcgccccaacccgccggacaaagcggctgttgataatggtcatcacaaacaggaacacaatattcagcgcgaagtag

SEQ ID NO: 900 - DNA, 1776 bp, Enterobacter cloacae
ctgaatagagaagccatgacgttcacattacgcccctatcagcaggaagccgttgatgccaccctcgcctggtttcgcaagcatcgggagcccgccgccatcgtactcccgaccggagccggcaaaagcctggtgattgccgaactggcgcgcctggcccgcggacgcgtgctggtgctggcgcacgtcaaagagctggtggcgcaaaaccacgccaaatattgcgcgctcggcctggaggccgacatttttgccgccggactgaagcgcaaagagagccacggaaaagtggtgtttggcagcgtacaatccgttgcgcgcaacctggaactgtttcgcagcgagttttccctgctgattgtcgatgagtgtcaccgcatcagcgatgacgacgacagccagtatcagcaaatcctcactcatctgaaaaaggtgaatcctcacctccgtctgcttggcctcaccgccacgccgtttcgtctgggcaagggctggatttatcagtttcattatcacggcatggtgcgtggcgatgaaaaggccctgttccgcgactgtatctatgagcttccgctgcgctacatgatcaagcacggctacctgacgccgccggagcggctggatatgcccgtcgtgcagtacgatttcagccgcttacaggcgcagagcaacgggctgttcagcgaggcagatcttaaccatgagctgaaaaaacagaagcggatcacgccgcatatcatcagccagattgaagagtttgcacaaacgcgcaaaggggtgatgatttttgctgccactgtcgaacacgcgcgtgaaattacggggctgctgcccgccgacgacgcggcgttaattaccggtgaaacccccggcccggagcgcgacagcctgattgaggacttcaaagctcagcggttccgctatctggtgaatgtctccgtactaaccaccggctttgacgccccgcacgtcgacctgattgcgattcttcgcccgacggaatccgtcagcctgtatcagcagattgttggccgcgggctgcgtctggcgccgggcaaaaccgactgtctgatccttgattacgccggtaacccgcacgatctctattcgccggaagtaggcacgccaaaaggcaagagcgacaacgttcccgttcaggttttttgccctgcctgcgggtttgccaacaccttctgggggaaaaccaccgccgacggcacgctgattgaacattttggccgccgctgtcagggctggtttgaagacgatgaaggccatcgcgaacagtgtgatttccgcttccgctttaaaaactgtccgcagtgcaacgccgagaacgatatcgccgcccgccgctgccgcgagtgcgacacggttctggtagacccggacgacatgctgaaagcagcgctgaaactaaaggatgcgctggtgctgcgctgttccggcatggccttacaacccggcgcggatgaaaaaggcgagtggctaaaaatcacctattacgacgaggatggcgcagacgtcagcgagcggttccgggtccagacgtccgcccagcgcaccgcgttcgagcagctctttatccgcccgcatacccgcacgcctggcgtaccgctgcgctggctaaccgttgccgatatcgtgcgccagcaggcgttgctgcggcatcctgattttgttgtcgcccgcaaaaaagggcagttctggcaggtacgtgagaaggtctttgactatgaaggacgctttcgccgggcaaacgaattgcgcggttaa

SEQ ID NO: 901 - DNA, 1035 bp, Enterobacter cloacae
gggccgctgatgtcgcgtttaagccccgtcaatcaggcccgctgggcgcgctttcgccacaaccgtcgcggctactggtcgctgtggatcttcgccgtcctgttcgccttaagtatgtgttcggaactgattgccaacgataaacccctgctggtgcatttcaaagaccgctggtacgttccggtgcttactacctatagcgaaagcgattttggcggcccatttgcgacgccagccgagtaccaggatccctggttacgtgagcagatagcgcagcacggctgggctatctgggcaccgattcgttttggcgcgaacagtattaacttcgccacgtctacccccttcccttcgccgccttccgcgcaaaactggctgggaacggacgccaacggcggcgatgtgctggcgcgcatcctctatggcacccgcatctcgctcctgtttgggctgatgctgacgctctttagcagcgtaatgggcgttgtggcgggcgccgtgcaaggctattacgggggtaaaatagatttatggggacagcgcgtgattgaagtctggtccggtatgccaacgctgtttctgattatcctgctgtccagtgtggtacagcctggcttctggtggctgctcgggatcaccgtcctgttcggctggatggcgctggtcggcgtggtgcgcgcggagtttctgcgcacgcggaattacgactatattcgcgccgcgcaagcgttaggcgtgagcgatcgcgcaattatcttccgccacatgcttcccaatgcggtggtggcgaccctcaccttcctgccgtttattttgtgcagctccattaccaccctgacgtcgcttgattttcttggtttcggtttgccactgggctcaccgtcccttggcgaactgctgttgcagggcaaaaacaatctccaggccccctggctgggcatcaccgcattcctctccgtggcggtgctgctttccctgctgatttttattggcgaagccgtgcgcgatgccttcgatcccaacaaggcggtatga

SEQ ID NO: 902 - DNA, 906 bp, Enterobacter cloacae
  unsure (117)
  unsure (200)
  unsure (216)
  unsure (295)
gggccgggcttggccacattcagcgaaaaccatacccgggccgttcggggactgaatccggaggtgatcgccgagatcacccatcgctatggtttgaacaagccgctgcacgagcgntattgcaggatgctatgggattatgtccgtttcgattttggcgacagcttgtttcgcagcgcctcggtgttaaccctgatcanacaaagcctgccggtntccatcacgctcggactgtgggggacgctgattatttatctggtctccattccgctggggataaggaaagcggtttacnacggtagccgtttcgatatctggagcagtacgtttattatcatcggctacgctatcccggcgtttctgtttgccgtgctgttgattgtgtttttcgcaggcggcagttatttcgacctcttcccgctgcgcgggctggtctccgcggatttcagcacgctgccgtggtatcagaaaatcaccgattacttctggcacatcacgctgccggtgctggcgacggtcatcggcggttttgcggcgcttacgatgctgaccaaaaacgcctttcttgatgagatccgcaaacagtacgtcgtcaccgcgcgcgccaaaggcgtcggtgaaaagcagatcatgtggaagcacgtttttcgtaacgccatgctgctggtgattgcaggtttccccgccacgttcatcagtatgttttttaccggctcgttgctgatagaagtgatgttctcgctcaacggattagggctgctgggctatgaggccaccgtctcccgtgattatccggtgatgtttggcacactctacattttcaccctgatcggcctgctgctgaacatcatcagcgatatcagctatacgctggtcgatccccgtatcgattttgagggccgctga

SEQ ID NO: 903 - DNA, 1644 bp, Enterobacter cloacae
tttttattggcgaagccgtgcgcgatgccttcgatcccaacaaggcggtatgacatgacccggcctcttctgagcatagaaaacctgtcgattgcgttttcaaagcagggcgaatcacgcacggtagtgacggatttatcgttgcagatccagcgcggagagacgctggcgctggtcggggaatccggttccggtaaaagcgtctcggcactttcggtgctgcgcctgctcccctccccgccggtcagctatccgcagggggatattctgttccatggacaatcgctgctgaacgctgacgagcaaaccctgcgcggcattcgtggcaataacatcgccatgatttttcaggagccgatggtgtcgctcaaccctctgcatacgctggaaaaacagctctatgaagtgctgtcccttcatcggggaatgcgtaaagaggcagcgcggggtgaaattctggactgccttgaacgcaccggtattcgtcatgcggcgaaacggctgaacgatttcccgcaccagctttccggcggcgagcgccagcgcgtgatgatcgcaatggccctgctcacgcgccccgaactgctgattgccgatgaacccaccaccgcgctggacgtcacggtacaggcacaaattctgcaactgctgcgcgaactgcgcgacgagctgaacatgagcctgctgtttattacgcacaacctgagcatcgtgaaaaagctcgctgacgcggtggccgtgatgcaaaacggccgctgcgtggaacagaaccgggcatccgccctgctgagcgcgcctcagcacccgtatacacagcgcctgctcgatagcgaacccgctggcgacccggttccgcttaacgctgactgcgcgccgttgctgagcgttgaggggctgtcggtgtcattcccgatccgcaaaggcattctccgtcgcgtggtcgatcacaatcatgtcctgaaagacatgagtttcgctctgcgtccgggtgagtcgcttgggcttgtgggcgaatccggctcgggcaaaagcaccaccggcctggcgctgctgcgcctgatcgcctctcagggaagcattgtctttgacggcatgccgctgcaaaacctgaatcgccggatgatgcttcctgtccgcccgcggatgcaggtggtatttcaggatccaaactcttcgcttaacccgcgcctgagcgtattacagattattgaagagggcctgcgcgtccaccagccgacaatgacggcgcaacagcgtgaaatcgacgtgaagcgggtgatggaggaagtgggtttagatcccgagacccggcaccggtatccggctgagttttctggcggacagcgccagcgtatagcgattgcccgcgcgctgatcctgaaaccggagctgatcgtgctggacgagccaacctcttccctggaccgcaccgtgcaggcgcaaattctggcgctgctgaaggggctacaggaaaagcatcggctggcctatatctttatcagccacgatttacaggtggtgcgtgcgctttgccatcaggtggtggtattgcggcagggagaagtcgtggagcagggagagtgccagcgcgtattcaccgcgccgacgcaggattacacgcgccagctattgtccgctgactag

SEQ ID NO: 904 - DNA, 480 bp, Enterobacter cloacae
aggcagcccgacgctggcaatctcttcttccgtcagcgggcgatattcccctggcgccaggtctggatcgagttcaatcgcgccgatacgttcacgatgcagccccacaacgtggttgcccacggcggcaaacatccgtttcacctggtgatagcggccttcactgatggtcaggcgcacgtcagttggagtgatgatttccagcaccgccggtttggtcagatctttttcattatgcagctgaacgccttttgcgaactgctctgccgtgtcatccgagaccggagactcaagcgtcacccgataggttttctcacagtgatggcgcggggaggtgatgcgatgcgaccactggccgtcatcggtcatcagcaccaggccggtggtatcaatatccagtcgccctgccgcatgcagcttgtgcgccacaggttcgtcgaggaagtagagcaccgtcgggtgatccggatcgtccgttga

SEQ ID NO: 905 - DNA, 363 bp, Enterobacter cloacae
acagacgtaaccttccggtttgttgagcatgaagtagcgcgggccattctgctgggtcagcgggttgccgtcatactccacctggtgctcaggctggagtttaaaagcgctgtctttcacaatgtcgccgtccacggttacgcggctggcgcgaatttcacgcccggcaatagcgcggcttacgccgagttgctgagcgataaacttatcaagtcgcatgaaatctttttagccttaatggtgctggaagtcggactacgcgtccgaaaaagaagcagtcagaaacagttcagtataatggtctggttgcgccactcaagggaaaaagtttcgtggcatactatatgcgagttaactgaatag

SEQ ID NO: 906 - DNA, 309 bp, Enterobacter cloacae
ggttttaaatacagagagaaatcaatgttcactatcgaagcagaagtacgtaacgtgcagggtaagggtgcgagccgccgcctgcgtaccgcaaacaagttcccggctatcgtttacggtggcgaagctgctccagttgctattgaactggatcacgacaaagtatggaacatgcagaccaaagctgagttctacagcgaagttctgaccatcgttgttggcggtaaagaagaaaaagtgaaagttcaggctgttcagcgtcacgcgttcaagccaaaactgactcacatcgacttcgttcgcgcgtaa

SEQ ID NO: 907 - DNA, 1488 bp, Enterobacter cloacae
gaaattactatgttgctgtcctcgacgcgtaaggactggctgggtaacgtccgtggtgacgttctggccggtattgttgtcgcgctcgcactcattccagaagcgatcgccttttccattatcgccggtgttgatccccaggtgggcctctactcggcgttctgtattcctctcgttatggccttctttggcggacgtccggcgatgatttcgtcctccaccggtgcaatggctctcctgatggtgacgctggtgaaagatcatggcttacagtatttactggctgcctccatactgaccggggtattccagctgatagccggatatctgaagcttggcgggctgatgcgttttgtttcacgctcagtggtcacggggtttgttaatgcactggcaatactgatttttatggcccagttgcctgagctgaccaatgtgacatggcatgtttatgccatgactgcggcagggctggggatcatctatctcttcccttatatcaacaaaaccattccttcaccgcttgtgtgcatcgtggtgctgactgggattgccatgtggctgcatctggatgtgcgaaccgtcggggatatggggaaacttcccgacagtctgccggtcttcctgctcccggacgtgcctttaaatcttcagacgctgctcatcatcctgccatattctgcggggcttgcggtggttggcctgcttgagtcgatgatgaccgccactatcgtggatgacatgaccgacacgccaagcgacaaaaacagggagtgcaaagctcagggcatcgcgaacatctgcacatcctttatcggaggaatggcaggctgcgcgatgattgggcaatctgttatcaacgtaaaatccggtggacgcggacgactttcaaccctcacggcgggcgtggtgctgctttgcctgattgtgttcctgcgcaactgggtctcccaaattccgatggcagcgctggtcgcggtgatgattatggtttccatcgggacattctcctggcgctccattgccaacctgcggacacaccccctttcaaccagcgtggtcatgcttgccaccgtcgcggttgtggtggcaacacataatctggccttcggtgtgctgaccggtgtactgattgcttcgctcaattttgccactaaagtatcccggttcatgcgtgtaacctcagttctggaggggacgagccggacgtataccgtcaccggccaggtattctttgcatcagcagaccgctttacgagccactttgatttccgtgaagcgattgagaatgtggtgatagacgtttcacatgcccatttctgggacatcacgtccgtcagcgccctggataaggtggtcattaagttccgtagagagggcgccggggttgaaatacgtgggatgaatgaagccacccgcaccatcgttgaccggtttggtgttcacgataaacctgaagaagtcgaaaaactgatgggcggtcattaa

SEQ ID NO: 908 - DNA, 846 bp, Enterobacter cloacae
cagactggagggaaaactatgaataatactgttacagcctgtgtggacggttcactttcaacgcggtcagtgtgtgaatatgcggcgtgggcagcccgcactttgcaatcacagctagcactgttgcacgttatcgaaaaagacagcaccccggtagtgtcagacctgaccggcactctcggcatagacagtcagcaattgctgaccgatgagctggtagaaattgaagggcaacgtaatcgcctgctgatggcccaggggaaagcaatactggaaagttgtgctgaactgcttcaaaaacagggaagcccggatgtgcttttgatgcaaaaacacggtacaccggatgaagttctggcagagctgagcgaccttcgtctcatggtgctggggcgtcggggtagccagcatccggtaggctctcatctggaaagcgttattcgtctgcaaaagaaacccctactggttgttccggagaactactcagtgccttccagagtcatgctggcttatgatggcagtgaagaaagcaggagtaacctggaacgtctgacgatgagtcccttactcagggggctggagtgccaccttgtcatggtaaacggtaagaaggaagagctgctgaccgcacagcaaattttacgtgacgcggatatagaaaacagcacaacacatcttaccgggcaatcagtcggggacgcgcttattcgttacgccgaggaaaatgctgtcgatctgatagtgatgggggcctacggtcattccaggttgcggcagttctttatcggtagtcatacctccgaaatgctgcaaaagacgcaacaaccgcttcttatcctccgttag

SEQ ID NO: 909 - DNA, 726 bp, Enterobacter cloacae
cttatgaaatggagattttttatgaccgacttaccagcaatcgaaccggcttattttgatgatgcgcttgccagcaaacttacgggcaacaacgaaaccatgccgcgaattctcatcctgtacggttcagtacgagagcggtcctacagtcgttttgcagcggaagaggccgggcggttgctggcaaagatgggggctgaggtgaaaatatttaacccatccggtctgccgttacccgatgatgcgcccgaaagtcaccccaaagtgcttgaactccgcgagctggtcaggtggtgtgacggaatggtctggagttctccggaaagacatggcgccatgagctcggtgatgaaggcccagattgactggatacccctgagtgaaggtgctgttcgtccttcccagggtaaaacgctggccgtcatgcaggtttgtggtggttcacagtcgtttaacacggtcaatcagatgcggatacttggccgctggatgcggatgttcaccatccccaatcagtcgtcagtgccaaaggcatggcaggaatttgatgatgaagggcgcatgaaaccctcaccctggtatgacaggattgtcgacgttaccgaagagttgttcaaaatgacgttactcctgaaagggcacacagcctacctgtccgaccgctacagcgaaaggaaagagagtcatcaggagctcgcggcacgggtcaatcaggccaaaatctga

SEQ ID NO: 910 - DNA, 1536 bp, Enterobacter cloacae
tttatgcattcatacgaggaccggatccgggccgtcgaactctattaccggtacggaaagaaagcctccgttgtcgtcatggagctgggatatccttccacaaaacagctgggccgttgggttcggatttatgaagagaagggcgatttacccagggaattaaagccaagagaacgctattcacggacacagaaaattgctgctgttgagcattatcttactcacggtggttgcctgtcgtacactcgccgagccatcggctaccccagtaacgaaattctaaagcgctggattgaagagttttacccaaatgcgcgtcccctggtcattcgctctggcacaaacaaatgcttcagcccggaagagaggtctcaggccgtccgggagctctgtaaccgacgtggaaccgcgcgtaaagttgcacaaagcataggcgtcagcgtcccggtcctgtacaaatggaagaaagaccttatcagtgacgaggcttatcaatccatgcgcaaacgaaaggcagcccctcaagataaaaatcaggatgctttactcggtgaaatccagcgactcaggcagcaggttcatcagctgcagctcgaacgtgacatactgacaaaggcgaatgaactgataaaaaaagatctgggcatcagctttctgacactgaaaaacagggagaaaaccctgatagttgatgcccttaagaaaaagtaccccgttgctgagttgctaagcgttctgcaacttgcccgcagctgttatttttaccacaaagccagcaaacgtctgtgcgataagtatgcggaaatacgcgtgatcatggccgatatctttgaggagaattaccgctgttacggctaccggcgccttcacgcgatgcttcgcggtaacaacagggttatttctgaaaaggttgtccgcagactgatggcagaagagcagctcgttgttaagcgcaccaggcgacgacgatacaactcttactgtggcgaaatcggcccggcaccggaaaatttactcgcccgggattttagttcctgcaggccaaatgagaagtggctgaccgatattacggagttccagcttccggctggaaaagtctatctgtcgccggttatcgactgctttgatggccaggttgtaagctggtcgataggaacacgcccggacgcgacgctggtgaatacgatgctcgatgaagcactcgatacgctcaacgaacatgataaaccggtaatacacagcgatcgtggtggccattaccggtggccgggctggctcgatcgtatcaacacatccggacttataaggtccatgtcgcgcaaaggatgctcgtcggataatgctgcgtgtgaaggcttcttcgggcgtatcaaaaacgaaatgttctatggcagaaactggactggtatcacgctggaaaaatttatctgcttcctggacaggtacatacgctggtataacgagaaacgtatcaagctatcattaggtgcaatgagtccggtgaagtaccggcagcatcttgggatcacaacataa

SEQ ID NO: 911 - DNA, 1443 bp, Enterobacter cloacae
gttaagatgtccggcgtgtataatcaagtaaggattaccatgacggctctcgcagcggagtttttcacattggatgaagttaaccgactcaaaatcattcaggatgtcatcgaccggcgtctgacaacacaaatggcagctcagcggcttggtatctccgaccgtcagtgccgtcgtctgcttgcgcgttatcgtgaagatggtccgattggcatgaccagccgccgtcgtggtaaatccagtaacaaccagttgcctcagggactggccgcatacgcgctgaacattattcgcgaacgctataacgatttcggtccgacgctggcctgtgaaaaactgtctgaggtgcacggtgttcatctttccaaagaaaccgtccgtaagctgatgactcaggccagtctgtgggtcccacgtaagcaacgtgcgccaaaaattcagcaacctcgttaccgccgtgcctgtgccggtgaactcatacaaatcgacggctgcgaccaccactggtttgaaaatcggggacctaagtgtacggcactggtttacgttgatgacgcaaccagtcgtttaatgcagcttcttttcgtgaaatctgagtctactttcacctattttgaagcgacccggggctatattgaaaaacatggcaaaccgcttgcgctgtacagcgacaaagccagcgtattcaggatcaacaataaaaatgcaaccggcggcgacggcgatacccagtttggccgtgcgatgcatgaactgaacattcagaccatttgtgcagaaaccagtgctgccaaaggccgcgttgaacgggcgcacctgacgcttcaggaccgactggtcaaggagctcaggctccagggcatcagttccatggaagctgcgaacgcatttgccgaagagttcatgaacgattacaaccgtcgtttcgcaaaagcgcctcgccaggagtttgatgttcatcgggaactggatgtcgatgacgatcttgatatggtatttaactggcgtgaagctcgtaaagtgtcgaaatcactcacagtgcaatacgacaaagtcctttatctgattgaagacagcgaattcagtcgtcgggcgattggtaaatacatcgatgtctggcattacccggatggacataaagagctccggcttaatggcgtatcacttccctactccacctatgacaagctttctgaaatcgatcagggggccattgtggataacaaacgtctggggcgggccctggaaatggcgcagctggtccaggccgagcgggataataaccggtcgcaatccgtaccatccggagacggcccttctcgcaggcgtaaagctcccacgacgaagaaatcccagcgttccctggatcaggacgatatgttcaatgccctggtgaaacttcagtcacgctctgaagagatatttgggaagaaaccgatttaa

SEQ ID NO: 912 - DNA, 465 bp, Enterobacter cloacae
cttgatacgtttctcgttataccagcgtatgtacctgtccaggaagcagataaatttttccagcgtgataccagtccagtttctgccatagaacatttcgtttttgatacgcccgaagaagccttcacacgcagcattatccgacgagcatcctttgcgcgacatggaccttataagtccggatgtgttgatacgatcgagccagcccggccaccggtaatggccaccacgatcgctgtgtattaccggtttatcatgttcgttgagcgtatcgagtgcttcatcgagcatcgtattcaccagcgtcgcgtccgggcgtgttcctatcgaccagcttacaacctggccatcaaagcagtcgataaccggcgacagatagacttttccagccggaagctggaactccgtaatatcggtcagccacttctcatttggcctgcaggaactaaaatcccgggcgagtaa

SEQ ID NO: 913 - DNA, 375 bp, Enterobacter cloacae
aagttatcacatatgaaataccatatgtattgttatttttttacgaggttaagcatgctacagcctgttcagctttttaaactgctcgccgacgagacccgttcaactatcgtgatgcttctcagggagtccggtgaaatgtgcgtctgtgacatctgtgcggcaaccgcagagtctcagccaaaaatttctcgccatatggcccttttacgtgaagccgagctggtcatcgaccgtcgcgaaggaaaatgggtgcattaccgactgtcgccacacatgccagcatgggctgcgggtattattgatacagcctggaactgtgaacgagaaaacatacgcaacaagctcagtagcgtggcatctgtctcctgctga

SEQ ID NO: 914 - DNA, 1302 bp, Enterobacter cloacae
atggagtttctgatgttactggctggtgctatctttttattcacgctcgtcctggttatctggcaacccagagggctggggattggctggagtgcctcactgggcgcaattctggcattgctgactggcgtcgttcatctgggggatattccggtggtctggcagatagtgtggaatgcgaccgccacctttatcgccgtgatcatcatcagtcttctgctcgacgaatccggcttctttgaatgggccgcgctgcacgttgcccgttgggggaatggccgggggcggctgctcttcacctggatcgtcctgcttggtgcgatggttgcggcactgtttgccaacgacggtgcggcactgatcctgacacctatcgttatcgcgatgctgctggcgctgggattcagccggggagcaaccttagcgtttatcatggccgcagggtttatcgctgacacggcaagcctgccactgattgtctcaaacctggtgaatatcgtctcggcggatttctttaagcttggtttctcagaatatgccgccgtgatggtcccggttaacctggccgcgattgcggctacgctggtgatgctgcatctgtttttccgtaaggacattcccgccgtttacgacgtttctctgttgaaagaaccgaaagacgctatacgtgatgtgaatacctttaaaaccggctggctggttctggtgttgcttctggtgggattcttcggactggagccgctgggcgtaccggtcagtttggtcgcagccgctggtgcattgcttctgtttgctgttgcgaaaaaagggcatgccattaacaccggtaaggtgctgcgtggtgcgccctggcaaatcgttatcttctcgctggggatgtacctggtggtctacggcttacgaaatgccggtctgacccactatctctcttccttgctgaatcagctggcagagcagggattgtgggcggcaacgctgggtacgggcttcctgacggccttcctgtcatcagtgatgaacaatatgccgaccgtgctggtcggggcgctgtcgattgatggcagcacagcgaccggtgttatcaaagaagcgatgatttacgccaacgtcatcggcagcgacctggggccaaaaattacccctatcggcagtctggcaacgttactgtggctgcacgttctgtcgcagaaaaatatcaaaattacctggggatattacttccgggtgggcattgtcatgacaatccccgtgctgtttgtcacgcttgcagcactggcgcttcgtctgtctttcactttgtaa

SEQ ID NO: 915 - DNA, 435 bp, Enterobacter cloacae
gatactgatatgagcaacattaccatttatcacaacccggcctgcggcacgtcacgcaatacccttgaaatgatccgcaacagcggtacagagccgaccgttattcattatcttgaaaccccaccatcacgagctgagctggtaaaactcattgcggatatggggatcacggtacgagcgctgctgcgtaagaatgtcgaaccttttgaagcgttagggctggcggaagaccgctttactgacgagcagttaatcgattttatgttgcagcaccctgttctgatcaatcgccctatcgtggtaacgccgctgggtacccggctatgccgcccttctgaagtcgtgctggatattcttcccgatgcgcagaaaagcgcgttcacgaaagaggacggtgagaaggtagttgatgaaaaaggtaaccggctgaactaa

SEQ ID NO: 916 - DNA, 624 bp, Enterobacter cloacae
ccgccattgtgcggcttttttattggagattcgctggtggctgaagaagttaagtttgttgtggttggtcaccacacccggacgggacaagcacaacgtcttgctgcgctgctggatgctcatctgctgattgatgacggtaaacacggcgcgaactggaatcatcgccgcgcgcttgagtgggcagcagaacaaacctgccgggtagttgttgttgaagatgacgcactgccggtacatggattcaccgaaaaggtaactgactggctggctcgttttcctgacgacatgctgagcttttatctcggtaccgggcggcctccacagtatcaaatgcagattgctgagcggctaaccgtggctgataagacacgcgctgattacatcacgctgtcgagactcattcatggcgtttgctatagcgtcccgcctgagcatgtgcatcgggtgctatcccgttgggataacagcaagcccgccgattacgctgtgggtgatgcatggggtggctcagtgatctatccgtgttactcgctggtggaccatgctgacggcgaaccggttgagcgtcacccagactcagcgccacgcacagaacgccgccgggcgtggaggttagcctga

SEQ ID NO: 917 - DNA, 486 bp, Enterobacter cloacae
gagttttcgattatgtctggaccaccgaaaaccccgacccatctacgtttggtgaggggtaacccatctaaacgcccgatcaatgagaacgaaccaaaacccccttcaggggtacccccaacgccgaagcatttcgacaagcaggggaaatactggtttaaacggatggccgacgagcttgatgctatcggtgtgatgtctcagcttgatgccagagcccttgagctgctggttgaggcctataccgaataccggcatcactgcgacacgcttgaagttgagggctacacctaccggaccgaaacgcagagcggggatgtgctgatcaaggctcaccccgccgccatcatgaaagctgatgcctggaaacgtctgcgtgccatgcttggtgagttcggcatgactccagccagccgatcgaaagtgaatgcaaaaggtcctgaagcggttgatccgctggccgagtttatgaaagcgagggattaa

SEQ ID NO: 918 - DNA, 1326 bp, Enterobacter cloacae
tcccatcatggtaggtttctgatgaaaaaaaacaaacggccaggcagggttaaaagtgctctgcttaactggcttggtgtgcctatcagcctgactaccggcacgttctgggaggaatggtttggtaccagcagcagcggaaaggtggtaacggccgataaagccatccagctatcggctgtgtgggcatgcgtaagactgttaagcgagtctatttcaacccttccgctgaaaatatacgttcgacagcctgacggttcgcgtaaagcggcaaccgatcatccggcctattcgatactgtgccgccgacccaattcagaaatgacaccatcacgctttatgttgatggtggtcgccagtatttgcctgcgcgggaacgccttcattgagaagaaattcatcgcaaaccgcctggtttcgctggtgcctttgctgccgcagaacatggtggttaaacgtctcgtgaccggggcgctggaatacaaatacactgaaaacggtaacgagcgcgtcattcccgtcaaaaacatcatgcacattcgcgggttcggtcttgacggcgtttgcggcatgatgccgatgaaaacaggccgggatgtgatcggttctgcaatggcggttgaggagtctgctgcgaagatatttgaacaggggcttcagagttcaggttttctctccgctgagaatgcgctgtctgacgaacaacgtgaaagacttcgcagctacatggctgcatttaccggttcaaaaaacgccgggaaaatcatggtgcttgaaggcggattgaagtaccagggcgtcaccatgaatcccgaagacgcccagatgctggaaagccgctctttcagtattgaggaaatctgccgctggtttcgcgttccgcctttcatggtcggtcacaccacgaagcaaagcagctgggcatccagtctggagggcatgaacctccagttcctgacacataccctgcgacccctgttggtgaacatagaacaggaaataggaaggtgcctgctggacagcgatgatgaggtgttcgcggagttctctgtagaaggactgctgcgcgccgacagcgcgggccgtgctgcgtactataccagcgcgctccagaatgggtggatgtcccgcaatgacgtgcgccgtcttgagaatatgccaccgattgaagggggtgacatttacaccgttcagctcaacctgacgcaactgaaaaatctcgaaagcagcaatcctgctgtgcaggctctggccctgagagaactgcataaccacatattccctgacatttcctttgaacaatctccgctgaaacaggccgcttag

SEQ ID NO: 919 - DNA, 408 bp, Enterobacter cloacae
gcgtcacccagactcagcgccacgcacagaacgccgccgggcgtggaggttagcctgatgcctgcgttaataccgagagcatgccgcaagcgtggctgccctggcacaaccactgaccgctcaggttattgtcccaagcaccttaacgaaggctggcagcagcatcagcgaggacagagcaggcatcagcgaggttatggcagcaagtgggacaggctgcgcccaatcgttctcggcagagataaacacctttgtcaggaatgcctgcgaaatggaaggtatacacccgctgagacggtggaccacatcaccgccaaagcaaatggggggaccgatgacctgtccaacctcgaaagcctctgcaagccttgccacagggcgaagacagcggtcgaaagactcaaatga

SEQ ID NO: 920 - DNA, 1770 bp, Enterobacter cloacae
tccgctggccgagtttatgaaagcgagggattaatggctaaggttgcagaaggcatccgctacgccgagagggtagtggcgggggaaattattgcctgtgagtatgtgcgccttgcctgtcagcgttttcttgacgatctggcacacggcgaagagcgcggtattttcttcagtgaaccgcgcgcgcagcacattctgaatttctataattttgtacctcacgtaaaaggcgcactggcagggcagcctattgagctgatggactggcacgttttcatcctgattaatatttttggtttcgtgatcccgctggttaacgaggaaacgggagaaaccgttttgcgtaacgacggcagcggtcgtccagtaatggttcggcgcttccgtacagcagatgttgaggtggcccgtaaaaatgccaaatcaacgctttgctccggcgtggggctttatatggctggtgccgacggcgagggcggtgcggaggtttattccgctgcaaccacccgtgaccaggcacgcattgtttttgaagacgcgaagaatatggtcaagaaggcgaaagccactcttgggcggatcttcgaattcaacaagctcgctatctaccaggagcaaacggcctccaaattcgagcctttatcatcagatgcgaacaaccttgacggcctgaacatccactgtgccatcgtcgacgagctgcatgctcacaaaacccgtgacgtctgggacgttctggagacggcaaccggcgcacgtctgcaatcgctgcttttcggtatcaccaccgccggtttcaacaaagaaggcatctgctacgaattgcgtgattacgccatcaaggtgctgcgtgggctggtaaaagacgatacgttttttgccatcatctacaccttagatgaaggtgacgatccctttgatgaaaaagtctggcagaaggcgaatccggggctgggtatatgtaagcgctgggatgacctgcgccgcctggctaaaaaggcgaaagagcaggtttcggccagaattaactttttcaccaagcacatgaatatctgggttaccgctgagtcagcctggatggacatgatgaaatgggagaaatgcgagtttatcgccccgcagcacgaacttaaaacctatccctcctgggtgggcgttgacctgtcaaacaaaattgatatctgtgcggccgctaaagtttggcgcgcgccagatggccacgttcatgcggatttcaaattctggctaccggaaggacgccttgagaaatgttcacgccagatggcagagctctatcgtaagtgggccgggatggacaagctgatccttaccgacggggatgtaatcgaccatgctcagattaaggaagagctacagctgtgggtggctggcgagagcctgaaagaaattggcttcgacccatggagtgcgacgcagttcagccttgcactggcagaagaagggttgccgctggtggaagtgccgcagacggttcgcaatttctctgaggcgatgaaagaggtcgaagcgctggtatacggtggccgcttccaccacagcgatcacccggtgatgaactggatgatgtccaacgtaaccgtcaaacctgaccggaacgagaacattttcccgaataagtccacaccagaggccaaaattgatggccctgcggctttgttcacagcaatgagccgcgttctggttaacggtggcaacgaccagcaggatctctccggattcttcaataatcccatcatggtaggtttctga

SEQ ID NO: 921 - DNA, 876 bp, Enterobacter cloacae
aacaggccgcttaggagcactttcctgatgagcaaaaaacaacttccggcagcaccggcgggtcgcccctgcgcgcgggtcacctgtgaaactttaccctccgccctggatcgctgggatggcgggatcaaagctgcggccaccgacgataacagtatttctgtttttgatgtgatcggacaggactactggggtgaaggcgtaacagccaaacgtatcgccggtgcgctacgggcgatgaatggcgccgacgtcacggtcaatatcaactcccctggtggtgacatgttcgaaggcctggcaatctacaaccttctgcgtgaatacgaaggccgtgtgacggtgaaggtgctcggaattgccgccagtgccgcctcagtcattgcgatggccggggatgatattctgatcggtcgtggtgcatttctgatgatccacaactgctgggtctatgcgatgggtaaccgccatgactttgcggaactggcacagtctctggagccattcgataacgctatggcagacatctacgcggcgcgttccggccttgatatggcagctgttcagaaactgatggatgccgagagttatatcggtggcagtgacgctgtggcgaagggactggcagacagcctgctttctgctgatgcggtcagtgatggcgatgaatcacccgcggccgcgcttcgcaaacttgatgcgctgctggctaaaaccaacaccccgcgctctgagcgcagaaaactcattaaagccttatccggtggcatgccaggcgctgtcaccaccaacgacggtacgccgggcgctgccgaagatatcaaacctgaaaccctcaattcacttgaaagcgctcttgcggcgttagtcaaataa

SEQ ID NO: 922 - DNA, 1251 bp, Enterobacter cloacae
gcaggaaggataaacatgggcttaaaacacctctttgaaaaaattgagccgcactttaccgaagggaagctcaaaaagtactacccgctgtatgaagcgacaacgaccattttctacacgccgggtctggtaacgaaaggcgcggcgcacgttcgcgacgccatcgacctcaagcgaatgatgattctggtctggtttgcggtcttcccggccatgttctgggggatgtataacgttgggttgcaaactattccggcgctgcaccatatgtatgatgcagagcagctggcgcaggtgattcagtctgactggcactatcgtctggcacagtcgctgggggtgagctttgcggcagatgccggctggatcagcatgatgacgctgggcgctgtcttcttcctccccatctatatgactgtctttatcgtgggcggtttctgggaggtgctgttcgccattattcgcaaacatgagatcaacgagggcttctttgttacctctattctgtttgcgctgattgttccgccaacgctgccgctctggcaggcggcgatggggatcagctttggcgtggtgattgccaaggagatcttcggcgggaccggacgcaacttcctcaacccggcgctggcaggacgcgcgttcctgttctttgcttatccggcgcaaatctcgggcgacctggtgtggacggcagcagacggattctccggcgcgacgccactttcacagtgggcggcaggcggcggcgaaacgctggtcaataatgcaaccggacagcctgtcacctggtttgatgcgtttatcggcaatatcccaggctccatcggtgaagtgtctaccctgatgattttgatcggcggagccatcatcctctttggccgcgtggcgtcctggcgcattgtcgctggcgtcatgctcgggatggtactcaccgccacgcttttcaacttcattggttcagacacaaacccgatgttctccatgccgtggtactggcacctcgtgctgggaggctttgcgtttggcatgatgttcatggccaccgatcccgtctcggcttcgtttaccgacagaggtaaatggtgttacggcgcgctcattggggtgatgtgtgtactgattcgcgtggtcaacccggcttatccggaagggatgatgttggccattctgtttgccaatctgtttgcgccgctgttcgactacctggtcgtgcgcgccaacattaaacggaggaaggcgcgtggctga

SEQ ID NO: 923 - DNA, 1227 bp, Enterobacter cloacae
caaatggaaattattcttggcgtggtgatgttcacgctgatagtactggtgctgtcagggctgatcctggcggcgcgtgcgaagctggtcaattccggggatgtgatcattgatatcaatgacgatccgcagaatcagatccgtaccccggcaggggataagctgcttaacacgctctccggcaacgggatttttgtctcgtctgcctgtggcggcggtggctcctgtggccagtgccgtgtgacggtgaaagagggcggcggtgatattctgccaacggaactgtcgcatattacgaagcgtgaagcgaaagagggatgccgtctggcgtgtcaggtcgctgtgcgccagaacatgaagattgagctgccggaggagatcttcggcgtgaaaaaatgggagtgcgaagttatctctaacgataacaaagccacgttcattaaagagctcaagctgcgtgtccctgaaggggagagcgtcccgttccgtgcgggtgggtatatccagattgaatgtccggcacacaccgtcgcgtatgctgacttcgacgtgcccgaagagtaccgggccgactgggataaatttaacctcttccgctttgtttccgaggtaaaagagcccgcgctccgcgcctattccatggctaactacccggaagagaagggcattattatgctcaacgtgcgtatcgccacgccgccaccgaatgtgcctgatgccccccctggcgtcatgtcatcctatatctggtccctcaagcctggcgacaaagtgacgatttccggcccgttcggcgaattctttgccaaagatactgacgcggagatggtctttatcggcggcggagcgggtatggcgccgatgcgttcgcatatctttgaccagctcaaacgacttggcagcaagcgcaagatcagcttctggtacggagcgcgttcactgcgcgaaatgttctatgacgatgagtttgaacaactggcacgtgataaccctaactttaccttccatgtggcgttatccgatccgcagccggaagataactggacaggctatacgggcttcatccacaacgtgctgtatgaaaattacctcaaacagcacccggcaccggaagactgcgagttctatatgtgtggtccaccaatgatgaacgcggccgtgattaagatgctaaaagatcttggcgtggaagatgagaacatcatgctcgatgatttcggaggctga

SEQ ID NO: 924 - DNA, 489 bp, Enterobacter cloacae
gccgtatataaacaggctgggacacttcacatgagcgaaaaatacgtcgtcacctgggacatgttgcagattcacgcacgcaaactggctgcgcgtctgatgccttccgaacagtggaaaggcattattgccgtcagccgtggcggtctggtaccgggggcgctgctggcacgtgagctgggtattcgtcatgtcgataccgtatgtatctccagctacgatcacgacaaccagcgcgaactgaaagtgctgaaacgcgcggaaggcgacggtgaaggctttatcgttatcgacgatctggtggataccggcggtactgcggtggctatccgcgaaatgtatccaaaagcgcacttcgtcactatcttcgcgaaaccagcgggtcgcccactggttgatgattacgtcattgatatcccgcaggatacctggattgaacagccatgggatatgggcgtggtcttcgtaccgcctatctctggccgttaa

SEQ ID NO: 925 - DNA, 1449 bp, Enterobacter cloacae
ctcgcatttcggcgcgccagacggcggatttgctgcccctggcagggcctaaaatggtacactccggtctctctggattgttgttcatggatacctgctaaccacatgtttagaatcagaaaaggactcgatctgccaatctctggcgtgcctgaacagcacgttaccaccggcgccagtattcatcatgtcgccattgtaggtgatgattacgtgggcatgcgtcctgcgatgctggtacaggaaggcgatcgcgtaataaaaggccaggcactcttcgaggataaaaaaaatcctggcgttatgtttacagccccagccagcggcaccgttgttgccatccatcgtggtgagcgtcgcgtcctgcaatcggttgttattcaaattgaaggtgatgagaaacgcgaatttgcgcgttttgacgccgccgatctcgccaccctcagccacgacgtggtgcagacgcaactgctggagtcgggactgtggacggcgcttcgcacgcggccctatagcaaaacgcccgtgccaggcactgtgccggccgctatcttcgttacggccatcgacaccaacccgctcagcgcagatccgcagcctcttatcctggcggaacgaaaagctttcgatgccggcctcgccgtgttaacacgcctgacgccgggcaaagtgcatgtctgccaggcctgcggcggtaagctgggcggtcatccgcaagggcaggtggcctttaatgaatttgccggcccgcatccggcggggctggtgggaacgcatattcatttcctggagccggtaagcctgacgaaacaggtctggcatcttaattatcaggacgtgatcgctatcggtaagctgttcaccacgggtgagctgtgcgcagaacgcattattgccatcggcggccctcaggcaacccaaccgcgtctggttcgcacgctgcttggggctgacctgacggcgctgttggctggcgaaacgaaagagggtgaaaaccgtattatttccggttcggtgctgagcggcaggcacgcgacaggcccgatggcctggctgggtcgtttccatcttcaggtgagtgtggtgcttgaaggacgcgataaagagctgttcggctgggtactgcctggcgcagaaaaatactcggtaacccgcaccacgctcggccacttcctgcgtcataagctgtttaacttctccaccagcaccaacggcggtgagcgcgccatggttccgattggcaactacgaacgcgtgatgccgctggatattctgcccaccgtgctgctgcgggatctcctggccggtgataccgacggtgcccaggcgctgggctgtctggagctggacgaagaagatctggcgctgtgtacctatgtgtgtccaggtaaatacgaatatggacccgtattgcgcgaggtgttaacccgcattgagcaggaaggataa

SEQ ID NO: 926 - DNA, 879 bp, Enterobacter cloacae
tgttggccattctgtttgccaatctgtttgcgccgctgttcgactacctggtcgtgcgcgccaacattaaacggaggaaggcgcgtggctgagatcaaaaataacgacagcatcagcaaaacgctgctggtggtgctggtactgtgtctggtttgttccattgtcgtggccggttctgccgtagggttgaaaccgctacagcaggagcaacgtgcgctggataaacagcgtaacatcctggccgttgccgggctgatgcaggaaggcatgacgaaggatgacgtcgcagcggtgtttgccgaacgtattaccgcacggctggtggatttaaaaaccggggagttaatggataaagacccggcgaaatacaaccaggcgctggcgctaaaagatccgcaaatgagcaccacgcttgacgcctcgcaggatccggcaggcattaagcgccgcagcaatgtcgcggagatttacctcgtccgtgacgagcaaaaacgcattcagaaaatcgtgttgcccatctatggcaacggtttatggtcaatgatgtacgcctttgtggcgctggataccgacggccgtacggttaaaggcattacttattacgatcagggcgaaacgccggggctggggggcgaagttgagaaccctaactggcgggcacagtttgttggtaaaaaagtgctcgacgacaacggccagcctgcgctgaaggtggtaaaagggggcgcgcgtcccggcgatgaatttgccgttgatggcctttccggcgccacgctcacctcaaacggtgtgcagcacagctttgatttctggatgggtgaactgggctttggtcccttcctgaagaatgtacgtgaaggagcgctgaataatggctga

SEQ ID NO: 927 - DNA, 1068 bp, Enterobacter cloacae
gggcttactatgcgcaaaataatccacgtcgatatggactgcttttttgccgcagtggagatgcgtgacaacccggcgctgcgggatattcccattgccattggcggcagccgggtacagcgcggtgtcatcagcaccgccaactatcctgctcgcaaatacggcgtgcgcagcgccatgccgacagcgatggcgctgaaactgtgcccgcatctcactcttttgcccggacgttttgatgcctataaagaagcatcgagccacattcgggagatcttttcccgctacacctcactgattgaaccgttatcgctggatgaagcctatctggatgtcacccacagcgtgcactgccacggctccgccaccctgatggcgcaggagatccgccagactattttcaacgagctgaacctgacggcatcggcgggtgtcgcgccggtcaaatttctcgccaaaatcgcctccgatttaaataagcccaacggccagtacgttatcactccggaagaggtttcggcgtttttaaagacgctgccgctcagcaaaatccccggagtgggcaaagtctccgccgcgaagctggaaagtatggggctacgcacctgcgaagacgttcagcgcagcgatctggcgctgctgcttaagcgttttggcaagtttggccgcgtactgtgggaacgcagtcagggcattgatgaccgggatgtgaacaacgaacggctgcgtaaatcggtcggcgttgaacgcacgctgagtgaagatatccatgactggaccgaatgtgaaaccattattacggaacaactctatcctgaacttgaacgacgcttactgaaggtcaaaccggatctgcttattgcccggcagggcatcaaactgaaatttaacgattttcagcaaacgacgcaggaacacgtctggccacgcctcaacaaagaggatcttatcgcgacggcaaaaaaggcatgggaagaacggcggggcgggcgaggggtgaggctggtggggctgcacgtcaccttgctggatccgcagctggagcgtcagctggtgttgggactgtag

SEQ ID NO: 928 - DNA, 642 bp, Enterobacter cloacae
ataatggctgatacgggtgaactgaaagaagttaaaaaggtgctgattggcccgctgttagccaataacccgataacgcttcaggtgctgggggtgtgctcggcgctggcggtcaccaccaagctggaaacggcggtggtcatgacgctggcggtaacgctggtgacagctttttccagcatgtttatctcaatgatccgccaccacatacccaacagcgtaaggatcatcgtgcagatggcgatcatcgcctcgctggtgatcgtggtcgatcagctcctgcgcgccttcgcctatgaaacctcgaagcagctttcggtgtttgtcggcctgattatcaccaactgtatcgtgatggggcgtgctgaagcctatgcgatgaaaatgccgccgctggcgagctttatggacggtatcggcaacggcctgggttacggcgtaatcctgttgacggttggtttcctgcgcgaacttattggcagcggcaagctgtttggcattccggtgctggatacggtacagaacggcggctggtatctgccgaacggcctgttcctgctggccccaagcgcatttttcattatcggtttgctgatctggctgattcgtacgttgaagcctgaacagcaggaaaaggagtaa

SEQ ID NO: 929 - DNA, 603 bp, Enterobacter cloacae
ccgacaatggctcattacctgagtttatttgtgcgcgcggtgtttgttgaaaacatggcgctcgctttcttcctgggcatgtgtacgttccttgccgtttctaaaaaggtatcgacggcatttggtctgggcgtggcagttaccgttgtgctggggctttccgttccgattaacaacctggtattcaacttcgtgctgcgcgatggcgcgctggtggagggggttgatcttagcttcctgaacttcatcacctttatcggagtgattgcggcgcttgttcagatcctggagatgatcctcgataaatacttcccgtcgctgtacaacgcgctggggatcttcctgccgctgatcgccgtgaactgcgccatttttggcggtgtttcctttatggttcagcgtgattacaacttcagtgaatcggttgtgtatggcttcggttccggtatcggctggatgctggcgattgttaccatggcggggatccgtgaaaaaatgaaatatgccaacgtacctgcggggcttcgtggcttagggatcacctttatcaccaccggcctgatggcgttgggctttatgtccttctccggtgtgcagctataa

SEQ ID NO: 930 - DNA, 216 bp, Enterobacter cloacae
tttcggaggctgattatgctgacctttctggcgacctttgcggtgtttgtgctggtgatcttcggcatgtccttaggctggatcatcaagcgtaaaagcattcagggcagttgcggaggcatctcttccatcggaatggaaaaagtgtgcgattgtccggaaccgtgcgatgcgcggaaaaagcggatggctcgcgagcagcaacgcattatttag

SEQ ID NO: 931 - DNA, 558 bp, Enterobacter cloacae
cctgcaacattgttttgcagcgcatcgacaaggagacctatcgtgtctgaactgtctcaattatctccacagccgctgtgggatatttttgccaaaatctgctccattccgcacccttcctatcacgaagaacagcttgccgaacatattatgggctgggcaaaggaaaaaggtctgcacgctgaacgcgaccaggttggcaatattcttatccgcaaacctgccaccgcaggtatggaaaaccgtaagccagtggtattgcaggcgcacctggacatggtaccgcagaaaaacaacgacaccgttcacgacttcacaaaagacccgattcagccgtacatcgacggcgagtgggtgaaggcgcgcggcacgaccctgggcgcagataacggtattggtatggcttccgcgctggccgtgctggctgacgacagcgttgaacacggtccgctggaagtgctgctgaccatgactgaagaagcgggcatggatggcgcgttcggtctccacgcaaactggctgcaagcggacattctgatcaacaccgactccgaataa

SEQ ID NO: 932 - DNA, 942 bp, Enterobacter cloacae
caaggtgagatctacatgggctgcgcgggcgggatcgatttcatctctaccctgccgctgtcccgcgaagcgatccctgctggattcgagacctttaagctgacgctgaaagggctgaaaggcggtcactccggcggtgatattcacctgggcctgggcaacgccaacaaactgctggcgcgtttcctggcgggccatgccgctgaactggatctgcgtctggtggacttcaacggcggtactctgcgtaacgcgatccctcgcgaagccttcgctaccttggcagtgcctgcgtcgaaagcggacgagctgaaaaacctctccagcgtgtatctggagatcctgaaaaacgaactgtctgcaaaagagaaaaacctgacggtggtgctggagtccgttacgacggataaagccgcgctgaccgcacagtctcgtgacacgttcgtccagctgctgaacgcaacgccaaacggcgttatacgcaactctgacgtggcgaaaggcgtggtggaaacctccctgaacgtgggcgtggtgaccatgggtgacgacagcgcagagatcatctgcctgatccgttccctgatcgacagcggtaaagagtacgttgtgagcatgctggaatctctgggtaccctggcgggcgcgaaaacgtctgcaaaaggcagctacccgggctggcagccggatgcaagttctccggtcatggcactggtgcgtgaaacttatcagcgactgttcaacagcaccccgaacattcaggttattcacgcgggtctggagtgtggtctgttcaagaaaccgtatccggatatggacatggtctccattgggccgaccatcacgggtccacactccccggatgaacaggttcatattgaaagcgtcggtcactactggacgctgctgactgagctgctgaaagcaatccctgcgaagtaa

SEQ ID NO: 933 - DNA, 1701 bp, Enterobacter cloacae
tattgcttgcgcggatgcccggcccctgtggtgaagactatcgagcagatgcgtttgtcggcgaccaaggcgctgctggagcgtcgtgatgtggtggtggtggcctcggtgtcggcgatctacggcctgggcgatccggatctctatctcaagatgatgctgcacctgacgcaggggatgatcatcgatcagcgggcgattttgcgccgtctggcggagttgcagtacacccgtaacgatcaggcgttccagcgcgggaccttccgcgtgcgcggcgaggtgattgatatcttcccggcggaatcggacgacatggcgctgcgcgtggagctgttcgacgaagaggttgaacgcctgtcgctgttcgatccgttgaccggtcacgtcgagtcggtgatccagcgcttcaccatctacccgaaaacgcactacgtgacgccacgcgagcgtatcgtgcaggcgatggaagagatcaaaattgagctggcggaccgccgcaaggtgctgctggcgaacaataagctgctggaagagcaacgcctgagccagcgtacccagttcgatctggagatgatgaacgagctgggctactgctccggcatcgaaaactactcgcgctacctatccgggcgcgggccgggcgaagcgccgccgacgctgtttgactaccttccggcggacggcctgctggtgatcgacgaatcacacgttacgatcccccagatcggcgggatgtaccgcggtgaccgcgcgcgtaaagagacgctggttgagtacgggttccgactgccgtcagcgctggacaaccgtccgatgaagtttgaagaatttgaggcgcttgctccgcagaccatctacgtatcggcgacgccgggcaactacgagctggaaaaatccggtgatgacgtggtggaccaggtggtgcgtccgaccgggctgctggatccgattatcgaggtgcgtccggtggcgacgcaggtggacgatctgctctcggaaatacgtgcccgttccgccatcaacgagcgcgtgctggttaccacgctcaccaaacgtatggcggaagatttgacggagtatctggaagaacacggcgagaaggtgcggtatctgcactcggatatcgataccgtggagcgtatggagatcatccgcgatctgcgtctgggcgagttcgacgtgctggtagggattaaccttctgcgagaagggctggatatgcctgaggtgtcgctggtggcgattctggacgcggacaaagagggcttcctgcgttccgagcgctcgctgatccagaccattggccgcgccgcgcgtaacgtcaacgggaaggcgatcctgtacggggataaaatcaccccgtcgatggccaaagcgattggcgaaacggaacgtcgtcgcgagaagcagcagcgctataacgaagagcacggcatcacgccgcaggggctgaacaagaaggtggtggatatcctggcgctgggtcagaacattgcgaagactaaagcgaaaggccgcggcaaggcccgttcagtggtggaagaggataccgtcgcgctgacgccgaaagcgttgcagcagaagatccacgagctggaagggcagatgatgcagcatgcgcagaacctggagttcgaagaggccgcccaaatccgcgatcagctgcatcagctgcgggatctgtttattgcggcatcgtag

SEQ ID NO: 934 - DNA, 252 bp, Enterobacter cloacae
aaagccatgattaaggtgcttttttttgcccaggtccgtgagctggtcaataccgacagcctgacgctggacggctctttcgaaaacgtcgccgccctgcgcgcgcatctggcggcgcaaggcgaccgttgggcgctggcgctggatgaaggcaaactgctggccgccgtgaatcagacgctggtggagttgacccacccgctggccgatggggacgaagtggccttcttcccgccggtcacagggggttaa

SEQ ID NO: 935 - DNA, 444 bp, Enterobacter cloacae
attagcagagaaaaatccttcaggagagaagccatgaagtggcaacaacgcgttcgtgtcgcaaccggtttgagttgctggcagataatgttgcatttactggtcgtggccgtactggtgatgggctggatgagcggcacgctggtgcgtgttggcttagggttatgcgtggtttacggcgtgaccgtgctgtcgatgctgtttttacagcgtcaccacgacgcgcgctggcgtgaagtgggagatgtgctcgaagagctcaccaccacctggtattttggtgcggcaatgatcgtcctgtggctgttgtcacgcgtgctgcaaaacaacctgctgctggccctggcgggtctggctatcctcgcaggacccgcggtggtgtcgttgctcaccaaagagaaaaagctacgcgatgtttcgtctaaacatcgcataggccactga

SEQ ID NO: 936 - DNA, 513 bp, Enterobacter cloacae
cccacccgctggccgatggggacgaagtggccttcttcccgccggtcacagggggttaagatgacggaaacccgaattctggtcggccctgagcgctttagcgtcggtaccgaatacagctggctggcagagcgcgatgaagacggcgcggtcgtgacgtttaccggaaaagtgcgtaaccacaacctcggcgacagcgtaaaagcgctgacgctggagcactatccggggatgaccgaaaaatcactggcggccattgtcgaagaggcgcgaggccgctggccgctgggacgcgttacggttatccatcgcatcggcgaaatgtggcccggcgaagagattgtgtttgtcggcgtcaccagcgcccatcgcgggagtgcgtttgcggcgggggagttcatcatggattatcttaaaaccaaagcgccgttctggaaacgtgaagcgacgccggaaggtgagcgctgggtggaatcacgcgacagcgataagcatgccgccagccgttggtaa

SEQ ID NO: 937 - DNA, 1212 bp, Enterobacter cloacae
aaatgcacgataacatcgttatgtataaatttatatagcgaaaagcgacaatggcgaagtggcgatttccacgctactatcgccataaccacgttttcaaaactgaaaacatacactctagccctggcgcctgtgtcgagagatatggcgccctggccgtggcggatttgccaccagggtacagaaagaaatgactgtgcctcccgatctggaaaggtgtacatggcttcacaacttactgatgctttcgcgcgtaagttttactacttgcgtctgtcgattaccgatgtgtgcaacttccgttgcacctactgcctgcccgatggctacaagccgggcagcgtcaccaataatggctttctctccgtggatgaagtacgccgcgttacgcgtgcgttctcggaactcggcacggaaaaagtgcgtcttaccgggggagagccctccctgcgtcgtgatttccctgacattattgccgccgtgcgtgaaaacgaacgtatccgccagatcgcggtgaccaccaacggttaccgcatggcgcgtgacgtggcgaactggcgcgatgcggggctgacggcgatcaacgtcagcgtggacagccttgatgcccggcagtttcacgccattaccggtcaggacaagttccgccaggtgatggacggcatcgatgcggcgtttaccgccgggttcgaaaaagtcaaagtcaacacggtgctgatgcgcgacgtaaaccaccatcagttggacaccttcctggcgtggattaaatcccgtcccattcaactgcgttttatcgagctgatggaaacgggcgagggcagcgagctgttccgccgtcaccatatttccggcatggtgttgcgcgacgagctgctgaaacgcggctggatccatcagatccgccagcgcagcgatggcccggcgcaggttttttgtcatccggattatgaaggcgaaatcggcctgatcatgccctatgaaaaagacttctgtgccagctgcaaccgcctgcgtgtctcctccgttggcaagctccatctttgcctgttcggggatggcggcgtcgatctgcgcgatttgctggaagatgacgctcaacaggacgcgcttgaagcacgcatttccgaggcgctgacgcacaaaaagcagacccatttcctgcatcagggcaacaccggcattactcagaacctgtcctatatcggcgggtaa

SEQ ID NO: 938 - DNA, 537 bp, Enterobacter cloacae
tcaggctttagaaggaaccagaagatgagtcaagtaagcgcggaatttatcccgacacgcattgctattcttaccgtttccgaacgtcgtggtgaagaggatgatacctccggccactggctgcgcgaggcggcacacgaagccggacaccagattgttgataaagcgatcgtcaaagaaaaccgttacgccattcgcgctcaggtctcacagtggattgcgaacgatgacgtccaggtggtgctgatcactggcggcaccggctttaccgcaggcgaccaggcgccggaagcgctgctcccgctgttcgatcgcgaagtggaaggcttcggcgaagtgttccgcatgctctcgtttgaagagattggtacctctacgcttcagtcccgtgctgtcgcgggggtggcgaacaagacgctgatcttcgccatgccggggtcgaccaaagcctgccgcaccgcgtgggaaaacattattgccccgcagctggatgctcgtacccgtccgtgtaacttccatccccatttaaagaaataa

SEQ ID NO: 939 - DNA, 489 bp, Enterobacter cloacae
gctatgtcacaactgacccacataaacgccgctggcgaagcgcatatggtggatgtctccgccaaagccgaaacggtgcgcgaggcgcgtgctgaagcgttcatcaccatgctgccggagacgctggcgatgattatcgacggcagccatcacaagggtgatgtgtttgccaccgcccgtatcgctggtattcaggccgctaaacgtacctgggacctcattccgctctgccatccgctgatgctcagcaaagtggaggtaaatttgcaggcgcagccggcgcataatcgcgtgcgtatcgagtccttgtgccgcttaaccgggaaaaccggcgtggagatggaggcgttgacggcggcctccgtggcggcgctgaccatctacgacatgtgtaaagcggtgcagaaagatatggtgattggcccggtgcgtctgttggcaaaaagcggcggcaaatccggcgattttaaggtagaaagccatgattaa

SEQ ID NO: 940 - DNA, 711 bp, Enterobacter cloacae
atcatggaccgatttccgcgttccgattcgatagttcagcagacccgtagcgggctgcaaacctacatggctcaggtatatggctggatgacggttggcctgctgcttaccgcgtttatcgcgtggtatgcggcaaacacgcctgaactgatgatgtttatcttctccagcaaaatcaccttctttgggctgattattgcgcaactggcgctggtatttgtgctctccgggctggtgcacaagctcagctcgggtatggcgaccacgctgtttatgctctattcggcgctgaccgggctgacgctttccagtattttcatcgtttacacctactcctccatcgccagcacctttgtggtgaccggcgggatgttcggtgtgatgagcctgtacggttacaccaccaaacgtgacctgagcggcttcggcaacatgctgtttatggggctgattgggattgtgctggcgtcgctggtgaacctgtggctgaaaagtgacgcgctgatgtgggcggtgacctatatcggggtggtgatcttcgtgggcttaaccgcctacgacacccagaagctgaaaaacatcggtgagcaaattgatgttcgtgacagttcaaacctgcgcaaatactcgattctgggcgcgttgacgctttatctggacttcatcaacctgttcctgatgctgctgcgtatcttcggcaaccgtcgttag

SEQ ID NO: 941 - DNA, 1297 bp, Enterobacter cloacae
ggcccggggaccaaattttccccggggggaaaattttgggggccaggtggccaaccctttttccggggggggggaatttcccgggggggcggattttcaaacacggtgttttaaaggggttgggcggggaagtttattcgggtgggaggggggggaaacccacacgggcggttggattagggggcgggcattttttcgcggttatggaccattgatcgccaaggggcggcaatccatggtgcgggagcggcgaacccgcgccattatggggctgccggtgctggttccggttgtactgtttcggtttgcccccacggtggaggtcaccacggccaccttcgccatttacaacgaagacaatggcaagcattccgtcgagctgacgcagcgtttcgcccgcgccaaagcctttacccatgtcctgctgctgcaaagcccgcaggcgatccagcccaccatcgacacgcagaaagcattattgctggtgcgcttcccggcggatttctcccgcaatctggacaccttccagaccgcgccgatgcagctgatcctcgacgggcgtaactccaacagcgcccagatcgcggccaactacctccagcaggtggtgaaggattaccagcaggagctgatggacggcaaacctaagcccaacaacagcgagctggtggtgcgcaactggtacaacccgaatctggactacaagtggtttgtggtgccgtcgctgatcgccatgatcaccaccattggcgtgatgattgtcacctcgctgtccgtggcacgcgaacgtgagcaaggtacgctggatcagctgctggtctcgccgctcgccacctggcagatatttgtcggcaaggcggtgccggcactgattgtcgcgacgttccaggccaccatcgtgctgggggtgggaatatgggcgtaccagatcccgtttgccggatcgctggcgctgttttacttcacgatggtgatttacggcctgtcgctggtggggtttgggctgctgatttccgcgctatgctcaacgcagcagcaggcgtttattggggtgtttgtctttatgatgccggcgattttgctttctgggtacgtttcgccagtggagaacatgccggtgtggttacaggatttgacgtggataaacccgattcgtcacttcacagatatcaccaagcaaatctatctgaaggatgcgagtctggatattgtgtggggaagtttgtggccgctactggtcatcgcggccactacgggctcagtggcctatgcgatgtttagacgaaacatcgcgtag

SEQ ID NO: 942 - DNA, 1155 bp, Enterobacter cloacae
gtccatggtgccgaaacggagctggtggaacgtgggcatcggcgtggtggtgttccacttcctgcgccacttcccggccatggtgggctggctgcccgcgcatacgccgaaactggcgctggtggatccgcctgtgcaacccgaaatggaaacccaggaccgcgtagaggcggaagatggagggaaaacctgatgtcgaaatctcatcctcgctggcggctggcgaaaaaaatcctgacctggctgttctttattgccgtcgcggtcctgctggtggtgtatgcccagaaggtggactgggaagaggtgtggaaagttattcgcaactacaaccggacagtcctgctgggtgccgttgggctggtgattgtgagctacctgatgtacggctgctatgacctgctgggacgcgcctactgcgggcataagcttgccaaacggcaggttatgctggtgtcattcatctgctacgcctttaacctgacgctgagcacctgggtgggcgggattggtatgcgctatcgcctgtactcccgccttggcttaccgggcggcaccattacgcgtattttctccttaagcataaccaccaactggctggggtatattctgctgggcggggtgattttcaccatcggcgtggtgcagctgcctgcgcactggtacatcgatgaggccactctgcgcattctgggcatcgtactgctgctgatcatcgcggcctacctgtgggcctgcgcctttgccaaacgtcgtcacatgaccattaaaggccagaagctggtgctgccgtcatggaagtttgccgtcctgcaaatggtggtttccagcgccaactggatggcgatgggggccattatctggctgttaattggcgaagatgtgaattacttctttgtgctgggcgtgttgctggtaagcagtattgccggggtgattgtgcatattccggcaggtattggcgtactggaagcggtgtttatcgcgctgcttgcgggggagcatgtgtctcacgggacgattatcgccgccctgctcgcgtaccgcatgatctactacttcctgccgctggcgctggcaacggtctgttatctggtgctggagagtcgggccaagaagctgcgcgcgaagaacgagaaggcaatggcaaaataa

SEQ ID NO: 943 - DNA, 918 bp, Enterobacter cloacae
ggaataggtatgcgcaatcgcacttttgcggatctggaccgcgtggtcgctcttggcggaggtcacgggctgggacgggttatgtcgtcgttatcgtcactgggctcacgcctgacgggcatcgtgacaacaacggacaacggcggctcaaccgggcggatccgacgtgctgaaggcgggatagcctggggcgacatgcgcaactgcctcaaccagctcatcactgagccaagcgtggcctcggcgatgtttgagtaccgttttggcgggaatggcgaactttcaggccataaccttggaaatctgatgttaaaggcgctggatcacctgagcgtgcgccctctggaagcgatcaatttaattcgtaacctgctaaaagtggatgcgttcctgatcccaatgtccgaacagccggtagatttgatggcgatcgatgctgacgatcacgaagtgtatggtgaagtgaatatcgaccagcttcttctgccgccaaaagagctgatgacctaccccagcgtacccgcaacgcgtgaagcggtagaagcgattggcgaggccgatctgatcctgattgggccgggaagtttttacaccagcctgatgccgatcctgctggtgaaagagctggcgcaggcgctgcgcagaacgcctgcgcccatggtctatatcggtaatttaggccgcgaactcagcccggcggcggcaagcctgtcgctggcggataagctggacctgatggaacagtacgttggtaagaaaattatcgatggtgtcgtggtcgggccgaaagtggatgtgtcagggattggcgatcgcgtggtggtacaggagccgctggaagccagcgatattaaatatcgccacgaccgccatctgctacgcgaggctctggagaaggcgattcaggcattaggttag

SEQ ID NO: 944 - DNA, 306 bp, Enterobacter cloacae
tcacccaggaaggtgtttatgagcaaaaaaacgcagcatttctcgcttaaggtgctgacgataaacattcataagggcttcacagcatttaaccgccgcttcattttaccggagctgcgcgacgcggtacgcaccgtcagcgccgatattgtctgcctccaggaggtcatgggcgcgcatgaagtgcacccgatgcatttcgaaaactggcccgacacgccccactacgagtttctggcggataccatgtggagcgattacgcctacgggcgcaatgcggtctacccggagggggcatcacggtaa

SEQ ID NO: 945 - DNA, 1344 bp, Enterobacter cloacae
ccgcatctacgtaaaaaatgcccacgccagcagcccgacggcgctggctttactcaactggcgacatctctccgaccatgccccactcagcgcggagatccacttatgaaatgcacatggcaggaaggtaaccgtattacgctgctggaaaatggcgataactattatccggcggtttttgaggcgattagccacgcacagcagaaagtctttctggaaacgtttatctggtttgaagacgacgtgggcaggcagttgcacagcgcactgctgcatgccgctcgtcgcggtataaaaatcgaggtcctgctcgacggatatggttcgccggatctcagcgacgaatttgttaacgagctcaccgccgcaggggtggtattccgctattacgatcccggcccgcgtctgttcgggatgcgcaccaacctgttccgccgtatgcaccgcaaaattgtggtggtggatgaaacggtggccttcgttggcggcattaactactccgccgagcatatgtcggattacggtcccgaagcgaaacaggactacgcgatccgtatcgaagggccggtagtgcaggacatccagctgttcgtgctggaaaacttacccggcaaagaggccgctcgccgctggtggcgacgccgtcaccgcccggaggagaaccgcaagcccggcgaggcgcaggccctgttcgtctggcgggataacgaggagcatcgggacgatatcgagcgtcattacctgaagatgctggcgaacgcgaagcgcgaggtgattatcgctaacgcctatttcttccccggttaccggattttgcatgccatgcgcaacgcggcccgacgcggcgtgagcgtgaagcttatcgtgcagggggagcccgatatgccgattgtgaaggtgggcgcgcgtctgctctatcgctatctggtcaaaagcggcgtgcagatctatgaatatcgccgccgcccgctgcacggcaaagtcgccgtgatggacgatcactgggcgaccgtcggctccagcaaccttgatccgctgagcttatcgctgaatctggaagcgaacctcatcatccacgatcgccagtttaatcacaccctgcgcgataaccttcagggtcttattaataaagactgcgtgcgtgtggatgagtccatggtgccgaaacggagctggtggaacgtgggcatcggcgtggtggtgttccacttcctgcgccacttcccggccatggtgggctggctgcccgcgcatacgccgaaactggcgctggtggatccgcctgtgcaacccgaaatggaaacccaggaccgcgtagaggcggaagatggagggaaaacctga

SEQ ID NO: 946 - DNA, 717 bp, Enterobacter cloacae
acattcataagggcttcacagcatttaaccgccgcttcattttaccggagctgcgcgacgcggtacgcaccgtcagcgccgatattgtctgcctccaggaggtcatgggcgcgcatgaagtgcacccgatgcatttcgaaaactggcccgacacgccccactacgagtttctggcggataccatgtggagcgattacgcctacgggcgcaatgcggtctacccggagggggcatcacggtaacgcggtgctgtcgcgttttcctatcgagcattatgagaaccgggacgtctccgttggcgagagtgaaaaacgcgggctgttatactgtcgtatcacccccccagagctcgattttcccattcatgtaggctgtgttcatcttggcctgcgtgaagcccaccgtcaggcccagctacagatgctggcagactggacaaatgcgctgccggagggcgagcccgtggtggtggccggtgatttcaacgactggcgacagcgtgccaaccatccgctgaaggtgaatgcggggctggaggagattttcacccgcgcacgcggtcgtcccgcgcgaacgtttccggtgcgcttccccctgctgcgccttgaccgcatctacgtaaaaaatgcccacgccagcagcccgacggcgctggctttactcaactggcgacatctctccgaccatgccccactcagcgcggagatccacttatga

SEQ ID NO: 947 - DNA, 717 bp, Enterobacter cloacae
aagtcacccgtaaccgaaactagcattatgaattcaaaacgttacgagcgaatctgcgaaatgctcgccaggcgtcagcctgatctgacggtctgcatggagcaggtccataaacctcataacgtctctgctatcgtccgcaccgcagatgccgtcggcgtgcatgaagtccacgccgtctggccaggcgcacgtatgcgtaccatggcctccaccgccgcaggcagcaacagctgggtatccgtgaaaactcaccagactattggtgaagcggtctcgcacctgaaagggcgtggcatgcaggttctggcaaccaacctctctgctaaagccgtggatttccgtgagatcgactacacccgtccgacctgtattttaatgggccaggagaaaacggggatcacgcaggaagcactggatttggccgatcgggacatcatcattccgatgattggcatggtccagtcactcaacgtgtcggtcgcctcagcgctgatcctgtatgaagcgcagcgccagcgtcagaatgccggaatgtacgagcgcagcaacagcatgctgccggaagaggagcagcagcgcctgctgtttgaaggtggctatccggtgctggctcgcgttgcgaagcagaagaaattgccttacccccacgtcaacgcgcagggcgaaattgaagccgatgccgagtggtggtccaccatgcagtacgcgggataa

SEQ ID NO: 948 - DNA, 2085 bp, Enterobacter cloacae
atcatgaaaggccgcctgctggacgctataccgctcaacagcctgacgggcgtgggcgcggcacaaagcagtaaactggcgaagattggcctgcacaccgtgcaggatctcctgctccacctccccctgcgttacgaagaccgtactcagctttataaaattggcgatctgctgcccgctatttacgccaccgttgaaggggaagtgctgaactgcaacatcacctttggcggacgcaggatgatgacctgccagatcagcgacggcaccggtattcttaccctgcgctttttcaacttcaatgcggcaatgaaaaacagccttgccactggacgacgcgtacttgcgtacggtgaagccaaacggggcaaatacggcgcggagatgatccacccggaataccgcgtgcagggcgatctcagctcacctgagctacaggagacgctcacgccggtctatccaaccaccgaaggcattaagcaggctacgctgcgcaagctcaccgaccaggcgctggagctgctcgatacctgcgccattaacgagctgctgccgccggagctggcgcagggcatgatgagcctgccagaggcgttgcgcaccctgcaccgcccaccgccaacgcttcagcttgttgatttagagagcggtaaacaccccgcccaacggcgtcttatccttgaggaattactggctcacaacctgagcatgctggccctgcgcgcaggtgcgcagcgtttccacgcgcagccattaagccagcgtgatgagctcaaagataagctgctggcctcactgccgtttaaacccaccggcgcccaggcgcgggtgaccgccgagatcgaacgcgatatggcgctggatgtgccgatgatgcgcctggtgcagggcgatgtgggttccggtaaaacgctggtcgccgcgctggccgctttgcgcgctatcgcccacggcaagcaggtggcgctgatggcaccgacggaactgctggccgagcagcacgccaacaatttccgtaactggtttgccccgctgggaattgaagtgggctggctggccgggaagcagaagggcaaagcgcgccttgcgcagcaggaggcgatagccagcgggcaggtgcagatgattgtcggcacgcacgccattttccaggaacaggtgcagtttaacggcctggcgctggtgattatcgacgaacagcaccgctttggtgttcatcagcgtctggcgttgtgggagaaaggtctgcaacagggcttccacccgcatcagctgatcatgaccgccacgccgattccgcgcaccctggcgatgacggcctatgccgatctggatacctccaccatcgacgaactccccccgggtcgtacgccggtgacaacggtcgccattccggacacgcgccgcagcgacatcattgaccgcgtgcgcaacgcctgcacccacgaaggacgtcaggcttactgggtctgtaccctgattgaagagtctgagctgctggaagcgcaggctgccgaagccacatgggaagagttaaagctcgccctgccggagctgaacgtcggtctggttcacgggcgcatgaagcctgccgaaaagcaggcggtgatgcagtcgttcaaacagggtgaactgcatttactcgttgcgaccacggttatcgaagtgggcgtggacgtgccgaactccagcctgatgattattgagaacccggagcgcctgggcctggcgcagctccaccagctacgaggccgcgtgggccgtggcgcgatcgcctctcactgcgtgctgctctacaaagccccgctgtcgaaaaccgcgcagatgcgtttgcaggtattacgcgacagcaatgacggcttcgtcattgcgcaaaaagatctggagatccgcggcccgggtgaactgctgggcacgcgtcagacgggtaacgccgaatttaaagtggcggatttgttgcgcgatcaggccatgatccccgaagtacaacgccttgcgcgtcatattcatgaacgctaccccgaacaggcggcagcgttaattgaacgctggatgccggaaaccgagcggtattccaacgcctga

SEQ ID NO: 949 - DNA, 1425 bp, Enterobacter cloacae
aatgcccgcttttccaccgtgggattgccgccaatgtctgttaacactctggagtctgctgatgcgcaaccgattgcgcagaagcaaaacagcgaactgatttaccgccttgaagatcgtcccccgctgcctcaaaccctgtttgccgcctgccagcacctgctggcgatgttcgttgcggtcatcacgccggctctgctgatttgccaggcgctagggttaccggcgcaggatacgcaacacatcatcagtatgtctctgttcgcttccggcgtggcctccatcattcaaattaaagcctggggtccggtgggttcaggtttactgtcgattcagggcaccagctttaactttgtggcgccgctgatcatgggcggtacggcactgaaaaccggcggcgcagatgtcccgacgatgatggcggcgcttttcggcaccctgatgctggcaagctgcacagagatgatcatctcccgcgttctgcacctggcgcgccgggtgatcaccccgctggtctccggcgtggtggtgatgattatcggcctgtcgctgattcaggtgggtctgacctccatcgggggcggctacgcggcaatgagcgaccataccttcggcgcgccgaaaaacctgctgctggcaggcgtggtgctggcgatcattattctgcttaaccgtcagcgtaacccgtacctgcgcgtggcatcgctggtgatcgccatggcggccggttacctgctggcgtgggcgctgggtatgctcccggagaacaccaccccaaccaacagcgcgttgattaccgtgccaacgccgctctactatggcctgggcattgactggagtctgctcctgccgctgatgctggtctttatgattacctcgctggaaaccattggcgatatcaccgccacctccgacgtgtccgagcagccggtctccggcccgctgtacatgaaacgtcttaaaggtggcgtgctggcgaacggactgaactcgtttgtctcggcggtgttcaacaccttcccgaactcctgcttcggccagaacaacggcgtgatccagctgaccggcgtggccagccgctacgtgggcttcgtggtggcgctgatgctcgtggtcctcggcctgttcccggcggtaagcggatttgtacagcacattcccgagccggtgctgggcggcgcgacgctggtcatgttcggtaccatcgcggcctccggcgtgcgtatcgtctcccgcgagccgctgaaccgccgcgcaatcatgattattgcgctgtctctcgccgtagggcttggcgtctcccagcagccgatgattttgcagtttgccccggactgggtgaaaaacctgctctcttccggcatcgccgcgggcggtattaccgctatcgtgctgaatctcattttcccgcctgaaaagaactga

SEQ ID NO: 950 - DNA, 330 bp, Enterobacter cloacae
acccactttcagtatcatgcccagtcatttcttcacctgtggagcattttaagtatggcacgcgtaactgttcaggacgctgtaaagaaaattggtaaccgttttgacctggtgctggtcgccgcgcgtcgcgctcgtcagatgcaggtaggcggtaaagatccgctggtaccggaagaaaacgataaaaccaccgttattgcacttcgcgaaatcgaagaaggtctgatcaacaaccagatcctcgacgtgcgtgagcgccaggagcagcaagagcaggaagccgctgaattacaagctgttaccgctattgctgaaggtcgtcgttaa

SEQ ID NO: 951 - DNA, 1728 bp, Enterobacter cloacae
cacccttatgtgcgtttcgcgggaaggaagaccatgaaatttattggaaagctgcttatctatcttctggtagccctgctcattgtagtgctcgccttttattttctgctccagacccgctggggcgcatcgcaggtcagcagctggatcacggtgaataccgattacgagctcaactttgacctgatggatcaccgcttttcatccccttctcacatccttctggaaaacgttaccttcggacgagatggcaaaccggccacgctggtcgctaaaaaagtggatattggcttaagcagccgccagatcaccgacccgctgcatatggatgccatcaccctgttcgatggcacgctgaatttatcgccgcagacggcgccgctgccgttccaggccgaccgtctgcaactgaataacatggcctttaacagcccgaatacggagtgggatctcagtgcgcaaaaggtgaccggcggcgtcagcccgtggcagcccgaggcggggaacgtactggggaaaaatgcgcaaatccagatgagcgccgggtcgctcaccctcaacggcataccggccaacaacgtgctgattcagggacaactcaacggcaaagaggtggcgctgaataccatcggtgccgatatggcgcgcggctcgcttacgggctcggctctgcgtaatgccgacggtggctgggttatcaacaccctgcgtctgaatgagatccgcctgcaaagcgacaaatcgctgctggatttcttcgcccctctctccaccctgccttcgttacagattgggcggctggaagtgaccgatgcccgtctacaggggccagactgggcagtaaccgacctcgatctcagcctgcgtaacctcaccctgagtaaaggtgactggcaaagccaggagggacggttatccatgaacgccagcgaatttatctacggctcgctgcatctgtttgaccctatcctgaacgcggaattctccccgcagggcattgcgctgcgtcagttcacctcccgctgggaagggggcatggtgcgcacctccggcaactggctgcgcgagggtcaggcgctggtgctggacgacgttgcgattgccgggctggaatatacgcttccggaaaactggaaaacgctgtggatggacccgctcccggcatggctgaacagcgtgacgctgaaaaaattcggcctgagccgcaacctggtgatcgacatcgatccggcgttcccgtggcagatcacctccctcgacggttatggcgctaatttgcggctggcgcaggatcacaagtggggcgtgtggggcggtaacgcaaccctcaacggggcggcagcaacctttaaccgcgtcgacgtgcgacgcccgtcgctggcgctgaatgccaacgccgcgacggtaaatattaccgacctgagcgcctttaccgagaaagggatcctggaagcgaccgccaccgtgtcacagctgccacagcgacaaaccaccgtgagcctgaacgggcgcggtgtaccactcaacgttttgcagcagtggggctggccagcgctgccgattgcgggcgacggcaatattcagctcaccgccagcggaagcgtgcaggcgaatgcgccgctgaagccgacggtgaacgggaagctgagcgcggtgaatatggataaacagcaggtgcaacagacgatgacgggtggtgtggtgtcgacggtggctccggcacagtaa

SEQ ID NO: 952 - DNA, 2130 bp, Enterobacter cloacae
acctgcgggtcgcccttgtatctgtttgaaagcctgaatcaactgattcaaacctacctgcctgaagaccagattaagcgtcttcagcaggcgtatctcgttgcacgtgacgctcacgagggccagacacgttcaagcggtgaaccctatatcacgcacccggtagcggtggcctgtattctggccgagatgaaactcgactacgaaacgctgatggccgccctgctgcatgacgtgattgaagatacccctgccacctaccaggacatggaacagctgtttggcaaaagcgttgccgagctggtggaaggggtctctaagcttgataagctgaaattccgcgataagaaagaggcgcaggccgaaaacttccgcaagatgatcatggcgatggtgcaggatatccgcgtcattctcatcaaactcgctgaccgcacccacaatatgcgcacgctgggctcacttcgcccggataaacgtcgccgcatcgcccgtgaaaccctcgaaatctacagtccgctggcgcaccgtttaggtattcatcacattaaaaccgagctggaagagttgggttttgaggcgttgtacccgaaccgctatcgcgtgattaaagaggtggtgaaagccgctcgcggtaaccgtaaagagatgattcaaaagatcctctctgaaatcgaagggcgtttgcaggaagcgggcattccgtgccgcgtgagcggtcgcgaaaagcatttgtactctatctactgcaaaatggtgctcaaagagcagcgttttcactcgatcatggatatctacgcgttccgcgtcatcgtccacgactcagacacctgttatcgcgtgctggggcagatgcacagcctgtacaagccgcgtccggggcgcgtcaaagattacatcgccattccaaaagcgaacggatatcagtctttgcacacctccatgattggcccgcacggtgtccctgttgaggtgcagattcgtaccgaagatatggatcagatggcggagatgggtgtcgcggcgcactgggcttacaaagagcacggcggcgaaagcagcaccaccgcgcaaatccgcgcccagcgctggatgcagagcctgctggagctgcaacagagcgcaggtagctcgtttgaatttatcgagagcgttaaatccgatctcttcccggatgagatttacgttttcacgccggaagggcgcattgtcgaactgcctgcgggcgcgacaccggtcgacttcgcttacgccgtgcataccgatatcggccacgcctgcgtaggtgcccgcgtcgacaggcagccttatccgctgtcgcagccgcttttcagcggacagacggtggagatcattaccgcgccgggggcacgtcctaacgccgcctggctgaactttgtcgtgagctcaaaagcgcgcgcaaaaatccgccagctgctgaaaaaccttaagcgcgacgactccgttagcctggggcgtcgtctgctcaatcacgcgctgggtggcagccgcaaactggcagagatcccgccagaaaacattcagcatgagctggagcgtatgaagctcgcctcgctggatgacctgctggcagagattggtctcggcaacgccatgagcgtggtcgtggcgaagaatctgcaacaaggcgaaacgacagccgttcctgccaccacgcaaaatcatggtcacctgccgatcaaaggcgctgacggtgtgctcatcaccttcgccaaatgctgccgtcctatcccgggcgacccgattattgcgcacgtcagcccgggtaaagggctggtgatccaccacgaatcctgccgtaacatccgtggctatcagaaagagcctgagaagttcatggcggtcgagtgggataaagagacggcgcaggaatttatcactgaaatcaaggtggatatgttcaaccaccagggtgcactggcgaacctgacggcagcgattaacacggcctcgtccaacattcaaagcctgaatacggaagaaaaagatggccgcgtttacagcgcctttattcgcctgaccgcccgtgaccgcgtgcatctggcaaatattatgcgcaagatccgcgtgatgccggatgtcataaaagtcacccgtaaccgaaactag

SEQ ID NO: 953 - DNA, 1215 bp, Enterobacter cloacae
caggagccttttatgattcatctcgatacgttgtcgacccttgttgccgcaacgctggttcttctgcttggtcgcaagctggtacacagtgtttcctttctgaaaaagtacaccattcctgaacccgtcgccggtggtttgctggtggcgctggccctgctgatactgaaaaaaagcatgggctgggaaatcgattttgatatgtccctgaaagatccgttgatgctggccttctttgccactatcggcctgaacgctaacctcgcaagcctgcgttcgggtggcaaggtgctgggcgtgtttctgattgttgtggtgggcctgcttctgatgcaaaacgccatcggcatcggtatggcgtcattgctggggctggatccgctgatgggtctgctggcggggtcgattaccctgtcaggtggccacggaacgggcgcggcgtggagcaagctgttcatcgaacgctatggctttgaaaacgcaacggaagtggcgatggcctgcgcgacctttggcctggtgcttggcgggctgattggcggcccggtggcgcgctatctggtgaaacactccaccacgccggaaggcaggccagacgatgaaatggtgccgaccgcgtttgaaaaaccggacgttggccgcagcatcacctcgctggtgatgattgaaaccatcgccatgattgctatctgcctcaccgtgggcaaaatcgttgcgcaatggctggctggaacggctttcgaactgccaacctttgtctgcgtgctgtttatcggggtgatcctgagcaacggtctggcgcagatgggcttctaccgcgtctttgagcgcgcagtgtccgtgctggggaacgtcagcctgtcgctgttcctggcgatggcgctgatgagcctcaagctgtgggaactggcctcgctggcgctgccgatggtggcgatcctggcggtacaggccgtgtttatggcgctgtatgccatctttgttacctggcgcatgatgggcaaaaactatgatgcggcggtactggcagcgggtcactgtgggtttggactgggggcaacgccaacggccatcgcaaacatgcaggcgatcactgaacggttcggtccgtcgcacatggcgtttctggtggtgccgatggtgggggcattcttcattgatatcgtcaacgcgctggtcattaagctctacctgatgctgccgatgtttggctga

SEQ ID NO: 954 - DNA, 585 bp, Enterobacter cloacae
gctcacgacaaagttcagccaggcggcgttaggacgtgcccccggcgcggtaatgatctccaccgtctgtccgctgaaaagcggctgcgacagcggataaggctgcctgtcgacgcgggcacctacgcaggcgtggccgatatcggtatgcacggcgtaagcgaagtcgaccggtgtcgcgcccgcaggcagttcgacaatgcgcccttccggcgtgaaaacgtaaatctcatccgggaagagatcggatttaacgctctcgataaattcaaacgagctacctgcgctctgttgcagctccagcaggctctgcatccagcgctgggcgcggatttgcgcggtggtgctgctttcgccgccgtgctctttgtaagcccagtgcgccgcgacacccatctccgccatctgatccatatcttcggtacgaatctgcacctcaacagggacaccgtgcgggccaatcatggaggtgtgcaaagactgatatccgttcgcttttggaatggcgatgtaatctttgacgcgccccggacgcggcttgtacaggctgtgcatctgccccagcacgcgataacaggtgtctga

SEQ ID NO: 955 - DNA, 255 bp, Enterobacter cloacae
gtgatggccaatattgagatctacaccaaagcaacgtgcccgttctgccacagagcgaaagcgctgctgtccagcaaaggcgtaacgttcaaggaactgccgatcgatggtgacgcgattaaacgcgaagagatgatccaacgcagtggtcgcacaacggttccacagatttttattgatgcgcagcacattggcggctgtgatgacttgtatgcgctcgacgcccgtggtggactcgatccgctgctgagctag

SEQ ID NO: 956 - DNA, 1086 bp, Enterobacter cloacae
tgcgctgttcatgaactatctacagcagcaggctggcgaaggtgccgaacaacatcaggatgcctgatgagcactgttaatgcgtcaatgactgtgatcggtgccggctcttacggcaccgctcttgccatcacgctggcaagaaatggtcacgacgtggtcctgtggggccacgatccaaaacatatcgcgacgttgcaacacgaccgctgcaacgtggcgtttctcccggacgttccgttccctgactctctctatctggaaagcgacctcgcgaccgcgctggcggtcagccgcaatattctgattgtggtgccaagccacgtgtttggcgaagtcctgcgtcagattaagccgctgatgcgtgcggatgcgcgtattgtgtgggcgacgaaggggctggaagcggaaaccggacgtctgttgcaggacgttgcccgcgaagcgctgggaacagcgatcccgctggcggtgatctcggggccgacctttgccaaagagctggctgcgggcttgccgacggcgatctcgctggcgtccaccgaccaggcattttccgacgatcttcagcaactgctgcactgcggcaaaagcttccgcgtgtacagcaaccctgattttatcggcgtgcagctgggcggcgcggtgaagaacgtcattgccatcggggctgggatgtctgacggcatcggtttcggcgcgaatgcgcgtacggcgttgatcacccgtggtctgaccgaaatgtcccgcctgggcgaagcgctcggtgccgatccggccacttttatgggaatggctgggctgggcgacctggtgctgacctgcaccgataaccagtcgcgtaaccgccgctttggcatgatgctcggacagggcagcgatgtaaaaagcgcgcaggagaagattggtcaggtggttgaaggctatcgcaataccaaagaagttcgcgaattggcgcaccgtttcggtgtcgaaatgccaataaccgaggaaatttatcaggtattgtattgcggaaaaaatgcgcgcgaggcagcattgaccttattaggtcgtgcgcgcaaggacgagcgcagcagcaattag

SEQ ID NO: 957 - DNA, 876 bp, Enterobacter cloacae
atgacccagccagcgcagaactggctggtcattaactatcgtctggagcaagcaatgccgtgtgaagaactggatatcgtctggaataatattaaagccgaagcccgagctttggccgactgtgagcccatgctggccagtttctatcacgcgacgctacttaagcacgaaaatctcggcagcgccctgagctatatgctcgccaataaactggcttcccctatcatgcctgctattgccattcgcgaggtggtggaagaggcctacgccgcagatccggagatgattgcttctgccgcctgcgacattcaggccgtgcgcacgcgtgacccggcggtggataaatactccacgccgctactgtatctcaaaggattccacgccttacaggcgtaccgcatcggccactggttatggaatgagggacgccgcgcgctggccatctttcttcaaaaccaggtttccgtgaccttccaggtcgatattcatccggcggcgaaaattggccgtgggatcatgctcgaccacgccaccggcattgttgtcggtgaaacggcggtgatcgaagatgacgtgtcgatcctgcaatccgttacgctgggcggtaccggtaaaaccagcggcgatcgccatccgaaaattcgtgaaggggtgatgattggcgcgggtgctaaaatcctcggcaatattgaagtcggacgcggcgcgaagattggcgcggggtcggttgtgctccagcctgtaccgccgcacaccaccgccgctggcgtcccggcgcgcatcgtcggtaagccagacagcgataagccgtcgatggatatggatcagcacttcaacggtattcaccacaccttcgaatacggcgacggcatctga

SEQ ID NO: 958 - DNA, 459 bp, Enterobacter cloacae
tcacttagtcgggagttgttaccccccatgcaagaaattatgcaattcgttagccgccacccggttctgagcatcgcgtggattggcctgctggtcgctgtactgttcaccacatttaagggactgacgtctaaaattaaggtgatcacccgcggtgaagcgacacgtctgatcaacaaagaggacgccgtggttgtcgatctgcgtcagcgcgacgatttccgcaagggccatattgcaggtgctatcaacctgctgccagcggaaattaaagcgaacaacattggtgagctggagaagcataaagcccagccgattattgttgttgacggcactggcatgcaggcgcaggaatctgccaacgcactgcataaagcaggctttgaaaacgtaacggtgctgaaagaaggcatctccggctggagcggggagaatcttcctttagtgcgcggtaaataa

SEQ ID NO: 959 - DNA, 504 bp, Enterobacter cloacae
gctagagactttaggacaattaaaaagggtttttccatgtcagaacaaaataacaccgagatgactttccagatccagcgcatctacaccaaggatgtctctttcgaagcgccaaatgcgccgcacgttttccagaaagactggcagccagaggttaaacttgatctggataccgcatccacccagctggcggatgatgtgtatgaagtcgtactgcgtgtcaccgtgaccgcctctctgggcgaagaaactgcgttcctgtgcgaagttcagcagggcggtatcttctccatcggcggcatcgaaggtaaccagatggcgcattgcctgggtgcatactgcccgaacatcctgttcccgtatgcgcgtgaatgcatcaccagcctggtttctcgcggtacattcccgcaactgaacctcgcgccagtaaactttgatgcgctgttcatgaactatctacagcagcaggctggcgaaggtgccgaacaacatcaggatgcctga

SEQ ID NO: 960 - DNA, 519 bp, Enterobacter cloacae
tcaaaagcccggtgcattgactcaccgggcttttttatttggctgttccggcgttcagatgccgtcgccgtattcgaaggtgtggtgaataccgttgaagtgctgatccatatccatcgacggcttatcgctgtctggcttaccgacgatgcgcgccgggacgccagcggcggtggtgtgcggcggtacaggctggagcacaaccgaccccgcgccaatcttcgcgccgcgtccgacttcaatattgccgaggattttagcacccgcgccaatcatcaccccttcacgaattttcggatggcgatcgccgctggttttaccggtaccgcccagcgtaacggattgcaggatcgacacgtcatcttcgatcaccgccgtttcaccgacaacaatgccggtggcgtggtcgagcatgatcccacggccaattttcgccgccggatgaatatcgacctggaaggtcacggaaacctggttttgaagaaagatggccagcgcgcggcgtccctcattccataa

SEQ ID NO: 961 - DNA, 1587 bp, Enterobacter cloacae
aattacgcaaaatttttgtctcttgagcatgaggttgtcgcaatgtcggtttctaaaaaacctatggtactggtgattctggatggctatggctaccgtgaagatcaacaggataacgccattttcaacgccaaaaccccggttatggatgcgctatgggcaaaacgtccccacaccctgattgatgcgtctggcctggaagtgggtctgccggatcgtcagatgggcaactcagaagtgggtcacgttaacctgggtgcgggccgtatcgtttatcaggacctgacgcgcctggacgttgaaatcaaagaacgtacattctttgccaacccaacgctcaccggagcggttgataaagccgttgccgcaggcaaggctgttcacattatgggtctgctctctgcgggcggcgttcacagccacgaagatcacatcatggcgatggtagaactggccgctgagcgcggtgcggaaaaaatctatctgcacgccttcctggatggtcgcgatacgccaccacgcagcgcaaaaggttctcttgaagcgtttgaagacaaatttgccgcactgggcaaaggccgcgtggcgtccatcattggtcgttactatgccatggaccgcgacaaccgctgggaccgcgttgagcaagcctatgatctgctgaccctggcaaaaggcgagttccagttcccgaccgccgttgaaggcctggaagcggcttacgcgcgtgatgaaaacgacgaatttgtgaaggcaaccgtgatccgcgctgaaggccaggccgatgccgccatggaagatggcgatgcgctgatcttcatgaacttccgtgccgatcgcgcgcgcgaaatcacccgcgccttcgtcaacagcgattttgacggtttcgcccgtaagaaagtggcgaagattgatttcatccagttgaccgaatatgcagcggatatcaaagccccatgcgcgtatccgcccgcctcgctggcaaacaccttcggcgagtggatggcgaaaaatgacaaaacgcagctgcgcatctccgaaactgagaagtatgcgcacgtgacattcttctttaacggcggcgtagaagagccgtttaaaggcgaagaccgcatcctgattaactcaccgaaagtcgccacttacgatctccagccagaaatgagctctgcggagctgaccgaaaaactggtggccgcgatcgaaagcggtaaatacgacaccatcatctgtaactatccgaatggcgatatggtgggccacaccggcgtgatggaagcagccgttaaagcggttgaagcgctggaccactgcgttgagcaggttgcgaaagcggttgaatccgtaggcggccaactgctgattaccgctgaccacggtaacgcagaacagatgcgtgacccggcaaccggtcaggcacataccgcccataccaacctgcctgttccactgatttatgtgggtgataaatcagtgaaagcagtggaaggcggcaagctttccgacatcgcgccaaccatgttgtcgctgatgggtatggaaatccctgaagagatgactggcaagccgctgttcatcgtggaataa

SEQ ID NO: 962 - DNA, 1293 bp, Enterobacter cloacae
tcgctccccatgaggggaaaggcgattttttcaatcacatgggtcatgaagccgcttcggttatcagtcagacctctgctttgcgccagcgcactcagcgctggcgtattgctgtgcgccgcatccgcccatgcggatgaccgcgatcagcttaaatccattcaggccgatatcgccgccaaagagcgtgcggtacgccagcagcaacagcagcgcgccaccctgctcgcccagcttaaaaagcaggaagaggccatttccgccgccgcgcgtaagctgcgtgaaacacaaaacacccttgcccagctcaataagcaaatcgatgaaatgaacgcgtcgattgcgaaactggagcgtcagcgcgatgcccaggagcggaaccttgctgcacagcttgatgctgctttccgtcagggtgaacacacaggccttcagctgatcctcagcggtgaagagagccagcgaggtcagcgtttacaggcctatttcggctatcttaaccaggcgcgtcaggagaccattgcgcagctgaaacagacgcgcgaagaagtcaccacgcaaaaagccgagctggaagagaagcagagccagcagcaaacgctgctctacgatcagcaggcgcagcaggagaagcttgagcaggcgcgcaatgagcgtaagaagacgctcgccgggctggagtcctctatccaggcaggacaaagccagctgagcgaaatgcgcgccaacgaatccagactgcgtaacagcattgcccgggcagaagccgcggccaaagcgcgcgccgaaaaagaagcgcgcgaagcgcaggcggtgcgtaacaagcagcaggaagcctcccgcaaaggcaccacctacaaaccgactgaaaatgaacgttccctgatgtcccgtaccggcggcctcggctccccgcgtggtcaggcttactggcccgttcgcggtacgatcctgcatcgctatggcgaacagttgcagggtgagctacgttggaaggggatcgttatcggtgcgtctgaaggtagcgaagtgaaagccatcgccgatggccgcgtgatcctggccgactggctacagggttatgggctcgtggtggtggttgaacacggtaaaggcgacatgagtctttacggctacaaccagagtgcgctagtcagcgttggcactcaggtgcgcgcgggtcaacccattgcccttgtgggcagcagtggcggtcagggccgcccgtcactctatttcgaaattcgtcgtcagggtcaggcggtcaatccacagccgtggttgggaagataa

SEQ ID NO: 963 - DNA, 966 bp, Enterobacter cloacae
  unsure (875)
gttttgcttcaatttcgtcgaattgttttttccgtagtcagcgcactggcgctggctgcaccggtttatgcaggcaaactcgcgattgtgattgatgacttcggttatcgaccacactatgaaaatcaggtgctggcgatgccgtcagccatctctgtcgccgtcctgcctaatgcgcctcacgcgcatgaaatggcgaccaaagcgcacaatggcggccatcaggtccttatccatctgccgatggcccccctcagcaagcagccgctggaaaaagataccctgcgcccggacatgagcagcgacgagatcgatcgcatcatccgcgatgcatacaataaagtgccgtatgccgtgggtctgaataaccatatgggcagcgcgatgacctccagcctgtacggtatgctgaaagtgatgcaggcgctggagcgttacaacctctatttcctcgacagcatgaccatcggcaacagccaggcgatgcgtgccgctcagggaacgggcgtgaaagtcatcaagcgcaaagtattcctggatgactcccagaacgaagcggatatccgcgtccagttcaaccgcgcggtacagctggcgcgccgtaacggttcggcgattgccattgggcatccgcatccatctaccgttcgcgttttgcagcaaatgttgccgggcttacccgccgatatcacgctggtgcgtccgagcgatctgctcaatgaacctcaggtggatacttctcgtccgggtagcgcgcaaccacccgcaacgcggccacgtaatccattccgcggcgtgaagaactgcacgctgaaacagccgcctgaaccggtctatgcaacccgcttcttcacggtgattggcgaaagcatcancagcagtacgctggttaaaatacgtccagcaacagtggcagggttggggaaaaaaaaccctgatcgggttaaccctattcctgccagataa

SEQ ID NO: 964 - DNA, 417 bp, Enterobacter cloacae
atagttcatgaacagcgcatcaaagtttactggcgcgaggttcagttgcgggaatgtaccgcgagaaaccaggctggtgatgcattcacgcgcatacgggaacaggatgttcgggcagtatgcacccaggcaatgcgccatctggttaccttcgatgccgccgatggagaagataccgccctgctgaacttcgcacaggaacgcagtttcttcgcccagagaggcggtcacggtgacacgcagtacgacttcatacacatcatccgccagctgggtggatgcggtatccagatcaagtttaacctctggctgccagtctttctggaaaacgtgcggcgcatttggcgcttcgaaagagacatccttggtgtagatgcgctggatctggaaagtcatctcggtgttattttgttctga

SEQ ID NO: 965 - DNA, 606 bp, Enterobacter cloacae
cgcaggcacagtaagggagacgacgtttacgtaatggatatcaacggtcttattgaacaatatggatacgccgcgctggtgatcggcagcgtggcggaaggcgaaactatcacgctgctgggcggggtggccgcacaccagggattgctgaaattctcgctggtggtcgccgccgtcgcgttgggcggtatgattggcgatcagctgctctattttctggggctgcgctttggcccgacgcttttgcaacgttttgccaggcatcaaaagaaaattcgccgcgcccagcggctgatccagcgacatccttatctgtttgtgattggtacccgctttatgtacggttttcgcatcattgggccgatactgattggcgcgagtcgtttaccaccgaaaattttcctgccgctgaacattctcggggcgattgcctgggcgttgattttcaccacgcttggctacgcgggtggcgaagtgattggcccatggctgcataatcttgaccagcacctgaagcactgggcgtggttgatcctggtggttgcggtggtgattggggtacggctgtggctgaagcatcgtgaaaagcggcgggatgaagagtga

SEQ ID NO: 966 - DNA, 432 bp, Enterobacter cloacae
ttgtatgatgaatacgtctcagcaaggactttcaccatgagcaaatcactgaatactatctggcaataccttcgcgccttcgtcctcatttatgcctgcctgtacgccggcatttttatcgcttcgctgctgccgattacgatacccggcagcattatcggcatgctgatcctgtttgtactgctggcattacaggtgctgcccgcaaaatgggtcaacccagggtgcttcgttctcattcgctacatggccctgctttttgtgcctatcggcgttggggttatgcagtattacgatgtgcttaaagcgcagttcggcccgattgtggtctcctgcgccatcagtacgctggtggttttcctggtcgtcagctggagttcacacattgtgcatggcgaacgtaaggtcgtcggggagaaaacaaaaaaatga

SEQ ID NO: 967 - DNA, 360 bp, Enterobacter cloacae
atccgtcaccacgccgattgccatggccgtgggcggcagcatcgggggcattccggccatcagcgccgtgtgcgtgattttcgtcggtatcctgggcgcggtgtttggtcatacgctgctgaatatcatgaaaattcgtaccaaagcggcacgcggtctggcgatgggtaccgcctcgcacgcgctgggcaccgcacgctgcgcggaactggattatcaggaaggggcattcagctcgctggcgctggtgatctgcgggattatcacttccctggtcgcgccgtttatcttcccgattattctggcagtaatgggctaaaatttgcgatgcgtcgcgcaaatttcattttcatttcataa

SEQ ID NO: 968 - DNA, 894 bp, Enterobacter cloacae
ggcaacgtcatgcatccacgttttcaagctgctttctctcagcttgcagagaatttgcaatcagccctggctccggttctggcggatgcgcatttccccgccctgctgacggcagatcaggtcacgacgcttaaacaggcaacggggctggacgaagacgcgctggctttcgccctgctgcccctggcggctgcctgcgcccgcgctgacctttcccattttaacgtaggcgcaattgcgcgcggtgtgagcgggacctggtacttcggcggaaacatggagtttctcggtgcgaccatgcagcaaaccgtccacgcggagcagagcgccatcagtcacgcctggctacgcggcgaaaaagccctgcgcgccatcaccgtcaactataccccttgcggccactgccgccagtttatgaatgagctgaacagcggtcttgaactgcgtatcaacctgccgggacgcgcaccgcatacgctgcgtgattacctgccggatgctttcggcccgaaagatcttgagatcaaaaccctgctgatggacgagcaggaccacggttatgcgctctcaggggatgagctgagcgaagcggccattgccgccgccaataaaagccacacgccatacagcaaatctccaagcggcgtcgcccttcagtgccgcgacggccgcatcttcaccggcagttacgcagagaacgccgcgtttaacccgacgctgcctccgcttcagggcgccctgaacctgcttagcctgaacgggtatgactacccggatattcagcgcgcaatcctggctgaaaaggccgatgcgccgctgatccagtgggacgcgaccgcagccacgctgaaagcgctgggctgttcaaccattgaccgcgtgctgctggcataa

SEQ ID NO: 969 - DNA, 720 bp, Enterobacter cloacae
ggtcgtcggggagaaaacaaaaaaatgatggcgaatatctggtggtccctgccgttaaccctggtggtgttctttgctgcgcgtaagcttgcggtgcgtttcaaaatgccgttgctcaacccgctgctggtcgccatggtggtgattattccttttctgctgctcaccggcatttcttatgagcgttacttcgccgggagcaagatccttaacgatttgttgcagcctgccgtggtggcgctggcgtttcctttatatgagcaactgcatcagatccgcgcgcgctggaaatccatcataaccatctgcttcgtggggagccttgttgcgatgatcaccggcacctcggtggccttaatgatgggcgcatcgccgcagatcgccgcctctatcctgcctaaatccgtcaccacgccgattgccatggccgtgggcggcagcatcgggggcattccggccatcagcgccgtgtgcgtgattttcgtcggtatcctgggcgcggtgtttggtcatacgctgctgaatatcatgaaaattcgtaccaaagcggcacgcggtctggcgatgggtaccgcctcgcacgcgctgggcaccgcacgctgcgcggaactggattatcaggaaggggcattcagctcgctggcgctggtgatctgcgggattatcacttccctggtcgcgccgtttatcttcccgattattctggcagtaatgggctaa

SEQ ID NO: 970 - DNA, 765 bp, Enterobacter cloacae
ccaggcgggtacagtagcctgagggaaatttcatcatcggtacgagccatctgcatgttaaagcgcgtgttttacagcctgtctgtcctggtcggcatactgctgttgatcgtgctgggtctcgaccgctggatgagctggaaaacagccccctacatttttgatgacctacaggacctcccctaccgtcaggttggcgtggtgcttggcaccgccaagtattaccgcaccggcgtcataaatcagtattaccggtatcgtattcagggcgcgctgaacgcctataacagcggcaaggtgaactatctgctgttgagcggcgataacgcgctgcaaagctataacgagccggtgacgatgcgcaaagatctgattgccgcaggcgtcgacccggccgatatcgtgctcgactacgccggattccgcacgcttgattccatcgtgcgtacccgcaaggtgttcgacaccaatgatttcatcatcattacccagcgtttccactgcgagcgggcgctgtttatcgccctgcatatgggcattcaggcgcagtgttatgcggtgccatcgccaaaagatatgctgagcgtgcgcgtgcgtgagtttggcgcccgtttcggcgcgctggctgacctgtacctgttcaaacgtgaaccgcgctttttaggcccgctggtgccgatcccaacgatgcacgaagtgccggaggatgcacagggttatccggcggtaacgccagagcagttgctggaaattcagaagaagtaa

SEQ ID NO: 971 - DNA, 978 bp, Enterobacter cloacae
agagcagctactatagcgcgtcttttttcacaggtactcagaatgcgtgttttactggccccgatggaaggcgtgctcgactctctcgtgcgcgagctgcttaccgaggtgaacgattacgatctctgcgtgacggagtttctgcgcgtggtcgatatgttgctgccagaaaaatcattttatcgtctctgtccggaactgcatcgtcagagccgcacgccgtccggtacgctggtgcgcgtccagctgctcggccagtatcctgagtggctggctgaaaacgccgcccgcgcggtagcgcttggttcgtacggcgtcgatcttaactgcggctgtccgtcaaagctggtcaacggcagcggcgggggggcgacgctacttaaagatccggagctgatttatcgcggcgcaaaggccatgcgtgaggcagtgccatcgcatctgccggtgacggtcaaagtccgtctgggatgggacagcggcgataagcagtttgaaattgctgacgcggtgcagcaggcgggcgccaccgagctggtggtgcacgggcgaaccaaagaggatggttataaagccgagcgcattaactggcaggcgattggcgagatccgcaaacggcttacgattccggtgattgccaacggcgaaatctgggattacgagagcgcgcaggcctgcctcaaagagaccggctgtaatgccgtgatgattggccgcggtgcgctgaacgtgccgaacctcagccgggtggtgaaatataatgagccgcggatgccgtgggcggatgtggtgaaactactgcaaaaatacacgcggctggaaaagcagggcgataccggcttgtatcacgtcgcgcgcattaaacagtggctgagttatttgcgtaaggagtacgacgacgcgctgggattatttcaggagatccgtaccctacagacgtctgcggatattgcccgggtgatccagtcgaagtcctga

SEQ ID NO: 972 - DNA, 537 bp, Enterobacter cloacae
atcattatcagaagtctcatcatgctgaaatttcgagtgtcactccttagtcttgcgctgctgttgggcgtctccgctaccgcgccagccatcgccaaaacgaccgcagtcgccaccgctgctgcgcaaccccagattgcgtccggcagcgcgatgatcgttgacctgaataccaacaaggtgatctacgccagtcatccggatctggtgcgcccgatcgcttccataaccaaagtcatgaccgcgatggtggtgcttgatgcacgactgccgctggacgaaaagctaaaagtggatatcagccacacgccagagatgaaagggatctactctcgcgtgcgtctgaaaagtgaaatcagccgtaaaaatatgctgctgttggcgctgatgtcctcagagaaccgcgcgggcggcgagccttgcccaccattatcctggcggttacgacgcgtttatccgcgcgatgaatgccaaagccaaagcgctggggatgaaaaatacccatttcgtggagccaaccggtctgtcgatccataa

SEQ ID NO: 973 - DNA, 930 bp, Enterobacter cloacae
agcaaaaattccggcgctcaaagagcgtattgccgggttgatgctgaaaggtcagtacgtggatgccacgctccagctcacctccgcgctgggtggcggatatcatcacggctaacattgcgcattatctatacttacctctttgcagattttcaggaggtgagtatgacgcgagtcgcaattgttaccgcatcggattcaggaattggcaaaacgacggccctgatgctggccgagcgcgggtttgatatcggggtgacctggcactcagatgaggaaggggcgctggaaacctgccgtgaggttgaagcgcgcggtcagcgtgccgaggccatccatctcgacctgggtactctgccagaaggcgcaaaggccattgaaacgctgatttcccgcttcgggcggctggacgtgctggttaacaatgccggggcgatgaacaaagcgccttttctggaactgtcatttgatgactggcgaaacattttcaccgttgacgtggacggtgcgtttctctgctcgcaaatcgcggcgcgtcagatggtgaagcagggggaaggggggcggatcgtgaacatcacctcggttcatgaacatactccgctgccggatgccagcgcctacaccgccgcaaagcacgctctgggcgggttaaccaaatcaatggcgctggaactggtgcagcataagatcctggtgaacgccgttgcgcccggtgcgatcgccacgccgatgaatgatatggacgacagcgaagtgaaagaaggctcaatgccggaaatcccgctggcacggccagggcataccaaagaaattgccagcctggtggcgtggctgtgtgacagtgacgccagctacaccaccgggcagtcgtttatcgttgacggcggttttatgctggcgaatccgcagtttaagccggaagggtag

SEQ ID NO: 974 - DNA, 645 bp, Enterobacter cloacae
tctaaagcctgcattatacttaagctatcgctgacgggccgacaacaagggggcgttatgaaccatgtctggggacttttctcccatcccgatcgtgaaatgcaggtcatccgtaacgagaacgaaacggtcgcgcatcactatacccaccatgtcctgctgatggcagcggtgccggtggtctgcgcatttattggtactacgcagataggctggaactttggtgacggcaccgtggttcagctttcctggttcaccggactgtacctggccattctgttttatggcctgatgctggccggggtggcggtgatggggcgggtcatccactggatggcgcgcaactatccgcagcgcccgtcgctggcacactgtatggtcttcgccggatacgtcgcgaccccgctgtttttaagcggtattgtcgcgctctatccactggtctggctgtgcgcgctgatcggtacggttgccctcttttataccggttatctgctgtatgtaggggtgccaaccttcctcaatatcaataaagaagagggcctgagcttctccagctctacgcttgccatcggcgtactggtcctggaggcgctactggccctgacagttattctttggggttatggataccgtctcttctaa

SEQ ID NO: 975 - DNA, 267 bp, Enterobacter cloacae
tgtcctcagagaaccgcgcgggcggcgagccttgcccaccattatcctggcggttacgacgcgtttatccgcgcgatgaatgccaaagccaaagcgctggggatgaaaaatacccatttcgtggagccaaccggtctgtcgatccataacgtctcgacggggcgtgatttaacaaagctgctgatcgccagtaagcaatacccgctgattggtcagctcaacaccacccctgaggagatggcgaacttctccaaacccggcgtataa

SEQ ID NO: 976 - DNA, 1431 bp, Enterobacter cloacae
gttcatggcgtaatgaaacgttctcttactttatctctgagtgctcctcttgtttttatgctggccgcctgcgcgccggaacatgccacggtgtctccagtaaaaacgcaagccgccgccgcaactgtaaatacccaactgcgtcatgccgactggccaaaaagcgaatggtggaaagactttaacgactcccagctcaacgcgctgatcgacaaagcgctggcggatgcgccggatatgcaaattgcccgtcagcgtatcaccctggcggaagcacaggcgaaagccgctgtcgctgctgagggtccacaactggatttttccgcagatgtggaacggcaaaagatgtcggcagaggggttgatggggccatttgcactgaccgacccggcagcggggaccaccggcccctggtataccaacggcacctttggtctgacggcgggttgggatctggatttatggggtaaaaaccgcgcccaaattgaggcccgcatcggtaaggtgaatgcgcaaaaagcggagctggagcagacccgccagctgctcgccagcagcgtcgcgcggctgtactgggactggcagaccgaggccgcggtgggtgacgtgctcgcgcagatcaaacgggagcaggaaaatatcatcggtgccgatcgggagctttatcagcacggcattacctcctcggtggaaggggttgaaacggatatcagtgccagcaaaaccgatgaacagctcgctgacgtgcacggcaaaatgaaggccattgaggcgcgtctgaatgcgttgaccaataccccttcagtcacgctcgcacggcatgccttacctgacgcagaggcatcgctgccatcaacgctcggttatgaactgctggctcggcgcccggatttgcaggaggcgcactggtatatcgaagcatccatgagcgaagtcgatgccgccagagccgcgttctaccctgacatcaatttgatggcgttcttgcagcaggatgcattgcacctgagcgacctattccgctcatctgcgcagcaaatgggcgtaaccgcggggctgacgctgccaatttttgacagcggtcggttgaatgcgaacctggatatcgcccaggcgcaaaacaacctctccgtggcgaactacaacaaggccgtggtagatgccgtaaaccaggtcgcccggacggccagcgaagtggaaacgctgaccgccaaaaatcagcaccagcagcagatcgaaaaagatgcggcgcgcgtcgtcgcgctggcgcaggcgcgcttcagggcggggatcattgccggctcccgggtgagtgaagcaaaaattccggcgctcaaagagcgtattgccgggttgatgctgaaaggtcagtacgtggatgccacgctccagctcacctccgcgctgggtggcggatatcatcacggctaa

SEQ ID NO: 977 - DNA, 2559 bp, Enterobacter cloacae
gtgaaacctggagctatcagctacctgccaatgaataatacatctgaatatattgatgccatgccgctgacggacattaaaaaagcggcgctccctgcgagcgacatccgcgcggttcacaccgcgctggatggtgaacatcgtcatttttcccgtgatgatgatacgccgctggggtcagtgaaggcacgtctggagcaggcatggccggactcgctggcagaagggcagttaatcaaggatgacgaagggcgtgaccagctacaggcgatgccgaaggccacgcgttcctccatgttccccgatccgtggcgcaccaacccggtgggccgcttctgggatcgtctgcgtgggcgtgacgtgacaccgcgctatctgtcacgtctgaccaaagaacagcaggcctccgagcagaaatggcgtaccgtaggaacgattcgtcgttacattctgctactgctgacgctggcgcagacggttgtcgccacctggtacatgaaaaccattctgccgtaccagggctgggcgttgattaaccctgctgacatgattggccaggatatctgggtctccttcatgcagctgctgccgtatattttacagagcggcattcttctgctgttcgccgtgctgttctgttgggtctccgccgggttctggacggcgctgatgggcttcctgcaactgctgatggggcgtgacaaatacagcatttccgcgtcgacggtcggggatgaacccctcaatcctgagcaccgtaccgcgctgatcatgcctatctgtaacgaagacgttgaccgcgtattcgccgggctgcgtgccacctgggagtctgtgaaggcgaccggtaacgcggcgcatttcgacgtctatatcctgagcgacagctacaacccggatatttgcgtggcagagcaaaaagcctggatggagctgattgccgaggtgcagggggaagggcagatcttctaccgccgtcgtcgtcgtcgtgttaagcgtaagagcgggaacattgatgacttctgtcgtcgctggggtaaccagtacagctacatggtggtactggatgcggactccgtgatgagcggcgactgcctgagcgggctggtccgtctgatggaagccaacccgaacgcgggtattattcagtcctcgccaaaagcgtcaggtatggacacgctgtatgcgcgctgccagcagtttgcgacccgcgtctacgggccgctgtttactgccggtctgcacttctggcagctgggtgaatctcactactggggccacaacgccattatccgcgtgaagccattcatcgagcactgtgccctggcgccgctgccgggtgaagggtcgtttgccgggtccattctgtcgcatgactttgtggaagctgctctgatgcgtcgtgcagggtggggcgtctggattgcctacgatctgcctggctcgtatgaagagctgccgccgaacctgctggatgagctcaaacgcgaccgccgctggtgtcacggtaacctgatgaacttccgcctgttcctggtgaaagggatgcaccctgttcaccgtgcggtgttcctgacgggcgttatgtcctatctgtctgcgccgctgtggtttatgttcctggcactctcgaccgcgttgcaggttgtgcatgctctgacggagccgcaatacttcctgcaaccgcgccagctgttcccggtgtggccgcagtggcgtccggagctggcgattgcgctgttcgcgtcgaccatggtgctgctgttcctgcctaagctgctcagtatcattctgatctggtgcaaaggttcgaaggagtacggtggtttctgccgcgtgaccctttcactgctgctggaagtgctgttctcggtcctgctggcgccggtgcgtatgctgttccatacggtgtttgtggtgagcgcgttcctgggatgggaagtggtgtggaattcaccgcagcgtgacgatgactctacgccgtggagtgaggcctttatgcgccacggctctcagctgctgctgggcctggtgtgggccgttggtatggcctggctggatctgcgtttcctgttctggctggcgccaatcgtcttctcgctgatcctgtcgccgtttgtgtcggtgatctccagccgttccacggttggcctgcgtaccaaacgctggaagctgttcctgatcccggaagagtattctccgccgcaggtgctggtggataccgatacctatctggagcagaaccgcaaacgcacgctggatgatggctttatgcacgccgtgtttaacccgtcattcaacgcgctggcaaccgcgatggcgacggcgcgtcaccgcgccagccaggtgctggagatcgcccgcgatcgccacgttgagcaggcgctgaacgagacgccagaaaagcttaaccgcgaccgtcgtctggtgctgttgagcgatccggtgacgatggcacggcttcactaccgcgtgtggtccgcgccggagagatactcttcgtgggtgaactactataaggacgttaagctgaatccgctggcactgaaggcgaagtaa

SEQ ID NO: 978 - DNA, 237 bp, Enterobacter cloacae
aggtcagacatgaaagtaatcattgtcgtcatgatggcatgcctgctcagcggctgcggcagcattatcagccgcaccatccccgggcagggccacgggaatcaatactaccccggcgtacagtgggatgttcgcgattccgcatggcgctatctcaccgtgatcgatctgccgttttcgctgattttcgacacgctactgctgcccatcgatgccagccacggcccttacgagtaa

SEQ ID NO: 979 - DNA, 1137 bp, Enterobacter cloacae
cgtaaattgtgtggatgtaaattgtctttgtttgctatatcatgccgaccgatttttatttctcaacgattgcaggacttgtacaccatgccagtgttacacaaccgcgtttcgaatgagatgttgaaagcgcgtatgttggccgaaaccgaaccgcgcacaacgatctctttctataagtatttcaccatcgacgatccacaggcgacccgcgatgcgctttaccaggctttcaccgccctgaacgtgtttggtcgcgtctatctggcgcgtgaggggattaacgcgcagatcagcgtgccggaaagcaaggtcagcgccttccgcgatctcctttacgggtttgatccggcgcttaacggcttacgcctgaatattgcgttggatgatgacggtaaatcattctgggtgctgcgcatgaaggtgcgcgagcgtattgtggcggatggcattgacgatccgagcttcaatgctgctaatgtgggggaatacctgaaggccgctgaagtgaacgcgatgctcgacgatccggatgcggtgttcatcgatatgcgtaaccactacgaatatgaagtggggcacttcgaaaatgcgatggaaattcctgccgacaccttccgcgagcaactgccgaaagcggttgagatgatgcaggagcataaagacaaaaagattgtgatgtactgtaccggggggatccgctgtgaaaaagccagcgcctggatgaagcacaacgggtttaataaagtctggcacattgagggtgggattatcgagtatgcccgccgcgcccgtgagcagggtttaccggtgcgttttatcggtaagaactttgtgtttgatgagcgtatgggcgagcgaatttcagaggacgtgatcgcgcactgtcaccagtgcggaacaccgtgcgatacgcataccaactgcaaaaacgacgggtgtcatctgctgtttattcagtgccctgcatgcgccgagaagtttaatggctgctgtagcgagctgtgcagcgaagagagtatgttgcctgaagaagagcaacgtcgtcgccgtgccggacgcgagaacgggaataagatctttaataaatcccggggccgactgaataccaaactgggtattccggacccggagtaa

SEQ ID NO: 980 - DNA, 1614 bp, Enterobacter cloacae
gtttccattaaaatggatcggatcgatataagcacacaaagggggaagtgcttacttattatgaaacataaaccacaaatgatgaaaatgcgttggttgggtgtagcagtgctgttgtcactgtatacctcatctgcactggcctttaacatcgatgatgtcgcaaaacaggcaaaatcgatggcgggcaagagctacgaagcgccaaaaagtaacctgccctccgttttccgcgacatgaaatacgcggactatcagcagatccagttcaatcacgataaagcgtactggaacaatattaaaaccccgttcaagcttgaattttaccaccagggtatgtacttcgacacgccagttgccatcaatgaagtgacggcgaccgcggtacgcaaaatcaagtacagcccggattacttcaattttggcgatgtgcaacacgataaagacacggtgaaagacctcggcttcgcaggcttcaaggtgctttatccgattaacagcaaagataaaaacgatgaaatcgtcagcatgcttggcgccagctacttccgcgtgattggcgcggggcaggtgtacgggctttctgcgcgcggtctggcaattgataccgcgctgccatcaggtgaagaatttccacgttttcgcgagttctggatcgaacgtccaaaaccaaccgacaaacgtctgacaatttatgcgctgctggactcccctcgtgcgaccggcgcttatcgcttcgtgatcatgccagggcgtgacacggtggttgacgtgcagtctaaagtttacctgcgcgataaagtgggcaaactgggcgttgcaccgctgaccagtatgttcctgtttgggccgaaccagccatctccggcgaccaatttccgtcctgaactgcatgattccaatggcctctccatccatgccggtaacggcgagtggatctggcgtccgctgaacaacccgaaacacctcgcggtcagcagctttgcgatggaaaacccgcagggctttggtctgctgcaacgtggccgtcagttctcccgctttgaagatctggatgaccgctacgatctgcgcccaagcgcctgggttacgccgaaaggcgactggggtaaaggtaaggttgagctggttgaaattccaaccaacgatgaaaccaacgataacatcgtggcgtactggacaccggatcagctgcctgaagccggtaaagagatgaacttcaagtatgcgattaccttcagccgtgacgaagacaagctgcacgcaccggataacgcgtatgtgatgcagacgcgtcgttcaacgggtgacgtgaagcagtccaacctgattcgtcagccggatggcacgctggcatttatcgtggacttcaccgggcaggatatgaaaaaactggcgccggatactgccgtgacggcacaggccagcattggcgataacggtgaaatcgttgaaaacgccgtgcggtacaacccggtcaccaaagggtggcgtttgaccctgcgcgtgaaggtgaaggatccgaaacagaccactgaaatgcgcgccgcgctggtcagtaacgataagccgctgagtgaaacctggagctatcagctacctgccaatgaataa

SEQ ID NO: 981 - DNA, 621 bp, Enterobacter cloacae
agcgcatgcttggccgttcgtcagttgactctggagcataaaatgaaaaaacgcctgttgggtatcgcattaggttcgctgttatttactaccggttcggccctggccgccgactataaaattgataaagagggccagcatgccttcgtcaatttccgtattcagcatctgggttacagctggttatatggcacgttcaatgatttcgatggcacatttactttcgacgagaaaaaccctgctgccgataaagtgaacgtcaccattaataccaacagcgtcgacactaatcacgccgagcgtgataaacatctgcgcagcgctgaattcctgaacgtgggcaaattcccgcaagctactttcgcgtcgacagaggtgaagaaagacagtgataaactcgctattaccggtaatctcacgctgaacggcgtaacaaaacctgtcacactggatgccaaattaattggacagggtgacgatccatggggcggaaaacgtgctggctttgaagccgcaggcaaaattcatctgaaagattttaatatcaccacggatttaggcccggcatcgcaggatgtagagctgattatttcggtggaaggcgttcagcagaagtcataa

SEQ ID NO: 982 - DNA, 957 bp, Enterobacter cloacae
cctttcaggacgttagaacacaggacagacatgacccagttaccgaaatttactgccgcgcttttgcatccccgctattggttaacatggtcaggcattggcttgttgtggctaattgtacagctgccttatcccgtcattttccgcatgggtaaagggctgggtcgcattgctcagcagtttatgaagcgtcgcgccaggatcgcgtatcgcaaccttgagctttgctttcctcagatgagtgaatctgagcgccacgacatggtggttaaaaacttcgaatctgtcggcatggggctgatggagaccggtatggcctggttctggtcggataagcgcatggcgcgctggacggaagtggctgggaccggcatggagccagtgcatactcttcaggccaaccagactggcgtcctgctgattggcgttcattttctgacgctcgaaattggcgcacgcatgttcggcatgcaggcgcccggtattggcgtttatcgtcctaacgataatccggtgatcgatttgatccagaccaacggacgtatgcgctccaataaaagcatgatcgaccgaaaagacctgaaagggatgatccgcgccctgaaatcaggtgaagtggtctggtacgccccggatcatgactatggcccgcaatccagcgtgtttgttccgttctttgcggtggaagatgcagcgacgaccaccgggacctggatgctggcgcgaatgtccaaagcggctatcgtgccgtttgtaccgcgccgtaaaccagacggttcaggctatcagctcatcatgctggagccggagctcgcgccaccgctgattgatgcggaaaccaccgcccgctggatgaacggcgttgtcgagaaatgcattatgctcgccccggagcagtacatgtggctgcatcgccgctttaaaacccggcctcagggcgtcccttcccggtattaa

SEQ ID NO: 983 - DNA, 1290 bp, Enterobacter cloacae
caggcttattacctcactggtcacggtgccctgcacctcattatgcggatagttatgtcccccacagatgctcccataaactggaaacgtaacctgacggttgcgtggctgggttgttttcttactggcgccgcctttagcctggtgatgcctttcctgcccctctacgttgagcagctcggcgtcaccggacatagcgccctgaatatgtggtccggcctggtgttcagcattacgttcctgttctccgccattgcgtcgcctttctggggtgggctggcggatcgcaaaggccgcaaaattatgctgctgcgctccgcgctcggcatggcgatcattatgctgctgatggggatggcgcagaacgtctggcagttcctgatattacgcgcactcctgggtctgctcgggggatttatccctaacgccaacgccctgatcgccacccaaatcccgcgccagaaaagcggctgggcgttgggcacgctctccactggcggcgtaagtggcgcactgctgggcccgctggcgggcgggctgctggccgaccactacggactgcggccggtattcttcattaccgccagcgtgctgttcctctgcttcctggtgacgcttatctgtatccgggagaatttcacgccggtagccaaaaaagagatgctgcacgcccgggatgtgctggcctcgctgaaaaacccaaagctggtgctgagtctgtttgtgactaccatgattatccaggtggccaccggttcaatcgcgcctattctgacgctctatgtccgcgatctggcgggaaacgtcagcaatatcgcctttatcagcggcctgatcgcctctgttcccggtgtggcggcgctactgagcgcgccgcggctcggcaagctgggagaccgtatcggcccggaaaagatcctgatctgcgccctgatcgtctccgtcctgctgctgatccccatggcgatggtgcagtctccctggcagctcggcgtcctgcgcttcctgctgggggctgccgatggcgcactgctcccggccgtgcagacgctgctggtctataattccaccaaccagatagccggtcgtattttcagctataaccagtcgtttcgcgatctgggtaacgtcaccgggccgctggtcggtgcggggatttcagccagtttcggtttccgggcggtctttatcgtgacggcaggcgtcgtgctgttcaacgccgtttattcgtggctcagcttatcccgggcgctacgcccggggcgaataagacaacatcgtgacggctaa

SEQ ID NO: 984 - DNA, 471 bp, Enterobacter cloacae
ggcgaaaagtctgagaatgcgcaaagttatatgagcacaacccctgtacaacgtgaatatttcctcgactcgatccgcgcatggctcatgctattggggatcccttttcatatttcactgatctattccagccacacctggcacgtgaacagccagatgccctcctggtggctgacgctgtttaatgattttatccatgccttccgcatgcaggtgttttttgttatttccggttatttctcttacatgctcttcttgcgctatcccctcaagcgatggtggaaagtgcgcgtggagcgcgtgggcataccgatgttgacggccattccgctgctgacgctgccgcagttcatcatgttgcagcatgttaaaggcaaggcggaaaactggccgaatctctccttctatgagaaatacaacaccctggtctgggagcttatttcccacctctggttcctgctggtactggtg

SEQ ID NO: 985 - DNA, 309 bp, Enterobacter cloacae
agacaagagcgccaaccgtacggcgcttatccgcaggatggttccgaagcctttacgttcctgcgtaatatcctgccgggtgtaggcgggttgctttacggcgcagcgtgcacctacgacaacaccctggatgaagactttatcatcgacaccctgccggggcacgacaacaccctgctcgtaaccgggctcagcggtcacgggtttaaatttgcctctgtgttaggtgaaatcgccgcccagtttgctcaggggatagcgccttcgtttgatctcaagcccttcgcgctctcgcgctttgatcgataa

SEQ ID NO: 986 - DNA, 651 bp, Enterobacter cloacae
aatacattattcatttttttcagttgcattatttatttaacccgtccatttttattgctcagtcatttgagaacggaaattcatatgcaatggcgtaactcctcccgtcgctacggaataatatccatgtgtttacactggctatttgcaattgccgtctatgccatgtttggtctcggcctctggatggtgacattaagctattatgacggttggtatcatcaggcccccgaattgcacaaaagcattggggttctgctgatgatgggtctggtttttcgcgtgatctggcgacatatctctccgccccctcctgcgcccaaaagccatggccgacttacccgcataagcgctgttggcgcgcatatcgcactctatgccctgctgttcgccattttgatcagcggctatctcatttcgaccgcagacggcaaaccgatcagcgtatttgggctttttgatgtcccagccacgctggctgacgccggttcacaggctgacaccgcaggtgtggttcatttgtggctggcatggagcgtagtgatcctgtctgtcctgcatggccttgcggccctgaaacaccactttattgataaagacgatacgctgaagcgcatgcttggccgttcgtcagttgactctggagcataa

SEQ ID NO: 987 - DNA, 423 bp, Enterobacter cloacae
tcagctattctttccctgaataccttcacgaaaaacagggagacaccaatgaccatgtacgccacgctggaagaagcaattgatgccgctcgcgaagagttcctcgccgataatcccggcattgaggaagaagatgctgacgtgcaacaactcaatatccaaaaatacgtcctacaggacggcgatattatgtggcaggccgaattctttgctgatgaaggtgaagatggtgaatgtctgccgatactgagtggtgaaggtgcacaggcggtattcgacggcgactatgacgaaattgagttacgtcaggagtggctggaagaaaatacgctgcacgaatgggacgaaggcgagtttcagctcgaaccgccgctggataccgaagagggtcaggccgcagcggacgaatgggacgagcgatga

SEQ ID NO: 988 - DNA, 273 bp, Enterobacter cloacae
agccatcatccagcgtgcgtttgcggttctgctccagataggtatcggtatccaccagcacctgcggcggagaatactcttccgggatcaggaacagcttccagcgtttggtacgcaggccaaccgtggaacggctggagatcaccgacacaaacggcgacaggatcagcgagaagacgattggcgccagccagaacaggaaacgcagatccagccaggccataccaacggcccacaccaggcccagcagcagctgagagccgtggcgcataa

SEQ ID NO: 989 - DNA, 1299 bp, Enterobacter cloacae
agcaatagtaagctgatattctaccacactatgagcaaaacacatttaacagaacagaagttttccgacttcgccctgcacccaaaggtgatcgaagcccttgaaactaaagggtttcataactgcacgcccattcaggctctcgccctgccgctgacgctggccggtcgcgatgttgcagggcaggcgcaaaccggtactggcaaaacgatggcgtttttaacgtcaacgtttcattatttactttctcacccagcgattgcagaccgcaaagttaaccagccgcgcgcgctaattatggccccgacgcgagaactggcggtacagatccacgcagacgctgagcccctggcgcaagccaccggcctgaaacttggcctggcctacggcggcgacggctacgataaacagctgaaagtgctggaaagcggcgtcgatatcctgattgggaccaccggccgtcttatcgactacgccaaacagaaccatatcaacctcggcgcaatccaggtcgtggtgctggatgaagcagaccgcatgtacgatctgggcttcattaaagacatccgctggctgttccgccgtatgcctgcggcaaaccagcgtctgaacatgctgttctccgcaaccctgtcataccgcgtacgtgaactcgcattcgagcagatgaacaatgcggaatatgtggaagtagaaccggagcagaaaaccgggcaccgcattaaagaagagcttttttatccttctaatgaagagaaaatgcgcctgttgcaaaccctgatcgaagaagagtggccggatcgcgcgattatcttcgcgaacaccaaacaccgctgtgaagatatctggggtcacctggcggcagatggtcaccgtgtcggcctgctgaccggcgacgtggcgcagaaaaaacgcctgcgcattctcgacgaatttactcgtggcgaccttgatattctggtcgcgaccgacgtggcggcccgtggcctgcacattccagccgtgacgcacgtctttaactatgacctgccagatgactgtgaagactatgtacaccgtatcggtcgtactggtcgtgcaggcgcaagcggtcactccatcagccttgcgtgtgaagagtatgcgctgaaccttccggccattgagacctacatcggtcactctattccacagagcaaatacaatccggaagcgctgttaagcgagttgccgccacctaagcgccttacacgtccacgctccggcaatggcccgcgtcgttccggcggtgcaccgcgtaatcgtcgtcgttcaggttaa

SEQ ID NO: 990 - DNA, 1491 bp, Enterobacter cloacae
gaaaatatgctcagctccacctcgctttatgcggcaattgatctcggttcgaatagttttcatatgctggttgtgcgcgaggtggcgggaagcatacaaacgctgacgcgcattaagcgcaaggtccgcctcgcggcgggcctgagcagcgataatcatctctccccggaagccatggaacgtggctggcagtgtctgcgtctgtttgcagaacgtttacaggatatcccgctcagtcaaattcgcgttgttgccacggcgacccttcgtctggcggttaacgctggcgatttcattgccagagcacaggaaattctgggctgtccggtgcaggtcatcagcggtgaagaagaagcgcgtctgatttatcagggtgtggcgcatacgaccggcggcgacgatcgtcgtctggtggtcgatatcggtggcgccagtaccgaactggtcacgggcacaggcgcgcaggcgacgtcgctcttcagcctgtcaatgggctgtgtgacctggctggaacgctactttaccgatcgaaaccttgccaaagagaattttgacgaggcggaaaacgcggcgcgtgcggtcctgcgcccggtcatggacgaactgcgctatcacggctggaaagtgtgtgtcggcgcgtccggaaccgtgcaggcgttgcaggaaatcatgatggcacaggggatggacgagcggatcacgcttgccaaactccagcagcttaaacagcgcgccatccagtgtggtcgtctggaagaacttgaaatagaagggctgacgcttgaacgcgcgctggttttccccagtgggctcgccatactgattgccattttcaccgagcttaatatccagtgtatgaccctggcaggcggtgcgctgcgtgaaggtctggtctacggaatgctgcaccagtcggtcgatcaggacatccgtagccgtacgctgcgtaacgttcaacgccgctttattgtggataccgaccaggcgcagagagtgagtcaactggcgtcacagtttgccgatcaggtgaaaaaaagctgggatattgaaccgttaagccgcgatctgttgctaagcgcctgtgcgctacatgaaattggtctcagcgtggagtacaagcaggcaccgctgcacgcggcctggctggtgcgtaatctcgatttgccgggttatacgcccgcccagaagaagctactggccaccctgctgctgaatcagactaacgccgtcgatctctcttcccttcaccagcagaacgctgtgccgccgcgcgtggcggagcatctgtgtcgtctgcttcggctggcgatcctgtttgccagtcggcgtcgagatgatttgctgccagccattacgctggcggcagacgatgagaaactgacgctgacgctaccggaaaactggcttgaggatcatccgcttggggcggaactgattgagcaggagtaccagtggcagagctatgtgcactgggcgcttgatgtgaagtga

SEQ ID NO: 991 - DNA, 277 bp, Enterobacter cloacae
tcgactcaaggcacgatcatggcaaaaacagcagcagcactgcatatccttgttaaagaagagaaactggcacaggatctgctcgaacagattaaaaacggcgccgacttcggcaaactggcgaagaaacactcgatttgcccgtcaggcaaacgcggtggtgacttaggcgagttccgccagggccagatggtcccggcgtttgataaagtggttttttccctgccccggtcctggagccaacgttttcacacacgccgctggaaggacaacgctc

SEQ ID NO: 992 - DNA, 405 bp, Enterobacter cloacae
ttggttaatgcgacatcaacacgtcgttggtggagacaaaaccaacgtaccaggcttattcctgtggagttatatatgagcgataaaattattcacctgactgacgacagttttgacacggacgtacttaaagctgacgggctgatcctcgttgatttctgggctgaatggtgtggtccttgcaaaatgatcgctccgattctggatgaaatcgctgacgaatatcagggcaaactgaccgttgccaagctgaacatcgaccagaacccgggcaccgcgccaaaatacggtatccgtggcatcccgaccctgctgctgttcaagaacggtgacgtggcagcgaccaaagtgggcgcactgtccaaaggtcaactgaaagagttcctggacgctaacctggcgtaa

SEQ ID NO: 993 - DNA, 2031 bp, Enterobacter cloacae
tcatttatgcgtttaaaccccggacaacaacaagctgtcgaattcgtcaccggaccctgcctggtgctggcgggagcgggatccggtaaaacacgcgtgatcaccaacaaaatcgcccacttaattcggggttgtggataccaggcgcgccatatcgcggcggtcacctttaccaacaaagcggcgcgtgagatgaaagagcgcgtcggccagacgctgggccgtaaagaggcgcgcgggctgatgatctccaccttccacacgctgggtctggatattatcaagcgcgaatacgcggcgctgggcatgaagtccaacttttctctctttgatgacaccgaccaggtggcgctgcttaaagagctaacggaagggctgatcgaagatgacaaagtgctgttgcaacagctgatctcgacgatctcgaactggaaaaacgatctgatgacgccggcccaggcagcggcaagcgccaaaggcgagcgcgaccgcatctttgcccactgttatggcctgtacgacgcgcatatgaaagcctgtaacgtcctggatttcgacgatctgatcctgctgccgacgctgctgcttcagcggaatgaagaggtgcgcgagcgctggcagaacaaaattcgttacctgctggtggatgaataccaggataccaacaccagccagtacgagctggtaaagctgctggtagggcagcgtgcgcgctttaccgtcgtaggcgatgacgatcagtcgatttactcctggcgtggcgcacgtccgcagaacctggtgctgctgagcaaagacttcccggcgttgcaggtgattaaactggagcagaactaccgttcctccgggcgtatcctgaaggcggcgaacatcctgattgccaataacccgcacgtctttgagaagcgcctgttctccgaactgggttacggcaccgagctgaaagtgctcagcgccaataacgaagagcacgaagcggagcgcgtaaccggcgagctgattgcccatcacttcgtcaacaaaactgaatacaaggattacgcgatcctctatcgcggtaaccaccagtcgcgcgtctttgaaaagatgctgatgcagaaccgcatcccctacaaaatctccggcggtacgtcgttcttttcgcgtccggaaatcaaggatctgctggcctatctgcgcgtgctgaccaacccggatgacgacagcgctttcctgcgcattgtaaatacgccgaagcgcgagattggctctgcgacgctgcaaaagctgggtgaatgggcgatgacccgcaacaaaagcctgttcaccgccagcttcgatatggggctgagccagaccctgaccgggcgcggctatgaggccttaacccgctttacccactggctgggtgaggtgcagcgtctggctgagcgcgagcctgtggcggcagtacgcgatctgatccacggcattgattacgaatcctggttgtatgaaacctccgccagcccgaaagcggcagagatgcgcatgaaaaacgttaaccagctcttcagctggatgaccgaaatgcttgaaggatctgagattgacgagcccatgaccctgacgcaggtggtcacccgcttcacgctgcgtgatatgatggagcgcggggaaagcgaagaagaggccgatcaggttcagctgatgacgttacatgcctcgaaagggctggagttcccttatgtctatctggtggggatggaagagggcctattgccgcaccagagcagcattgatgaagataacgtcgacgaagagcgccgtctggcctacgttgggatcacccgtgcgcagaaagagctgacgtttacgctgtgcaaagagcgccgtcagtatggtgagctggtgcgcccggagccgagccgttttctgctggagttgcctcaggacgatcttatctgggagcaggagcgtaaagtcattaccgctgaagagcgtatgcataaagggcaggcaaacgtggcaaacattcgcgcgatgctggcaaaagccaaagagaagggataa

SEQ ID NO: 994 - DNA, 498 bp, Enterobacter cloacae
gagcaatccattgtgaatctactcactgcagtaactgagctgatcagtatttttttattcacaacctgttttttgttcattgcgcgcaaggtagcaaaaagaattgggttagtggacaaaccgaacttccgtaaacgtcatcaggggcttattccgctggtgggcggcatttcggtatacgcaggcatctgtttcacattcgggatcgcggattattatatcccccatgccgcactctatctggcatgtgccggtgtgctggtactggtcggcgcccttgatgatcgttttgatatcagcgtgaagttccgcgcgacggtacaggcggccattggcattattatgatggtggtaggcggcctctatctcagaagcctgggctacgtgtttggtccctgggagctggtgcttgggccattcggcttcttcctgacgctgtttgccgtgtgggcggctatcgtcttcaccgacagggggcggaaggaaacgcgcatgcgt

SEQ ID NO: 995 - DNA, 1338 bp, Enterobacter cloacae
acaggcatggatgaccctgccataccattcacaacattaagttcgagaatcaccccgagtttaagaacccacaccattatgaatcttaccgaattaaagaatacgccggtttctgagctgatcactctcggcgaaaatatgggactggaaaaccaggctcgtatgcgcaagcaggacatcattttcgccatcctgaagcagcacgctaagagtggcgaagatatctttggcgacggtgtgctggagatactgcaagacggatttggtttcctccgctccgcagacagctcctacctcgccggccctgacgacatctacgtatcccctagccaaatccgccgtttcaacctccgcactggtgacaccatttcaggtaagattcgtcctccaaaagagggtgaacgctactttgcgctgttgaaggttaacgaagtcaactacgacaaaccggaaaactcccgcaataagatcctgttcgagaacttaacgccgctgcacgcgaactctcgcctgcgcatggagcgtggtaacgggtctactgaagacttaaccgcgcgtgtgctggatctggcatcgccaattggtcgtggccagcgtggtctgattgtagcgccgccaaaagccggtaaaaccatgctgctgcaaaacatcgcgcagagcattgcttacaatcacccagactgtgtgctgatggtgctgctgattgacgaacgtccggaagaagtgaccgagatgcagcgtctggtgaaaggggaagtggttgcgtctaccttcgacgagcctgcttcccgccacgttcaggttgcggaaatggttatcgagaaggcgaaacgcctggttgagcacaagaaagatgtgatcatcctgctcgactccatcacccgtctggcgcgtgcctacaacaccgtggtgccggcttccggtaaagtactgaccggtggtgtggatgccaacgccctgcatcgtccgaagcgtttcttcggtgcggcgcgtaacgtggaagagggcggtagcctgaccattatcgcgacggcgctgatcgataccggctccaaaatggacgaagttatctacgaagagttcaaaggtacaggcaacatggaactgcacctttctcgtaaaatcgcagaaaaacgcgtcttcccggcgatcgactacaaccgttccggtacccgtaaagaagagctgcttaccactcaggaagagcttcagaaaatgtggatcctgcgcaaaatcatccatccaatgggcgaaatcgacgcaatggaattcctcatcaacaaactggcgatgaccaaaacgaacgacgatttcttcgacatgatgaaacgctcgtaa

SEQ ID NO: 996 - DNA, 525 bp, Enterobacter cloacae
  unsure (16)
gtaaaggtggttatcntggggcaggatccataccacggccccgggcaggctcacggactggcattttccgtacgtccgggcgtggccatccccccttttctgttgaatatgtataaagagctggaaggaacgattccgggtttcacccgccctaatcacggttatctggaaagctgggcgcgccagggcgtgctgttgctgaataccgtattaactgtccgggcgggtcaggcacactcccacgccagtctgggatgggaaacctttaccgataaggttatcagcctgatcaatgagcatcgtgaaggcgtcgtgtttttactctggggttcgcatgcccaaaagaaaggggcgattatcgatcgtcagcgtcatcacgtgctgaaggcgccgcacccgtcgccgctgtctgcgcatcgtggtttctttggcagtaatcattttgttctgacgaatgagtggctggaaaagcgtggcgaaaagccgattgactggatgcctgtgttaccggcagagagcgagtag

SEQ ID NO: 997 - DNA, 885 bp, Enterobacter cloacae
aaaataagcgtttggcgtggtcgtctgaccacgccttttcccttcggttttttctcccgccttcttcctttcttcgataaaataaccacacaaatcacaatgttaattattgatttggataataaaattcacaggaagaatatgatgaaacacatttcaggcaaggcagcgctgctggcgctgagcatgatttcggctacggcttacgcatcacactggagctatcaaggagaaggcgcaccggaacactggggcgaactggacgaggcgtacaagacgtgtaaaagcggaatgtatcagtcgccggtcaacatagataacacggtcaaagcccacatctctccgctggaaacgcactatatcgacggcccggtcattctgacaaataacggccatactatccaggcgagtgaaaatgccgatacacgcgacagcatcacgcttgataaacagcgctggacgttacagcagttccatttccatgcaccatccgaaaacacggtgcacggtaaaaaatacgcaatggaaatgcatctggtccataaaaacgctgacggcgaactgacggtcgttgccgttatgttcgatcagggcgctgcaaacactgaactggataaactctggggcgtgatgccgggacaggttgaccagaacgtcacgattaagccaacccttgatatgaataaattactgcccgcggataaaacttactggcgttttagcggctctctgaccaccccaccgtgttcagaaggggtaacgtggctggtcctcaagcatccgctgactgtctctgctgaacagctgcaaaaatttactcacactttgcaccacgaaaacagccgcccggttcagccgcttcatggccgtctggttgttgaataa

SEQ ID NO: 998 - DNA, 1149 bp, Enterobacter cloacae
ggaacagtaatgacgaatcacttcagatgcttacccttatccggtttcattgtctgtgccgcgctgcttaccgggtgcgatgggcaagaaaacccacagcagcatgcgcaagctcctcaggtcagtgttcatattgttaaaagcgcgccactggccgtaacgacagaattgcctggcagaactgacgcgtatcgtgttgcggaggttcgtccccaggtaagtggtatcattctgcaccgtaattttaccgaaggcagcgacgtcaaagcgggtgaatccctttatcagatcgatccggccacgtatcaggcagcctacgacaatgcgaaaggtgaactggtaaaagcacaggcggcggccaatatcgctcatctgacggtgaaacgttacgttccgctggtcggtacgcaatatgtgagcaagcaggagtacgatcaggcggtggcaaccgcccagcaggcggatgcgagcgtcgttgccgcgaaggctggcgttgaaagcgcgcggatcaacctggcttataccaaagtcacatccccaatcaacgggcgtataggtaaatccagcgtcaccgaaggggcgttggttactaatggtcagtcgactgcactggcgacggttcagcagctcgatcccatttatgtcgatgtgacgcaatccagcagcgattttatgcgtctgaagcagcagacgagcctgcaaaagggagacaccagcagcgtcgagttgctgatggaaaatggccagccttatccactgaaaggaacgctccagttctctgatgtcacggtagatgaaagtaccggctcaatcacccttcgcgccctcttccctaaccctcagcatatgctgttaccgggtatgtttgtccgtgcacgcattgacgaaggtacacagcctgatgccattcttgttccccagcagggggtaacccgtacaccgcgcggggatgccactgtgcttgtggtaaacgataaaaaccaggtggaatcgcgcactgtcgttgcaccgcaggcgattggcgatcgctggctgatcacggaaggcctgaaaaacggcgaccgcgtcattatcagcggcctgcaaaaagttcgccctggcgttaccgtcgtggctattcctgataccgccgcgactccagccagttaa

SEQ ID NO: 999 - DNA, 1275 bp, Enterobacter cloacae
  unsure (374)
  unsure (403)
gacaagatcgtggacgtgcattcaagcgcggatcgcgatttaaaacacgtattgctggcggatgagacggtctgtatcggtccggctccgtccgtaaaaagctatctgaacatcccggcgatcatcagcgccgccgaaatcactggcgcggtcgcgattcacccgggttatggtttcctctctgagaacgccaactttgctgagcaggttgaacgctctggctttatcttcatcggcccgaaagccgacaccatccgcctgatgggcgacaaagtgtctgcgatcaccgcgatgaaaaaagccggtgtaccaaccgtaccgggctctgacggcccgctgaccgacgatatggatgctaaccgcgcccatgctanacgcattggctatccggtgatcatcaaancgtccggccgccgcggcggtcgcggtatgcgcgttgtacgcagcgatgctgaactggcgcagtccatctccatgaccaaagcggaagcgaaagcggctctcagcaatgacatggtgtacatggaaaaatacctggaaaacccacgccacatcgaaatccaggtgctggctgacggtcagggtaacgcgatctatctggcagaacgtgactgctccatgcagcgtcgtcaccagaaagtcgtcgaagaagcgccagcgccgggcattacgccggaactgcgtcgctacatcggtgagcgttgcgccaaagcgtgtgtcgatatcggctatcgcggggcgggtaccttcgagttcctgttcgaaaacggcgagttctacttcattgagatgaacacccgtattcaggttgaacacccggttaccgaaatgatcaccggcgttgacctgattaaagaacagctgcgtatcgcagccggtcagccgctgtccatcaaacaggaagaagttgtggttaaaggccatgcggtagagtgccgtatcaacgccgaagacccgaacaccttcctgccaagcccgggtaaaatcacgcgtttccacgcgccgggtggctttggtgtgcgctgggagtcccatatctacgccggttacaccgtaccgccgtactatgactcaatgattggtaagctgatctgctacggcgaaaaccgtgacgtggccattgcccgcatgaagaacgcccttcaggagctgatcatcgacgggatcaaaaccaacgttgatctccagatgcgcattatgagcgacgagcacttccagaatggtgggactaacatccactacctggagaaaaaactcggtctgaacgagaagtaa

SEQ ID NO: 1000 - DNA, 291 bp, Enterobacter cloacae
gccccatcatgtacaatccccgctttcttcatccacaagggacaaaaaatggacaaacgttttgttcaggcccataaagaagcgcgctgggcgctgtggctgacccttctctatctcgccgcatggttagtaactgcttacttacctgattcggcgattggcattaccggcctcccgcactggtttgaaatggcctgcctgctgctgccgctggtgtttatcctgctgtgctgggcgatggtgaaattcatctatcgcgatatttcactggaggacgatgatgcagcttga

SEQ ID NO: 1001 - DNA, 900 bp, Enterobacter cloacae
caaataaagagttttgccatgccgtggatccaattaaaactgaacacaaccggcgcgaacgccgaagaactgagtgatgcgctgatggaggccggttcggtctctatcaccttccaggacacgcatgacacgccggtctttgagccgctgccaggcgaaacgcgcctgtggggtgatacggacgttatcggcctgttcgatgcagaaaccgatatgaaagaggtcgtggcgattctggaaaaccatccgctgctgggcgcgggtttcacgcataaaattgaacagctggaagacaaagactgggaacgcgagtggatggacaacttccatccgatgcagtttggtcagcgtctgtggatctgcccaagctggcgtgaagtgcccgatgaaaacgccgtcaacgtgatgctggatccgggtctggcgttcggcaccggtacccacccgacaacctccctgtgcctgcaatggctggatggcctggatctggaaggcaaaaccgtgatcgacttcggttgcggatccgggatccttgctatcgcagcactaaaactgggcgcggcaaaagccatcgggatcgacatcgatccgcaggcgattcaggccagccgtgataacgccgagcgtaatggcgtttccgatcgccttgaactgtatctgcccgatgcacagccagaggcgatgaaagccgatgtggtggtcgcgaatatcctggctggcccattacgcgagctggcgccgttaatcagcgtgctgccggttgaaggcggtctgctgggcctgtccggtatccttgccagccaggcagacagcgtctgtgaagcctacgccgatctctttgcgctcgacccggtggtcgagaaagaagagtggtgtcgcatcaccggtcgtaaaaaataa

SEQ ID NO: 1002 - DNA, 312 bp, Enterobacter cloacae
agagctgacagaactatgttcgaacaacgcgtaaattctgacgtactgaccgtttctaccgttaactctcaggatcaggtgactcaaaagcccctgcgtgactcggttaaacaggcactgaagaactattttgctcaactgaacggtcaggatgttaatgacctgtatgagctggtactggctgaagttgaacagccactgttggacatggtgatgcaatacacccgtggtaatcaaacccgcgctgccctgatgatgggcatcaaccgtggtaccctgcgtaagaaactgaaaaaatacggcatgaactaa

SEQ ID NO: 1003 - DNA, 2253 bp, Enterobacter cloacae
actggtcaactgctcagagctggactaaccgcttccatcctgtataaaaccctgttaacacccaataaaaacaggggcttaaatcacttttcgtcatttcctgacgatgataatgtctgtcccctttccaaccgctcttgcttaacgtctcacacgagtgaacagaccatgctggttagccaatacaaccaaatcctcgtagtcatctcctttgttgttgccattcttgccgcctataccgcactgaatatggctgcgcgcgttgccggaagccagggcgtcgctgcacgcgtctggctggcaggtggcggtgtttcgatggggattggcgtgtgggcgatgcatttcatcggtatgctggcgatggatctttccatgagcatgagttacaacgcggccctgaccgtgctttcgatggttatcgccattagctcgtcaatgtttgccctgtggctcgttagcggcgagcagctacgtttgcgccggctgctgcctggcgccgtcgtgatgggaacgggcattgttgccatgcactacaccggtatggctgccctggaggtcacaccgggtattgtctgggataaaacgtgggtggctatctctgtggtcatagcccttgccgcttcactggccgctctttggctgacgttccgtttacgtcaggaagccgcacgaatggcgttgatgcggctgggggcggcgatcaccatgggcatcgctatcgctggcatgcattacgctggcatggaagcagcacaatttccgatgtcgacgatggtccaccatcatggcattaacgggagctggctggcgatattggttagcgtggtcgcgctcgctattctggggattacgctgctggtgtcgatgtttgatgcccgccttcaggctcgtacctcgctgctggcctcatcactggcagaagctaatcgtgaactcgcacagctggcgttgcatgatacgctgacgcgattacccaatcgtattctgcttgaggatcgcctcgatcaggccatcagcaaggccgatcgcgaaggaagccctttcgcgctgatgtttatggatctcgacggctttaaaaccgtcaacgatgcctatggtcatgatgtcggtgacaagcttctggtagcggtgactcagcgtttgctgttgcagttgaaaggtcagtacacgctggcgcgtatcggtggggatgaattcgtgctgctggccgaaaccgccaccccggatgatgctgcctcactggcaaattcactggtgcgcgtcattgatagcccgttccatctcgatccttacgaactgatggtcaccctgagcattggcattgcgctctatccacacgatggcaaaaccgatcgtgaactaatgtttaacgctgatgctgcgatgtaccacacgaaacatatgggtcgcaacggctatcacttcttccagccgtcaatgaatacgctggcgcagacgcatctacagctgatgaatgatctgtggcaggccatcgaccgtgatgagttacgcctgctttatcaacctaaattccacgcccctgccgggccggtcatcgggttcgaagcgctgttacgctggcagcatcccaaacagggattactctcccccgacctgtttctgccgctggcagagaaaacagggctgattattccgattggaaactgggtaatcgacgaggcctgccgccagctgcgtgaatggcatcttcagggccacacggactggtcaatggcggtgaatctttctacgttgcagttcgaacagccgtcgctggttaaaacggttctcgattgtctgacgcgccatagcgtgccgcccggcatgttgatcctggaggtgactgaaaccacggcaatgagcaatccggacgaaagcgtacgcgtcctgacagcgctgacggatgcgggagtaaaagcctcaatagacgattttggtacaggttactcaagccttctctatcttaagcggcttcccgcctgcgagttgaaaatcgatcgcgcttttgtgaaagagttaagtggagagagcgaagatgcgacaattgtctcggcgattgtcgccctggcaaaaacgctgaatctgaaggtcgtggcggaaggggtcgaaaccgcagcgcagcagaccttcctgacagaactgggatgcaatacgctacagggttatctgctgggcaaaccaattaccgcgcaagctattatggaacagtgccagcacggggagatgtcgccaccccgggcgcagtcataa

SEQ ID NO: 1004 - DNA, 1488 bp, Enterobacter cloacae
aattcatctatcgcgatatttcactggaggacgatgatgcagcttgaagtcattctgccccttatcgcttacctgtgcctggtgtttggcctgtcggtttatgcgatgcgtaaacgttcgaccggcacctttctgaacgagtatttcctcgggagccgctcaatgggtggcgtcgtgctggccatgacgctgaccgctacttacatcagcgccagctcgtttatcggtggcccgggcgccgcttataagtacgggctgggctgggtactgctggccatgatccagctgcctgccatctggctctctctgggcatactgggtaaaaagtttgccattctggcccgtcgctacaatgccgtaacgctgaacgatatgctgtttgcccgctatcagagtcgcttgctggtatggctggcaagcctgagtctgctggtggcgtttattggcgcaatgacggtgcagtttatcggcggcgcacgtctgctggagacggcagccggtatcccctatgagacgggcctggtcattttcggtgtgagtatcgcgctgtataccgcgtttggcgggttccgcgccagcgtactcaacgacacgatgcaggggatggtgatgctcattggcaccctcgttctgctggtgggtatcgtgcatgccgcagggggcctgagccatgcggttgaaaccctggaagcgatcgatccgaaactggtctcgccgcagggggcggatgacatcctctctccaacctttatgacctcgttctgggtgctggtgtgctttggcgtgattggcctgccgcatactgccgtgcgctgcatctcatataaagacagcaaagcggtgcaccgcgggatcattatcgggacaattgtggtggcgatcctgatgtttggtatgcacctggcgggcgcgctgggccgcgcggtgatccctgaccttaccgtaccggatctggtcattccgaccctgatggtgaaagtgcttccgccgtttgccgccgggattttcctcgccgcacccatggcggccattatgtcgaccatcaacgctcagttgctgcaaagttccgctacgatcattaaagatctctatctgaatttgcgccctgaacaggtcgaaaatgagcgacgcctcaagcgtatgtcggcggtgattaccctggtgctgggggcgttactgctgctggccgcgtggcgtccaccggagatgatcatctggctaaacctgctcgcctttggcgggctggaggccgttttcctgtggccgctggtgctggggctgtactgggaacgcgcgaatgccgcgggtgcattaagcggcatgattgtcgggggcgtcctgtatgccgttctcgccacgtttaaaattcagtatctgggcttccatccgatcgtgccttcgttactgttaagtttactggcgtttgtggtgggaaaccgttttggtcgaccggtgccacaaactgccctgatttctactgacaaataa

SEQ ID NO: 1005 - DNA, 969 bp, Enterobacter cloacae
ctcatgcgcatcggacaccaccagctcagaaatcgcctgatcgcagccccaatggcaggtattactgaccggccgttcaggacgctgtgctacgagatgggagcaggattaaccgtttccgagatgatgtcgtctaacccgcaggtttgggaaagcgacaagtcccgccttcggatggtgcacgtggatgaaccaggtatccgcaccgtgcaaattgccggaagcgtgcctgaagaaatggcagatgccgcgcgtattaacgtggaaagtggcgcccagattattgatatcaatatgggttgcccggccaaaaaggtgaatcgcaagcttgcaggttcagcccttctgcaataccccgaccaggtgaagtcaatcctgacggcggttgtcagcgcagtggacgttcctgttacgttgaagattcgcacgggttggtcgccggaacaccgtaactgcgtagagattgcccaactggccgaagactgtggcattcaggccctgaccattcatggacgcactcgcgcctgtttgttcaacggtgaagctgaatacgacagcattcgggcagttaagcagaaagtttccattccggttatcgcgaatggcgacattactgacccgcttaaagccagagctgtgctcgactatacgggagctgatgctctgatgataggacgtgccgctcagggaagaccctggatctttcgggaaatccagcattatctggacactggggagctgcttgccccgctgcctctggcagaggtcaagcgcttgctttgttcgcatgttcgggaattgcatgaccactacggccaggcaaaagggtaccgaattgcgcgtaaacacgtctcctggtatctccaggagcacgctccaaatgaccagtttcggcgcacattcaacgccattgaggatgccagcgaacagctggaggcgttggaggcatacttcgaaaatcttgcgtaa

SEQ ID NO: 1006 - DNA, 233 bp, Enterobacter cloacae
taccgccgcgactccagccagttaaggaataacgacatggctaatttctttattcaacggcctgttttcgcctgggtgctcgccatcattctgatgattgcgggcgggctggccattttaaaactgccggtggcgcaatatccgaccattgcgccgccagcggtggcggtgacagcaacctaccctggcgctgatgcccagacggtacaggacaccgtaactcaggttatcga

SEQ ID NO: 1007 - DNA, 654 bp, Enterobacter cloacae
caggtaatggcgcgcaaaaagaaagaagaggctcaaaagacccgccagcagctgattgaagccgctatcaggctattcgcgacgcgtggtgtggccagcaccacgcttaccgacattgccgatgcagctcaactcactcgcggggcggtttactggcatttctcgagtaaagcggaaatatttaacgcaatatgggaacagcaattgccgctgcgtgaaatcattcgtgacaggctaatgctttccgaaaatgacgaccctttgttaatgcttcgtgaacaatttattgttgcgctgcaatatattgcgagcgaaccccgacagtatgcgcttttacaaattctgtatcataagtgtgaatttcatgacgatgtgatttcagaatgtgaaatacgcaagcggatcggtttaaacgatgattatcttcgcaagacgcttaagcgatgcattgctcataacattatctcttcgcaaactaatattgaactggcgctgattgttttccatgcgttttttagcggagtcattaaaaactggttaatggataacaccagttttaatctgtacaaacaagcgccggctctggtggataatattctggcgacactaaatatcacccgagtggcgccagtggtttacgatacagccttatga

SEQ ID NO: 1008 - DNA, 918 bp, Enterobacter cloacae
acgatggtggcgcagtactacactgacccggaaattcagcagttggcagaggagacgggcggctgtatctcagactcgctggagatggcgcgtttcggcgctaaacatcctgcctccacgctgctggttgcaggtgtgcgcttcatgggcgaaacggcaaaaattctcagcccggaaaaaaccatactgatgccgacgctgaatgccgactgctcccttgacctcggttgcccgattgatgagttcaccgccttctgtgatgcccaccctgaccgtaccgtggtggtctatgccaacacgtctgcggcggtgaaagcccgggcggactgggtaatgacgtccagtatcgccgttgagctgattgaacatctggacagcctgggggagaaaatcatctgggcgcccgatcgtcacctgggaaactacgtacaaaaacagaccggtgctgatgtgctgtgctggcagggcgcctgtatcgttcacgacgagtttaagacccaggctctgacgcgcatgaaggggttatatccggacgccgcgattctggtgcacccggaatccccgcagtccatcgtcgacatggcggatgccgtcgggtcaaccagccagcttattcatgctgcgaaaaccctgccgaacaagcagctcattgtggcgaccgatcgcggtatcttctacaaaatgcaacaggccgtgccggaaaaagagctgcttgaagcgccaaccgccggagaaggggcgagctgccgaagctgcgcgcattgcccgtggatggcgatgaatgggctcaaagcgatttcggaggcgcttgagaacggtggcgcagcgcatgagatccacgtggatgccgctctgcgtgaaggcgcgttaattccacttaaccgtatgctggattttgcggctacactacgtacttaa

SEQ ID NO: 1009 - DNA, 789 bp, Enterobacter cloacae
ttccacttaaccgtatgctggattttgcggctacactacgtacttaacttattacgccccggagaaaaaatggatttttttagcacacagaacatcctggttcatatcccgattggtgcgggcggctatgacctgtcgtggattgaagcggtgggtacgctggccggtttactctgtatctggctggccagccttgagaagatcagcaactatgcgttcgggctgataaacgtcacgctgtttgcgatcatctttttccagatccagctctacgccagcctgcttctacagctgttcttcttcgcggccaatatctatggctggtacgcctggtctcggcaaaacagtcagcaggaggcggaactgcaaatccgctggctgccgttgccaaaagccatcgcctggttcgcggcctgcgtggtggctatcggctttatgaccgtctttattgatccggtatttgccttcctgacgcgcgtggcggtctcggtcatgtcgggtctgggattaaatgtgacgatgcctgagcttcagccggatgccttcccgttctgggattcctgcatgatggtgttgtcgattgccgcaatgatcctgatgacccgtaaatacgttgagaactggctgctgtgggtggtcatcaatgtcattagcgtggtgatttttgcccgccagggtgtttatgccatgtcgctggagtatatgctcctgaccttcattgctctcaacggcagccgcatgtggattaacagcgcgcgtgagcgtggctctcgcgcgctttcccgttaa

SEQ ID NO: 1010 - DNA, 1077 bp, Enterobacter cloacae
agatatggcagagccggaaagaagatgaattatcagaacgacgatttacgcattaaagagatcaatgagttattacctcccgtagcgctccttgaaaaattccccgccaccgaaaatgccgccaacacggtgtctcatgcccgcaaggcgatccacaagatcctgaaaggtagcgacgatcgtcttctggtagtgatcgggccatgctccattcacgatcctgctgcggccaaagagtatgcgtcgcgtctgctcgccctgcgtgaagagctgaaaggcgaactggaaatcgtgatgcgcgtttatttcgaaaaaccgcgtaccaccgtgggctggaaagggttaatcaacgatccgcatatggacaacagtttccagattaacgacggcctgcgcattgcgcgtaagctgctgctggagatcaacgacagcgggctgcctgctgccggagaattcctcgatatgatcaccccgcagtatctggctgacctgatgagctggggcgctattggtgcgcgtacgactgaatctcaggttcaccgcgagctggcgtctggcctgtcatgcccggtgggtttcaaaaatggcactgatggcaccatcaaggtcgccattgacgccattaatgcggcgggcgcgccgcactgcttcctgtcggtgaccaagtggggccactcggctatcgtgaataccagcggtaatggcgattgccatatcatactgcgcggcggtaaagagcctaactatagcgctaaacacgtagcggaggtaaaagcagggctggagaaagcaggtctggcaccgcaggtgatgatcgatttcagccatgccaactccagcaaacagttcaaaaagcagatggaagtcggcgcagatgtgtgtcagcaaatcgccagcggtgaacgcgcagtgattggggtgatgattgagagccatctggttgaaggcaaccagaacctggagggcagcgagccgctggtctacggtaagagcgtgacggatgcctgcattggctgggacgataccgatgcgatcctgcgtcagctggcggatgcggttaaagcgcgtcgcggctaa

SEQ ID NO: 1011 - DNA, 1113 bp, Enterobacter cloacae
acagtacgaagccaaaacgggcatcaaagaaactttctatgtctgcaaagcatcacaaggagccggacagtgctaaacgaaacaccaacactcgcaccggatggtctgccgtatcgcctgttaaccctgcgcaacagcgccgggatggtggttacgctgatggactggggcgcaacgttactttctgcccgcgtaccgatgcctgacggcagcgtgcgcgaaaccctgctcggctgcgcatcgccggagcagtatatcgagcagaccgcttttctgggcgcatccataggccgctacgctaaccgcatcgccagaagccggtttacgctggacggcgtaacgtattccctgcttgccagccagggcgaaaatcagctgcacggcggcccggaagggtttgataaacgtcgctggaagattgtgcagcaaaatgacgctgaggtctggttctctctggactccctcgatggagaccagggcttcccgggcaatctcaccgcaacggcgcgcttcaccctgaccgaagataatcgcatcgccattgagtaccgcgcgaccgtcgataagccgtgcccggtcaacctgactaaccacgcctatttcaaccttgacggtaatcagaccgatgtccgcagccacaaactccagatcctgtcggacgagtatctgccggtcgatgagatgggtatcccttatcaggggctgaaaccggtaagcggtaatagctttgattttcgtcagccgaaaaccatcgcccaggatttcctgagtgatgacgatcagcgcaaggtgaaaggctacgaccatgctttcctgttgcaggcgaaaggcgatctttctcaacctgccgcacaggtctggtctgctgatgagaagttacagatgacggtctacaccaccgcccccgccctacagttctattccggtaactatctggagggtaccacggcgcgcgaacatgacgcctacggcgcctggcaaggactggcgctggagagcgagttcctgccagacagtcctaaccatcctgaatggccgcagccggactgcgtgctacgtccgggtgaagagtacgtaagcgtcaccgagtatcatttcattccgcgcgcttaa

SEQ ID NO: 1012 - DNA, 447 bp, Enterobacter cloacae
ttcaggagtccggaatctttcgccactgaacaagatgcactgttggagaatgttatccagcgtaacgataagaacaggagcaccatgatgaaaatgacgaaactgactacgcttttcctgacggcaacccttaccctggcaagcggtagcgtactggctgctgatgcaggctcatccggcagcaacggcgacgcgaatgccgctgccgaagcaggccaggttgcgccggatgcaaaacagaatattgcgccaaacaatgttgataacagtaatatcaacacgggcaataccaatactggcgggacgaacacaggcacgatgaaccatgagggtatgactaccgacgaggtgcataaaaactcagtctgtaaagacgggaaatgcccggacccgaatgacaaagtgggcagcgatgccaataccaaaacggacggtactacccagtaa

SEQ ID NO: 1013 - DNA, 954 bp, Enterobacter cloacae
atcaggaacgataccatggcgcactcccactcccattcccactccactggcgatgaaaatgccaaacggcttttgctggcttttggcgtcactgccacctttatgattattgaggtcacaggcgggctgatatccggatcgctggcgctgctggccgatgcaggacacatgcttaccgatgccgcggcgctgctcttcgcgctgctggccgtgcagtttgcccgtcgacctcccaatgcccgccacacctttggctggctcaggctgaccacgcttgccgcctttgtgaatgcgattgcactggtggtcattactattcttatcgtctgggaggcttttcagcgctttcggcatccacaaccgatagccgggacgacaatgatggttatcgccattgccgggttggtcgccaatattctggcgttctggatattgcaccgcggcagcagtgaaaaaaatctgaacgtacgggccgcggcgcttcatgtgctgggcgatctgctgggttctgttggtgcgattgtggccgcgctgatcattatgggcacgggctggacccctatcgacccgatactttccgtgctggtatcgtgcctggtattgcgcagcgcctggcggctactgaaggagagcgtaaatgagctactggaaggcgcgcccacatcactggatattggcgaactgaagcgcaacctgagtcgttccattcctgaagtccgtaacgttcaccacgttcacgtctggctggtgggtgagaaaccgctgatgacgctgcacgttcaggttattccgccccacgatcacgatgcgctgcttgaacgtattcggcatttcctcgagcatcactatgagattgcgcactccactatccagatggagtaccagccttgcagcgggccagactgccaccttaacgaggcgcagtccggccactcacacgcacatcaccattaa

SEQ ID NO: 1014 - DNA, 1182 bp, Enterobacter cloacae
cgacgtccattaccgcgaatcaggagtctaaaaatgagtctgaaagataaaacacaatccctgtttgctgaaaaatttggctaccctgccacccatgttatccaggcgccaggccgcgttaatctgatcggcgaacacaccgactataacgacggttttgtcctgccgtgtgccatcgactaccagacggtgatcagctgtgcgaaacgcgacgatcgtcacgtgcgagtgatcgccgcggattacggcaacgaaattgacgaattttccctcgatgcgccgatcgtgacccacgacagccagcagtggtcgaactatgttcgcggcgtggtgaagcacctgcaaaagcgtaacaagaatttcggcggggccgatctggtgatcagcggcaacgtgccgcagggggcgggattaagctcttccgcatctctggaagtggcggtcggcaccgtgttccagcagctttatcatctgccgctggacggggcgcagatcgccctgaacggtcaggaagcggaaaaccagttcgtgggctgcaactgcggcattatggatcagctgatttccgcgctgggcaagaaagaacacgctttgctgattgactgtcgctccctcgggaccaaagcggttccgctgcctaaaggtgcggctgtggtgatcatcaacagcaacttcaaacgcaccctggtgggcagcgagtacaacacccgtcgcgaacagtgcgaaaccggcgcgcgcttcttccagcagccagccctgcgtgatgtctcacttgatgaatttaacaaggtcgcccacgagctggacccggttgtcacgaagcgcgtgcgccatatactgaccgaaaatgcccgtaccgtagaagccgcctccgcgctggcgaaaggtgacctgaaacggatgggcgaactgatggccgaatcgcatgcctccatgcgtgacgatttcgaaatcaccgtgccgcaaatcgacaccctggttgaaattgtgaaagccacgattggcgacaaaggcggcgtgcgtatgaccggcggcggatttggcgggtgcgtcgtcgccctcgtgccggaagagctggtccctgccattcaggacgcggtggctaaacagtacgaagccaaaacgggcatcaaagaaactttctatgtctgcaaagcatcacaaggagccggacagtgctaa

SEQ ID NO: 1015 - DNA, 756 bp, Enterobacter cloacae
gaaatggctaatactaagcttgtcctggtgcgccacggcgaaagccagtggaacaacgaaaaccgcttcaccggttggtatgacgttgatctgtccgagaaaggcgtgagcgaagcaaaagcggcaggtaagctgctgaaagaagaaggcttcaactttgactttgcttacacctctgtgctgaaacgtgccatccataccctgtggaacattctggacgagctggatcaggcctggctgccggttgagaaatcctggaaactgaacgagcgtcactacggtgcgctgcaaggtctgaacaaagcggaaaccgcagaaaaatacggtgacgagcaggttaagcaatggcgtcgtggttttgcggtcacgcctccagagctgagcaaagatgacgagcgctacccgggccacgatccgcgttacgcgaagctgactgaggctgaactgccgcagaccgaaagcctggcgctgaccatcgaccgcgttgtgccttactggaacgaaaccattctgccacgcctgaaaagcggcgagcgcgtcattatcgctgctcacggtaactccctgcgtgcgctggtgaaatacctggacaacatgggtgaagatgaaatcctcgagctgaacatccctaccggcgtgccgctggtgtacgagttcgacgaaaacttcaagccagttaaacattactacctgggtaacgccgacgaaatcgctgcaaaagcggcggccgtggcgaaccagggtaaagcgaagtaa

SEQ ID NO: 1016 - DNA, 1218 bp, Enterobacter cloacae
cgctcggagggcgctgccctccgcttttcagacaacctgcaacaatacatctctatctctttgatctacaatgcactcagtctgagaaaaagcgcgtgtgaaaaccagtgtaaacgataccactattttatcccatgtcacacttttcgcgtctctgatatgctatggttaattcataccataagcctaatggagcgaaatatgcgagttctggtaacaggtggtagcggttacataggaagtcatacctgtgtgcaactgctgcaaagtggccacgatgtcgtcattcttgataacctgtgcaacagtaagcgcagcgtgctgccggtcattgaacgcctttcgggtaaacagccgactttcgttgaaggcgatatccgcaatgaagcattgatgactgaaatccttcacgatcacgcgattgaaaccgttatccacttcgcgggcctgaaagcggttggcgaatcggtggcaaaaccgcttgagtactatgacaacaacgtcaacggtaccctgcgtctgatctccgccatgcgtgcggccaacgttaaaaactttatcttcagctcttccgcgaccgtctacggcgatcagccaaaaattccttacgttgaaagcttcccgaccggtacgccgcaaagcccgtatggcaaaagcaagctgatggtagagcagatcctgaccgacctgcaaaaagcccagcctgagtggagcatcgcgttgctgcgctacttcaatccggtcggcgcgcatccttcaggtgatatgggcgaagatccgcagggcattcctaacaacctgatgccgtatatcgcgcaggttgccgtagggcgtcgcgattccctggcgatttttggtaacgattatcccaccgaagatggcaccggcgtgcgcgattacattcacgtcatggatctggccgacggccacgtggcggcgatgcagcagctggcggacaaaccgggcgtgcatatttacaacctcggcgccggggttggcagcagcgtgctggatgtggtgaatgctttcagtaaagcctgcggcaagccggtgaagtatcacttcgctccccgccgtgatggcgacctcccggcttactgggccgatgccaccaaagcggataaagagctcaactggcgtgtcacccgcacgctcgatgaaatggcacaggatacctggcactggcaatcacgccatccgcagggctatccggactaa

SEQ ID NO: 1017 - DNA, 1056 bp, Enterobacter cloacae
ggatttgtcatgacgcaattcaatcccgtcgatcacccgcatcgtcgttttaacccgctcagcgggcaatggattttagtttcaccgcatcgcgccaagcgcccctggcagggggcgcaagagacgcctgccaaacagacgctgccgcagcatgatccggactgtttcctctgcccgggcaatacccgcgtgacgggcgataaaaacccggactacaaaggcaccttcgtgtttactaacgactttgccgcgctgatgaccgatacgccggacgcgccggaaagccatgacccgctgatgcgctgcgaaagcgcccgcggcaccagccgcgtgatctgcttctcgcccgatcacagcaaaacgttgccggagctgagcgtggatgccctgaaagaggtggtcagcacctggcaggtgcaaaccgcggagctgggccagagctatccgtgggtacaggtgtttgaaaataaaggcgcggcgatgggctgctccaacccacatccgcacggtcagatctgggcgaacagcttcctgccgaacgaagccgagcgtgaggaccgactgcaaaaagcgtatttcgcccagaacggttcgcctatgctggtggattacacccagcgtgagctggcggatggcagccgtaccgtggtggaaaccgaacactggcttgcggtagtcccttactgggcggcgtggccatttgagacgctgctgctgccgaaagcccatgttcagcgcattaccgaactcagcgacgcccagcgtgacgacctggcgctggcgctgaaaaaactgaccagccgctacgacaacctcttccagtgctccttcccctactccatgggctggcacggcgcgccgtttaacggcgaagagaatcaacactggcagttacatgcacacttctacccgccgctgctgcgctcagcaacggtacgtaaattcatggtgggctatgaaatgctggcggaaacccagcgcgacctgacggcggaacaggcggcagaacgtctgcgtgccgttagcgacgtccattaccgcgaatcaggagtctaa

SEQ ID NO: 1018 - DNA, 696 bp, Enterobacter cloacae
cagagccgctacagtcccccaaaaagagagacaaaagatgataaggaatctccagacaatatgacgctcaaacatagtaacttactccatctcgatttgcatactaatcatgtaaccatgaccaacatccgtaccgtgcttggctcgatggagctggatgaaatgctctcccagcgcgacagcattaatacccgcctgctgcacattgtggatgaagccaccaatccgtgggggatcaaagtgacacgcattgagatccgcgacgtgcgcccaccggcagagctgattgcttccatgaacgcgcagatgaaggccgagcgtaccaagcgtgcctatattcttgaagccgaaggggtgcgtcaggctgaaatcctgaaagcggaaggggaaaaacagtcgcagatcctgaaagccgagggcgaccgtcagtctgccttcctccaggcggaagcgcgtgaacgttcggcagaagcagaagcccgcgcgacgcaaatggtctccgaggcgattgccgccggggatatccaggccgtgaactacttcgtcgcacaaaaatataccgatgcgctgaaggagatcggctccgcgaacaacagcaaagtggtaatgatgccgctggatgccagcagcctgatggggtctatcgccggaattgccgaactgatcaaagacggcggaaacgagcgtaaaaaatga

SEQ ID NO: 1019 - DNA, 858 bp, Enterobacter cloacae
accgaaagattgaaccttgtacccgtacgcgctagcatgaacctttccgtttatggagcgcgtatgggtctgtttaatcgtataaaaacatcgtttcgcgccctttttccccgccgttatgcctggcccggtatggatatttcgcttccgggtgggcagcatctgcacctggtgggaagcattcatatgggcacgcaggatatgtcccccctgccctccggcctgattaaactactgaagcgcgccgacgcgctgatcgtcgaagccgacatctccggccatgaatcgccgtttgccgggctggaaagcgaccgccccctggcggaacgtcttaacgagacgcagttggctgagcttactcgtcttgcggatgagaccggcgtctcgctctcaatgctcgacaccctgcccctgtggcaaattgccatggtgctacaggccacccaggcgcagcgcctggggctgcgcggcgattacggtatcgattatcaactgctgaatgcggcaagggcgcgcaacctgtccatcattgaactggaaggcacgggcagccagattgcgctccttcgccagcttcccgatgacggcctgatactgctggatgataccctgacccactggcacaccaacgcgcgtctgctgcaaacgatgattggctggtggctggatgcgccgcccgcagacggtaagctggcgttaccgtcgacgttcagtgaatcgttgtatgatgtgctgatgaacgcgcgcaaccaggcgtggcgggagacgctatatgccctgcctgccggtcgttatgttgtcgcggttggcgcgttgcatttgtacggagaagggaatttgccgtcgctgctgaaataa

SEQ ID NO: 1020 - DNA, 579 bp, Enterobacter cloacae
ccatcactgccaatactattgcgcaagatggtgctattttttagacaaacgtcaggcgtatgctgctggcatgaatcgtctgtcgtaagaaggatagccatgactcccgccgttaaattactcgaaaaaaacaaaatttctttccggatccacacctacgatcacgatccgaacgaaaccaactttggtgatgaagtggtgcgcaagctggggctgaacgcggaccaggtctacaaaacgctgctggtcgcggtgaacggcgatatgaagcacctcgccgtagcagtaacgcccgtcgccggacagcttgatctgaagaaagtggccaaagcgctgggagcgaaaaaggtcgatatggcagacccgatggttgcgcaacgcacaacgggttatctggtcggcgggatcagcccgctcggtcagaaaaagcgtctgcccacgctgatcgatgcgccttcgcaagaatttgaaacgatctatatttctggcggcaaacgcgggctggatatcgaactgtccgcaggcgatctggcgaaaatgctggacgcgaaatttgcggatattgcgcgccgggattga

SEQ ID NO: 1021 - DNA, 2640 bp, Enterobacter cloacae
gccggtttttttcgcaacatcgctgatattcacatttcccccttgaccttccccttgatggaaggtttaaccttcataacagttagcgaaaagcagagtgaaggtcaacaattgaccagaacattatacgggagttttgttatgtctcacactattgacctgacactggacggcctctcctgcggccactgtgtcaaacgcgttaaagaaagcctggagcagcgtcctgacgtggaaagcgctgaggtgactatcgatcatgccgccgtgaccggcagcgccagcgccgacgcgctgattgataccattaaacaggccggttacggggcggagttaagccacccaaaggctaaaccgctggcagagtcatcatccccgtcggaagcactgacagcggccactcctgagcttccggtagctgatgacattgatgacagccaacagctgctgatcaacggcatgagctgcgccagctgcgtttcccgggtacaaaacgccttacaggcggtaccgggtgtagcacaggcacgggtaaacctggcggagcgtactgcgctggtgatgggcagcgcctccgccgcagagttagtgcaggccgtggagaaagcgggctacggggcggaggccatcgaagatgatgccgagcgccgcgagcgccagcaggaaacggctgtcgccaccatgaagcgcttccgctggcaggcgattgtcgccctgctggtcggtattccggtgatggtgtggggcatgatgggtgacaacatgatggtcaccgctgacaaccgcaccctgtggctggtgattggtctgattacccttgcggtgatggtgtttgcaggcgggcatttctataccagcgcctggaagagcctgaaaaaccgcaccgcgacgatggataccctggtcgccctcgggaccggcgcggcgtggctctattcgatgagcgttaacgtctggccgcagtggttcccgatggaggcgcgccatctctattatgaagcgagtgcgatgattatcggtctgattaacttaggccatatgctcgaagcccgcgcgcgtcagcgctcgtcgaaagcgctggaaagattactcgatttaaccccgccgacggcccgcgtggtcacggacgagggggaaaaaagcgttccattggccgaggttcagcccggcatgacgctgcgtctgaccacgggagaccgtgttcccgttgacggtaagataagccagggcgaagcctggctggatgaagcgatgctgaccggggagcctattccccagcagaaatccgatggcgacgccgtgcatgccggtacggtcgtgcaggacggcagcgtgctgttccgcgccagcgcggtcgggagccataccacgctgtcacgcatcattcgcatggtccgccaggcgcagagcagtaagccggagattggtcagcttgccgataaaatctccgccatttttgtgccggtagtcgtcggtattgccctgctgagcgcggcaatctggtatttcttcggcccggcgccgcagattgtctacaccctggtgatcgccaccacggtactgatcatcgcctgcccttgtgcccttggcctggccacgccgatgtcgattatctctggcgtcggacgcgccgccgaatttggcgtactggtccgtgatgctgacgccctgcaacgggcaagcacgctggacacccttgtttttgataaaaccggcacgctcaccgagggcaaaccgcaggtggtggccgtcagtaccgttggctgtacggagacggatgccctgcgcctggccgccgcgctggaacaaggctccagccacccgctggcgcgcgccatcctggagaaagccggtgatgctcgtctgccgcaggtaagtaacttccgcaccctgcgcggtttaggggtcagcggtgaagccgaaggccatacgctgctgctgggaaaccaggcactgctgactgaacacggcgttgatacgtccgcgctggacgctgagctgaacgcgcaggcctctcagggcgcgacgccggttctgctggcgagggatggtcaggtggcggcgctgctggccgtgcgcgatccgttacgccaggacagcgtagatgccttacagcgcctgcaccgcgcgggctatcgtctggtgatgctgaccggggacaacccgaccaccgctaacgccatcgccaaagaagccggtattgatgaggtgatcgcgggcgtgctgccggacggcaaagcggacgccatcaagaacctgcaaagtcagggtcgccaggtggcgatggtgggcgacggcatcaacgacgccccggcgctggcgcaggctgacgtaggtattgcgatgggcggcgggagcgatgtcgccattgaaaccgcggcgatcaccctgatgcgccacagcctgatgggcgtggcggacgcgctggcgatttcgaaagccacgttgcgcaacatgaagcagaacctgctgggggcgttcgtctataactcgctcggcattccgattgccgccgggattttgtggccgctgaccggtaccctgctgaacccggttgttgcgggtgcggcgatggcgctctcgtcaattaccgtggtgagcaacgctaaccgtctgctgcggtttaaaccgaaagattga

SEQ ID NO: 1022 - DNA, 456 bp, Enterobacter cloacae
aaaatgattgagctcatcgttgcacatcctcatgcgttctggctaagccttggcggactgctgctggccgccgagatgcttggcggcaacggttatctgctgtggagcggggttgccgcggtgattaccgggctggtcgtctggctgctgcctgtcggctgggagtggcagggcgcgctgtttgccgtgctgacgctgctggccgcctggctgtggtggcgctggctgaacaaacgggtgaaggcgcagaagccggtcgacgcgcatctcaaccagcgtgggcagcagatcgtgggtaaacgctttacgcttgataacacgctaataaacggacgcggtcatatgcgcgtgggggacagttcgtggccggtggtggccgatgatgacctcagcgccggcacgcgggttgaggtcatcgcggtggaaggtattaccctgcgggttaaagcctgttag

SEQ ID NO: 1023 - DNA, 1026 bp, Enterobacter cloacae
  unsure (991)
caaatcgacgtggtatttatggcaatcagtgaatcaacccagcccgtccagggcgctccggcgtcgccgccgaaatcgcgcacttcctttaaagtattaggcgcaatcagtctctctcatctgctcaacgacatgatccagtcgctgattctggcgatctacccgctgttgcagtctgagttctcattaaccttcgtgcagatcgggatgatcaccctgaccttccagctggcctcttcgctgctacagccggtggtgggctattggacggacaaatacccgatgccatggtcgctgcccattgggatgtgcttcaccctgagcgggctggtgctgctggccatggcgggcagctttgaggcggtactggttgccgcggcgctggtgggaaccggttcatcggtgttccatccggaatcgtcccgcgtggcgcgtatggcctccggcggacgccacgggctggcgcagtctctgttccaggtgggggggaactttggtagctccctcggtcctctgctggcggcggtgattatcgcgccctacggtaaaggcaacgtggcgtggtttgtgctggccgcgctgctggcgattgtcgtcctggcgcaaatcagccgctggtatgccgcgcagcatcgcgtaaataagggaaaacctgccgtgaagataaccaacccccttccgcgcaataaggtgatccttgccgtcagcgtgctgctggtgctgattttctcgaaatatttctatatggcgagcatcagcagctattacaccttctatctgatgcaaaaattcggattatcggtacaaaacgcccagttccatctctttgccttcctgtttgcggtggcggcaggcacggtgattggcggccctgtgggggataaaatcggacgtaaatatgtgatttggggctctatcctcggcgttgcaccgtttacgcttgttttaccctacgcaacgctggaatggaccggaatattgtcttcaaccngggcggatggaacatatacgtcccccccccccccc

SEQ ID NO: 1024 - DNA, 1698 bp, Enterobacter cloacae
gtcactgtaatttttgcgtttgtctatgggtcagggagagagaagatgaagttaatgaagcgtggcgtcgcgctggcgctcatcgccgcatgggggctaacaagcctgcccgcgcaggcgtatgaaaaagataaaacctataaaattaccattctgcatactaacgatcatcacggccatttctggcgcagcgaatacggtgaatatggcctggcggcgcaaaaaacgctggtggatggcattcgtaaagaggtcgcggcccagggcggcagcgtgctgttgctgtcgggcggggatattaataccggcgtaccggaatctgatttgcaggatgccgagcctgatttccgcggcatgaatttaattggttacgacgcgatggcggtcggaaaccacgagtttgataatccgctgagcgtgttgcgccagcaggagaagtggtccaaattcccgttcctttccgccaatatttatcagaaaagcaccggcgagcgcttgtttaaaccgtgggcgctgttcaagcgtcaggatctgaagatcgcggtcatcggcttaaccaccgacgatacggccaaaattggcaaccctgaatttttcaccgacatcgaattccgtaaaccggcggacgaagcgaagctggtgatccaggagttgcagcagaatgaaaaaccggatgtgattatcgcgaccacccacatggggcattacgataacggtcagcacggctctaacgcgccgggcgacgtggagatggcgcgcagccttccagcgggctcgctggcgatgattgtgggcggtcattcgcaggatccggtctgcatggcttctgagaataaaaagcaggtagattatgtgcccggcacgccgtgcgcgccggatcgtcagaacgggatctggattgtacaggcccacgagtggggtaaatacgttggccgcgcggatttcgaattccgtaacggcgagatgaagctggtgcactatcagctcatcccggtcaacctgaagaagaaagtgacctacccggatggcaaaagcgagcgggtactctacacgccagagatcgctgaaaaccagcagatgctctctctgctgacgccgttccagagcaaagggaaagcgcagctggacgtgaagattggcacgcttaacggacgactggaaggggaccgcagcaaagtccgctttgtacagaccaacatggggcgtctggtgctggccgcgcagatggcgcgcacgaatgcggatttcgccgtgatgagcggcggcggtattcgtgactccatcgaaggcggagacatcacctataaagacgtgctcaaagtgcagccgtttggcaacgtggtggtctatgcggacatgagcgggaaggaggtgattgactacctgaccgccgtggcgcagatgaagccagattccggggcgtatccgcagtttgctaacgtcagcttcgtcgcgaaggacggtaagctcaacgatctcaaaatcaaaggcgaaccggttgatacggcgaaaacctaccgcctggcaacgttaagctttaacgccaccggcggcgacggctatccgcatatcgataacaaaccgggctatgtaaataccgggtttattgatgcggaagtgttgaagcagtttatccagcaaaattcaccgattgacgtgaacgcgtatgagccgaaaggtgaggtgagctggcagtag

SEQ ID NO: 1025 - DNA, 444 bp, Enterobacter cloacae
accttccatcaaggggaaggtcaagggggaaatgtgaatatcagcgatgttgcgaaaaaaaccggcttaaccagcaaagcgattcgcttttatgaggaaaaagggctggtgacgccaccgttgcgcagtgagaacggctaccgcagctatacgcagctgcatcttgatgaactgacgttactgcgccaggcaagacaggtaggatttaaccttgaggagtgcggcgagctggttaacctgtttaacgatccgaaacgccacagtgccgacgtgaaaaaacgtacgctggaaaaagtggcggagatcgaacgccatatcatcgaattacaggcgatgcgtgagcaactgttacagctggcagaatcctgcccgggagatgacagcgccgagtgcccgattatcgacaatctttccggctgctgccaccgtaaaacccacgcctaa

SEQ ID NO: 1026 - DNA, 207 bp, Enterobacter cloacae
agaattggcttccagagatgggagccttttttgtatcggaaattcattatgagaacagcttacgcttacattcgttttagctctgaaaagcaatcagcaggggattctgtaagacgacaacaatcactgattgattcatgggtgaagaataaccctgactacatactctcatttttcaccacagccgcgaaggtcacgctattggtt

SEQ ID NO: 1027 - DNA, 735 bp, Enterobacter cloacae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccccctctgatgttacattgcacaagataaaaatatatcatcatgaacaataa

SEQ ID NO: 1028 - DNA, 228 bp, Enterobacter cloacae
aatgcacatataggtacgtatcaatgtcgttttttgggtacgatcatgggtaggggtaggcgtctcaaatcctatttggattatgaaaatgcgctaggtgacggcataggagtgggctatggccaaagttatcagccctggcttagagctcaggacgttaaatcccgtggaaaccgttcgatagtctttggccttaagacgtttcgaaaccatcatcatggggtttga

SEQ ID NO: 1029 - DNA, 861 bp, Enterobacter cloacae
acaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 1030 - DNA, 786 bp, Enterobacter cloacae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgcctctactcttgccacaggtttacgagtaggtgatttgggaggaagcgtcttagcctttgaagttggcgcgaaggagagaatggcactccgtgcaacgcattaa

SEQ ID NO: 1031 - DNA, 255 bp, Enterobacter cloacae
gtccgtaacgttgttcagcgacaggtcagcgcagatgatttcatgtgttttactgtcaacggcgagatgcagcttacgccagatacggcggcgttcctggccatgctttttgactttccactcgccttcaccgaagaccttcagcccggtggaatcaattaccaggtgtgcgatttcaccccgggtgggcgttttgaaactgacattaaccgactttgcccgcctgctgacacagctgtaatccgggcagcgtag

SEQ ID NO: 1032 - DNA, 1665 bp, Enterobacter cloacae
ttatcatcaatgtttttactggtttactattttccggaggtgttaatgcctgtacttttcagggtgaaagttattccgctggttttacttctggcaatgatctttgcgtttttacttaactggccaatattgctgcatttttacgagattttgtcgcatttagagcatgtcaaaattggttttgtcatttctattccctttgttctggttgcggcgcttaacgttgtttttatgcctttctcagttcgttttctgctgaaacctttctttgctttactgtttatcactggctcactggtcagttattcgacactaaaatataaattaatgtttgatcaaacgatgattcaaaacattattgaaactaacccccaggaagcgcattcctatcttaatggctcaattattatatggttcgtctttaccggtatccttcctgccatcctccttttttcaataaaaattcaatatcctgaaaaatggtataaaggcattgcttaccgtttgctctccgtgctggcatcgttgagtttgattgcaggtgttgccgcactttattatcaggattatgcctctgtcggccgcaataactcgacattgaataaagagatcatcccggcgaactacgcttacagcactttccagtatgttaaggatacgtactttacgactaaagtgcctttccagacgctggggaatgatgctaaacgcgtcgtcgctcacgaaaaacccacgctgatgttcctggtgattggcgaaacggcacgcagccagaatttctcgatgaacggttattcgcgtgataccaatgcctttaccagcaaatccggcggcgttatttcgtttaaaaatatgcattcctgcggtaccgctaccgcaatatccgttccgtgcatgttctcgaatatgaatcgcaccgagtacgacagtaaaaaagcatctaacagtgaaaatttcctcgacatcgtgcagaaaaccggtgtctcgctgttatggaaagagaacgatggcggttgtaaaggcgtatgtagccgcatcccgactgtcgaaattaagcctagtgataacccgaaactgtgcgatggcaaaacgtgccatgacgaggtgatgctggaaaaccttgatgatgaaatcgccaaaatgccaggtgataagcttgtcgccttccatatcattggcagccatggaccgacttattacctgcgttatccggctgagcatcgccacttcatgcccgaatgtgcacgtagcgatatcgaaaactgtactcaggaacaattggtcaacacctacgacaacacccttcgttatacagactatgtattagctgagatgattgaaaagctaaaaaattacagcgatcagtacaacaccgtgctgctttatgtgtccgatcatggtgaatcattgggcgaaagcgggctatatctgcacggcacgccgtacaaactggcaccggatcagcagacgcatattccgatgcaggtctggatgtcaccgggctttatcgccgggaaacacatcaacatgtcttgccttgaaaataatgcggcgaaaaaatcatattcccacgacaacctgttctcatcgattttggggctgtgggacgtaagcaccagcgtctataatcctgaccgcgatttgttccgcgaatgccgtggctaa

SEQ ID NO: 1033 - DNA, 738 bp, Enterobacter cloacae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttccgatctttgcccgtggcacatggatgaaacctacgtgaaggtcaatggccgctgggcgtatctgtaccgggccgtcgacagccggggccgcactgtcgatttttatctctcctcccgtcgtaacagcaaagctgcataccggtttctgggtaaaatcctcaacaacgtgaagaagtggcagatcccgcgattcatcaacacggataaagcgcccgcctatggtcgcgcgcttgctctgctcaaacgcgaaggccggtgcccgtctgacgttgaacaccgacagattaagtaccggaacaacgtgattgaatgcgatcatggcaaactgaaacggataatcggcgccacgctgggatttaaatccatgaagacggcttacgccaccatcaaaggtattgaggtgatgcgtgcactacgcaaaggccaggcctcagcattttattatggtgatcccctgggcgaaatgcgcctggtaagcagagtttttgaaatgtaa

SEQ ID NO: 1034 - DNA, 821 bp, Enterobacter cloacae
cctggtatgagtcggcagcgctttcttcacgaggcagacctcagcgctattctgaccttgccatcacgactgtgctggtcattaaacgcgtattcaggctgaccctgcgcgctgcgcagggctttattgattccattttttctctgatgaacgttccgctacgctgcccggattacagctgtgtcagcaggcgggcaaagtcggttaatgtcagtttcaaaacgcccacccggggtgaaatcgcacacctggtaattgattccaccgggctgaaggtcttcggtgaaggcgagtggaaagtcaaaaagcatggccaggaacgccgccgtatctggcgtaagctgcatctcgccgttgacagtaaaacacatgaaatcatctgcgctgacctgtcgctgaacaacgttacggactcagaggccttccccgggttaatccggcaaacccaccggaaaatcaggtcagccgccgccgatggcgcttacgatacccggctatgtcacgatgaactgcggcataagaaaatcagcgcgcttatccctccccgaaaaggtgcgggttactggcccggtgaatatgcagaccgtaaccgtgcagtggctaatcagcgaatgaccgggagtaatgcgcggtggaaatggacaacagattacaatcgtcgctcgatagcggaaacggcgatgtaccgggtaaaacagctgttcgggggttcactgacgctgcgtgactacgatggtcaggttgcggaggctatggccctggtacgagcgctgaacaaaatgacgaaagcaggtatgcctgaaagcgtgcgtattgcctga

SEQ ID NO: 1035 - DNA, 738 bp, Enterobacter cloacae; identical to SEQ ID NO: 1033

SEQ ID NO: 1036 - DNA, 999 bp, Enterobacter cloacae
ttttcagtcctcgttagcgttggcaggatactggggggcggggaggtagcctccgctgatggtatgcgttttgtcacgccagtgaaaacggtgaattctggccccaacagaaaatactttggttcagggcgcggcatcacctggtacaactttgtctctgaccaatattcgggttttcatggcatagtgattcctggaacactgcgggattccatctttgtgctggaagggctacttgagcaacaaacgggactaaacccggttgaaatcatgacggacacagcaggtaccagtgacattatctttggcctgttctggctactgggataccaattttcacctcgtctggcggatgcgggtgaggctgtgttctggcgggccgacaaagcagcgaattacggggcgttggacaaactggcgcggggttgtgttgacctttctaaaatcgaaagccactgggatgagatgatgcgggttgccggttcgctgaagctgggcactattcatgcgtcagaactcattcgatcgctattgagaagtacccgaccgtcagggcttgctcaggcaataatggaggtcggaagagttaacaagacactgtatcttctcaactatattgatgatgaggactatcgtcgccggatcctaacacagttgaaccggggtgaaggccgccatgccgttgcaagagccatctgctacggtcagcgtggcgagatcagaaaacgttaccgcgaggggcaggaagatcagttgggtgcgctgggtctggtgacaaacgcagtggtgctgtggaatacgctttatatgcaggaagccttgtcgcacctgcgcagcatcggggaagggccagaggatgaacatatcgcgcggctttcgcctctgatgcacggtcatatcaacatgctgggacattatacgttcacactaccggaggatattatgaagggggaattgaggccgttaaatctcaatttaaacaatgaattatctccttag

SEQ ID NO: 1037 - DNA, 2148 bp, Enterobacter cloacae
cattcagtaccgttttgggtggtatcaaaactcataacatttgagacggttaaaaagagaacagaacacccgtttacgaaaggatgcgtgatggctgctgattttctgaccgacaaacagacacagaactacgggcgttatgccgcagagccaaacgagatccagctggcacggtattttcatcttgatgagcgagaccttactttcatcaacctgcgtaggggcaggcataaccggttgggaattgcccttcaactcacaactgcccgctttctgggaaccttcttgtccgatctcatgcaaataccgcccggtgtccagttttatgtcgcaaggcaacttaacatccgctatccagagatcatttcccgctatgctcaaagggaaaacacacgttgggagcaccacgggcttatcaggcagcactatagctatcatgatttcggtgatttcccgtggtcgttcagactgaagcgattgctgtatacccgtgcatggctcagtaatgaacgccccggactgatgttcgattttgccaccgcgtggttgcttcaaaataaagtgttgttgccagccgcatccaccctgacgagagtcattggtgaaatccgtgagcgtgcgacccgccgcttgtggcgaaaattggccgcgctgccaaaccgttggcagaccgcacaactggctgggttacttgaaatccccgaaggacagcgactctcagtgatggagcacctaaaaagaggccctgtcactatcagcggccccgcgttcactgaagcacttgaacgttacactcgcctgcgcagcctggagttttcctgtctgaatttcactgggctgcccgccatacagctccgcaatctggcacgctatgccggaatggcatcggtgaaatatatcagcagaatgccagaagaacggcggctggcgatccttaccgcattcgtgaaagcgcaagaaatctcggcgctggacgaggccgttgacgtgctggatatgctgatcctcaatattacccgggaggcgaagaaaaccgggcagaaaaagcgacttaggacgctcaaggatcttgaccgcgcggcgttgctgctggcgcgggcatgcgcacttttacttgatgaagataccgccgatgatttgctgcgaaagaccatattcagcagtgtgtctgtcgccagactggcagagtccgtggaaaaagtgaatgaactggcccgcccccaggatacaaactttcaggatgaaatggtggagcaatacggacgggtaaggcgttttttgcccgcactactgcgcgatctgcacttccgtgcggccccagacggtgaacataccttggctgccatccattacctggcagagctaaacggctcgaaaaaacggatcctggacgatgcacctgaacatatcatttcaggcccttggaaacgcctggtgtacgatgctgacggtcggatacagcgagcaggttactcgttgtgtctgctggagcgacttcaggatgcgctacgccgtcgtgacatctggttggaaaacagcgatcgttggggtgatccgcgccaaaaacttcttcagggggaggaatggcaggcgcagcgggttccagtctgccgggcattgggtcaccccactaatggcagtaaagcatcggagcaattggccgctcagttagatgaaacctggaaaacggtggcatcacgttttgatcgcaataccgccgtggacatctgcaatgaaggtaaacatccttcgctgaccatcagcagcctggataaattggatgaaccaccggcgctgatacaactgagcagccgagtcagacaattgcttccacccgttgacctgacagaactgttgctcgagattgacgccagaactggcttcacccgtgaattcagccatgtcagcgagtcaggtgcccgtgcgcaggatctgcatataagcctgtgtgcggtgatgctggctgaggcctgcaatatcggacatgagccgctgatcaagcacaatatccctgcactgactcgccatcgtctgagctgggtgaaacagaactacatccgagcagaaacgctggttagcgccaatgcgcggctggttgattttcagtcctcgttagcgttggcaggatactggggggcggggaggtag

SEQ ID NO: 1038 - DNA, 591 bp, Enterobacter cloacae
gctgagggaataacgatgcaacgcctctttcctgcactgtgggtagtcctgtttttagtcgtatctccgctgcatgcggagccgaaagtctatggcgaacagcgtattcatcgctggtgggatgcagtaacggacgatattgcgcaaacctgggaacagccggatcgttacgatctctaccttccgtttttgagctggcatgcacgcttcatgtatgacaaagagaaaacggataattacaacgaaatgccgtggggcggggggctgggcgtgtctcgctacaacgacgagggcaactggagcgcgctgtttgccatgatgtttaaagattcccacaacgagtggcagcccgcgatgggctacggctgggagaaggggtggtttctggataacgcaaaagatttccgtctggggctcggggccgccgcggggatcaccgcgcgcgacgactttgccaactatgtcccgctgccgtttatcttcccgcttttctctgccggatataagcgtgtcaccgtccagttcacgtatattcctgggacctacaacaacggcaacgtgctgtttgcctggctgcgcctgggcttttag

SEQ ID NO: 1039 - DNA, 2715 bp, Enterobacter cloacae
aaagaacccgaggaaggaacgatgataacagaaaagcctcaccgcccgtattatcaacagaccgttgatgaaaccctgacaaatatccaatccagcctcgacggactcagcagtacagaagcgaccgccaggctggaaaaatacggcgaaaacgccttaccgcaaaaaccgggtaaacccggctggctgcgctttctggcccatttcaacgatgtccttatttacgtccttctggcggcggcgctgctgaagctgataatgggacactgggtggatatgtttgtcattcttggggtggctatcattaacgccctgattggccatattcaggagagcaatgcggagaaatcgctgcaaagcattcgtaatatgctctccagcgaggctgtggtcatccggcagggcaaccatgaaactatcccgacgacagcgctggtgcccggagatatcgtggtgatacgcgccggggatcgcattcctgccgatcttcgcgtgatagaggcgcacaacctgcgggtggaagaagctattctcaccggcgaatccacggtagtggagaaaagcagcgatgtgctcagcggcgaactcccgttaggtgaccgttacaatctgctgtattcgggcaccaccgtcagctccggcgggggaaaagggctggtggtggcaaccggtggggagaccgaactcggccatatcaaccagatgatgtcagacattgaaaaacaccgtaccccgttgatggtgcaaatggacaagctcggcaagaccatttttatcaccattctggtgatgatgctggcgctgttcgttttcagcctcatcttccgcgatatgcccgtttcagagctggtgctgtcgctgattagccttgcggtggcggcggtgccggaaggattaccggccattatctcgatcatcctctcgctgggcgtgcaggcgatggcgcgtcgcaaggcgattattcgcaagctgcctaccgtggaaacgctgggggcgatgacggttatctgctcggataaaaccggcaccctgaccatgaatgagatgacggtaaaagcggtgattaccgcggacaccacctaccgcgtggagggagacagttacgagccggtgggcgctattcaccctgttgacgatccaacaccggtcaccgtgacccaggggtctgtgcttgagcgctatctgcgcaccgtcgatctctgtaatgacagccagctgatcaaagatgagcaggggctgtggaaaatcaccggcgggcccactgaaggcgcgctgaaggtgctggcggccaaaatcccgcttccgacaattgacgccgaattgcgcagtaaaatcccattcgattcgcaatataaatacatgtccaccctttatcacctgggcgacgaagaggtgatgttaatcaccggtgcgccggacgtccttttccgtctttgccagcaccagcagacccaaaacgggctggagccgttcaacctgcactattgggaagagaagattgaagagtatgcgcgcgagggattgcgcatggtggctgcggcctggaaaccggccgccagcgggcagcgcgagctgacgcatgcggatctgcaagaaggggtcatactgctcggcattgcgggcatgatggatcccccgcgcccggaagccatttcggccattgccgactgcttgcaggcgggcattcgcgtgaaaatgattaccggggatcatccacaaacggcgatgagcattggacagatgctgggtattggcaacgcggcgagcgccattaccgggcgcgagctggaggcgatggacgaccaccagctgagcgaggcggcgcaaaaatacgatatctttgcccgaaccagcccggaagataaattccgcctggtgcaggcgctgcaaagtaagcaggaagtggtcggaatgaccggggacggggtgaacgatgcgcctgcgctgaagcgggcggatgtcggcatcgcgatggggatcaaaggtactgaagtcaccaaagaagccgccgatatggtgttaacggatgataactttgccaccattgcccgggcggtccatgaagggcgtcgggtctacgacaacctgaaaaagaccattttgttcgttatcccgagcaacatcgcccaggccctgctgatcattattgccctgctggcggggaacctgatcccgttaacaccggtactgatcctgtggatgaacatggcaacctcggcaacgctgtcgtttggcctggcgtttgaagcgggtgagaaggacatcatgaaccggccgccgcgtaagtctaacctgcatgtgatggacggatatgccatctggcgagtggtgtttgtcggattgatgattgccatcagcgcctttgtgatggaggcctggctgcaaccacgcggttactcgccggagatcatccgcaccgtgttgctgcaaacggtggtcaccgcccagtggttttacatgctcaactgccgcgtcaccgacggtttctccctgagtaaaggtctgctggctaataaggggatatggatcgtgagcggcgtacttatggcccttcagcttctgatcatctatgcgccgttcatgcaaatgctgttcggtaccgaagcgctaccgttccgatactggatcattacctgcctgattgggtttgcgatgttcatgattgttgaagcagaaaaagtctttacccggagatggcgcacgacgaaaagatga

SEQ ID NO: 1040 - DNA, 540 bp, Enterobacter cloacae
catccattccttttttccgtaaaaggcattcacgcctgtacccatggggttgatgcgatctctcctgattcactcactgttgtgttggttataaaaaggatgcttgatatgtataaaacgattctggtgccggtggatgtatacgaaacagcgttgtctgataaagcgctacagcatgcccaattcctggcgcaaagcgcatcgggtaatgtccatctgctgtacgttatgccaaagttctcggcggaactgacccgcggttttattgcagacgcgagaaagatggatgaatatatgattaataatgctaaagaaaaactggctgcgctggtaaaaaaaatcaacctgccggaagcaaatgtccatctgcatgttcgcagcgggaatatacgtgatgaggtaatcaaactggcggatgaacttaacgtcggtgcgattattgtgggatcgcgtaatcccaatattcaaacccatttattagggtcagaggcggcgagtatcgttcgttatgcgcatgttcctgttttcgttattcgttaa

SEQ ID NO: 1041 - DNA, 713 bp, Enterobacter cloacae
  unsure (705)
gtacagaacactatgattcgatttgcctcgttcgtttttacgcttggtattctggttcccgctgcatctgctgtaacctaccccctccctcccgagggcagccgcctggtgggggcgccgatcaccatcaccgtgcctgagggcaatactctgccgctcgaagcgtttgcagcgcagcacggacaggggttgagcaatatgctggaagccaacccgggggtggatccgtttttaccgcgagccggaacacagcttgcggtgccgcagcagcttattctgccgccaacggtgcgcgagggaattgtggtgaacgtcgcggaaatgcgactttactattatccacccggcagcaacacggttgaggtgctgcctattggcatcggtcaggccgggcgcgaaacgccgcgtaactgggtaaccgccgttgagcgcaaacaggaaggcccaacctggtcacccacgccaaatacgcgacgcgcttacgcgaaggaagggaaaacgttgcccgcgttcgttcccgccgggccggataacccgatggggctgtatgccctttatatcggcaggctgtacgcgatccacggtaccaactcaaatttcggcattggtctgcgcgtcagccagggctgcattcgcctgcgtaataacgatatcaaatacctgttcgatgacgtttctttttcacctgggagtgccggatcaggnataattaa

SEQ ID NO: 1042 - DNA, 1110 bp, Enterobacter cloacae
aacaattattatcaggggaatactgtgaagcgctacctctctcttctgcctgttgttttattgctgctgacggcgtgcgatccgaaatccgaccgcgccgcgcccctgccgaaaatggtaaaagtcgcagaggtggtgaaggctggcaacgcgcagcagcgcgtctttcccgcccgtatcgaatccggcgacgccacggatcttgcgttcaaacgtgccgggcagattgagaccctggacattcgccagggtgccgttgtcaaacaggggcaacggctcgccagtcttaacgatcgcgaagcccggcagcgtctgaacgacaggcaaacggcggcgaccctggctcagcggcaattcgaccgcttccagaccctggcaggacgccaggccgtgtcgaaggccgagatggatgtccagcgcgcaaaccgcgattctgcaaacgccgcgcttcagattgcacgcgaagaattgagtcagatgacgctcgtcgccccctttagcgggacagcggccagcgtacatgtgcgaaatcatcaggtcgtctcagccggccagcccgtcgtcacattgacccgtaccgatctgctggacgtggttttcagccttccagagaacctgtttaacaccttcgatatccgcaatgcgcaatacaaaccggtagtgaggatcaacgccctgcccggtcgcgagtttaccgctgtgtacaaagagcactcaggcagtagcgacagcaacactttgacctggcaggtaattttaaccatgccccgcccggatgattttcccgtcgttggcggcgtcagcggaacggtcaccatcaatttaaccaacctaccggcgggcgtcggcagtgaggcgctggtggtgccggttgaagcggtctttaacccggataaccacccgcgcaatgagccacacgtctgggtggtgacgggcgaaggcgatacgttgcaccttgaagatcgtaaggtcagcgtgggacaagtcagcgctgagggggtcatcatcgtcggtgggcttaaggcgggtgaacgcgtggtggccgcaggcgttggggagttacatcccaaccagccggtacgtatctggacgcgtgaacggggactataa

SEQ ID NO: 1043 - DNA, 477 bp, Enterobacter cloacae
gtggtgtccgcggtaatcaccgcttttaccgtcatctcattcatggtcagggtgccggttttatccgagcagataaccgtcatcgcccccagcgtttccacggtaggcagcttgcgaataatcgccttgcgacgcgccatcgcctgcacgcccagcgagaggatgatcgagataatggccggtaatccttccggcaccgccgccaccgcaaggctaatcagcgacagcaccagctctgaaacgggcatatcgcggaagatgaggctgaaaacgaacagcgccagcatcatcaccagaatggtgataaaaatggtcttgccgagcttgtccatttgcaccatcaacggggtacggtgtttttcaatgtctgacatcatctggttgatatggccgagttcggtctccccaccggttgccaccaccagcccttttcccccgccggagctgacggtggtgcccgaatacagcagattgtaa

SEQ ID NO: 1044 - DNA, 1344 bp, Enterobacter cloacae
ttaaaaatcagtacagacaggacaactatggactccacccttatctccgctcgccgcaacgaggagacaccttcgcttaaccgcgcccgccgcgccgctttaggtagcttcgcaggcgccgtcgtcgactggtatgactttctgctctacggtattaccgctgcgctggtctttaaccgtgaattctttccccagatcagccccgccatgggtacgcttgctgcgtttgccaccttcggcgtcggttttctgtttcgtccgctgggcgggataattttcggccacttcggcgatcgccttggccgtaaacgtatgctgatgctcaccgtgtggatgatgggtattgccaccgcgctaatcggtattttgccctcctttgcatcgattggctggtgggccccggtgttgctggtgacgctgcgcgccattcagggctttgccgttggcggcgaatggggcggcgcggcattgctgtccgtggaaagcgcgccgaagaacaagaaagcgttctacagcagcggcgtgcaggtaggttatggcgtgggtctgctgctctccacgggtctggtgtcgctaataagccagctcacgacagacgagcagttcctgagctggggctggcgtattccgtttatcttcagcattgtgctggtcgtggtggccctgtggatccgtaacggcatggaagagtcggctgagtttgagcggcagcagcgcgaaaaaccggtcgccaaaaaacggctgccagtgatggaagcgctcgtgcagcaccctggcgcttttctgaaaattatcgccctgcgcctgtgcgaactgctgacgatgtatatcgtcaccgcctttgccctcaactattccacgcaaaacctcggccttccgcgggaattgttcctgaatattggcctggtggtgggcgggatcagctgcctgaccatcccctgcttcgcctggctggcggatcgctttggccgtcgacgggtgtatatcaccggggcgctcatcggcacactcagcgcctggccgttctttatggccctggaggcacagtcggtcttctggattgtcttcttcgcgatcatgcttgcgaacatcgctcacgatatggtggtctgcgtgcagcagccgatgtttaccgagctgtttggcgcaagctaccgctacagcggcgcgggcgtgggatatcaggtggcgagcgtggtcggcggcgggtttacgccgtttatcgccgccgcgctggtgacgttctccggcggtaactggcatagcgtggcgatttatctgctggcgggttgcctgctttctgctgccaccgccctgttgatgaaggaaaccgcgcacagctga

SEQ ID NO: 1045 - DNA, 3075 bp, Enterobacter cloacae
acggggactataatggatatctctcgtcagtttatcagcaacccggttcgcgtctggctgacgattttgctgctgggcgtaggtggcattattgccctgttgaacatcggcagactggaagatccggcgtttaccatcaaaacggcggtggtgatcacccattatccgggcgcgtcggcgcagcaggttgaggaagaggtcactctgccgctggaaaacgcgcttcagcaattaccttacctggataacgtcagctccatctcctccagcggcctgtcgcagattacggtcaatatagcctcgcgctaccactcaaatgcgctgccgcaaatctgggatgaactgcgtcgccgggtgggagatgccgcccgacagtttccacccggcgtagtgaccccgtttgtaaatgacgattttggcgatgtgttcggctttttctttgccatttccggcgatgaattcagcaatccggaactggtccggtatgccgagcagctgcgccgggagttggtcctcgtgccaggcgtgggcaaagtggccatcggcggagccctcacccagcagattaacgtagatatttctctgagcaaaatggccgcgcgcgggataacgctgaaccagctttctgcccagctcagcaggctgaacgtggtctccagcgcgggagagatcccctccggtaccgagtcaattcgtctgcatcctaccggtgaattcgaaagtattgacgagctggccgatctcatcgtgaccccgccgggcgttggggcggctacccgcttacgggatattgccaccctgtcacgcgggctggatgcctcccctgccagcatctaccatgccaacggcaaagaagccgtcaccatgggcgtctcctttatccccggcgttaacgtgatcgacgtgggacatgccctggaggcgaagcttgagcagatgtcagccgagaaaccggcaggtatccacatcgacctgttttacgatcaggcggcggaggtcgggcattccgtcaacggatttatcattaatttcgtgatggcgctggcgattgtcgtcggtgtgttgctgatctttatgggcttacgcagcgggatcattatcgccttttccctcgcgcttaatgtgctgggtacgctgctgatcatgtatctctggggtattgaactacagcgcatttcactgggcgcgctgatcatcgccctcagcatgctggttgacaatgccattgttattgtcgaaggggtactgatagcccggcagcagggctcgtccctgatgaacgccattagcaacattattcgccgttctgcgctgccgctgctgggtgcgacggtgatcgccatcctggcctttgcgcccgtcgggctgtcgcaggactctaccggcgaatactgtaagtcgctgtttcaggttctgctgatttcgctcatgctgagctggttctctgccctcaccattacaccggtgctgatcaaatggtggctgtttaaacgggacgctgcgccgccagaggctgacgaaacggatccctatgacaaacgcatctatcggatctatcaggcggtgctcaacgcgctgttacggcgtaaagcgccaacgctggtggtgatggccgcactgctggcagccgccatctggggctttggctcggtgcggcagaacttcttcccctcctccagcacgccgattttctttgtcgacctctggctcccttacggtaccgacattaaatggaccgagaagatgaccagtgatatcgagaaaaccattaacggccagcctggcgtggaaaccacggtctcgacgattggtcagggaagtatgcgatttattttgacctacagcggacagcggcagtacagcaactatgcgcaaatcatggtgagaatggacgaccagcgtaacatccccgccctgacccgccacgttgatgagtacatcgcccggaactatccgcaggttaacgccagcacgaagcgggtgatgtttggcccctccggcgacagcgctattgaagtgcgtattaaaggccctgacccggacaggctgcgtctgatcgccagccaggtagacaacattcttacgcgcgatccggcgacggacagcgtcaggaacgactggcaaaaccgcagcaaagtgatccgcccgcagtacatcaccgcgctcggacgtgagcttggcgtggataagcaggacgtcgataacgcactggagatgaatttctccggcagccgggcaggactgtacagagaaggaagcgatctgttacccgtggtggtgcgcccgccggaaagcgagcggctggacgccaaccacctgaacaacgtcctggtctggagccagacccggcagcagtatattccgctgagcaacgtcgtcagcggcttcgcgctggagtgggaagatccgctgatcctgcgtcgcgaccgctcgcgcgtgctgaccgtgcagaccgaccctgacccgctaagccagcaaacgtccggcgatattctcgcccgcgtgaagccgcaaatagatgccctgcccctgcctcacggctacagcattgagtggggcggggacgcggagaattccagcgaagcgcagcaggggctatttaccacgctgccgatcgggtatctggtgatgtttgtgatcacggtgctgatgttcagttcggtgaaaaacgccgtcgctatctggctgaccgtgccgctggcgctgatcggcgtgacgccggggtttttaattaccggcatcccctttggctttatggcgttgattggcctgctgagcctgagcgggatgctgatccgcaacggcattgtgctggtggaagagatagagcagcagaaagcgcagcaggatcagcacagtgcgatcgtttacgccgccacgtcgcgcctgcgtcccatcctcctcaccgcctttacgaccgtactcgacctcgcccccctgctgctggatgtgttcttccagagcatggccgttgtgattatgtttgggcttgggtttgctacaatcctgacgctgctggtactccccgtaatttacgcgtgtttccatcgtaaggacaaagctgaacaacaatga

SEQ ID NO: 1046 - DNA, 1551 bp, Enterobacter cloacae
aggaaaccgcgcacagctgatctcctcacttttgtttcacaggcgtgtgacatactatcgggtaaagccgcacacctgtggaacaaggagacagacatgaataataagggctccagcctgaccccggctcaggcactggaaaaactcgacgcgctgtatgaacagtccgtcaatgcactgcgcagcgccatcagtgactatatcgaaacagggaaacttcccgatgaaaaggccagaacccagggcctttttgtttatccatcgctctctgtcacctgggacggtagcgccagcagcaatccgaaaacccgcgcctatgcgcgtttcacccactccggctgttacagcacaaccatcacgcgacctgcgctgttccgcccctacctggaagagcagcttaccctgttgtatcaggattacggcgcgcatatcagcgttgagccgtccctgcacgagatcccttacccgtacgtgatagacggctcagcgctgacgctggatcgctccatgagcgcagggctgacccgtcatttcccgaccactgagctgtcgcagattggcgatgagacggcggacgggatctatcacccggcagagttttcaccgctgtcgcactttgatgcccgccgtgtcgatttctcgctggcacgcctgcgccactacaccggcacgccagccgaacatttccagccgttcgtgctgtttaccaactacacccgctatgtagacgaatttgtccgctggggctgtagccagatcctcgccccggacagcccttacgtcgccctctcctgcgcgggcgggatctggatcaccgccgaaaccgaagcaccggaagaggccatctccgacctggcgtggaaaaagcaccagatgcccgcctggcacctgatcaccgccgacggtcagggcattacgctgattaacatcggcgttggcccgtcgaatgcgaaaaccatctgcgaccatctggcggtactgcgcccggacgtctggctgatgatcggccactgcggcggcctacgtgaaagccagctgattggcgattacgtcctcgcccacgcttatctgcgtgacgaccatgttcttgacgcggttctgccgccggatattcctatcccgagtatcgcggaagtgcagcgcgctctgtacgacgccaccaaagaggtgagcggcatgccgggtgaagaggtgaaacagcgcctgcgtaccggtacggtcgttaccaccgacgatcgtaactgggagctgcgctattccgcctccgccctgcgtttcaatcttagccgtgcggtcgcaatcgatatggaaagcgccaccattgccgcgcagggctaccgcttccgcgtcccttacggcacgctgctgtgcgtgtccgataatccgctgcacggcgagatcaaactgccgggccaggcgaaccgtttttacgaaggggcgatctcagagcaccttcagattggtattcgcgccatcgatttactgcgtgcagagggcgacaaactgcattcccgcaagctgcgcaccttcaatgagccaccgttccgctga

SEQ ID NO: 1047 - DNA, 538 bp, Enterobacter cloacae
cgtgtcctaaagcatataattttaacggctatttgcgcattgctcaatctatacgcaaagaagtttagatgtccagatgtattgacgtccatactttcaatgtttactctggtgcctgacttttcacctcattcgccaggaagcctcaccatgacgcgtaaacaggccaccatcgcagtgcgtagcggattgaatgatgacgagcagtacggctgcgttgtcccgccaattcatctctccagtacctataatttcaccggatttaatgaacctcgcgcgcatgactactcgcgtcgcggcaatcctacgcgcgacgtcacccagcgcgcgctggcggaactggaaggcggcgcaggggcggtattaaccaataccggcatgtctgccattcacctggtaaccacagtgttcctgaaacctggcgatctgctggtggcaccacacgaatgttacggcggtcactatcctctgtttgatatccctgctaacactggcttctacctcgtcttcctacctccttcttcgatctacactaccc

SEQ ID NO: 1048 - DNA, 312 bp, Enterobacter cloacae
cccacttcggtgaacttagtggcttcaactttgatgaacggcgcgttagccagtttggccagacgacgggcgatttcggttttacccacaccggtcgggccgatcatcagaatattttttggcgtcacttcgtggcgaagctcttcgtcgagctgcatgcgacgccagcggttacgcagtgcgatagccacggagcgcttggcattgtcctggccgataatgtgtttgttcagttcgctgacaatttcgcgtggggtcatttcagacatgggcgatccttacgctttagacggtaattcttcgatggtgtga

SEQ ID NO: 1049 - DNA, 222 bp, Enterobacter cloacae
ggttctcccatgaaaaaagatattcacccgaaatacgaaatgattactgcaaactgctcttgcggtaactctatccagatccgctctaccgtgggtcacgatctgaacctggacgtgtgcggcaaatgccacccgttctacactggtaagcagcgtgatgttgcaaccggtggccgtgttgaccgcttcaacaagcgtttcagcatcccgggcgctaaataa

SEQ ID NO: 1050 - DNA, 765 bp, Enterobacter cloacae
aattacactgcgctcgacataaattcttatttgccatttcaacagcgatggctttcagggtgtatttactttgagggaaaaaggatgaaactgaagcaacttttattcgtgcttccattactatcgtgcgcggcgcaggcgggatatgttgattaccgacacgagtattacgacgatggacgtaactatgaccgtgtgtacatgtcacaccgtttcgggacgggctttggtgtggccgtagaggccgtctcacgctcagacgaaaagcaatctaatgatgcgctcaataatatggagagtaacagcaacgaatatactgccagctaccagtttacctggcagggatttatctggcagccgggtgtcgcggttgaaatgggtgacgacatggctatttataaaccctatttacgcgtacagtataatattaatgaaagctggtggacggcgttccgttatcgtaccgaatatacccgccgtaatgcagacggtaaagatgacagactggtatatcgcccggaaatgtggctgggatataatattgataactggatgtttgagctgaacggaatttataaattcgccgacaacgaagatctgtataacaacaaaaaagaggattacgaatataacttccgcgtggcgtataacatcgattcgtgggtgccattcgtggaggtgggtaatgtctcttccggctataacactgctaccactgacgaccgacaaacgcgtctgcgtgtcggcttaggttacaacttctga

SEQ ID NO: 1051 - DNA, 1080 bp, Enterobacter cloacae
ctatctgtaaaaatggtgcggtccgcagttcggtgttcaggcgaggagaagacgttgaagtccaggaaagaggttgcctcggcgaccatgaaagacgttgccgagaaagcacaagtctcaacagcaaccgtgtcccgcgcattgatgaaccctgacaaagtctcccaggcgacccgaaaccgggttgaaaaggcggcgcttgaggtcggttattttccgcaagccatggggcgtaacgtaaaacgcaacgaatcccgcaccatcctggtgatcgtgccggacatctgcgatcccttcttcagcgaaatcatccgcggcattgaagtcacggccgccgcccagggctatctggtgctgattggcgattgtgcccaccagaaccagcaggaaaaaacgttcatcgacctgatcatcaccaagcagattgatggcatgctgctgcttggctcacgcctgccgtttgatgccagcattgaagaacagcgcaatttaccgccgatggtcatggcgaacgaattcgcgccggagctggagctgccaaccgttcatatcgataacctcaccgccgcgttcaacgccgtgaactatcttcaggaactggggcataagcgcatcggttgtatcgccggaccagaagagatgccgctgtgtcattaccgcttgcagggctacgttcaggcgctgcgccgtaccggggctatcgtcgatccgcactacattgcgcgcggtgatttcacctttgaagcgggcgggcaggcgctggaaaaattgctggccttgccagaaccgcctaccgcggtcttctgccacagcgacgtgatggcgctaggggcgttatcctacgccaaacgtcacggcctgcgtgtgccgcaggacctgtcgataatcggttttgataatatttcgctttcggagttttgcgatccgccgctttcgaccgttgcacagccgcggtatgacattggccgggaagcgatgctgcttttgctggatcagctgcacggtcaaacagttagcagtgggtcacggctactggattgtgagctaattgtgcgcggctctacccaggcattaacttaa

SEQ ID NO: 1052 - DNA, 459 bp, Enterobacter cloacae
acgaagtgccgtggaacgaacaaaccccggcgcagcgtcagcaaacattgcagcgccagcgtcaggctcagcagcaaacgcaacagcagcagtggacgcagacgcagccggtacagcagccgcgttcacaaccgcagcagcagacgcgtaccgtacaaactcagcctgtccagcagcaaccgaaggcgcagccgcagaagcaaacggcacagccgtatcaggatctgttgcagacgcctgcgcataccactgcgcaacagccaaaaacgcagcaggctgcgccggtcaccaaagagaccgaggtgccgaagcagacggctgagaaaaaagatgaacgccgctggatggttcagtgcggttcgtttaaaggcgccgaacaggcagaaacggtgcgtgctcagctggcatttgaaggatttgactcacgcattaccaccaataacggctggaatcgcgtag

SEQ ID NO: 1053 - DNA, 546 bp, Enterobacter cloacae
ccagggggtctgctcgtgacaacaatagtaagtgtacgccgtaacggccaggtggtaattgccggtgatggccaggccacgctgggtaataccgtcatgaaaggcaacgtgaagaaagtacgtcgtctttataacgacaaagtgatcgccggtttcgcaggcggcacggctgatgccttcacgctgtttgaactgtttgaacgcaaactggaaatgcatcagggtcatctggtgaaagccgccgttgagctggcaaaagactggcgtaccgaccgcatgctacgcaagctcgaagcgctgctggccgtggctgacgaaaacgcctcgctgatcatcaccggtaacggcgacgtagttcagcctgaaaacgacctgattgccatcggctctggcggcccgtacgcccaggccgcagcccgtgcgctgttggaaaataccgacatgaacgcgcgcgatatcgcggtgaaagcgttggatattgcaggtgatatctgcatctataccaaccacaatcacaccatcgaagaattaccgtctaaagcgtaa

SEQ ID NO: 1054 - DNA, 1074 bp, Enterobacter cloacae
ggatcgcccatgtctgaaatgaccccacgcgaaattgtcagcgaactgaacaaacacattatcggccaggacaatgccaagcgctccgtggctatcgcactgcgtaaccgctggcgtcgcatgcagctcgacgaagagcttcgccacgaagtgacgccaaaaaatattctgatgatcggcccgaccggtgtgggtaaaaccgaaatcgcccgtcgtctggccaaactggctaacgcgccgttcatcaaagttgaagccactaagttcaccgaagtgggctatgtgggcaaagaagtggactccatcatccgcgatctgaccgattcggcgattaagatggtgcgcgtccaggcgattgagaaaaaccgctatcgcgccgaagagatggccgaagagcgtattctcgacgtgctgatcccaccggcaaaaaacaactggggacaggctgaacagcagtctgaaccttctgctgcgcgtcaggcattccgcaaaaaactgcgcgaaggcgagctggacgataaagagattgagatcgatctcgctgccgcgccaatgggcgtggaaattatggcgcctccgggcatggaagagatgaccagccagttgcagtccatgttccagaacctgggcgggcaaaagcagaaagcgcgtaagctgaaaatcaaagacgcgatgaagctgctgattgaagaagaagccgcgaagctggttaacccggaggagctgaaacaggacgctatcgacgcggttgagcagcacggtatcgtgtttatcgacgaaatcgacaaaatctgtaagcgcggcaacgcgtccggcccggatgtctcccgcgaaggcgttcagcgcgacctgctgccgctggtggaagggtgcaccgtctccaccaagcacggcatggttaagactgaccacattctgtttatcgcctccggtgcgttccagattgccagcccgtctgacctgatcccggaactccagggtcgtctgccaatccgcgttgagttgcaggcgctgaccaccgaagatttcgaacgtatcctgactgagccaatattaaccccgcggctggaaaat

SEQ ID NO: 1055 - DNA, 2325 bp, Enterobacter cloacae
gttctttggcgtaaaatacaccaaaggcggcgaatcatacagaatttgaccaacgtatgcaaactgatccgcacgccgctttcactaatgtgtatactaacgcgccacttttcaagtcaggaagattcgatgcccgtcgctcacgttgccctgcccgttccgcttccccgcacctttgactacctgctgcccgacagcatgagcgccaaagcgggctgtcgcgtgaccgtgccgtttggcaaacagcagcgcgtggggatcgtggtgtccgtcagcgacaaaagcgaactgccgcttaacgagctgaaatcggttgttgaggtgctggacagcgagccggtttactccaccagcacctggcgactgctgctgtgggcggcagattattatcatcatccgattggcgacgtcctgttccatgccctgcccattatgctgcgccagggtaagagcgccagccacgcgccaatgtggtactggtttgccaccgagcagggccaggcggtggacattaacagcctgaagcgctcgcaaaaacagcagcaggcgttggccgcgctgcgccagggaaaaatctggcgccatcaggtcgacgagcttgaggtaagcgaaaccgcgttgcaggcattaaggaagaaagggctgagcgagctggccagtgaagcacctgcccttcacgactggcgcgacggcttttccgtctcgggcgatcgtctgcgtctgaataccgagcaggccaccgccgtaggcgcgattcacagcgctgccgatcgtttttccgcctggctgctggcgggcgtcaccggctccggtaaaaccgaagtgtatctgagcgtgctggaaaacgtgctcgcgcagggcaaacaggcgctggtgatggtgccggaaatcggcctgacgccgcaaaccatcgcgcgtttccgtgaacgttttaatgcgcccgttgaggttctgcactccggcctgaacgacagcgagcgcctcagcgcctggctgaaagcgaaaaacggcgaagcggcgattgtgatcggcacccgttcatcgctgtttacgccgtttaaaaatctcggcgttatcgtgatcgatgaagagcatgacagctcctataaacagcaggaaggctggcgctatcacgcccgcgacttagccgtgtaccgcgcccacagcgagcaaatccccattattctcgggtctgccacccccgcgcttgaaacgctgcacaacgttcgccagcgtaaataccacatgctgcgcctgacgcgccgcgcgggaaatgcccgcccggccattcagcatgtgctggatctgaaaggtcagcaggtgcaggccgggttagcgcctgcgctgattagccgcatgcgtcagcatttgcaggcgggcaaccaggtgatcctgttcctgaaccgccgcggctttgcgcctgcgctgctgtgccacgactgcggctggatcgcggagtgcccgcgctgcgatcactactacaccttccaccaggctcagcgccatttgcgctgccaccactgcgacagccagcgtccggtcccccgtcagtgcccgtcctgcggctcaacgcacatcgtgccggtcggtctgggaacggaacagcttgaacaggcgctcgcgcccttcttcccggatgtgcccatctcccgtatcgacagggataccaccagccgtaaaggggcgctggagcagcaactggcggaagtacatcgtggcggcgcgcgtatcctgattggtactcagatgctggcgaaagggcaccacttcccggacgtgacgctggtcgccctgctggacgtcgacggcgcgctgttctccgcggattttcgctccgccgagcgtttcgcccagctttatacccaggttgccggtcgcgctggtcgagcgggtaagcagggcgaggtggtgctgcaaacgcaccaccctgaacatccgctgctgcaaaccctgctgcacaaaggctatgacgccttcgcggaccaggcgctggccgaacgtcagacgatgcagcttcccccgtggaccagccacgttatcatccgtgcggaagaccataataaccagcaggcgccgctgttcctgcaacagctgagaaacctcctgcaagccagcccactggtggataatcagctgtggattttaggcccggtacccgcgctcgccccgaaacgcggcggccgtttccgctggcaactcttacttcagcacccctcgcgtatccgtttacagcagatcgtcagcggcacgctggcgctgatcaataccctgccggaagcgcgaaaagtgaagtgggttctggacgtcgatccgattgaaggctga

SEQ ID NO: 1056 - DNA, 327 bp, Enterobacter cloacae
aggtatctcatggctgaatggagcggcgaatatatcagcccatacgctgagcacggtaagaagagtgagcaagtcaagaaaatcacggtgtccattcctctgaaggtgttgaagatcctcaccgatgaacgtacgcgtcgtcaggtgaacaacctgcgtcacgccaccaacagcgaactgctgtgcgaagcgttcctgcatgcgtttaccggccaaccgttgccgaacgatgacgatctgcgtaaagaacgcagtgacgaaatcccggaagaggcgaaggtgatcatgcgtgaactgggtatcgacccggagacctgggaatactaa

SEQ ID NO: 1057 - DNA, 996 bp, Enterobacter cloacae
cgaacgaataaatacagcgaaacgatagtggcacaacgagattatgtacgtcgcggccagccggcaccttcgcgacgcaaaaagagtagttcaaaaagcaagcaacgtagcctgtctgctgtctccccagccatggtcgccattgctgcggccgtgctggtggcctttattggcggcctctacttcattacgcatcataaaaaagaagagtctgaagcccttcagggtaacaaggtcgtcggcaacggccttcctcctaagcctgaagagcgctggcgctacattaaagagctggaaagccgccagcctggcgtacgtgcgcctaccgagccttctgccgggggtgaagtgaagaatgccgatcagctgacggacgaacagcgtcaattgctcgctcagatgcaggcggacatgcgccagcagcctacgcagttgaacgaagtgccgtggaacgaacaaaccccggcgcagcgtcagcaaacattgcagcgccagcgtcaggctcagcagcaaacgcaacagcagcagtggacgcagacgcagccggtacagcagccgcgttcacaaccgcagcagcagacgcgtaccgtacaaactcagcctgtccagcagcaaccgaaggcgcagccgcagaagcaaacggcacagccgtatcaggatctgttgcagacgcctgcgcataccactgcgcaacagccaaaaacgcagcaggctgcgccggtcaccaaagagaccgaggtgccgaagcagacggctgagaaaaaagatgaacgccgctggatggttcagtgcggttcgtttaaaggcgccgaacaggcagaaacggtgcgtgctcagctggcatttgaaggatttgactcacgcattaccaccaataacggctggaatcgcgtagtgattggaccggtcaaaggcaaagaaaatgcagacggcaccatttcccgtttgaaagtggctggccacacaaactgcattcgactcgcctccgggggttga

SEQ ID NO: 1058 - DNA, 2142 bp, Enterobacter cloacae
ctgaacggtgatcagcatgcaggactgctggtactgccaggcatggatcccaatgcctgccatctgcctgacctgcgagttcgcgccatccgctcccaccaccagctttacggccagctcatcgttgttgtccagcgtcaggagatacccgccctcatgacgatgcaggcctttcagcgagtccggcacgcgcagcgtcaccttcgggtgcgcctccagcgcctgccagagtgcctgctggagcacgttgttttccaccatatagcccaggcgcggcagtttcagctcggcggcatcaaacgacacatgagcattttcccactcccaggtttcgagacggctgtaaggatgcgcgcgcatcgccagcaccgcctcccagacgcccagcccgcgaagcagatcaacagaggccgcgctgatggcggaaatacgtacgtccggttggctggcaggatcgaatgccggcggagccgcctgttcaataacggttacgtcaaatccctgctgcgccagccccagcgccagtgcgccgccgaccataccgccgccaacaacggcaacttcggtgttcaggagtgtcatggtcactattccttattgaagaataccttaagtttaccggatttttgcggccctgaggttgacaaccttcatactggtcacaaccgcaccaaagcattacaatacgcggcttgcaatcctgagctgagcaagtcgatgactaaaaaactccatataaaaacctggggctgtcagatgaacgaatacgattcatcgaagatggccgatctgctggataccacccacggataccagctgactgaaaatgcgaaagaagccgatgtgctgctgctgaacacctgttcaattcgtgaaaaagcacaggaaaaagtctttcatgtgttaggccgctggaagcttctcaaacggaaaaatccggacctgatcattggcgtgggtggctgcgtcgcatcgcaggaaggtaagctgatccgccagagagccccctatgtggatatcgtttttggccctcagaccctgcaccgcctgccagagatgattaaccaggttcgcggcagccgtagcccggtggttgacgtgagcttcccggagatcgagaaatttgaccgtctgccagagccgcgcgctgatggcccgaccgccttcgtctccatcatggaaggctgcaacaaatactgtacttactgcgtggtgccttacacccgcggtgaagaagtgagccgcccggcagacgatatcctgtttgaaatcgcgcagcttgccgcgcagggcgttcgcgaagtgaacctgctggggcagaacgtgaacgcctggcgcggggaaaactacgacggcaccaccggcagctttgctgaactgctgcgtctggtggcggcgattgacggcatcgaccgcattcgctttaccaccagccatccgatggaatttaccgacgacattattgacgtctatcgcgatacgccagagctggtgagcttcctgcacctgcctatccagtgcggctctgaccgcgtgctgaacctgatgggtcgtccacatacggtgctggagtataagtccaccatccgcaagctgcgtgaagcgcgcccggatatccagattagctccgactttatcgtcggcttccctggcgaaaccgctgatgacttcgagcgcaccatgaagctcatcggcgaggtgaatttcgacgtcagctacagctttatcttctctgcgcgcccgggcacccctgcggccgatatggttgatgatgtaccggaagaagagaaaaagcagcgtctgtatattctacaggagcgtatcaaccagcaggccaacgcctggagtcgtcgcatgctcggcactgtccagcgtattctggtggaaggcacctcccgtaagagcatcatggaactatctggtcgaaccgaaaataaccgcgtggtgaattttgaaggcaccccggacatgatcggtaagtttgtggacgtcgagattgtcgaagtgctcacgaactcgctgcgcgggaaggtggtacgcactgaggatgaaatgggtctgcgaattgcacagactccggaatccgttatctctcgcacccgcaaggtcaacgactctggcgtaggtatttaccagccgtga

SEQ ID NO: 1059 - DNA, 474 bp, Enterobacter cloacae
acagaaatgagtcaggtgatcctcgatttacagctggcctgtgaagataattccggcatgccagaagaggcacagtttcagaaatggctggatgccgttatcccccagtttcaggaagaatcagaggtcacgattcgcctggtggatgaagcagaaagccatgagctcaacctgacctaccgcgggaaagataagccgaccaacgtgctctctttcccgttcgaagcccctccgggcattgagatgccgctgctgggcgatctgatcatctgccgtcaggtggttgagcaggaagccaaagagcagcaaaagccgctggaagcgcactgggcacacatggtggtgcacggtagcctgcatcttctgggttacgaccatattgaagatgacgaagcggaagagatggaatccctcgagacagagataatgcttgctctgggctatgaggatccgtacattgccgagaaagaatag

SEQ ID NO: 1060 - DNA, 963 bp, Enterobacter cloacae
tcagtcactgactaccatgccgccgcgcagggacatagcgcggcggttaacgttgaactaacaagagaacccttaacaaacgccatgagcgacgacaattcacacagtagcgacacgacaaccactaaaaagggatttttctccctcattctgaaccagcttttccacggcgaaccgaaaaaccgtgatgaactgctggagctgattcgtgattccgggcagaacgaccttatcgacgaagatacgcgcgaaatgctcgaaggggtgatggacatcgccgaccagcgcgtccgcgacatcatgatcccccgctcgcagatgattaccctgaaacgcaaccagacgctggacgagtgcctcgatgtgattatcgaatcggctcactcacgtttcccggtcatcagcgaagataaagatcacattgaagggattttgatggcgaaagatctgctgccgtttatgcgcagcgatgccgaagccttcagtatggaaaaggtgttacgcccggccgtagttgtgccggaaagtaagcgtgtggatcggatgctgaaggagtttcgctcccagcgctatcacatggcgattgttattgatgaatttggtggcgtttccggtctggtcacaatcgaagacatccttgagctgatcgtgggcgaaatcgaagacgagtatgacgaagaagaggatatcgacttccgtcagctgagccgccacacctggaccgtgcgcgcgctggcctccattgaagacttcaacgatacctttggcaccagcttcagcgatgaagaagtggacaccattggtggtctggtgatgcaggccttcggccatcttccggcccgcggtgaaaccgttgacatcgatggttaccagttcaaggtcgcaatggctgacagccgacgtattattcaggttcacgtcagaatgccggacgactcaccggtgccaaaactggaagattaa

SEQ ID NO: 1061 - DNA, 1227 bp, Enterobacter cloacae
gtatttaccagccgtgatcctcctggcctgcctgtccggcaggccttgtatttcctctcatcacccccaatatctaccgcaacgcttgcgcctttattctgtggcgtgaataatttcggtaatgaccgttttattacgccgtgtggccacaggtcagttaaccaattaaagaggaacagtttgaacatagatacgcgtgaaattagccttgagcccgcagacaacgctcgcctgctgagcctgtgcgggccgtttgatgacaacatcaaacaactggagcgacgtctgggtatcgaaatcaatcgtcgcgataaccatttcaaactcaccggacgcccaatctgcgtcaacgccgcggcagatattctccgcagcctgtatgttgataccgccccgatgcgcggtgagatccaggacattgaacctgaacagatccacctggccatcaaagaggcgcgcgtgcttgagcagagcgcggagagcgtgccggactatggcaaagccatcaacatcaaaactaaacgcggcgtgattaagcctcgtaccccgaaccaggcgcagtacatcgccaatattctcgaccatgacatcaccttcggcgtgggcccggcgggtacgggtaaaacctatctggccgttgctgctgcggtcgatgcgcttgagcgtcaggagatccgccgtatcctgctgacccgccctgctgttgaagccggtgaaaaactgggcttcctgccgggcgatctgagccagaaggtcgacccgtatctgcgcccgctgtatgacgcgctgttcgaaatgctcggcttcgagaaagttgaaaagctcatcgagcgtaacgtgattgaagtggccccgctggcctacatgcgtggccgtacgcttaacgacgcgttcatcattctggatgagagccagaacaccactatcgaacagatgaagatgttcctgacgcgtattggctttaactcgaaagcggttatcaccggtgacgtcacccagattgacctgccgcgtaacaccaaatcgggtctgcgtcacgccatcgaagtcctggccgaggtagaggaaatcagcttcaacttcttccacagtgaagacgtggtacgccatccggtggtcgcgcgtatcgttaacgcttatgaggcctgggaagaggcagatcagaagcgcagggccgaactggccgcagaacgtaagcgcgaagcgcaggagcatgaacagaaatga

SEQ ID NO: 1062 - DNA, 768 bp, Enterobacter cloacae
caagcttgcataacactgcactcgcattgcgcgagatataacaacatcacaatgggtatctatgcgtcactggcgctgataagaaaggagttgggtatgcaattacgtaaactggccacagcaatgctggttatgggaatgtctgcgggggttgtccacgctgaagacgctccggcagcaggaagcactctcgacaagattgccaaaaacggcgtgatcgtggtcggccaccgtgaatcttctgtcccgttctcttactacgacaacacgcaaaaagtcgtgggctattcacaggattactccaacgccatcgttgaagccgtgaagaaaaagctgaacaaacctgacctgcaagtgaagctgatccccatcacttcacagaaccgtattcctctgctgcaaaacggcacatttgattttgaatgtggctcaaccaccaacaaccttgagcgtcagaaacaggccgctttctcggacaccatcttcgttgtgggcacccgcctgctgacgaaaaaaggcggcgacatcaaagattttgctgacctgaaaggcaaagcggttgtcgtgacctccggtaccacgtccgaagtgctgctgcacaagctgaacgacgaaaagaaaatggacatgcgcatcatcagcgcgaaagaccatggcgactccttccgtaccctggaaagcggccgtgccgtcgcgtttatgatggatgacgctctgctggcaggcgagcgcgccaaggcgaagaaaccagacaactgggaaatcgtc

SEQ ID NO: 1063 - DNA, 1539 bp, Enterobacter cloacae
atggcatttgccccactcgttgaacgccagcgcgtccgtttgctgctggcgctgttactcggagccagcggtacgctggctttttctccttacgatatctggccagccgctattctctccctgatggggctacaggggcttaccctgaaccgtcgtccggtacaggccgcggccatcggctacttctgggggctgggactgtttggctctggtatcaactgggtctacgtcagtatcgcgcaatttggcggaatgccggggccggttaacgtcttcctggttgtgctgctcgccgcctatctctcgctctacaccggcctgttcgcgggcatcctgtctcgcctgtggccaaaaacgacctggctgcgcgtggcgatagcggcacccgttgtctggcaaatcaccgaatttctgcgcggctgggtactgaccggcttcccgtggttgcagttcggctatagccaggtagacggcccgctgaaaggcctggccccggtcatgggcgtggaagccatcaacttcctgttgatgatcgtcagcggcctgctggtgctggccctggtgacacgtaactggaagccgctggttgccgcgttaatcctgtttgccctgcccttcccgctgcgttatatccagtggtttacgctggagcccgcgcgcgccacgcaggtttctctggtccagggcgatatcccgcagtccctgaaatgggatgagaatcagctgctgaacacgctgaaaatctacgccaacgccactgaaaaggtgatgggcaaatcgcagctcatcatctggcctgagtctgcgatcccagacctggagatcaatcagcagcccttcctgaagatgatggacgatctgctgcgcgcacgcggcagtacgctgatcaccggaattgtggatgcgcgtctcaatcagcagaaccgctatgacacgtacaacacgatcattacgctcggtaagggcagcgaatacagctatacctccaccaatcgttacaacaaaaaccaccttgtaccgtttggcgaatttgttccgctggagtctattctgcgcccactggcaccgttctttgatttgccgatgtcctcattcagccggggcccttacgttcagccgcagctgcatgcgcacggttttgccctgacggccgccatttgctacgagattatcctcggcgagcaggtgcgcgataatttccgcccggacaccgactatctgctgaccatctcaaacgatgcgtggttcggtaaatcgattggtccgtggcagcacttccagatggcgcgaatgcgttctctggagctggcgcgtccgttgctgcgcagcaccaataacggcattaccgccgtgattggtccgcagggtgaaatccaggccatgatcccgcaatttacccgtgaggtgctgagtactaacgtcacgccaactaccgggctcaccccttacgcgcgcaccgggaactggccgctgtggattttgaccgtgctgttcggctttggcgcagtgctgatgagcctgcgtcagcgtcgtaaataa

SEQ ID NO: 1064 - DNA, 1188 bp, Enterobacter cloacae
ggaatagtgaccatgacactcctgaacaccgaagttgccgttgttggcggcggtatggtcggcggcgcactggcgctggggctggcgcagcagggatttgacgtaaccgttattgaacaggcggctccgccggcattcgatcctgccagccaaccggacgtacgtatttccgccatcagcgcggcctctgttgatctgcttcgcgggctgggcgtctgggaggcggtgctggcgatgcgcgcgcatccttacagccgtctcgaaacctgggagtgggaaaatgctcatgtgtcgtttgatgccgccgagctgaaactgccgcgcctgggctatatggtggaaaacaacgtgctccagcaggcactctggcaggcgctggaggcgcacccgaaggtgacgctgcgcgtgccggactcgctgaaaggcctgcatcgtcatgagggcgggtatctcctgacgctggacaacaacgatgagctggccgtaaagctggtggtgggagcggatggcgcgaactcgcaggtcaggcagatggcaggcattgggatccatgcctggcagtaccagcagtcctgcatgctgatcaccgttcagtcagaaaacgcgccgggcgaaagcacctggcagcattttacgccgaacggcccgcatgcattcttaccgctgtttgataactgggcttcgctggtgtggtacgacaaaccggcgcgcattcgacagttgcaggggctgtccatggatcagttgcagcgcgaaatccgccagcacttcccgagccgtctgggcaacgtgaccccggttgccgccggcgcattcccgctgatgcgacgccatgcgttgcagtatgcccgtgaaggactggtgcttgtgggggacgcggcgcacaccattcatccgctggcggggcagggggtgaatctgggataccgtgacgtcgatgcgttactggatgtgctgggtaacgctcgcgcccacgcggaagcctgggccagccatcaggttctgaagcgctaccagacgcgccgtatggcggataacttcattatgcagtcggggatggatctgttctatgccgggttcagcaatgatgttggtccggtgcgtatagtgcgcaatattggattgatggcagcggaacgtgccggtggtctgaagcgtcaggccctgaagtacgccctcggactctga

SEQ ID NO: 1065 - DNA, 297 bp, Enterobacter cloacae
ggtgaaggcatcaggccgcactattctgaacaacaaaaacaaaaaagcccgcagagcgggcttgtttgtttaaagtggctggggtgcagggattcgaaccccggaatgctggtatcagaaaccagagccttaccgcttggcgacaccccaattgcgttaaacaaactgcttaacgactttaaagtggctggggtacgaggattcgaacctcggaatgccggaatcagaatccggtgccttaccgcttggcgataccccaacaatgttcagtttaccgaatcgtattcgataacgtaa

SEQ ID NO: 1066 - DNA, 246 bp, Enterobacter cloacae
ccagtactgcaatcttcgatggctggggtacctggattcgaaccagggaatgccggtatcaaaaaccggtgccttaccgcttggcgataccccaataccgcggagaaccgcatgatcgaagaaatatggctggggtacctggattcgaaccagggaatgccggtatcaaaaaccggtgccttaccgcttggcgataccccatccgtgcaacgcttacctgggaatggtgcgggaggcgagacttga

SEQ ID NO: 1067 - DNA, 246 bp, Enterobacter cloacae
tcgaagaaatatggctggggtacctggattcgaaccagggaatgccggtatcaaaaaccggtgccttaccgcttggcgataccccatccgtgcaacgcttacctgggaatggtgcgggaggcgagacttgaactcgcacaccttgcggcgccagaacctaaatctggtgcgtctaccaatttcgccactcccgcaaaaaagatggtggctacgacgggattcgaacctgtgaccccatcattatga

SEQ ID NO: 1068 - DNA, 378 bp, Enterobacter cloacae
gtgatgtgctctaaccaactgagctacgtagccagtactgcaatcttcgatggctggggtacctggattcgaaccagggaatgccggtatcaaaaaccggtgccttaccgcttggcgataccccaataccgcggagaaccgcatgatcgaagaaatatggctggggtacctggattcgaaccagggaatgccggtatcaaaaaccggtgccttaccgcttggcgataccccatccgtgcaacgcttacctgggaatggtgcgggaggcgagacttgaactcgcacaccttgcggcgccagaacctaaatctggtgcgtctaccaatttcgccactcccgcaaaaaagatggtggctacgacgggattcgaacctgtga

SEQ ID NO: 1069 - DNA, 588 bp, Enterobacter cloacae
tttttttgcagaaaatattgggtgaaaaatatgcaaattggctacgttagggtgtcaacaaatgaccaaaacacagatcttcagcgacaagctctcgaacgagcaggatgtgaacaggtttttgaggaaaaaatgagcgggacggtagcgaaccggccagcgcttaaaaagcttctgcaaacgctgaatgagggcgatacgctggtagtgtggaagctggatcgcctcgggcgaagcatgcggaacctggtactgctggtagacgaactccggcagcgcggcatccacttcaaaagtcttacggacagcatagacacctccagcccaatggggcgtttcatattccacatcatgtcagccctggccgagatggagagggagttaatcgtggaacgcacccgggcaggactggcggctgcccgggagaaagggcggataggcggcagacggcctaagttaaccccagagcaatgggcgcaggctggcaggctgatcgcaaacggagtggacagaaagcaggtggcgattatttacgacgtagcggtttgcacgctgtataaaaaattccctgcatccaaaccggcttaa

SEQ ID NO: 1070 - DNA, 501 bp, Enterobacter cloacae
acagtcgctacgactaaggtgtattgcgcgctgacagaaacgaaactactgtatataaaaacagtattagaggtatgcgtaatggaatttatcaggcctactgaactgcgagaaattatcgcgatcccactatacagcgatttggtgcaatgtggttttcccagccccgcagctgattatgtagagcagcgtattgatcttaatgagttgcttgtttcccatcccagctcaacgtatttcgttaaagccgcaggggattcgatgatagaagcggggatcagcgacggtgatctgctggtggttgatagctcacggactgttgaacacggagatattgtcattgcggctgtggatggggaatttactgttaaacgtcttcaactgcgtccaactgttcagctcaatccgatgaacggtgcttacagcccgattgtggtaggcagcgaagatacgctggatgttttcggcgtagttactttcattgttaaatcggccagctga

SEQ ID NO: 1071 - DNA, 531 bp, Enterobacter cloacae
ggttccttccagccccgtggtgaagactggtcgatggatttcgtcatggacgcactttccaccggtcgcaggatcaagtgtcttacctgcgtcgatgatttcacaaaggaatgcctgacggtcactgttgcctttgggatttcaggcgttcaggtcacgcgtattctggacagcattgcactgtttcgaggctatccggcgacgataagaactgaccaggggccggagttcacttgccgtgcactggatcaatgggcctttgagcatggtgttgagttgcgcttaatccagccgggcaagccaacgcagaacggatttattgagagctttaacggacgatttcgcgatgaatgtttgaatgagcactggttcagcgatatcgttcatgccaggaaaattattaatgactggcggcaggattataacgaatgccgcccgcactccacgctgaattatcagacaccgtctgaatttgcagcgggctggagaaagggtcattctgagaatgaagattccgacgttactaactga

SEQ ID NO: 1072 - DNA, 645 bp, Enterobacter cloacae
tcatctgaggcactaatgaaccaaacacaatttcagaaggcggctggcatcagcgccgggttatctgcgcgctggtttccgcatatcgacgccgctatgaaggaatacggcataaccacaccgcttgatcaggcgatgtttattgcccagatggggcatgaaagcaccaggtttacccgtgttgtggaaaatcttaattatgcggctgaaaacttagtacctacgttcggcagccaccgcattactccacagcaggccgccgcccttggcagaacggcagctcacccggctaaccagaaagcgatcgctaatctggtttacggcggtgagtggggaaaagaacacctgggcaatcaggttgccggtgatggatggaaatatcgcggtcgcgggctaaaacaggttaccggcctgagtaactatcacagttgtggctacgcgttgaaactggaccttgttacccacccggagctgcttgaacaggatgaatacgccgcgcgctcagccgcatggttctatgcctcccgtggttgcctgcttcattccggcgacgttgagcgcgtgacactgttaatcaatggcggccgcaacgggctggataagcgccgcgagctgtttaacctggcgaaatcagttctggtatga

SEQ ID NO: 1073 - DNA, 1023 bp, Enterobacter cloacae
gggcggttttttattggagtttatatggcaaaaccggactggggcgagcttcagcaacggttcctgtccgaacatgccgcaaccggcgtatcaccaaaggaatggtgtgaagcgcagggactgaactatgctaccgcacgtcgatatatcaaaaaaccttctgcgcaatctgtgcaaaaatctgcgcagaaaaaagtgcgcactgcgcaaaaagaacaaagcgcagaagagctggtggatgatgatggattaacggcacagcaaagacgttttgtcgcagaatacctaaaggatggtaacgccacacaagccgctatcagggcgggttacagcaaaaaatctgctgaacaaatcggttatcaactccttcagaaaacttcagttgcccaggctattgcacaacagcagaaagcatccattgcgcgcacgcttggcagtgccgatgaagtcctcgcgcagatgtggcaacttgccaccttcgatgcaaaccaactctcacaataccgacgaggcgcgtgtcgttattgctggggcttcggtcatcactaccagtggcgggatgcagttgagtttgaagagaaaagactcgaggctgttgagcgtgacaggcgtgaacccgaagattccggcggctatggctacgaccacaaccgagaaccaaacccagaatgcccgcgctgtaatggggacggcatcggccagccttatttcccagacactcgcaagctcccggctgtttccaggcttgcctattcaggcgtgaaggttggcaagaatggtgtcgaaatcacagccatcagccgtgagcgaatgtttgaagcggtaatgaagcggctcggcctggcggatagcgagttcgctcagcgtctccagcagatcgaaatcgaccgccggctgctggaggtggaaaaactccgcaaagagctggccggtgatggtgatgatgacgaaccgaccccagttcagatcaatatcaatgtagtggacgcgagggcggaagatggggatcagcccgacacttaa

SEQ ID NO: 1074 - DNA, 1299 bp, Enterobacter cloacae
ttactttcattgttaaatcggccagctgatatgtttgcgctctgtgatgtgaattcattctacgcatcatgcgagacagtgttcaggcccgatttgagaggacggccggtggttgttctttcaaataacgatggctgcgtgatcgcgcgcagcgctgaggcaaaagccgcagggatagctatgggcgagcctttcttcaagcaaaaggagcttttccggcgcgctggcgttgtttgcttcagcagcaactatgagctctatgctgatatgtctaaccgggtaatgacgacgcttgaggaaatgagcccccgcgttgaaatttacagtatcgatgaagcattttgtgacctgacgggcgtaaggagctgccgggacctgactgacttcggcaaagagatccgcgcaacagttcttaagcgtacgcacctaactgtcggggttggcattgctcagaccaaaacactggcaaagctcgcaaaccatgccgccaaaaaatggcagcggcaaacgggcggagtagtggacctgtccaatatcgaccgccagcgtcgattgctcgctatcgtgccggtagaggacgtatggggcgtcggaaggcgcatcatcaagaagctgaacgcaatgggcattaaaactgccctcgacctttcggagcagagcacgtggattatccgcaaacacttcaatgtcgtgctggagggaaccgtccgggaactgcgcggcgagccctgtctcgagctggaggaatttgcgccttcaaagcaggaaatcgtctgtagtaggtcattcggcgaacgcgttaccgagtacgaacagatgcgtcaggctatttgcagctatgcggcgcgtggcgccgaaaagcttcgcggcgagcatcagtattgccgttttatctctgccttcgtgaaaacctctccatttgcgcttaacgagccctattatggcaacagtgcgtcaatgaagcttctgacacctacacaggatacccgcgacatctttaacgctgcagtcaagtgcctggacaaaatttggaaggatggtcaccgctatcaaaaggctggcattatgctgggcgacttcttcagccagggagtggcacagctgaaccttttcgatgaaaacgcgccacgcgcaggaagtgaaaggctgatggaggtactcgaccatcttaatgctaaagatggtaaaggaacgctgtattttgccgggcagggcatacagcagcagtggcaaatgaagcgttctatgttatcaccgcgttatactacgagattttccgacttacttcatgtaaggtag

SEQ ID NO: 1075 - DNA, 360 bp, Enterobacter cloacae
acctctctggcagcatggccgggcgatatgcttcgccgattgatggttcgaatggaaaaagggaggcgacaagaaacagccctacttcattcaccgagcagacgggatgcagaaggtttcctgatagtgacgtctgctgctgacaaaggactcgtcgatattcacgaccgccggcctctggttctgtcaccagaagttgcccttgagtggatgcggcaggatgttggcggaaagaaagcggaagagttagcttcagacggtgtagtgcctacagagaaatttatctggcacgctatatcacgtgccgtagggaatactgcaaacaatcatttctcactgattgaaagcataaatttatag

SEQ ID NO: 1076 - DNA, 636 bp, Enterobacter cloacae
aacgtcggtttaggaagtagcgcgactaaggacgtcggaacggactccggtaatgtcatgcaagtgggggcttttggggttggtacataccaggctccaaggccaaatgatgcaaactcatcgtttatcagtgatgctgacggtaacaccagttgggctcctgccaatggctgtggctaccaaagctcttataacactcagcgcatagcgcaaatgtgggttaccactggcggagctggctattgccgttttctgttaaacacgaatcctcaaactgcaaaaacagatgctccgtggacggtatttcagtcagcaggaacatcggacattaactttaagaaagtgaccggggatctggatctaaacgaatcgctgtcaaacatcgcggcaatggattttaagaccttctactaccttgctgatgaagataaagtcattcgccgcggcgttattgctcaggaactggaaaagatagatccccagtatgttcattcagctgaggaatcggggaaaatgacacttgacctcaaccctcttgtgctcgatgcgcttgctgccatcaaagccctgacaatccgtgtcagagagctggagaatgaggctcaagctgtggttcctgtctcatccgctgattaa

SEQ ID NO: 1077 - DNA, 318 bp, Enterobacter cloacae
ctggaggtttctatgtgtggacgttttgcacaagcacaaacccgtgaagaatatctggtttacctagctgatgaagccgatcgcgacatcgcatacgacccggaacccattggtcggtacaacgtcgcgcccggtaccaaagttctgttgctgagcgaacgagacgaacagttgcacctcgatcctgtcctgtggtcatatgcgcccggatggtgggataagccgccactgattaacgctcgcatcgagacgacggccaccagcagaatgtttaaacctctctggcagcatggccgggcgatatgcttcgccgattga

SEQ ID NO: 1078 - DNA, 1146 bp, Enterobacter cloacae
tcgaagagaatcgatgtgaaagtactaaccgtatttggcaccaggccggaggccatcaagatggcgcctctggttcatgcgctggccagagatcctgatattgaagcgaaagtgtgcgtgactgcccagcaccgtgagatgctcgatcaggtcttaaccctcttttctatcgtcccggattacgatctcaatataatgaaaccgggacagggactgacggaaatcacctgccgtattctgcaagaattaaagcctattctggagtcgttcaagccggatgtagtgctggtgcacggcgacaccaccactaccgtggcaaccagcctggccgcgttctatcagcgtatccccgttggtcatattgaagcgggtctgcgtaccggcaatctctattccccgtggccggaagaggccaaccgtacgctcaccggtcacctggcgatgtaccattttgcgccaaccgagaactcacgccaaaacctgctgcgcgaaaatatcagcgacagcaagatcttcgtcaccggcaatacggtcattgatgcgctgatttgggtgcgtgaccgcgtgctggctaacagcgagcttcaggcagaacttgctgcgcgctatccgttcctgaacaacggcaagaaaacgattctggtgacgggccaccgccgcgaaagctttggccgtggctttgagcaaatctgccacgcgctggctgaaatcgccgcgcagaacgaggatgtgcagattgtctatccggtgcacctcaacccgaacgtcagcgaaccggtcaaccgtatcctgggtcacgtggaaaacgtgctcctgatcgagccgcaggactatctgccatttgtctggctgatgaaccacgcctggctgatcctgaccgattctggcggcattcaggaagaggcgccttcactcggtaagccggtactggtgatgcgtgaaaccaccgaacgcccggaagcggtcactgctggtaccgtgcgtctggtgggaacggatccgcgtcgtattgtcgaagaggtcacgcgcttactgcatgacgatgaagagtatcaggcgatgagccgggcccacaatccgtacggtgacgggcaggcttgtggtcgtattttgcacgcacttaaacacaatcgggtaacgctatga

SEQ ID NO: 1079 - DNA, 1266 bp, Enterobacter cloacae
gttatttcgcctgatatgtctctggcaaaagcatcggtgtggacggcagcgtccacgctagtaaaaattggcgccgggttactggtcgtcaagctgctggccgtctcatttggtccgtcaggcgttgggctggcagggaacttccgccagctggtcacggtgcttggcgtgctggcgggtgccgggatattcaatggcgtcaccaaatacgtcgcgcagcatcatgacgatgccgaaaagctccgcacggtggtgggcacctcctcggctatggtgctgggcttctctacgttgctggccgtcgtctttttgctggcggcggcacccatcagccaggggctgttcggacacacgcattatcaggggctggtgcgcctggtggcgctggttcagatggggatcgcctgggcgaacctgctgctggcgctgatgaaaggcttccgtgatgccgccgggaatgcgctggcgctgatcctcggcagcatcatcggcgttatcgcctactacttttgctatcggctgggcggctatgaaggcgcgctgctggggctggcgctggtgcctgcgctcgttgtcattccggctgcgtttatgctgatgcgcagaggcaatgtcccgctgagttacctgaaaccgcagtgggacaagatactggcggggcagctcggtaagtttaccctgatggcgctcatcacttcggtaacgcttcccgttgcctacgtgatgatgcgaaacctgctggcagcgcattacagctgggatgaagtggggatctggcagggcgtgagcagtatttcagatgcttacctccaatttattacggcttcctttagcgtctatttgctgccaaccttatcgcgcctgacttccaggcaggatattacccgcgagatttttcgctccctgcgttttgtgttgccggcggttgcgatcgccagctttaccgtctggttactgcgtgatttcgccatctggctgctgttttcggcgaagtttaccgccatgcgcgatctgtttgcctggcaactggtcggcgatgtgctgaaagtgggggcatacgttttcggctatctggtgattgcgaaggcttcgctgcggttgtatatcctggcagagatcggccagtttgcgctgctgacggcattttctcactggctgatccccacccacggtgcgctgggggcggctcaggcctatatggcaacttatatcgtttatttcgctgcctgttgcggcgtatttttactttggcgtaaacgcgcatga

SEQ ID NO: 1080 - DNA, 981 bp, Enterobacter cloacae
tttcgcgtgttatggcagggcagactgtggattgtagggattgccctggggttcgcgctgttagcgcttgcttacaccttctttgcaaaacaagagtggagcgccacggcgatcacagaccgaccaacggtgaatatgcttggaggctactactcccagcagcaattcctgcgtaatcttgatatcaaggccaatctggcgaccccggatcaggcctcggtgatggatgaatcctacaaagagtttgtgatgcagctggcgtcgtgggatacacgtcgcgatttctggtcccagacggactactacaagcagcgcatggtcggtaacagcaaagcggatgccgcgctgctggatgatctgattaataacattcagtttatgcctggcgatgtgcttcgtaacgttagcgacagcgtgaagctgattgcggaaacggcgccggacgccaataacctgttgcgtcagtacgttgcttttgccagccagcgcgcggccagtcatttgaatgacgagctgaaaggcgcctgggctgcgcgcactatccagatgaaagcgcaggtcaaacgccaggaagaggtcgctaaggccatcttcgcccgtcgcgtgcataatcttgagcaggcgctgaagattgcggaacagcacaatatttcccgtagcgaaacggatgttccggcggacgaactcccggattcagaaatgttccttcttggtcgcccaatgcttcaggctcgtctggaaaatatccaggccgtaggccctgactttgaccttgattacgaccaaaaccgcgccatgctcaatacgctcaacgtcggtccaacgctggacccgcgttttcagacctatcgttatttaagaacgcctgaagagcctgtaaaacgcgatagtccgcgtcgcgcattcctgatgatcatgtgggggattgtgggcgcactgactggcgctggcgtagcgttattgcgtcgccgcacaaactaa

SEQ ID NO: 1081 - DNA, 696 bp, Enterobacter cloacae
taccaaaggcgtgtggcgttgagtatcctcaacggcgtgctggagtcccttgagtgggaaagcgcattttttgcgcgtccctcagcgatagtgcgtctgcgcgacaatgcccctgcgttgcaggatgcagacttcagcgcctggcagcgcgtacaggctaagatcccggcggaccgcgccgatctgctggacgccctccagcagcacggattccggctggtcgagggcgaggttgatctctctgttaccgtggctcgctacgcctcaccgggcgcggaaattgcaacggagcaggatatccccacgctgcgcaagatggcggcgctggccttcgctcagagccgtttccgggcgccctggtatgcgcccgatgacagcggtcgcttttatgctcagtggatagagaatgcggtcaaaggcacgtttgaccacgtctgtctggtgttccgtactgacgggggacagattcagggttttgtttcgcttcgcaggctcaccgagcacgaggcgcgcatcggattgttagccgggcgcggcatgggcgagaaactcatgcaggcggcgctgcactgggcggagcaacaacaggtatcgacgctgcgggtcgcaacccagatgggcaacaccgctgcgcttaaacgttatattgcgagtggtgccagcatcgacgccaccgcctactggttatacaggtga

SEQ ID NO: 1082 - DNA, 1425 bp, Enterobacter cloacae
catcgactttttcagcccgaactacctcacgccgtggcaccacgcgctgcgtattgcttcaggagacaacgcatgagccagttgcaatttagcggcttgctggtggtctggctgctgagcacgctgtttatcgccacgctcacctggtttgagttccggcgcgtaagttttaacttcaacgttttcttctcgctgctgtttttgctgacctttttctttggcttcccgctgaccagcatcctcgtgttccgctttgatgttggcgtcgctccgccggaaatcttgttgcaggcactgctctctgcgacctgcttctacgcggtgtattacgtcacctataaaacgcgcctgcgcgcggcgaaagacaccgcaccccgtcgtccgctgtttaccatgaaccgggtagaaacccatctgacgtgggttatgctgatgaccatcgccctcgtcagcgtggcgattttcttcatgcataacggctttttactgtttaagttacagtcctatagccagattttctccgccgaagtctctggtgtcgcactcaagcgtttcttctatttcttcattccggcgatgctggtggtctttttcctgcgtcaggacagcaaagcctggctgttcttcctggtcagcaccgtcgcatttggcattctgacctacatgatcgtcggcggcacccgcgccaacatcattatcgccttcgcgattttcctgtttatcggcattattcgcggctggatctcgctgtggatgctggcggcggcaggcgtctttggcattgtggggatgttctggctggcgctgaagcgctacggactgaacgtggcgggcgacgaagcgttttataccttcctgtatctgacgcgcgacaccttctcgccgtgggaaaacctggcattgctgctgcaaaactacgacaaaatcgaattccaggggctggcgccgattgttcgcgatttctatgtctttataccgacgtggctgtggcctgaccgtcccggtattgtcctgaacacggcgaactactttacctgggaagtgctgaacaaccattcgggcctggcgatttccccaaccctgattggctcgctggtagtgatgggcggaacgtggtttatcctgccgggcgcgatcgcggtcgggttgataataaaatggttcgactggctatatacgctgggtaacgaagagaccaaccgctacaaagccgctgttttgcacagtttctgtttcggtgccattttcaatatgatcgttctggcgcgcgaggggctggattcattcgtctcacgcgtggtgttctttatggtcgttttcggactctgtctgctgctggcaaaactgctgtactggttgtttgacagtgcagggcttgtgcacagacgtgagccacagggcagcacaacgctgtcgcaagtctga

SEQ ID NO: 1083 - DNA, 753 bp, Enterobacter cloacae
  unsure (720)
gtagggattatcatgacggatacaacttcagccccgcgttatgcgctgcgcgggctacagctgattggctggcgagacatgcagcacgcgctggatttcctgttcgcggacgggcagatgaaatcgggcacgcttgtggccatcaacgcagaaaaaatgctggcggttgaagataatgcggaagtgaaaagcctgattgaagccgcggagtttaaatacgcagacggtattagcgtggtgcgttcaattcgtaaaaagtttccagacgctaatgtgtctcgcgtggcgggagctgacctttgggagcggcttatggaacgcgcaggcgctgaaggcacaccggtatttttgatcggcggcaagccagaggtgctggcgcagaccgaacaaaagctgcgtaaccagtggaatgttaacatcgtgggcagtcaggatggctatttcaggccggaagatcgccagacgttatatgagcgcgtacgcgacagtggggcgaaaattgtcactgtcgccatggggtcgccgcgccaggaaattctgatgcgcgattgccgtctggtcagcccggatgcgctctatatgggcgtcggcggcacctacgacgtctttaccggccacgttaagcgtgcgcccaaagtctggcaaaacctggggctggagtggctctaccgcctgctttctcaaccgacacgaatcaaacgacagatccgtcttctgcgntacctcgcctggcactacaccgggaaaatgtaa

SEQ ID NO: 1084 - DNA, 984 bp, Enterobacter cloacae
  unsure (975)
gaaaccattcgctccgtatttcagtacccctcaaaaacaatacccggcaataagtcgggaaacagcaaacacaaccgaggaattatggcagagaaaaaaccggagcttcagcgtgggctggaagctcgacatattgaattgatcgcgctgggcgggactatcggcgttggcctgtttatgggctcggcaagcacgctgaaatgggcggggccttccgtcctgctggcgtatattattgccggactgttcgtcttcttcatcatgcgctcaatgggcgaaatgctgttcctggagccggtaacgggctctttcgccgttaacgcccaccggtatatgagcccgttctttggttatctcacggcctggtcgtactggtttatgtggatggccgtcgggatttcggagatcaccgccatcggggtctacgtgcagttctggttcccggagatggcccagtggatacctgcgcttattgccgtagggctggtggcgctggcgaacattgccgccgttcgtctttacggtgaaatcgagttctggtttgcgatgatcaaagttaccaccatcatcgtgatgattgttgtgggtctgggtgtcatcttctttggcttcggtaacggcgggcacgctgtcggtttcggtaacctgaccgggcacggcggcttctttgcgggtggctggaagggctttctgacggcgctctgtatcgttgtcgcctcctatcagggcgttgagctgatcggcattaccgccggtgaggcgaaaaacccgcaggtcacactgcgtagcgcggtaggcaaggtgctgtggcgtatcctgattttctatgtgggcgcgatcttcgttatcgtgaccattttcccatggaacgagatcggcaccaccggcagcccgtttgtcttaactttcgctaagattggcatcacggcggcagccgccattatcaactttgtggtactgacggcggcgctttcncggctgtaa

SEQ ID NO: 1085 - DNA, 1281 bp, Enterobacter cloacae
acacaatcgggtaacgctatgagttttactaccatctctgttgttggtcttggctatatcgggctgcctactgcggcggcctttgcctctcgtcaaaagcaggtcgttggcgtagatatcaacgcgcacgcggtggaaaccatcaaccgtggcgaaattcatatcgtggagcccgatctcgatcgcgtggtgaaaaaggcggtggacggtggcttcctgcgcgccagcaccacgccggtagaagccgatgcgtacctgattgcggttccaacaccctttaaaggcgatcatgagcctgacatggtttacgtcgaggcggcggcaaaatccattgcgcctgtgctgaagaaaggggcgctggttatccttgagtccacttcacctgttggggcaaccgagcagatggcacagtggctggccgaggcgcgtcccgatcttagcttcccccagcaggtgggcgaccaggccgatatcaatatcgcctactgccctgagcgcgtactgccaggccaggtgatggtggaactgattaaaaatgaccgcgtgattggcggcatgacgccagtctgctccgcgcgcgccagcgagctgtataaaattttccttgaaggcgaatgtgtggtgaccaactcccgcaccgccgagatgtgcaaactgaccgaaaacagtttccgcgacgttaacatcgcgtttgcgaatgaactgtcgttgatttgcgccgatcaggggattaacgtctgggaacttattcgccttgccaaccgtcacccccgcgtgaacatccttcagccggggccgggcgtgggtgggcactgcatcgcggtcgatccgtggtttatcgtggcgcaaaatccggaacaggcacgcctgattcgcaccgcgcgcgaagtaaacgaccataaaccgcactgggttatcaaccaggtcaaagccacggtcgcggattgcctggccgacagcggcaaacgcgccagtgagctgaaaattgcctgctttggtctggcattcaaaccgaatattgacgatctgcgcgaaagcccggcgatggaaattgccgaaatgatcgctgcctggcacagcggtgaaacgctggtggttgagccgaatattcatgcgttgccggcaaaacttgccggtcactgcacccttaccgccctggatgacgcgctggcgacggcggatgtgctggtgctgctggtggatcacaatgcgtttaaagcggtctccggtgatgccgtacgtcagcagtatgttgttgataccaaaggcgtgtggcgttga

SEQ ID NO: 1086 - DNA, 1305 bp, Enterobacter cloacae
ccgggcgcggcatgggcgagaaactcatgcaggcggcgctgcactgggcggagcaacaacaggtatcgacgctgcgggtcgcaacccagatgggcaacaccgctgcgcttaaacgttatattgcgagtggtgccagcatcgacgccaccgcctactggttatacaggtgacaagatgattccatttaacgcgcctcccgttgtgggcactgaacttgattacatgcagtcggctatgggcagcggcaagctctgtggcgacggcggttttacccgccgctgccagcagtggatggagcaacgttttcacagtgccaaggtgctgctgacgccgtcctgtaccgcatcgctcgagatggcggcgctgctgctggatatccagcctggcgatgaagtgatcatgccgagctacaccttcgtctccacggcgaacgcgtttgtcctgcgcggggcgaaaatcgtgtttgtggatatccgtccggataccatgaacatcgacgaaacgctgattgaagcggcgatcactgacaaaacgcgggcgattgtgccggtgcattacgcgggcgtggcctgtgagatggacaccatcatggccatcgccaaaaagcacaacctgtttgtggtggaagacgccgcgcagggcgtgatgtccacctacaaaggtcgcgcgctgggcaccatcggtcatatcggctgctttagcttccacgaaaccaaaaactacaccgcaggcggcgaaggcggcgcgacgctgattaacgatcgtgccctggtggagcgtgcggaagtgatccgtgaaaaagggaccaaccgcagccagttcttccgcggtcaggtggataagtacacctggcgcgatatcggctcaagctacctgatggcggatttgcaggccgcgtatctctgggcgcagctggaagcggcagagcgaatcaatctgcaacgcctctccctgtggcaaacctactacgacgcgctggagccgctggcaaaagccggacgtattgaactgccgactattccggcagactgtatccacaacgctcacatgttctacatcaagctgcgcgataacgacgatcgcagcaagctgattgcctggctgaaagaggcggaaattatggcggtattccactatattccgctgcactccagcccggctggcgaagccttcgggatgtttgccggtgaagaccgctacaccaccaaagagagcgaacgtctgctccgcctgcccctgttctacaacctcgcgccggtgaaccagcgtacggtgatcaattcgcttctgagttatttcgcctga

SEQ ID NO: 1087 - DNA, 1086 bp, Enterobacter cloacae
acgcgcatgactgcactgatacacatactgggatcggatatcccgcatcacaaccagaccgttctacgtttcttcaatgatgaactggcatccggcacgcccgatgcgcgcgagtttatggtcgttggacgcgataacggtctgagcgtggcgtgtccggcattgcacatcaccttctggccagacaaagcggcgctgaccaaagccgttgtcgcgaaagctaaagcggaccgaagccagcgtttcttcttccacggacagttcaatactggcctgtggctggcgctgttaagcggcgggataaaaccttcccagttcagctggcatatctggggagcggatctctacgaagtctcccgtggctggaaattccgtcttttctatccgctgcgtcgtctggcccaggcgcgcgtgggctgcgtttttgctacccgtggcgatctcaactattttgctaaacagcacccgaaggttcgcggggagctgctctattttccgacccgtatggatcctgcgctgaacaccctggcgaatgacgcggttcgtgagggcaaactgaccatcctggtgggaaattccggcgatcgcagtaacgagcatgtcgcggcgctgcgggcggtacatcagcagtttggcgatacggtgaacgtagtggtgccgatgggctatcccgccaataacgacgcctacatcaatgacgttcgccagcaggggcttgcgctgtttagcgcggaaaatctgcacattctcaacgataagctggaatttgatgactatctcgcgctcctgcgaaaatgcgatctgggctatttcatctttgcccgtcagcaggggattggtacgctgtgtctgctgattcaggcgggcgtaccgtgcgtgctcaaccgcgaaaacccgttctggcaggacatggccgaacagcatattccggtgctgtttacctctgacacgcttaatgtcgaggtagtacgggaagcgcagcgtcagctcacgctggtggataaaaatagcatcgactttttcagcccgaactacctcacgccgtggcaccacgcgctgcgtattgcttcaggagacaacgcatga

SEQ ID NO: 1088 - DNA, 873 bp, Enterobacter cloacae
cagcccatccctgctgttgtctgccgactaaccaaggccaaatctgaattgtcccgtttaagtaaccaacccgctgccgccaggcgggtaaatcctcttaatggagttttaatgcaaatctcaactgaagttctgaacgtcttatctcgctgccgtgctgaagggaactttcttttcctggccgaccagctcgaccgcagcatttatgttaagacaaacaaagtgctcgaagccgccggtggcaaatggaaccgaaaagagcaggcacatatttttacggcggatgcagctgagcgtatcgagcaaatcattctgacaggttcggttgacatcccacgagatctgttcaatttcttccctacacctgagaatttagtcacagatatggttctacgcgctgaaccagctgccggggagcgtgtactggagccagagtttggtgatggccgcattctgaaagccttaaaactggcggctccggatgcattgattaccgggatcgaattgaacgatgagcgattccttgcagtgaagaacgatagtgtccttagcacaggagtcgagctggtgcataccgactttcttgggtaccagcccgatgaaacttttgatgttatcgttatgaatccaccattccttaaacgctctgacgttaaacatgtcatgcatgccatcgcaatgctcgctaagcgaggtcgcttacaggccattctgtcagctggggtattgttccgggaagacacactgacaaaagcgctcagggagcgagtcaaacaacttggcggacaaatttcgcctcttccggatgatacatttagggagtccggaacaaaggtcaaaacagcccgccttgaaattgatcttcgccgctaa

SEQ ID NO: 1089 - DNA, 1095 bp, Enterobacter cloacae
cttattatgactaaagagaaagatactgagcagcaggacctggtcaccagggctttctctgttagagagaaagaatcaggtaaagacatcattttgcgtcctaacagcaaccgtacggtgcagtctattgctttgatgcggctcgggctgttcgtcccatcaccaaagagtgtggggcgtcaaaatcgggaatataaaacggttggctttgacgcaacgaaagagttacagacgctctctttaatggagagcgaggggttcaccaatatttcaattgtcggtgagcgtcttgatatgtcagtagattttaagacgtggatgggcatcattcgaacctatgccaatcatccgattaacaatgacacgataagcttaaaattcactgaattcctcaagctatgtacgcctgaaaattatcgctcatctacagcgtccagaaaacgtatagacgcctccttacgcaggttagcatccgttaccttgtcgttcaccagtaataactcgtccaaagtctatacaacgcatctggtacagtctgccctgttagacccggaatcagatcaggttgtccttcaggttgatcctaagattttcgagctctatcaatacgatcataaggttttgatgcagctgaaggcaattaaggagttggccaagaaggaaagcgcccaggctctctatacgttcatagagtcattaccgccaaatcctataccgatatcccttactcggctgaaaaatcgtctgaacctcaaaacacgagcaaatagtcagaatgctaccgtgagaaaggctcttgaagagttggcatcgataggatacctccagtacaccgaaattaagaaagacggaaaagtatacttccagattcataagcgggatcccgatctgaatttgaacaatactcagcctcctttagaagtggttgaagatgaagaagagaactcagggtcttctgttttagaaggtgagttatgcccaccagctgacccgatagacggcgatgatgttcttaccgtccatgatttaaccgctgaagaactgcgctatattcgtagtcttcgaagccagaaaaagaacagcaacgccagctaa

SEQ ID NO: 1090 - DNA, 819 bp, Enterobacter cloacae
agaccatacgtcaaagatatgacaggaggtgggccatttcaacttcgtgcaggcgaatggacggatgatacatccatggcattatgtcttgcggaaacgcttcttgagaaaggcgatgctgatactatatgtttcaggaataagcttctggaatggtatcagcatggttataacagttcaattggcgtctgttttgatataggtaatacaacgcgatttgctttagagcaatatttaacaattggcccaggatggagcggcaatactgctccagaaactgcgggtaatgcttccattatcagacaagcccctgtctctattttttttagaaagtcattaagcaaagcgttttatgaagctaaaaaacaatgtatcgcaacacacggtgccgcggaagcaatcaatagcacgcagtatttaagttatttgcttgtgcatatgattaacggtagcaataaagattttgttttttctccgcacgttatgccgcttcagccacgcgtaatgattatcaacgcgggtgaatataagcaaaaaactcgcgatcagattcgttcaagtggttatgttatcgatacgcttgaagccgcgatgtggtccgtatggaatacggataatttccgtgatgccattctgctggcagccaaccttgccgatgatgctgacagcgttgcggcgacggcgggacaaatagctggagcattatatggttattccggtattccgcaggagtggaaaaacaatcttgtacaacatgaacgtatcgccaaaatggctggtgaattgttcgatagagcccccgaagacactttcttataa

SEQ ID NO: 1091 - DNA, 4371 bp, Enterobacter cloacae
ggcatgagcgataacaacgcggcccgtaagggcgacgagattattcactccagcatttttgctgatattaccagcattgtggcggaaggtgccgcctatgcggtgattggcgcggcggtgggcgcggcagcgaccgtcgcggccccactgctgggagccggggccgcagcagcgggcgtggcggcgattgggtccagctgtctgttgagcggcattattggtggggttctggcgaacgtcgccgggatcaccgacgatatcagcaacgccgcggaagggttaggcaatgcgcttttcccgccgtcgcctgcgggtaaaatcaccaccggttcaaataacgttctcaccaacgcaatccccgccgcgcgcgcggcaggcacgctgacgcccgccgataccccttcccctgagccgcagtcgccgggcagctttgccgattacgcgggcatgctgctttccgccgccggacagtttggcagcgaaatgtggcagccgagcgttgcctcagccgccgcgggaacctcgccgctggaagaagataaggtggcgtgtgaaaagcactccgggccacagtatctggcggaaggctccaaaagcgtctttatcaacgggcagcccgcggtacgtgcgaaagatcgcaccacctgcgaaggcaccgtttccgacgacgtctccccgaacgtgatcatcggcggcgacaccctcacggtccgcgatatcaaaagcggtaaaacgccgggtctggcgttggggatgattgcgctctccctgttgcgcgggcgtccgggcaagatcctgaaaaacatgccctgcgcgctggctgctgccggtggcgggatgctggctgatatggccgtcaacgccgtgttcggctcctcgcacccggttcacgctgctaccggcgtgaaggtgctgaatgacgacgacgaactcgatttctcgctgccggggcgctttccgctgcgctggcagcgcagctacaacagcctgaccacccgcgaagggcttttcggtctgggctgggctaccacctttgacagctatctgacgctggaagaaaacaatgccacctggttcgatgaaaccgggcgcgagctgagctttgaactgccgccggtcgaccgcgcgttttacagcatcagcgaaggcattatcatccgccgcaatgagagcggcgacgtggcgattgccgacgatgacggcgcggtgtggcgtctgtataaaccgacccgcgctaacccctccatcctgcgcctggcctccctcagcgacgagtacggcaatgcgctgctgacggcgtgggacgagcacggcaggctggttggtatccatgatgagccgcgggccatcgacgtctccctgcgctatgacgatgaacgtttcccgcagcgcgtgaccgcagccagccatttcgacggcaaccagacatggccgctgatgcattgggggtacgacgcgcgcggtcagctggccagcgcaacggatgcctccggcgtggtaacccgtgaataccgctacaacgatcacggcctgatggtctggcaccgaatgccgggcggtctggagagcgaataccggtggcaaaaattcgaccactggcgcgtggtggaaaaccgcaccagcaccggcgacggctgtcgctttacctatgatctagccgccgggcttacgaccgtcgaacactacgacggtcagacgcgaaagcattactggaacgcgcaaaacctcattgttcgctacgttgacgagagcggtgagaactggcgctacgagtgggatgacaacgaactcctcacgcgtcgcatcgatccgctgggtaatgccgttaccttcgtctatgacgacatgggcaaccgggtgcaggagatcgacgccgacggcaacacccgcaccaccacctggctggagcaccgcgcgcttcccgcggccattatcgaagctgacggcaacgccacccggttctggtacgacgaacatcacgggctgaagcgcgtggtggacccgatggggcagaccacgctgctgcgtcgggacgagtttggtcaggttgtggaagaagtcgatgccgccgggaacagccgctaccaggagtacaacgaggccgggcagatggtgcgtgcgacggactgttcgggccgtgtgacacaataccgttatcatccgctgggctggctgatggctgagacagccgccgacggtgaagagactcgctaccgctacgacgccgcagggcgtccggtgcagctcgatcgcccggaaggctggacggaatcgctcaaatggaacgaacgtggcctgccggtgaagcatgcgggcgccgacgggaaagagagcgagttcagatacgacgaagcggggcgcttaaccgccacccgaaatacgcagggtgaagaggtgcgccgccgctgggacagccgcgggcgtctgattgccctggaaaacgagaacggcgaagcgtatcagttccgctgggggccagactcgctgctgctggaagaggtggggcttgatggcgtggcctcgcagtatcgctatgacgcctgcgggcgcacgattgcgcgcacctttgccgccggtcatccggaggccatcacccatgcctttgcctggagcgcgagcggccagctggtcgcccgcaccacgccggaggggcagacccgctaccactacaccccgtccggccttctgagccggattgggctgcatcccgcgctttcagccgatgcctggagtgccgaggccgagcaggagcttgtgtttgagtatgacgcgctcgggcgcgtcacgcgcgaaacgggcgagcacggggagctggcgtgggagtatgacgcgctgggtaaccgcacctccgtcacgctgcccgatggtcgggagctgaaacagttctactacggcagcgggcatctgctcagcatcgcgcttgataagctctcggtctccgactttacccgcgacgaacttcaccgtgaaaccagccgtacgcaggggctgctaaccacacgcagcgaatatgaccgtctcggtcgactgcatcgccgggacgtttttaccggcaatgcccagcgcccgtcgccgcgccgctggtcccgccgctgggattacgactatcgcaataacctggtgcgggaagagcgggacgataacccgttcaactggtaccgctggcagtacgacagcgccggacgtctgctggttcaggacggcacgctgcccggtcaggagcagtggcgctgggatgcagccggtaacccgctcgaaggatctgttgagaaggtcacgcacaaccggctgacgcagctgaacggcattcgctggcgctatgacgtccacggccgcaccgtggagaaagataacggacagacccgctggcactaccgctacgacggcgagcaccgcctgacggaggtcatcagccagccgcgggaccgcaacaggccgcagacgcaggtcagcttccgctacgatccgctcgggcgacgcatcagcaaaacgcgccgccagatgctgggcggacagccagccggcaagccggtcaccacgcggtttgtctgggaagggttccggctgttgcaggaagtgcacggggaagtgcctctgacctacgtctacagcgatcaggacagctacgatccgctggcgcgtatcgacggcgttgatgccccggaaatcttctggttccactgtcagccgaacggcacgccggaacggatgacggatagcgaaggacaggtgcgctgggtaggggtaaacagcgcctggggcaagctgctgcgggaaagcgagacgcaggtatcaggatattcccagaacctgcgcatgcaggggcaatacctggaccgcgagacagggctgcactacaatctgttccggtattatgacccggactgcggactatttacgcagcaggacccgatagggctggcgggagggattaacctttaccagtatgcgccgaatgcgctggggtgggtggatccgtgggggttaaaatgtggtttttctcaaaaagatcgtataacacaaagatgggtggatagattaacagggaaaaaacccgctgatgttcataatattttgacatccaaaggttggacgagaacatatccacaagccaataaaccaggagctatccaacatattcaatatgtcaaaacaacaaaatcaggtactacgtacaaattagattatcatcccggagggactccaactcaacctaatattcatggtaatgattactggaaagtttatcgcgaagttgatggtgctgatgtagtatatgggagaattggtcatggagagtttaaaaattatgatttaataaccgattcacctgtttatgttgacggagttttacttaatgggggggtataa

SEQ ID NO: 1092 - DNA, 2283 bp, Enterobacter cloacae
aacgcgaccgtaacctgcgtatcttccaacgcccaaacggtacgcagattgtcaaaaccctgctgggtgagcatcaagttaaacctccaaaaacaactcaccggcagctaccgggtgtgggactactgcgtgcagtatcaggagtcgagcctggacttcatcagccgcctgatggagctggaggggattgcgtactacttccgccatgaggcggacaagcacaccctggtgctgaccgacgccgcgacgcagcatcagccgttcagcggctatgaggtcattccttaccatcagacgccgtccggcggcagtacggatgaagagggcatcagccagtgggcgctggaggactgcgtcacgccggggatttacagcctcgacgactacgacttccgcaagccgaatgcgtggctgttccaggcgcagcagaacccggcgtcaccgaaaccgggcagcatcgacgtgtacgactggccggggcgctttgtggagacgggccatgcggaattctacgcccgcatccgtcaggaacgctggcaggtggagcatcagcagattcaggcgacggccacggcggcgggcattgcgccgggccacatctttacactgaccaacgccccgttcttcagcgataacggggagtatctggtcacggcggcgggctaccatttcgaggagaaccgctacgcgagcggtgagggggagaccattcaccgcaccgatttcaccgttatcccggcgtcggtgtcctaccgtccggcgcagagcacggcgtggccgcggacctacggcccgcagacggcgaaagtggtggggccgcagggggagagtatctggacggacaaatacggtcgcgtgaaggtgaagttccactgggaccgtctggcgaagggcgatgacaccagctcctgctgggtgcgtgtgtcgagcgcctgggcgggccagggctacggcggggtgcagatcccgcgcgtcggcgatgaggtggtggtggactttatcaacggcgacccggaccgtccgattattaccgggcgcgtgtataacgacgcgagcatgccgccgtgggcgctgccggctgcggcgacgcagatgggctttatgagccggacaaaagacggttccgtggacaacgccaacgccctgcgctttgaggacaaggcgggcgcagagcaggtgtggatccaggccgagcgtaatctggataccagcgttaaaaatgatgaaacgcacagcgtcggcggggcgcgcagccattacgtgaagaaaaatgagctgcatcgcgtggaggctaatcagatccaggccgtgaaaggcggaaccgagatcctgacgggtaaaggcaagctggatgcggcggtagagcagtatgttattgcttccgggacgaagctgcggctggtctctggtgagagcgccattgaactcaacgcgaacggcaagattaacctgatcggcaaagagtttaacttctttgtcgaaggggatgggtatatcaccacgggcggtaagcttcatctgaacacgtcgggaaccaagccgggcactacggcgccgggatcggggcataaaggggatattgatgcggcggtgcaggagaagttttctccgaataaaagtgctaagaatccggctcccgcagcttcagcgccagcagcaaccagaccaaaaccaacaacaaaatttgcatcagcgccaccattaaaagggagttacgtctatcaaaataattcctacaactctgatgtgatgcccttcagtgaagatgtagttaaggaaatcaataagtcaccaacgcttcagacacaattaaaagatctaaaagataaagggtgggctattcagccgggagcagcaggaggggggagttacgctgatacgaataacaaattgattgtcatggaccctgaacacatggaagatacagccacaacggtgcaaactctggcacatgaggcagggcatgcaacttatcctgttgcggtagattcttcgagtaaggaaagcttcatcaacagccagcttatggatgaaggtggagcaacgctgaataacattaaaatacaacgcgagatccttgcaaacggcggtattgatattgatatagcgggaagtgccgaaaacctaaaagcatataattctgcctatgataaaatggtaagtggtgagttatctcgcattgatgcagccaaagcaataggaaaagtgtatggtaaaggggaaatagcctcagggactaatctaaattataatgattactatggaggattctatggaaagtag

SEQ ID NO: 1093 - DNA, 1071 bp, Enterobacter cloacae
aaaccatgcatcatcggcagcaccgttttgttcatcgcctgttcgacggcggccccctcgacgttaatggccacttccgccgcaccaaagctgccgccaaataccatcagcccaagggcaaacatcagcggcgaggcgaaccacagcgccacgctcagaccgagcattcccaccacggcgcagcacatggtggtgcgaatcaccgcgcgcgtgccaaagcgcttcaccagccaggccgagcagaggatgccgctcatcgagccaatcgacaggccaaacagtacgatccccatctccgccgtcgagacggacagcgtatcgcggattgccggggtgcgcgttgcccaggaagccatcagcagcccggggatgaagaagaacataaacagcgcccacatgcgcagatgcagggctttgcgaggagaagttagcgtcattgggatcagcaccagaagtacaacaatagcgacaacactagcaactttgtgtacatttgtacacaaactggatgaggattttatgagcagaccaccgaacgaccctaaccgccgcgagaagatactccaggcgacgctggacaccattgctgagcacggtattcatgccgtcacgcaccgcaaaattgccacctgcgcaggcgtgccgctggggtcgatgacctactatttcgacgggatggagtcgcttctggaggaggccttcacgtggtttacgcagcagatgtctcagcagtaccgggatttcttcgcgggggtgaccgggcgggagagggcgtgcgaggccattaccacgctgatcaacagttcagccgtgaccacgccacacaatatggcgctgatgtatcagttatacgcgtttatgcaccgcagcgccgcgctgaaaacggtgatgcaggactggatgaagatgagccagactacgcttgagcagtggtttgattcggccaccgcccgtgcgctggatgcgtttatcgaggggatgacgctgcattttgtaaccgaccggtcgccgttaacccgggaggagatccgggtgatggtggggcggattgcgggcgaggataccgtctga

SEQ ID NO: 1094 - DNA, 738 bp, Enterobacter cloacae
atgtctacgcggaaaaaactgggtctgaccaataccacctttaaaaccgttcacggcctggatgcgccgggtcagttcagtaccgcgcgcgatatggcgctgctgggcaaagcgctgatccatgacgttccggatgagtacgccatccataaagagaaagagtttaccttcaataatattcgccagcctaaccgtaaccgcctgctctggagcagtaacgttaacgtggacggcatgaaaaccggtacaactgccggggccggatacaacctggtggcttctgcgacgcagggcgatatgcgcctgatctcggtggtgctgggcacgaaaaccgaccgcattcgttttaacgagtcagaaaaactgctgacctggggtttccgcttctttgaaaccgtcacgccgattaagccggacgccaccttcgtcagccagcgcgtctggtttggtgataaaagtgaagtaaacctgggggcaggtgaagcggggtccgtcaccattccacgcggccagctgaaaaacctgaaagcgagctataccctgaccgagccacagctgaccgcgccgttaaaaaaaggccaggtggtcgggacgatagatttccagcttaacggcaaatccattgagcagcgtccgctggtggtaatggaagcggtggaagagggcggcttcttcagccggatatgggactttgtgttaatgaaattccacggctggtttggcagctggttcagctaa

SEQ ID NO: 1095 - DNA, 1242 bp, Enterobacter cloacae
agagattgcatgataaaccgttcttcttccggtaatcgtctgggtcgtcaggcgttactttttcctctgtgtctggtgctttacgaattctctacctacatcggcaacgacatgatccagccaggcatgctggctgtggttgagcagtacaacgcaggtattgagtgggtacctacatcgatgaccgcctatctcgcgggcggcatgtttttacagtggcttttagggccgctgtcggatcgtattggccgccgcccggtgatgctgacgggcgtggtatggtttatcgtcacctgtctcgccacgctgctggcgcagaacattgagcagtttacgttgctgcgtttccttcagggcgtgagcctgtgctttattggtgccgtgggctacgccgctattcaggagtcgtttgaggaggcggtatgtatcaaaattaccgcgctgatggcgaacgtggcgctgattgcaccgcttctggggccgctggtgggagccgcatgggtccacgtcgcgccgtgggaagggatgttcgtgctctttgccgcgcttgcggccatctctttctttggtctgcaccgtgcgatgccggagaccgccacccgcctgggcgaaaagctctcgcttaaagagctggggcgtgactataaggcggtgctgcaaaatggccgtttcgtcgcgggcgcactggcgacgggctttgtcagcctgccgctgctggcgtggattgcccagtcgccggtcattatcatcagcggcgaacagcttagcagctatgagtatggcctgttacaggtgccgatttttggcgcgctgattatcggtaacctggtgctggcgcgtctgacgtcacgccgtaccgtgcgttcgctgattattatgggcggttggcccatagcggcagggctgattatcgcggcggtggcgaccgtagcctcgtctcatgcgtacctgtggatgactgcggggctgagcatttacgcgtttggtatcggcgtggcgaatgccggtctggtacgcctgacgctgttcgccagtgaaatgagtaaaggcacggtctctgccgcgatggggatgctgcaaatgctgattttcaccgtcggaattgaggtgagcaagcatgcttatgctttcggcggtaacgggctgttcagcctgttcaacctcgccaacggcgtgctgtggattgccctgatggtggtattcctgaaagacaaacgcgtcggaaacgccctgcaaccgtaa

SEQ ID NO: 1096 - DNA, 489 bp, Enterobacter cloacae
ggaaattacatgtctacacccgcacacctatggctagaagacgagaacggttcgccgattatcggtagctgcatgatgcccacgcgtcttggttccatagagctaaaatcgttctcccacggtgtaaccattccggctgatccaagctggggtaaactcaccggcacgcgcgtccatcgccctattacgatagttaaagaatttgatcagactaccccgcttctttaccgcgccgtgtgcgaagggagagttatgaagaaggggatcattaagatgtaccgcattctggagtccgggatcgaggccgaatatttcaatatcgtgatggaaaacgttaagttcacgacagtggcacccttcatgacccctaacgggatgagcagcacccatcttgaaacgctcgaattgcgttacgaagcaatctcatggaagtacacggaggggaatatcatttaccgtgacacctggaacgatcgctgctgcgcctga

SEQ ID NO: 1097 - DNA, 1293 bp, Enterobacter cloacae
aagatgtttctggcaggggctatttttctgtttacgctggtactggttatctggcagcccaaagggctcagtatcggctggagcgccaccattggcgccgtgctggcgctgatgagcggcgtgatccacatcaacgatatccctgtggtgtggaatatcgtctggaatgcgacggctacgttcatcgccgtcatcattatcagcctgctgctggatgagtccggctttttcgagtgggcggcgctgcacgttgctcgctggggaaacggtcgcgggcggttgctgtttacctggatcgtgctgctgggtgcggccgtggcggcgctgttcgccaatgacggtgcggcattgatcctgacgcctatcgttatcgccatgctgctggcgctggggttcagcaagcaggccacgctggcgttcgtgatggcggcgggatttatcgccgataccgccagcctgccgctgattgtatccaacctggtcaacatcgtctcagcggacttctttaagctgggctttagcgaatacgcctcggtgatgatcccggttgatatcgctgcgattgccgcaacgctggtgatgctgcatctgttcttccgaaatgaaatcccccccgaatatgacctggcaaaactccgcgagcctgctttggccattcacgacctgccgacgttcagaacgggctggatcgtgctgctgctactgctcgtcggtttctttgtgcttgaacctctgggtatcccggtcagcgctatcgcaacaactggcgcgctgattttgtttgccgttgctaaacgcgggcacgccattaacaccggaaaagtgctgcgcggcgcgccgtggcaaattgttatcttctcgctgggtatgtatctggtggtgtatggcctgcgcaacgccgggctgacggagtctctttcaggcgttcttgattacttagccgggtacggactctgggtcaccacgctgggaaccggatttatcaccgccttcctgtcatccataatgaacaatatgccaacggtgctgattggcgcgctctccattgagggtagtgctgcaacagggttggttaaagaggcgatgatttacgctaacgtgattggctgcgatttggggccgaaaattacccccatcgggagcctggctaccctgctatggcttcatgtgctggcacagaaaaacatgactattacctggggctactatttcaggacgggcatcataatgacgctgccagttctctttgtgacgcttgccgcgctggcgctacgtctctccttcacactgtaa

SEQ ID NO: 1098 - DNA, 441 bp, Enterobacter cloacae
gtaacggatatgagccatatcactatctaccacaacccggcctgcggcacgtcgcgcaatacgctggagatgatccgcaacagcggtacggaacccgaaattattctctatcttgagaacccaccgtcgcgtgatgaactgaccaggctgattgcagatatggggatttccataggcgatctgctgcgcaaaaacgtcgagccttatgagcaactgggcctttcacagggacatttcaccgacgaccagcttatcgatttcatgctgcaataccctattctgattaaccgtccgattgtggtgacgccgctgggtacccgtctgtgccgcccttctgaagtcgttctcgacatccttccggacgcgcaaaaaggggcatttacgaaggaagatggcgaagtcgtcgttgacgccaacgggaaaaaaatctcccgccagtaa

SEQ ID NO: 1099 - DNA, 1377 bp, Enterobacter cloacae
ataccgtgctcagcaatggtgtccagcgtcgcctggagtatcttctcgcggcggttagggtcgttcggtggtctgctcataaaatcctcatccagtttgtgtacaaatgtacacaaagttgctagtgttgtcgctattgttgtacttctggtgctgatcccaatgacgctaacttctcctcgcaaagccctgcatctgcgcatgtgggcgctgtttatgttcttcttcatccccgggctgctgatggcttcctgggcaacgcgcaccccggcaatccgcgatacgctgtccgtctcgacggcggagatggggatcgtactgtttggcctgtcgattggctcgatgagcggcatcctctgctcggcctggctggtgaagcgctttggcacgcgcgcggtgattcgcaccaccatgtgctgcgccgtggtgggaatgctcggtctgagcgtggcgctgtggttcgcctcgccgctgatgtttgcccttgggctgatggtatttggcggcagctttggtgcggcggaagtggccattaacgtcgagggggccgccgtcgaacaggcgatgaacaaaacggtgctgccgatgatgcatggtttttacagcctcggcacgctggcgggcgcgggcgtggggatggcgctgacggcgctgggcattgcggccaatgtgcacattttgctggcggcgctggtctgtattatcccgatcctcaccggcatcagggctattcccgcaggcacaggacaacacgccacggacgaacagaagtctgcggaaaaagggttgcccttttatcgtgatttccagctaatgctgattggcgtggtggtgctggcgatggcgtttgctgaaggctccgccaacgactggctaccgttgctgatggtggacgggcacggatttagccccacctccggctcgctgatttacgccgggtttacgctcggcatgaccgtcggacgctttaccgggggctggtttatcgaccgttacagccgcgtggctgtcgtccgtgccagcgccctgctgggcgggctgggcatcgcgatgattatctttgtggatgtggactggattgccggcgtgtcggtgatcctgtggggactgggcgcctcccttggcttcccgctgaccatttccgctgccagcgataccggccccgacgcgccgacgcgcgtgagcgtcgtggcgaccacgggctacctcgctttcctggtgggcccgccgctgcttggattcctcggtgagcactacgggttacgcagcgcgatgctggtggtattagggttagtcattattgccgccctggtggcgcgagcggtggcaaaaccggaagcagaaacaacgtcaatggagaagggatatgagcgttaa

SEQ ID NO: 1100 - DNA, 741 bp, Enterobacter cloacae
tgggattcgggcaggtcatgcgcggcgcgcattttttctctcacaacctgtgggccgggtggtgggtctggttttcccaggtgctggtttacgggctggtttccgcctggtttgctaaagagtaacgagattatgttagaaaatctgaactacgaactgttttacctgctcaacgccacgccgtcgtcaccggaatggatgatcgatctcgccaccttcattgcgaaagatgtgatcagcattgtaccggcgctggcggtgatcctctggttatggggacctcgtacacaggtcaccgcccagcgccatctggtgatcaaaatggcgatggcgatcggcgtcagcgtgctggcaagctacgtgctgggccacgccttcccacacgatcgtccgtttgtcgatcgcgtcggctacaacttcctgcaccatgcgccggacgactcgttcccgagcgatcacggcacggtgatcttcacctttgcgctggccttcctgttctggcatcgcctgtggtccggcgtagtgctgatgggcgtggcggtcgccatcgcctggtcccgcgtctacctgggcgtgcactggccgctggatatggtcggcggtttcctggtggggctgatgggctgcgtcagcgcagccatcctgtggagcctctttggtccggcgctttatcgtggattatcacaggcctatcgcgttctgtttgcccttccgatccgcaaaggctggatacgtgactaa

SEQ ID NO: 1101 - DNA, 429 bp, Enterobacter cloacae
cgagtcctccagtcgcttttttatccttcctgctatctccttcttctctcctttactacaatcaaatatgatttaatgcatatgaaacaaaacattcaggatgacagaatgctccacccgctccagctcttcaaaaccctctccgacgaaacgcgcctctccatcgtcatgcttctgcgtgaggcgggcgagttgtgcgtctgcgatctctgttccgctaccaacgagccgcagccgaaagtctcgcgccatatggccttactgcgcgaggccgggctggtcatcgatcgtcgtgagggtaaatggatctactaccgtctctctcccaacatgcccgcgtgggcggcaaccgttatcgataacagctggaactgcctgcgagaagagacacgtatgaagctgaaaaaccgcctcccgggctcttgctga

SEQ ID NO: 1102 - DNA, 885 bp, Enterobacter cloacae
tcattattgccgccctggtggcgcgagcggtggcaaaaccggaagcagaaacaacgtcaatggagaagggatatgagcgttaaactgattgcagtcgacatggatggctccttcctgagcgatgcgaaaacctataaccgcgcgcgttttctggcgcagtacgcgcgcatgaaagcgcaaggcatccgttttgtggtcgccagcggaaaccagtactaccagctgatctcatttttcccggagatcgcccatgaaattgccttcgtcgccgaaaacggcggctgggtggtggatgcgggcgaagacgtgtttaacggcgaactgtcgaaagagcattttctgaccgtcgccaccctgttaaacgacgtgcccggcattgagataattgcctgcggaaaaaacagcgcctacacgctgaaaacgtataacgacctcttcaaagagattgctgcgaaatactatcaccgccttgaaagcgtcagcagctttgacaacctcaacgatattttcttcaaattcgggctaaacgtctctgacgacgaaattccgcgcattcaggcgctgctgcatgagaagcttggcgacatcatggtgccggtgaccacgggacacggtagtatcgacctgattatccccggcgtacacaaagctaacggcctgcggatcctgcaagcgcgctggggcattgaggacagtgaagtggtggcctttggcgacagcggtaacgacgtggagatgttgcgccaggctgggtttggcttcgcgatggccaatgccagaccgcacattaaggcggtggcccgctatgaagcgccgaacaataatgacgaaggggtgctggacgtaattgatagggtgctggacggggaggcgccgtttaattga

SEQ ID NO: 1103 - DNA, 801 bp, Enterobacter cloacae
gcccccgccctgcgggggctcacttttttagcccgaggatctatggaaacacgtcgcgatgaccgcattgctcagctgctccaggcgctgaagcgcagcgataagctgcatcttaaggaagccgctaccctgcttggcgtgtctgaaatgaccattcgtcgcgatctgaacaacgacagcgcccccgttgtgctgcttggcgggtatattgttctggagccgcgtagcgccagccattatctgttaagcgatcaaaaaacacgcctggtggaggagaagcgcaaagccgcgcggctcgccgcctcgctggtgcagccgcatcaaacgcttttttttgactgcggtacgacaaccccgtggatcatcgaggccatcaatagcaccgttccgtttaccgccgtctgttattcgctaaacaccttccttgccttgcaggagaaaccggcgtgccgggtgattttgtgtggcggcgaatttcatgccagcaacgccattttcaaaccgctgaatattcaggacacgctgagcaatgtatgcccggatatcgccttttactctgcggcgggcgtgaatgtgaaacagggggcaacctgttttaatcttgaagagttaccggtgaaacagtgggcgctcaacgccgcacagcagcatgtgctggtggttgatcacagtaaatttggcaaggtccgtccggcaaggatgggtgaactgtcgcgctttgacgccatcgtcagtgattgccgcccggatgacgagctggtggcatacgcgaaagcgcagcaggtgaagttgatgtattga

SEQ ID NO: 1104 - DNA, 408 bp, Enterobacter cloacae
ggttttactgagaaggataaggtcatgcgccatcgtaagagtggtcgtcaactgaaccgcaacagcagccatcgccaggctatgttccgcaacatggcaggttcactggttcgtcatgaaatcatcaagacgaccctgcctaaagcgaaagagctgcgtcgcgtagttgagccgctgattactcttgccaagactgacagcgttgctaatcgtcgtctggcattcgcccgtactcgtgataacgagatcgtggcaaaactgtttaacgaactgggcccgcgtttcgcgagccgtgccggtggttacactcgcattctgaagtgtggcttccgtgcaggcgacaacgcgccgatggcttacatcgagctggttgatcgttcagagaaagcagaagctgctgcagagtaa

SEQ ID NO: 1105 - DNA, 486 bp, Enterobacter cloacae
ggagggcatgccatgttcgacgtactgatgtatttgtttgagacttacatccacaacgaagcagaaatgcaggtggatcaggacaaattaacacgggatctgaccgacgcaggttttgagcgggaagatatttataatgcgttgatgtggctggataagttggctgattatcaggacggcctcgccgaaccgatgcagcttgcttctgacccattgtctgtgcgcatctatacagctgaagagtgtgaaaggctggatgccagctgccggggattcattttattcctcgagcagattcaggtgctaaacctcgaaacgagagagatggtgatagagcgcgtcatggcgctggatactgctgaatttgaactggaagatctgaaatgggtgatcctgatggtgctgttcaacattccaggctgtgaaaatgcctatcagcaaatggaagaattactctttgaagtgaatgaaggtatgctgcattaa

SEQ ID NO: 1106 - DNA, 627 bp, Enterobacter cloacae
aacgcttttgcgccagtaaacaatgtggaaagccggtttcggcggatcaaatcagtgaataataacctgccatcaggctccatcgcgcaggcggtggaaatcctgaaaaaagaagaagtcatcgcctatccaacagaagccgttttcggggtcgggtgcgatcctgacagcgaagtcgccgttaaccgtctgctggcgctaaaacaacggcctgtcgaaaaaggattgattttgatcgctgcgaactacgcgcagcttaagccttatattgatgattccatgctgacgcctgcacagcgggaaaccattttctctgcgtggcctggtcccgtgacgtttgtttttcctgcacaaccgacaacgccgcgctggttaaccgggcgtttcgattcacttgcggtacgcgttaccgaccatccgctggtggtggagttatgccaggcatttggtaaacctctggtttcaaccagcgccaacctgaccgggcttcccccctgtcggacaaccgaagaagttctggcgcagttcgggagtgatttcccggtagccgtcggtgaaaccggtggccgtcttaacccgtcagaaattcgcgatgccttgaccggcgaacgttttcgccagggataa

SEQ ID NO: 1107 - DNA, 366 bp, Enterobacter cloacae
gagtgcatagtggcccgtatagcaggcattaacattcctgatcagaaacatgctgtgatcgcattaacttcgatctacggcgtcggcaagacccgttctaaagccattctggctgcagcgggtatcgctgaagatgttaagatcagtgagctgtctgaagaacaaatcgacacgctgcgtgacgaagttgccaaatttgtcgttgaaggtgatctgcgccgtgaaatcagcatgagcatcaagcgcctgatggatcttggttgctatcgcggtttgcgtcatcgtcgtggtctgccagtacgcggtcagcgtactaagaccaacgcacgtacccgtaagggtccgcgcaaaccgatcaagaaataa

SEQ ID NO: 1108 - DNA, 624 bp, Enterobacter cloacae
aaaatggcaagatatttgggtcctaagctcaagctgagccgtcgtgagggcaccgacttattccttaagtctggcgttcgcgcgatcgataccaagtgtaaaattgaacaagctcctggccagcacggtgcgcgtaaaccgcgtctgtctgactatggtgtgcagttgcgtgaaaagcaaaaagttcgccgtatctacggtgtgctggagcgtcagttccgtaactactataaagaagcagcacgtctgaaaggcaacacaggtgaaaacctgctggctctgctggaaggtcgtctggacaacgttgtataccgtatgggcttcggcgcgactcgtgctgaatcacgccagctggttagccataaagcaatcatggtaaacggtcgtgttgttaacatcgcttcttatcaggttaaagcgaatgacgttgttagcattcgtgagaaagcgaaaaagcaatctcgcgtgaaagccgctctggagctggctgagcagcgtgaaaagccaacctggctggaagttgatgctggcaagatggaaagtacgttcaagcgtcagccggaacgtcctgatctgtctgcggacattaacgaacacctgatcgtcgagctttactccaagtaa

SEQ ID NO: 1109 - DNA, 459 bp, Enterobacter cloacae
aaggttaatacaaaaaataaacaaggagtagccatgtaccgcataggtgaacttgcgaagcttgctaacgtaacgccggatactatccgctactacgaaaagcagcagatgatcgatcatgaggtcagaacggaaggtggatttcgcctttatacggataacgacctgcaacgccttcgttttatccgctatgcacggcaactcggcttcacgcttgagtcgatccgtgaactgctgtcgatccgtatcgatcctgaacatcatacgtgtcaggaatctaaaagcatcgttcaggcccggctggatgaagttgaaggacgcattcaggaactgcaagccatgcagcgatctctgcaaaggttaaatgacccgtgctgcggtaccgctcacagcagtgtttattgctcaatactggaagcacttgaacagggtgccagtagtgaagctcaaggttgttga

SEQ ID NO: 1110 - DNA, 234 bp, Enterobacter cloacae
ctatgctcaggagaaatgatgagccgctatcagcatactaagggacacattaaggataacgccattgaggcattgcttcacgacccacttttcagacagcgagttgagaagaacaagaaaggaaaagggagttatttacgtaaaggtaaacatgcacaacggggtaaatgggaggccagtggcaagcaagctaatcgcttttttaccactggcctttctgtttctgtctcctga

SEQ ID NO: 1111 - DNA, 306 bp, Enterobacter cloacae
ccggcgaacgttttcgccagggataatgtgatggaaacctatgctgtttttggtaacccgatcgcgcacagcaagtcgcctctgatccatcagctgtttgcagagcaattgcagatagatcacccatatggtcgggttcttgcgcctgttgatgcatttttaccgacgctaaatagcttttttgttgcgggcggtaaaggtgcgaacgttacggtgccttttaaagaagaggctttcgggcgtgcggatgagctgaccgagcgtgcgtgtcttctaccacggggcctggccggtccgctaattgaa

SEQ ID NO: 1112 - DNA, 393 bp, Enterobacter cloacae
ataatggcaaaggcaccagttcgtgcacgtaaacgtgtaagaaaacaagtctctgacggcgtggctcatatccatgcttctttcaacaacaccatcgttactattactgatcgtcagggtaacgcattgggttgggcaacagccggtggttccggtttccgtggttctcgcaaatccactccgttcgcagctcaggttgcagcagagcgttgcgctgaagccgtaaaagaatacggcatcaagaatctggaagttatggttaaaggtccgggtccgggtcgtgaatctactgttcgcgctctgaacgccgctggtttccgcatcacgaatattactgatgtgactccgatccctcataacggttgtcgtccgccgaaaaaacgtcgcgtataa

SEQ ID NO: 1113 - DNA, 1008 bp, Enterobacter cloacae
taccaaagagaggacacaatgcagggttctgtgacagagtttctaaaaccgcgcctggtagatatcgagcaagtgagttcgacgcacgccaaggtgacccttgagcctttagagcgtggctttggccatactctgggtaacgcactgcgccgtattctgctctcatcgatgccgggttgcgcggtgaccgaggttgagattgatggtgtacttcatgagtacagcaccaaagaaagcgttcaggaagatatccttgaaatcctgctcaacctgaaagggctggcggtgagagttcagggtaaagatgaagttattcttactctgaataaatctggcattggccctgtgactgcagccgacatcacccacgacggtgatgttgaaatcgtcaagccgcagcacgtgatctgccacctgaccgatgagaacgcagctattagcatgcgtatcaaagttcagcgcggtcgtggttatgtgccggcttctgcccgaattcattcggaagaagatgagcgcccaatcggccgtctgctggtcgacgcatgctacagccctgtagagcgtattgcctacaatgttgaagcagcgcgtgtagaacagcgtaccgacctggacaagctggtcatcgaaatggaaaccaatggcacaatcgatcctgaagaggcgattcgtcgtgcggcaaccatcctggcagaacaactggaagctttcgttgacttacgtgatgtacgtcagccggaagtgaaagaagagaaaccagaattcgatccgatcctgctgcgccctgttgacgatctggaattgactgtccgctctgctaactgcctcaaggcagaagctatccactatatcggtgatctggtacagcgtaccgaggttgagttgctgaaaacgccgaacctgggtaaaaaatctcttaccgagattaaagacgtgctggcttcacgtggtctgtctctgggcatgcgcctggaaaactggccaccggcaagcattgctgacgagtaa

SEQ ID NO: 1114 - DNA, 510 bp, Enterobacter cloacae
tcgttcagagaaagcagaagctgctgcagagtaatctgtagtaacgtaaaaaaacccgcctcggcgggtttttttatatccgcagaatctccacttatctacaatgtctgtatcttttctgctcaccccctggagttcattatgtggttgctcgatcagtggtctgaacgccatatttgcgatgcccaaaacaaaggcgagttcgaaaatcttcccggcagcggtgagccgctgattctggacgatgattcacatattccccctgaattacgggccggttatcgcttactgaaaaacgcaggttgtttaccgcctgagcttcagcaacgtaatgaagccgtcgagcttgccgatctgcttaaaggcattcataagaatgacccgcggtactctgaaatcagtcgtcggttggcgctcatcgagctaaaactgcgccagacgggaatgaatactgactttttgcatggtgagtacagtgaaaggttaatacaaaaaataaacaaggagtag

SEQ ID NO: 1115 - DNA, 1200 bp, Enterobacter cloacae
acaaatccccggtcgattgacagcatcagtgaccaatcgcaaagattgctgaggctgcttatggcagggaaaaggatgacgtccacagagatatggttacggcttataaacatcgggtcgttatacggtgacgcgatgctggagattgcgcagaggctgcttcgccaggcaaccgttgatgctgaagctgtcaacgcggcagggctttcgcccaaacatgccgtaaagtttttttcgttcagcgagagtgagcttgaacgtagtctggaatggctggaacacaccgacaaccaccttctcacggcggatgatcctcgttttccgccattgttgcgttctatacctgattttcccggggcgctctttgtgcgaggccgcgtcgacgtgcttaatagcatgcagcttgcggttgtgggcagccgtgcgccctcgtggtacggcgagcgttgggggaaaatgctcagtgaacagctgtcccaatgtggctttacgatcaccagtggcctggcttgcggcatcgacggtgtggcacatcatgcggcgttgtcagcaaaagggcgaagtgtcgccgtgcttggcaatggtctttttagtctctatccgcgtcgtcatcacattctggctgagcaacttatcgcttctgagggggcgatagtatctgagttttcactttcgacatcgcccagaccgggtaactttccacggcgtaaccggatcatcagcgggttaagccagggcgtgctggtggtcgaagctgcgattcgaagtggatcgctggttactgcaaggtgcgcactggagcaggggcgtgaagtttttgcgctgcccggcccgttggggaaccctggctgcgaaggccctcactggctgataaaacagggggcgacgctggtgacctgtaaagaggatatcctggaaaatttgcagtatggattgcattggttgcaggatgatctccaaaagcgacatatttcatcggatcaggaggccgtagcattgccatttcccaagctcctggctaacgtaggagatgaggtaacacctgttgacgttgtcgctgaacgtgccggccaacctgtgccagtaacggtagcacagctactcgaactggagttagcagggtggatcgcagctgtacccggcggctatgtccgattaaggagggcatgccatgttcgacgtactgatgtatttgtttga

SEQ ID NO: 1116 - DNA, 597 bp, Enterobacter cloacae
aggtatgctgcattaattctatgtgcagcaacaagagttgttatggccaaatcagcactcttcacggtgcataaaaacgagccctgcccacagtgtggggctgaacttgttattcggtccgggaaacacggtccgtttctcggttgttcacactatccggaatgtgattatgtccgttccctgaagagccaggcggacggacatatcgtcaaaattctggagggacagctttgtccgctctgcggcggcgaactggcgctgcggcaggggcggttcgggatgtttatcggatgcagccgctacccggaatgtgatcatacggaacaaattgataaaccagatgaaacggcaattgcctgccctcagtgccagcgtggtcaattggtgcagcgccgctctcgttatggcaagaccttccattcgtgcgatcgctatcctgaatgccagttcgttatcaatttcaaaccagtagcgggcgtctgccataattgcgattatccgttacttatagaaaagaaaaccgcgcaaggcttgaaacgcttttgcgccagtaaacaatgtggaaagccggtttcggcggatcaaatcagtgaataa

SEQ ID NO: 1117 - DNA, 1323 bp, Enterobacter cloacae
ggcccggtgtttccgggcatttttatttttacggttatgaaaagacaaaatctacgcactatggcggctcaggccgttgagcaggttattgagcagggccagtcactgagtaatgtcctgcctccactgcaacaaaaggtttccgataaagataaagcgctgcttcaggagctgtgctttggcgtgctgcgtaccctctctcagcttgaatggttaattaataagctgatgtcacgcccgatgagcggcaagcaacgtaccgtgcattatttgatcatggtcggtttctaccagcttcttcatacccgcattccacctcatgctgcgctggctgagacagtggaaggtgccgttgcgattaaacgtccccagctgaaaggattgattaacggcgtgctgcgtcagttccagcgtcagcaggacgaactgctggcagaatttgcgcaaagcgaagcgcgcttcctgcatccagaatggctgctgaatcgccttaaaaaagcctacccacagcaatggcaagacattgtggatgccaataaccaacgtccgccgatgtggttacgcgtcaatcgtaaccatcatacccgcgacgcatggctggccctgctggaagagaccggaatgagcggcttcacacacgcggcttatcctgatgcggttcgtttagcctcccctgcaccggtacatgcattacccggttttgaagagggctgggtaacggtacaggacgcatccgctcaggggtgcatggcctggcttgaaccgaaagacggggagcagatccttgatctttgtgcagcgccagggggaaaaacaacgcacattctggaagtggcgccgcaggcctgcgtgatggccgtggatgttgatgagcagcgtctttcacgcgtctatgacaacctcaagcgtctgggtatgaaagcacaggttaagcaaggcgatggacgtaaacccgcagactggtgtggtgatacccggttcgatcgtattttgctggacgccccctgctctgcaaccggcgtaattcgtcgtcatcccgatatcaaatggctgcgtcgcgatcgtgatatcaaggagcttgcccagttgcaatccgaaattctggatgccatctggccgcatctcaaacccggcggaaccctggtgtatgcaacctgctctgttcttccggaagaaaacagtcagcaaattgcggctttcctgaagcgcaccccggacgcgacgctgcatgatacgggaacacctgagcacccgggtctgcaaaacctgccgggcgcagaagagggtgatggcttcttttacgctaagctaatcaaagagtga

SEQ ID NO: 1118 - DNA, 1410 bp, Enterobacter cloacae
tcaaagagtgatgttgagaacaggtcacgaaagatgaaaattatcattctgggcgcagggcaagttggcggaacgctggcggaaaatctcgtgggcgaaaacaacgatatcaccattgtggataccaatggcgatcgcctgcgcgttttgcaggacaagtttgatcttcgtgttgtgcaggggcacggctctcatcctcgagtgcttcgtgaggcgggcgcggacgatgccgacatgctggttgcagtaaccagttctgatgaaaccaacatggttgcatgccaggtggcctactcgctgttcaacacaccgaaccgcatcgcccgcattcgctccccggactatgtccgggatgcggaaaagctgtttaattccgaagcagtacctatcgaccatcttattgcccctgagcagttggttatcgacagtatttatcgtctgattgagtacccgggcgcgttgcaggttgtgaactttgctgaagggaaagtaagcctggcggtcgtgaaggcttattacggcggcccgctgattggtaatgccctgtcgacaatgcgcgagcatatgccacatatcgatacgcgtgttgcggcgattttccgtcacgacagacctattcgtccgcaaggttccaccattgtcgaagccggggatgaagtcttctttattgcggcttctcagcatatccgtgcggtgatgagtgaacttcagcgtctcgaaaaaccgtataaacgtattatgctggttggcggcggtaatattggcgcaggtctggcgagacggctggaaaaagactacagcgtgaagctgatcgaacgagatcaacagcgcgcgtcggagctggctgaaaaacttcagaatactatcgtgttttatggcgatgcttcggatcaggaattgctcgccgaagagcatatcgatcaggttgatctttttattgccgtcaccaacgacgacgaagcgaatattatgtccgccatgctcgctaaacgtatgggggcgaaaaaagtaatggtgcttatccagcgtaaggcttatgtcgacctggtacagggtagcgtaattgatattgctatttcaccccagcaagccaccatctctgccctgctaagccatgtgcgtaaagcggatattgtcggcgtgtcgtctctgcgtcgtggtgttgctgaagccattgaagccgtcgctcacggggatgaaacgacgtcgcgcgttgttggtcgcgcgatcgacgaaattaaacttccaccaggcaccattatcggcgccgtagtgcgaggtaacgatgtcatgatcgccaatgataatttacgtatcgagcagggtgaccacgttattatgttcctgaccgataaaaaatttattaccgacgtcgagcgtttattccagccaagtccattcttcctgtaa

SEQ ID NO: 1119 - DNA, 528 bp, Enterobacter cloacae
acacgactctggaaatttatggcagttttgcaagtgttacatattcctgacgagcgtcttcgcatcgtcgcggaaccggttaaagaagtgaatgcagaaattcagcgtatcgtcgatgatatgttcgataccatgtacgctgaagaaggcattggcctggcggcgacccaggtagacattcacaagcgtattatcgtgatcgacgtttctgaaaatcgcgatgagcgtctggtgctgatcaaccctgaactgcttgaaaaaagcggcgaaacaggcattgaggaaggctgtctgtctatccctgaacagcgcgctttggtgccacgtgccgaaaaagttaaaattcgcgcactggatcgtgacggcaatccgtttgagctggaagccgacgatctgctggcgatttgcattcagcatgagatggatcacctggtcggtaaactgtttatcgattacctctcacctctgaagcaacagcgtattcgtcagaaagttgagaaactggatcgtttgcgttctcgcgcttaa

SEQ ID NO: 1120 - DNA, 972 bp, Enterobacter cloacae
cgccccccggatacaaggaataacgtgtctacatcactacgtataatcttcgcgggtacccctgattttgcagcgcgtcatctcgacgcgctgctatcgtctggtcatcagattgttggcgtatttactcagccggatcgaccggctggccgcggtaaaaaactgatgcctggcccggttaaagtactggcagaaacgcatggtttaccggtattccagccagcgtcattacgacctgaggaaaaccagcagttagtggcagacctgaacgctgacgtgatggtagttgtggcttacggcctcattctgccaaaagcggtactcgatatgccccgcctgggctgtgttaacgttcatggttctttgctcccacgctggcgcggtgcagcccctattcagcgcgctctgtgggcaggcgatgctgaaactggcgtgacaatcatgaagatggacgtaggtttagacacgggtgacatgctgtataaactggcgtgtcccattaccgcagaagataccagcgccacgctgtatgacaagctggcggatctcggtccgcaggggctgattgaaacgttgcaacagcttgctgacaatacagcgacacctgaagtgcaggatgaggcacaggtgacctatgctgaaaaactgagtaaagaagaagcccggatcgactggtccctgtcagcagctcaactcgaacgctgcatccgcgcctttaatccgtggccgatgagctggttgatgattgatgagcagccagtgaaagtctggaaagcttcagttattaacggcaatacatcagcagagcccggtacgattatcgacgccagcaaaaacggtatccaggttgcgaccggagaagggatcctgaatcttgaatcgctgcaaccggccggtaaaaaggcaatgagcgcgcaggatctattaaattcccgtcgtgaatggttcatccctggcaatcgtcttgcctga

SEQ ID NO: 1121 - DNA, 459 bp, Enterobacter cloacae
tcatttgttaaacttataggcgtcagctggcacaaggagaacataatgagttttattaaagagtttcgcgaatttgcgatgcgcgggaatgtagtggatttggctgtgggtgtcattattggtgcggcgttcggtaagatcgtttcatcattagtcgccgacattattatgccgccgttaggactgttgattggaggcattgatttcaaacaattcgccttcacccttcgggaagctcagggcgatatccctgcggttgtaatgcactacggcgtattcattcagaacgtatttgatttcgtgatcgtggcatttgccattttcatggcgatcaaacttatcaacagacttaaccgtaaaaaagaagaaccggctgctgccccgccagcaccaactaaagaagaagtcttactgactgaaattcgcgatctgttaaaagagcagaataaccgcgtttaa

SEQ ID NO: 1122 - DNA, 408 bp, Enterobacter cloacae
caggaagttatcatggctcaaataccagcaggggcagattgtcccggccagttaagccgtaaacagaccggcgacgcgtgggagttaaaggcgcgtcgctggcttgaaggcaaaggactgcgctttgtcgccgccaacgttcgcgggcgcggcggcgagattgacctgatcatgaaagacggtcagaccatcgtgtttgttgaagttcgctaccgacagtcgtcccgttttggcggtgctgccgccagcgtgacgctcgccaaacaacaaaaattattacagactgcccacttgtggcttgcccgccataatgggagttttgatactgtggattgccgtttcgatgtggtagccttcaccggaaatgcgatcgactggcttaaaaacgcgtttggcgaagacgcataa

SEQ ID NO: 1123 - DNA, 600 bp, Enterobacter cloacae
agggataccgtgctcgaacgaattaaagtgtgcttcacagaaagcattcaaacgcagattgccgcggcggaagcccttccggacgcgatctcgcgtgcagcgatgacactggttcagtcgctgctcaacggcaacaaaatcctctgttgtggcaatggcacgtccgccgccaacgcacagcattttgctgccagcatgattaatcgctttgaaaccgagcgcccaagcttacctgccattgcactaaacaccgataacgtggtcttaactgcgattgccaacgatcgtctgcatgacgaaatctacgccaagcaggtgcgcgccttaggccatgccggagacgtgctgctggcgatctccacgcgcggtaacagccgggatatcgttaaagcggttgaagcggcagtgacccgggatatgacgattgtcgccctgaccggttacgacggcggtgagctggctggcctgctggggccgcaggatgtggagatccgcattccttcgcaccgtagcgcccgcatccaggagatgcatatgctcacggtgaactgcttatgcgatctgatcgataacacgcttttccctcaccaggatgattaa

SEQ ID NO: 1124 - DNA, 585 bp, Enterobacter cloacae
ggagttctcatgaaggttttatcggcccttgcagtcgtgatgtctgcattactgcttcagggatgcatcgctgccgctgtagtcggtaccgcagcggtcggcaccaaagcagcgaccgatccgcgtaccgttgggacgcaggtggatgacggtacgcttgagctgcgcgtaaacagtgcgctgtcgaaagacgagcagatcaagaaggaagcacgcatcaacgtgacggcttatcagggcaaagtgctgctggcaggccaggcgccaaatcctgaactcgcctcgcgcgccaaacagatcgcgatgggtgtggaaggcacggcggaagtgtataacgagatccgccagggccagccgattggtctcggcaccgcgtcatctgatacctggatcaccaccaaagtgcgttcccagctgctgggtaccgaccaggtgaaatcctcaaacgtgaaagtgaccacggagaacggcgaagtgttcctgctgggtctggtgacggaacgtgaagggaaagcggcagcggatatcgccagccgggtgagcggcgtgaaacacgtcaccaccgcctttacttacattaagtaa

SEQ ID NO: 1125 - DNA, 1173 bp, Enterobacter cloacae
gggggggggatcccaaaccggggaagaagggcgatgtttaggcggcaatgtggacggggaagttcaccaaatttcgtgcacgagcgcttccaggacacggtgctgcacgacgcgtttgccttctttagcggcattcgtattgtaccgattgttaccgccctcaccctgtcgctggtcggcttgttcatccccctgctgtgggaatatgtggcaatgggcattgccgggattggtcatatcatccagagcaccagcgtctttgggccgttcctgtatggcgtgggcgtactgctgctcaaaccttttggcctgcaccacatcctgctggcgatggtgcgcttcaccccggcgggcggcattgagatggttaacggccaggaagtggccggtgcgctgaacattttctacgccgagctgaaagccggcctgccgtttagcccgcacgttacggcatttttatcgcaagggtttatgccgacctttatcttcggcctgcctgccgtggcttacgctatctaccgcaccgcgcgtccggaaaaccgtccggtgattaaagggctgctgctttctggcgtgctggtttcagttgtcacgggtatttcagagccgattgagttcctcttcctgtttattgcccctgtgctttacgcgtttcatatcgttatgtctggcctggcgctgatggtgatggcgcttctcggcgtcactatcggcaacaccgacggcggcattctggatctgctgatcttcggcgtcatgcaggggatgtcgaccaaatggtatctgctgttcccggtgggtatggcctggtttgctatctacttcttcgtcttccgctggtacatcctcaggcacgatattaaaacgccgggccgtgaggttgacgcgcagggtgcgctccaggcggtggaagccaatacccgggcacgtggaaaatcaaaatacgatcatgggcttattcttcgcgcgcttggcggtaaagagaatattgagtcgctcgacaactgcatcacccgcttacgtctggtggtgaaagatatggggcttatcgaccagcaggcgctgaaggccgcgggcgccttgtcagtcgtggtgcttgatgcccacagcgttcaggtgatcatcggcccgcaggtgcagagcgtcaaatccggcattgaagccttaatttaa

SEQ ID NO: 1126 - DNA, 1185 bp, Enterobacter cloacae
cagggggacgttgtgtttgatttcgacagaatcattgagcgtaaaagcgataaatgccgtaaatgggatcatgcgtttgtgtgctcgcgtttcggtgatgtcccggagggatttatcccgctgtggatagcagacatggatttcacctcgccacccgccgtgattgaaggcttccagcgcatcgtggagcatggcaccttcggttacacctggtgcttcgacgaattctacgatgcggtcatcgccttccagcgcacccgtcatcaggttgaggtgcataagtcatggatcaccctgacctacggcaccgtttccacgctgcactatacggttcaggcgttctgcaaacccggcgactgcgtgatgatgaacaccccggtgtatgacccgtttgcgatggcgacacagcgacagggcgtgcgggtgcttgcaaatccgctgagcgtgaaggaaaaccgctatcacctggattttaatctgattgaagttcagctcaaaactcaccgtccaaaactgtggttcttctgctcgccgcataacccttcaggccgaatctggcgcgcggatgagatacgccaggtgtccgatctctgtaagcgctacggcacgattctggtggttgatgaggttcacgccgagcacattctggacggtacattcgtcagctgtctgacttcgggctgtgccgcccaggacaacctgattgtgctgacctcccccaataaagcgttcaaccttggcgggctaaaaacatcctactcgataattccagacgattcgctgcgccagcgtttccgccagcagctggagaagaactccattacctcgcccaatatcttcggcgtgtggggaattattctggcctatcagcagggtctgccatggctcgacgcgctgaatggttatctgcgcggcaatgcccgctaccttgcggatgccatccagacccacttccctgcatggaagatgatgaacccggagtcgtcatatctcgcctggatagacgtcagtgcggacgatcgcagtgcgacggcgctaacccaacatttcgccaaacaggctggcgtggtcatcgaagatggcagccactacgtacaaaacggcgaaaactacctgcgtattaacttcggcacccagcgctactggctggaacagtccatcaaccgaatgctgaagcattactga

SEQ ID NO: 1127 - DNA, 2169 bp, Enterobacter cloacae
gcattgcgtaaaaaaatcactggatacagtatggtaccgttaacgtttcttcgaaaaaaagccgcgcacagcgtgcccctcctgctggcagccctgatctttaccggctgcggcacccaggcacctgaccagagcactgctcatatgcagggatccgctcaggctgattctggcttttatctgcaacaaatgtcgcagagtacaaatgataccaggatcaactggcaattactcgccattcgtgcactgctgaaagaagggaaaacccagcaggccgccgagctgttcagccagctgccgcaggatcttaacgacactcagcgtcatgagcagacgctgctgtcagcagaactgaaggtcgcgcaaaaagattacgacggcgcgaagaagatcctcggcaccatcgatctcagcacgctggataaaaaccagcagacccgtttctggcaggccggtatcaccgccgagcagggccgcacttccctgacgctactccgcgcgctgattgcccaggagcctctgctcgcgggtgcggacaagcagaaaaatattgatgcaacctggcaggcgctcgcctccatgacccaggatcaggccaaagcgctggtaatcaacgccgatgaaaatgttctgcaaggctggctggatctgcaacagatgtggttcaacaaccgcagcgatccgaacatgctgaaagctggcattaccgactggcaaaagcgttacccgcaaaacccgggagcgaaaatgctgccaacgcagctggtgaacgtgcaaaactttaagcccgcctccaccagcaaaatcgccctactgctgccgttaaacggtcaggcagcggtgtttggtcgcgccattcagcaaggtttcgaagccgcgaaaaacggcactaccgccgtcagcggtagcgcggttccgacccaggcagcacaggcggcgaatgtgaatgacgttgtcagcccgtccgccgccgaaaccagcgacctgaccaccgcgcaaacccctgcgcagggcaccatgcagaatccggttaccgccccaacgacgcagcccgctccccctgcgcctgcggcaacacaggccccggctgaaacaccggcgcccgcgacggcagaacaacctcagccgcaaaccgagcagccggaacagcagccagcaacccagccgcaggctgtggccaccaccagcgctaaccctggtgcagagttgaaaatctacgacaccagcgcccagccgcttgaccaggtgctggcgcaggttcagcaggacggggccagcatcgttgtcggtccgctgttgaaaaacaacgtggaagcgctgatgaagagcaacaccacgctgaacgtgctggcgcttaaccagcctgagcaggttcagaaccgcgccaatatctgttacttcgccctctctccggaggatgaagcccgcgatgcggcccgtcatattcacgagcagggcaagcaggcgccgctgctgctgatcccacgcagcacgctgggcgatcgcgttgccaacgcgtttgcgcaagagtggcagacccttggcggtggcgtggtgttgcagcagaaatttggctcagctgccgaactgagagcgggcgtgaacggcggggcaggtattgccctcaacggtagcccggtatccgccagcctgccgcagcagcagagcgtcaccatcggcggtctgacgatcccggcgccccctaccgacgcgcaaatcagcggcggcggtaaagtggattcggcgtacatcgtcgctacgccggaagagatcgcctttatcaaaccgatgatcgccatgcgtaacggcagccagagcggcgcaacgctctacgccagctcacgcagcgcacagggtaccgcaggcccggatttccgtctggaaatggaaggactgcaatacagcgagatcccgatgctggcaggcagcaacccgcagttgatgcagcaggcgctgggcgcggtgcgcaatgactattccctggcgcgtctgtacgcgatgggcgtcgatgcttgggcgctggcaaaccacttcacccagatgcgccaggtaccgggcttcgagcttaacgggaataccggcgatctgaccgccgatcaggattgtgtgattaacaggaagttatcatggctcaaataccagcaggggcagattgtcccggccagttaa

SEQ ID NO: 1128 - DNA, 885 bp, Enterobacter cloacae
atcggcaatacggacgaaacaatgaaacaacacgaaacggcagataattctcaaggccagctttatattgtacctactcctatcgggaatttgtctgatattacccaacgtgcgctcaccgtattgcaagctgttgatttaattgctgctgaagacacccgtcataccggtttactgctacaacactttgccattaacgcccgtttgtttgccctgcacgatcacaatgagcaacaaaaagccgaaacgctggtggcgaagcttaaagaagggcagaacatcgcgctggtctccgatgcgggaacgccgctgatcaacgatccgggctaccatctggtacgcacctgccgtgaagcaggcatccgcgttgtgccgctgcccgggccgtgcgcggcgattgcggcgttaagcgctgcgggtctgccatccgatcgtttctgctacgaaggcttcctgcctgctaaatccaaaggccgtcgcgatgtgttagaggatctggaagctgaaccgcgtacgttgatcttctacgaatcaactcaccgtctgctggaaagcctggaagatatggtgaccgtctggggcgaagggcgctacgtggtgctggcgcgcgagttgaccaaaacgtgggaaaccattcacggtgcgccggttggcgaactgctggcgtgggtgaaagaggatgaaaaccgccgcaagggcgaaatggtgctgattgttgaagggcacaaagcgcaggaagacgctctgcctgccgatgcgctgcgtacgctggctctgctacaggctgaactccccctgaaaaaagcggcggcgctggcggcggagatccacggcgtgaagaaaaatgcactgtataaatatgcgctggagcagcagggggagtaa

SEQ ID NO: 1129 - DNA, 339 bp, Enterobacter cloacae
aaatatatcctggccgtactggtgctgggggccgcacgcgtctggctgttcccgcatgcggatggcgctatcgacaacacgctgatgtgggtgattgcgatggcggtggccggttgcctgttcgtgatcccaaccgcggcggagatcccgattattcagaccatgatgatggccggtatggggaccgcaccagcgctggcgctgctcatcacgctgccggcggtgagcctgccgtcgcttatcatgctgcgtaagtcattcccggcgaaagcgctgtggctgactgcggggctggtggcgttgagtggagtgattgtggggagtatggcgcttgtgtga

SEQ ID NO: 1130 - DNA, 291 bp, Enterobacter cloacae
ggggaggctgtccttcatccggctgttaagacatgggttgttgaaggttccaaaaaacgtctgcaggcattcgagggcgtggttatcgctattcgtaaccgcggtctgcactctgcattcactgttcgtaaaatttccaacggcgaaggcgttgagcgtgtcttccagactcactctccggtagttgacagcattgctgttaaacgtcgtggtgctgtacgtaaagctaaactgtactacctgcgtgagcgtactggtaagtctgctcgtattaaagagcgtctgaactaa

SEQ ID NO: 1131 - DNA, 996 bp, Enterobacter cloacae
acgaagaagcagtttatggcacaacgagtagaactcaccgcaacagtctccgaaaatcagctcggtcaacgcttagatcaggctttggccgaattgttccctgattattcgcgttcacgcataaaagaatggatccttgaccagcgcgtgctggtaaacggcaagatctgggacaaaccaaaagagaaagtgtttggtggggaagctgtcgccatcaatgctgaaatcgaagaggaaatccgcttcgagccgcaggatatcccgctggatatcgtctacgaagatgacgacattctggttatcaacaagccgcgcgactttgttgttcacccgggcgcgggcaatcctgacggtacggtacttaacgcactccttcattattatccgccgattgccgacgtaccgcgtgccggtattgttcaccgtctggataaagacaccacgggtctgatggtggtggcgaagacgattcccgcccagactcgcctggtggaatcgttgcaactgcgcgaaatcacccgtgagtatgaagcggtggcgattggtcatatgacctctggcggcacggtggaagagcctatcagccgtcacccaaccaagcgtacgcatatgtccgtacacccgatgggtaaaccggcggtaacccattaccgcatcatggaacatttccgtattcatacccgcctgcgtctgcgcctggaaaccgggcgtactcaccagatccgcgtgcacatggcgcatattacccatccgctggtgggtgacccggtttacggcggtcgtccgcgtccaccaaagggcgcatcggatgaattcatctccgtgctgcgtaaattcgatcgccaggcgctgcatgcgacgatgctgcgtctttaccacccaatcaccggaattcagatggaatggcatgcgccgatcccacaggatatggtggaacttatcgacgcgatgcgcgcagatttcgaagaacataaggatcacgtggactggttatga

SEQ ID NO: 1132 - DNA, 1134 bp, Enterobacter cloacae
tatcgttgtgtcacctcttcgaggaaaaccactatcgcaaacgagtttgacaggatcgcaatcatgcaaaaagacgcgctgaacaacgtacatatcactgacgaacaggtgttaatcaccccggatcaactgaaggcggaattcccgctgagcgtcgcgcaggaagctcagattgagcactcgcgccagaccatttctgacattatcgcaggccgggatccgcgcctgctggtggtatgtggtccttgctccattcacgatcctgaaaccgccattgagtacgctcgtcgatttaaagcattagcggaggaggtcagcgatagcctctatctggtgatgcgcgtctattttgaaaagccacgtactacggttggctggaaagggttgattaacgatccgcacatggatggctcgtttgatgtggaagcgggcctgaagattgcgcgtcgcctgctggtggagctggtcagcatggggctgccgctggcaaccgaagcgctggatccgaacagcccgcagtacctcggcgatctgtttagctggtctgcgattggggcgcgcaccaccgagtcgcaaacccaccgcgagatggcgtctggcctgtctatgccggttggttttaaaaacggtaccgacggcagcctggctacggcgattaacgccatgcgcgccgccgctatgccccatcgttttgtcgggatcaaccaggcgggccaggtatgcctgctgcaaactcagggcaacccggacgggcatgtgatcctgcgcggcggtaaagcgccaaactacagcccggcggatgtcgcgcagtgtgaaaaagagatggaacaggcgggactgcgtccggcgctgatggtagattgcagtcatggtaattcgaataaagattaccgtcgccagcctgcggttgcagaatctgtgattgcacagattaaagatggtaaccgttcaattatcggcctgatgattgaaagttatattcatgaaggcaatcagtcatcggaacagccgcgtatcgcgatgaagcccggcgtctccgtcacggatgcttgcatcagctgggaaaccactgatgcgctactgcgtgagatccacaaagatttgaacggccagctggcgacgcgtctggcataa

SEQ ID NO: 1133 - DNA, 387 bp, Enterobacter cloacae
cccattaccgcatcatggaacatttccgtattcatacccgcctgcgtctgcgcctggaaaccgggcgtactcaccagatccgcgtgcacatggcgcatattacccatccgctggtgggtgacccggtttacggcggtcgtccgcgtccaccaaagggcgcatcggatgaattcatctccgtgctgcgtaaattcgatcgccaggcgctgcatgcgacgatgctgcgtctttaccacccaatcaccggaattcagatggaatggcatgcgccgatcccacaggatatggtggaacttatcgacgcgatgcgcgcagatttcgaagaacataaggatcacgtggactggttatgaccaaactgattgtcccggagtggccactgcctga

SEQ ID NO: 1134 - DNA, 1554 bp, Enterobacter cloacae
accaagcgtagaagatacatcgccattttgcgtggtctgaaagagcgttatgagctgcaccatcacgtgcagatcaccgacccggccatcgttgcggcggcgacgctttcgcatcgttacattgccgaccgtcagttgccggataaagccattgaccttatcgatgaagcggcgtccagcatccgtatgcagattgactcgaaaccggaagagctggaccgactcgatcgccgtattatccagctcaagctggaacagcaggcgctgaacaaagagtctgatgaagcgagcaagaaacgccttgatatgctcaacgaagaactggacgagaaagagcgtcagtattctgagctggaagaagagtggaaagctgagaaagcctccctctctggcacccagacaatcaaggcggagctggagcaggctaaaattgccattgagcaggcgcgtcgcgtaggggatctggcacggatgtccgaactacagtacggcaagatccctgagctggaaaaacaacttgagatcgccacgcaatcggaaggcaaaaccatgcgtctgttgcgtaataaagtgacggatgccgagattgccgaagtgctggcgcgctggacgggtattcctgtggctcgcatgatggaaagcgaacgcgagaaactgctgcgtatggagcaggatctgcatcagcgcgtcattggacagaacgaagcggtcgaagcggtatctaacgccattcgtcgtagccgtgcggggctgtccgatccgaatcgtccaatcggctcgttcctgttcctggggccaaccggtgtcggtaaaaccgagctgtgtaaagcgctggctaactttatgttcgacagcgatgacgcgatggtgcgtatcgatatgtccgagtttatggagaaacacgccgtctcgcgtctggtcggtgcgcctccgggatatgtcggttatgaagagggcggttatctgacggaagcggttcgccgtcgtccttattccgtcatcctgctggatgaagtagaaaaggcacatcctgacgtgtttaacattctgttgcaggtgctggatgatgggcgtctgacggatgggcagggaagaacggtcgacttccgtaacacggtggtgatcatgacctcgaacctgggttccgatttgattcaggaacgcttcggtgagctggattacagccatatgaaagatctggtgctgggtgtggtcagccaaaacttccgtccggagttcatcaaccgtattgatgaagtggtcgtgttccatccgctgggtgagaaacacattgcgtcgattgcgcagatccagttgcagcgtctgtacaaacgtctggaagagcgtgggtatgaaatccacatctcggatgatgcgctgaaactgctgagcgagaatggttacgatcctgtttatggcgcgcgtccgttaaaacgtgctatccagcagcagatcgaaaacccgctggcacagcaaatcctctctggggagctggttccgggcaaagttatccgtctggaagccaacgaagaccgaattgtggcagtgcagtaa

SEQ ID NO: 1135 - DNA, 1599 bp, Enterobacter cloacae
agcatgcggctactgcgtgctgttagcgcatgtaccgggcgtgatgctggcgcttatcgttctgctcagcgtggtgttgcagcggctgcgcgtgaagccgcctcgtcaggcggtcagccactggcactttttcccctggctttaccccgatacccgcgcgccgccgcgtcggtctgctttctccctttaaaacaaaatcactcactttttgccttaaaaaggaaaagtatgactacctgcactccgcgcgcggcatggggaaacctgctgcgtcgcctccatttctatatcgggctgtttgtcggtccgtttatcttcttcgcagcgctgaccggtacgctgtatgtcgccacgccgcagcttgaaaatgcgctgtaccattatgcactccacacggatgccgttggtgaggcgcagcctcttgctaaacaaattaccgtggcagaaaaggccgtgggttcagcgctgcgtttacacgctgttcgtccggggctggaagagggtgaaacgacccgcgtgatgtttgccgacccggcgctgggtccctccgagcatcgggctatttttattgatcccgccagtcttgaggttcgaggggatatgactgtgtacggcaccagcgggattttaccgctgcgtcagactatcgattatctgcatacctcgctgatgctgggcaacatcgggcgcctctatagcgagttagccgcctcgtggatgtgggttgctgccctgggcgggatcgcgctgtggttctacacccgaccgaagcgccgtattaacaatcgtttccagaatcgtcgtcgcctgcatgtgatcttaggctggacgttactgacgggaatgctgctgttctcagtcaccgggttaacctggtcacaatgggccggtggcaacgtcgataagctgcgtgcagagatgaactggctgacgccgcaggtaaataccaccctttccggtgcgccggaaatgagggatgaacacgccgaacatcgtggtcatcacgggggaatgacgatgcctgaaatgcctgttgaactgtcgctttttgacagcgtattgcaggccgcccgccagtcaggaattgatgcgaaaaaggttgagatccgcccggcaagcagggacgaccaggcctggacggtgacggaaatcgatcgccgctggccgacgcaggttgatgccgttgccgtggatccccactcactgaaggtgctggacagcactcgcttcggggatttcccgctgatggctaaactcacccgctggggcgtggatttccatatggggatcctgtttggtctggcaaatcagctgctgctcatcgcgtttggcgttgcgctgtgcgtgttgattatctggggataccggatgtggtggatgcgtcgccctgcaacgtcagccgcgaacccggtacagacgctctgtcaaagctggctggcattgccgctgtggggaaggggagtgacgttcctgataagcctcctgctggggctggcgttgccagtaatgggcgtcagtctggtggtctttattgtgattgactggctgcgctggcgagcggtttcaggcgtgtcgctcgccggaacatccgttaaatag

SEQ ID NO: 1136 - DNA, 1161 bp, Enterobacter cloacae
acggccagctggcgacgcgtctggcataagaggatagttatggttgctgaattgaccgcattacgcgatcaaattgatgaagtggataaggcgttgctggatctgctggcgcgccgcatggcactggttgctgaggtcggcgaagttaaaagcaaatacggcctgccaatttacgttccggagcgtgaggcctctatgctcgcctcccgccgtaaagaggcacaggcgctgggcgtttcaccggacttaattgaagatgtcctgcgtcgtgtgatgcgggaatcctattccagcgaaaacgacaagggcttcaaaaccctctgtccgtcgctgcgtccggtggtgattgtcggtggcggcggccagatggggcgtctgtttgaaaaaatgctgacgctttctggctatcaggtgcgcatcctggaaaaagaggactggccgcatgcaccggaactcatgaaggatgccggaatggttatcgtcagcgtaccgattcatgtgacggagcagattatcgcgaaacttcctccgctgccggaagattgcattctggtggatctggcgtccgttaaaaatggtcctctacaggcaatgctggcggcgcacaccgggcccgtgcttgggttacacccgatgtttggcccggacagcggcagcctggcgaagcaggtagtggtttactgcgacggtcgtcagccggaagcgtatcagtggttcctggaacagattcaggtctggggggcacgtttgcaccgtatcagtgcggttgagcacgatcagaacatggcgtttattcaggcgctgcgccactttgcaaccttcgcctatggtctgcacctggcggaagagaacgttcagcttgaacaattgctggcgctttcctcgccaatctatcgtctggagctggcgatggtggggcgactgtttgcccaggatccacagctttacgccgacatcatcatgtcgtctgaaaataacctggcgctgatcaagcgctactatcagcgttttggcgaagcgatcaccttgctggaacacggcgataaacaagcgtttatcgacagtttccgtaaagtggagcactggttcggtgattacgccacgcgattccagagtgaaagccgcacgctgttgcgccaggcaaatgacagtcgccagtaa

SEQ ID NO: 1137 - DNA, 933 bp, Enterobacter cloacae
tgtaatgatgtatatactgaaagccagcattgctggcttttttcattttggggaactgtcatggctgaaccgcagctgctgttgaactataccgggcatctgcctgaatgcccgacgtggagtgcagaagagaaggcgctctactgggcggatatcctggaaggggagatccatcggtaccatctgcccaccgcggaacactcggtgctctcattccatgaagaagttgggtgttttgccctgcgtgaacgcggcggatttatcgtcgcgatgcgaaacgccatctggctgaccgataaacacggcctgctccagcgtaaggtttgcgataacccgtccaacccgcagcttgcacgctttaacgatggaggcaccgaccatcagggacggttttatgcgggcacgttctgggggccgggagattataacggcgccatgctgatgcgtatcgacaacgacctgacgccgaaagtgatccagtgcgatattcacggacataacggtttagcgtttagtcctgacaaacggtggatgtttacttctgatacgccgaacggtgtgatttaccgtacgccgcttgatgagcagggggaacccggtaagcgcgaagagtttcgccggtttagcgagggagacggtattcccgacggtgcggcaatggatgaggaaggctgttactggagcgcactgtttgacggctggcgtatcgcacggttttcaccgcaaggcgaacagctggaagagcaccggctgccggtacgctgcccgacaatggtctgctttggcggcgacgatatgaaaacgctgtttatcaccaccacgcgggaaaatatggaggcggaggagctggcgaaatacccgctttccggtgccatcttcaccctgccagtaaatgtggcagggatgaagaaaagccgctttatcgaacattaa

SEQ ID NO: 1138 - DNA, 750 bp, Enterobacter cloacae
ggatcacgtggactggttatgaccaaactgattgtcccggagtggccactgcctgaaggcgtggccgcctgtagttcaacccgtatcggtggcgtgagccagggcgcgtgggagtctttgaacctcggtgcgcactgtggcgataacctggagcacgttgaagagaaccgtaaacgcctctttgctgcgggaaaccttccttcaaaaccggtctggcttgagcaggtgcacggtaaagcggtgctgaagctgacgggtgagccctatgcgtctaaacgcgccgatgcttcgtacagcaatacgccgggaacggtttgcgcggtgatgactgctgattgcctgccggtgttgttctgcaatcaggcaggaactgaagtggctgctgcccacgccggatggcgaggcctgtgcgaaggcgtgctggaagagaccgtcgcctgctttcaggacgattctgcaaatctcatcgcctggcttggcccggcgattggcccgcaggcatttgaggtcgggcccgaagtgcgcgatgcctttatggaaaaagatccgcaagcggtcgaagcgtttgtggcttccggagataaatatctggccgatatttaccagcttgcccgccagcgcctgaataacgtcggtgtgacccaaatcttcggcggagatcgctgtaccttcaccgaaaagggtgattttttctcctatcgccgcgacaagacgacaggccgtatggcaagtttcatttggctgatataa

SEQ ID NO: 1139 - DNA, 1077 bp, Enterobacter cloacae
  unsure (1028)
cctgttatgggaggagttatgcgtctggatcgtcttactaataaattccagcttgctctcgccgatgcccagtcccttgcactggggcacgacaaccaatttatcgaacctcttcatttaatgagcgccttgctgaatcaggaagggggatcggtacgtcctttattaacgtccgctggcattaatgccggccagttacgcaccgccatcgatcaggcgctgagccgtttaccgcaggtagaaggtaccggcggcgacgtgcagccgtcgcaggatctggtgcgcgtgctgaacctttgcgacaagctggcgcaaaaacgtggggacaactttatttcgtcagagctgtttgttctggcggcgcttgaatcacgcggtaccttaaccgacctgctgaaatccgccggtgcaaccaccgctaatgtgacccaagcgattgagaaaatgcgcggaggtgaaagcgtgaacgaccagggagccgaagaccaacgtcaggctttgaagaaatttacggtcgacctgaccgaacgtgccgagcagggcaaacttgacccggtgatcggccgcgacgaagaaatccgccggacaatccaggtactgcaacgtcgtaccaaaaacaacccggtgctgattggtgagccaggcgtcggtaaaaccgccatcgttgaagggctggcgcagcgtatcgttaatggcgaagtgcccgaagggctgaaaggccgtcgcgtactggcgctggatatgggcgcgctggtggccggggcgaaataccgcggtgaatttgaagagcgtctgaaaggcgtgctgaacgatctggcgaaacaggaaggtaacgtcatcctgtttatcgacgaactgcacaccatggtgggggcgggtaaagctgacggcgcaatggatgccgggaacatgctgaaacctgcgctggcgcgcggtgaacttcactgcgtcggcgccactacgcttgacgagtatcgtcagtacattgagaaagatgctgcgctggagcgtcatttccagaaggtgtntgtcgctgaaccaagcgtagaagatacatcgccattttgcgtggtctga

SEQ ID NO: 1140 - DNA, 699 bp, Enterobacter cloacae
gcctggctttggtgggctgctccggtttggaatgaacaggtccctgacaatccgccgaatgaaatctatgcgactgcacaacaaaagttgcaggacggtaactggaaacaggcgataacgcaactggaagcgttggataatcgctatccgtttggtccgtattcgcagcaggtacagttagatcttatctacgcctactacaaaaatgccgatctgccgctggctcaggcaacgatcgatcgtttcatgcgtctgaaccctacccatcctaacatcgattacgtgatgtacatgcgcggcctgactaacatggcgctggatgacagtgcattgcagggcttcttcggggtggatcgttcagaccgtgacccgcaacatgcgcgtgatgctttcaatgacttctccaaactggtgcgtagctacccgaacagccagtacattaccgatgccactaagcgtctggtgttcctgaaagatcgtctggcgaaatatgagtactccgttgcggaatactacacccgccgtggcgcatgggttgccgtggttaaccgtgtagaaggcatgctgcgtgattatccggatacccaagccacgcgtgatggcctgaagctgatggaaaatgcgtatcgccagatgcagatgacggctcaggctgacaaagtggcgaaaatcatcgccgcgaacagcagcaacacctga

SEQ ID NO: 1141 - DNA, 396 bp, Enterobacter cloacae
cattgggtcgggtatgctggaatcaccaagacggaaagacaagaggtaaaatttatgacaatgaacattaccagtaaacaaatggaaattactccggcaatccgccagcacgtcgcagaccgtctcgccaaactggataaatggcaaacacatttgattaatccacatatcatcctgtccaaggagccgcagggtttcatcgctgatgcaactatcaatactccaaacggccatctggtcgccagcgcaaaacacgaggatatgtacaccgcaattaacgatttgatcaacaagctggaacggcagctcaataaagtgcaacacaaaggtgaagcacgtcgcgccgcaacctcggtgaaagacgccagcttcgcggaagaagttgaagaagagtaa

SEQ ID NO: 1142 - DNA, 429 bp, Enterobacter cloacae
aattacacacgcacacttgtaagccaggctatgctcacaaaaaggagaatagccatgcgttcaattactctcatgttattgtcgctgattttgtcgggttgccagatcaatccttatgcttttcagcctggctggaccagcccggactggttcactgccggtaaagaagacgctatgaatggtgttccggttaaagataaccaggcgctggccgatagttttaatgacccccaggttgatcgaggggaatatcttcgtggctacgctgacggacagaaaaaaatatgcgaagagggctttattcacgcctggggattagcgggaaaatcatttcctgccagctgcgatacaactgaaaatgcagtaaaactgtatgaatcctggcaacaaggaatggatgaaagtatgcgttccagcaggctgaattga

SEQ ID NO: 1143 - DNA, 600 bp, Enterobacter cloacae
acaatggtattctgccgacaattcttaaggacatctatttccggggcggtttggcggattctgatgagaaatgcaatcttgatcgctttgctccgactccccctggcgctaatgctgttcattttagtggcccctgcaaaggcaggctcgttcactgaaacggataaatcagtacgttcgattgtttctggtatcgtgagctacacccgatggccagcactgtctggccagcctaagctctgtatttatgcctcttcccattacagacaggcgctcagcagtgaagatgaacacaacccgttgccctatagtcctgtcattgtgcatagcgatcgggaagcactcacagcaaggtgcgatgccctctatttcgggagcgagtcgccagcaaaacaacaggaaataataaatcaatatcagggccaggcgttgctattaatgtcagaacaaaatcctgaatgcgttattggcagcgcattttgtctgataatagagcacaaccaggtcaggttttccgtaaatctggatgcgctggcgcgcagtggcgtaagagtcaatccggatgtattaatgctcgcacggaataagaagcatgaataa

SEQ ID NO: 1144 - DNA, 1179 bp, Enterobacter cloacae
aatgagacagacaacactatgacaccggaaaacccgctcctggatttacgcgtaaaaatcagtgcactcgacgaaaaattactggccctgctggcagaacgccgcgcgctcgccgttgaagtgggcaaagccaagctcgagtcccatcggccggtgcgcgatatcgatcgcgaacgtgatttgctggaacggttgattcaactcggcaaagcgcatcatctggatgcccactacatcacccgtctgttccagctcatcatcgaagattccgttctgacgcaacaagccctgcaccagcagcatctgaacaaaaccaacccgcactctgctcgtatcgctttcctcggtccgaaaggctcctattctcatctggcggcccgccagtacgcagcccgccatttcgaagagtttattgagagcggttgcgcgaaatttgcagacattttcaaccaggtcgaaaccggccaggccgattacgccgtggtgcctattgagaacaccagttccggcgccatcaacgatgtttacgatctgctccagcacaccagcctgtcattagtcggcgagttgaccatccctatcgatcactgcgtgctggtctctggctcaaccgatctgaatcagatcgaaacggtgtacagccacccgcagccgttccagcagtgcagccagttcctgaaccgttatccgcactggaaaattgagtacaccgaaagcacctcggcggcgatggaaaaagtggcgcaggcaaactctcctgccgtcgcggctctcggtagcgaagcgggcggcgcgctgtatggcttacaggtgctggaacgcaatctggccaaccagacgcagaacatcacccgtttcgtggttctggcccgcaaggccatcaacgtatcggatcaggtcccggcgaaaaccaccctgctgatggcgaccggccagcaggcgggtgcgctggttgaagcgctgctggtgctgcgtaatcacaacctgatcatgacgaagctggaatcccgtccaatccatggcaacccgtgggaagagatgttctatctcgacgttcaggccaacctggagtctgcatccatgcagaaagccctgcgcgaactgggcgagatcacacgctccatgaaagtgctgggctgctatccgagcgaaaccgtggtcccggtcgatccggcttaa

SEQ ID NO: 1145 - DNA, 1242 bp, Enterobacter cloacae
tgctcgcacggaataagaagcatgaataaggaagtcgtaccaacaccgcgtccgacgtttaaaagaacgttgcggcgaatcagcatgataagcgtcattataacgatgacgtttatatggttgctgctgtgtttcgcttccgtggtgacattaaagcaatacgcgcaaaaaaacctcgaacttaccggcgccaccatgagccacagccttgaagcctctctggtgttcaacgatgccgtggcagcaaatgaaacgctggcgaccctcggcaagcaggggcagtttgccgtggcggaagtgcttaatgcacatcataaacggtttgcctggtggtcgtggaacccggcggataataccgacacgctgggcgcgctggtcaaccggtggctgttccctgttcctgtcgcacagcccatcatacataacggcaatgtgattggcgaaattcgtctgaccgcacgcgacagcctgattagccactttatctggctctcgtttgcagtcctcaccgggtgcattctttttgcttctgccgtcgcattgaccatcacccgctcgctacatcatggcatggttgttgaaatgcaaaacatcactgacgttgtgcatgacgttcgcaccaaccgcaacttttctcgccgggtaacggaaggccgcattgaagagttccaccagtttggagaagacttcaacagcctgctggatgaaatggaagagtggcagctcaaactacaggcgaaaaacgctcaactgttgcgtaccgccatgcacgatccgctcacggggcttgcaaaccgcgccgcgtttcgcaacaacattgcagcattaatgaatgacgcttcggcaaaaaccaattccgccctgctatttctggacggtgataacttcaagtttatcaatgacacctggggtcatgccgcgggtgactgcgttctgatcgaagccgcaaaaaggatggtcgaatttggcgaaaaacgtcatcagtcttaccgtcttggcggcgacgaatttgccatgatcctttacggtgtccacaccgcgcgtgaggtcgaatatatttgcgctgcgctgtcgcagcaatttatccgtccgtttgatctgcataacgggcacacagcatcaatgtcactcagcattggctttgctctggcatgggaaaatgcctccgttgaggccttactggagcaagccgatcgcaatatgtatctggtcaaaaaccagcgttcgaaaacaatatcctga

SEQ ID NO: 1146 - DNA, 498 bp, Enterobacter cloacae
aaggaagacgatatgttaaagcgatattttgcgccgttgttactggcatcactggcaatgtccggatgccagtcatcccctgaagggaaattcacgccagagcaaatcgcggccatgaaatcctatggctttaacgaactgaatggcgactggtctctgggcctgtcagataagatcctgtttgataaaaatgacgccaggctgcgcccggaaagtcaaacgcagatccagactatggcctcacgcctggcggcaaccggcctgaaccacgcccggatggatggccatacggataactatggcgaagagagctacaacgaagcgctttcgttaaaacgtgccaatgttgtggcggatgcctgggcgaagggcgcgaacatcccgcgcagcaacctcaccacgcggggcttaggcaaaaaataccctgtcagcagcaaccgcactgcacaggggcgcgctgaaaaccgccgggttgcggtagtcatcagcacgccttaa

SEQ ID NO: 1147 - DNA, 816 bp, Enterobacter cloacae
ctggctgcgctggaacccggcctacaccgctcaggaggcgaaagcatgaatactgcacgactgaaccagggaacaccgttactgctgaacggcgtgaccaaacgctacggcgacaacaccattctgaatgcactggatctgcatattcctgccggacagtttgttgccgttgtcggccgcagcggtggcggcaagagtaccctgctgcgtcttttagccgggctggaagcgccaaacagcggtgacattctggcaggcactacgccgctggccacgattcaggatgatacgcgcatgatgtttcaggatgcgcgtctgctgccgtggaaaacggtgatggataacgtcgggctgggcctgaagggcagctggcgggaggacgcccggcaggcactcgctgcggtagggctggagaatcgcgcgggagagtggcctgcggccctgtcgggtggacaaaagcagcgcgtagcgctggcacgcgcgctgattcatcgtcccggcctgctgctgcttgatgaaccgctcggcgcgcttgatgccctgacgcggatcgaaatgcaggatctgattgaaaccctatggcagacgcacggctttacggtgctgctggtgacgcatgatgtcagtgaagccgtggcaatggcagacagggtgctgttaatagaagaaggtaaaattggtctggatctgacggtagatattccgcgtcctcgccgcgtgggatcggcccgactgggggagctggaagccgaagtgctggatcgggtgatgaagcgtggggtaagtgaacgggtgttgattaaagctaatgcctga

SEQ ID NO: 1148 - DNA, 249 bp, Enterobacter cloacae
acagggtatactccggagttgtttattgtactaaacgctcccgtgagaggatgctacagcgcacctatgactcaattcgcttctccggttctgcatacgttgctggataccgacgcgtacaagctgcatatgcagcaagccgtgtttcaccactatcatgatgtccatgttgcggcggaatttcgctgccggggtgacgacttgctgggtatctacgcagattccattcgtgcaacaggtcttcactag

SEQ ID NO: 1149 - DNA, 585 bp, Enterobacter cloacae
ggagcaaccatgcgcgtcattaccctggccggaagcccccgcttcccctctcgctccagcgcactgctggaatacgctcgcgaaaagcttaatgctctggatgtcgaagtgtgtcactggaatttgcacaatttcgcgcctgaagatctgctctacgcccgtttcgacagcccggcgctgaaaaccctgatcgaacaacttaagagtgctgacgggctggtcgtcgcgacaccgatttataaagcttctttttccggcgcactgaaaacgctcctcgatctgctgcccgaacgtgcgctggacggtaaggtcgtcctgccgctggccacaggcggtacggtagcccatttactggcggtggattatgccctcaagccggttctgaacgcgctgaaagcacaggagatcctgcatggcgtcttcgctgacgactcacaggtaatcgactaccagcataaaccgcatttcacgccgaatctgcaaacccgcctcgacagcgcgcttgaaaccttctggcacgccctgaaccgtcgggatcgccacgcggcggcatttcatcaatcacaaggagtggcgcatgtttaa

SEQ ID NO: 1150 - DNA, 1158 bp, Enterobacter cloacae
aggaaaaaaatcatgagtctgaatcttttctggtttttacccacccacggtgatggacactatcttggcacagaagaaggcgcccgcccggtcgatcacggctacctacagcagatcgcccaggcggcagaccgcatcggttttaccggggtgctgatcccgacgggccgttcatgtgaggatgcgtggctggttgccgcgtcaatgatccccgtcacccagcgcctgaaattcctggtagccttgcgcccgagcgtggtgtcgcccaccgtcgcggcgcgtcaggcggcaacgctggacaggctttccaacggccgtgcgctattcaaccttgtgacgggcagcgatccgcaggagctggcgggggatggcgttttcctcgatcataccgaacgctatgaagcctccgcagagttcacccgcgtctggcgacgtctgctggaaggggaaaccgtcaccttcgaagggaaacatatccacgttcgcgatgcgcagctctacttcccgccgttacagcagccgcgccctcccctctattttggcggatcgtcggacgtggcgcaggagctggcggctgagcaggtcgatctctatctgacctggggcgagccaccggagctggtgaaagagaaaattgctcaggtacgcgctaaagccgcagaacatggccgtacggtacgctttggtattcgcctgcacgtgatcgtccgcgaaaccaacgacgaggcctggcaagccgccgaccgtctgatcgctcatctggacgacgatactatcgctaaagcacaggcggcgtttgccaaaaccgactccgtgggccagcaccggatggcctccctgcacaacggcaagcgtgaaaaccttgagatcagcccgaacctgtgggccggggtgggtctggtgcgcggcggcgccggcacggcgctggtcggcgacggtccaaccgtagcggcacgcattaatgaatacgcggcgctggggatcgacagctttatcctgtctggctacccgcatctggaggaggcgtacaaggtgggtgaactgctgttcccgcacctggatgtcgctatcccggaaattccgcagccacgccagcttcagttacagggcgaagccgtggcgaacgcgtttatcccgagaaaagtcgcgcaaagctaa

SEQ ID NO: 1151 - DNA, 801 bp, Enterobacter cloacae
ggagccaccatgtctgcaaccgcacaaaaatggctactgcgcgccgcgccgtggtttctgcccgtcggcattgtcctcgtctggcaactggcgtcttcaactggctggctgtcgagccgcattttgccctctccggagggcgttgtggaagcgttctggtcgctcagcgccagcggtgagctgtggcaacatcttgccatcagctcctggcgcgcggtaatcggcttttcgattggcggaagcatcggcctgacgctggggctgatcagcggcctgtcccgctggggtgagcggctgctggatacctccgttcagatgctgcgtaacgtgccgcatctggcgcttatcccactggttattttgtggtttggcattgatgagagcgccaaaattttcctcgtggcgctgggaacgttattcccgatttatatcaatacctggcatgggatccgcaatatcgatcgcggtctggttgagatggcccgcagctatggcctgtcaggttttgccctgtttacccatgtgatcctgccgggcgccctgccctccattatggttggggtgcgttttgcgctcggcctgatgtggctaaccctgatcgtggcggaaaccatttcggctaactccggcatcggttatctggcgatgaacgcccgcgagttcctgcaaacggacgtggtggtggttgccattgtcctttatgccctgctcggcaaacttgcggacgtcagcgcccagtggctggaacgtagctggctgcgctggaacccggcctacaccgctcaggaggcgaaagcatga

SEQ ID NO: 1152 - DNA, 1014 bp, Enterobacter cloacae
accgtcgggatcgccacgcggcggcatttcatcaatcacaaggagtggcgcatgtttaaaacagttacccgtatcgggctggcaggtctgctggcagtggcgtcgctggctcaggcgacggagaaagcgccggagagcctgcgtatcggttatcagaaaggcagcgtcagcatggtgctggcgaaaagccatgcgttgctggagaagcgtttcccggagaccaaattctcatgggtcgagttccctgccgggccacagatgctggaggcgctgaacgtcgggagtattgatttaggcagcacaggcgatatcccgccgatctttgcgcaggctgccggggcggatctggtttacgttggcgttgagcccgccaagccgaaggcagaggttattttggtgccggaaaacagcgagatcaaaagcgtcgccgacctcaaaggccataaggttgctttccagaaaggttccagctcgcacaacctgctgctgcgcgcgttgcaggaggccggccttaaattcaccgatatccagcccgtttacctgacgcctgccgatgcgcgcgcggcgtttcagcaaaaaaatgttgatgcctgggctatctgggatccgtattactccgccgcactgttgcagggcggtgtgcgggtgctgaaagacggcaccaccctgaagcagaccggttcgttctacctggcggcacgtccttacgctgagaaaaatggcgcatttattcagcaggtgctggataccttctctcaggccgatgcgctgacccaaagccagcgtcagcagagcatcacgctgctggcaaaaaccatgggcctgcctgaaccggtgatcgccacctatcttgaccaccgtcctcccaccaccatagcaccggttgacgcccacgttgccgctctccagcagcaaacggcagacctcttttatcaaaaccgcctggttccaaagcaggtgaatattcgcgaacgcatctggcaacccgctggcattgaaggaaaaaaatcatga

SEQ ID NO: 1153 - DNA, 306 bp, Enterobacter cloacae
tacaggacgtttaggggacgggagagaaacatgcgaattaaacctgacgataactggcgctggtatttttgtgaagagcatgaccgtatgatgctcgacttagccaacggcatgttgtttcgctctcgttttgcgcgccgaatgttaacgccagacgcgtttgctccctcaggcttttgcgttgacgatgccgcgctctatttctcttttgaagaaaaatgccgcgatctcgatctctccaaagaacagcgcgccgaactggtattaagtcttcaccacgggactggcaggatccgagtaatgtta

SEQ ID NO: 1154 - DNA, 2718 bp, Enterobacter cloacae
ctaaaaagggcgttgtgcctgaaaagacgaacattctgcatagcgcgttttacacaacaggaatatattgaatcgttactcgacaaacgatgcataaggttttctatgacacaacagccacaagctaaataccgccacgactaccgtgcgccggaatacctgataagcgatatcgatctgactttcgacctggatgccacaaaaaccgtcgtgacggcggtaagccaggtgacgcgccagagcgcgacagccgtgtcgctgcgtctggatggtgaagacctgacgctggtttccctgcatattaacgatgaagcctggtcagactataaagaagaaggcaaccagctggtcatcgacaacctgccggaacgctttaccctgcgcatcgtgaatgaaattagccctgccgccaataccgcgctggaagggctttaccagtcaggcgtagccctgtgtacccagtgtgaagccgaaggtttccgccacattacctggtatcttgatcgcccggacgtcctggcgcgctttaccaccaaaattattgccgacaaaacgctgtacccgtacctgctctccaacggcaaccggattggcgagggggaactggagaatggccgtcactgggtacagtggcaggatccgttccctaaaccctgctatctgtttgcgctggtggcgggagatttcgatgttctgcgcgacacctttaaaacgcgctctggccgtgaagtcgcgctggagctgttcgtggatcgtggcaaccttgaccgcgcaccgtgggcaatgacctctctcatcaactccatgaagtgggatgaaacgcgctttggtctcgaatatgacctcgacatctatatgattgttgctgtcgatttcttcaacatgggcgcgatggagaataaaggtcttaacatctttaactccaaatacgtgctggcgcgtaccgataccgccacggataaagattacctcgatatcgaacgcgttatcggccacgaatattttcacaactggaccgggaaccgcgtcacctgtcgcgactggttccagctgagcctgaaagagggcttaaccgtcttccgcgatcaggagttcagctccgatctgggatcgcgggcggtgaaccgcatcaacaacgtgcgcactatgcgtggtctgcaatttgcagaagatgccagcccaatggcccacccgatccgcccggataaagtcattgagatgaataacttctacaccctgacggtgtatgaaaaaggcgctgaaattatccgcatgatccacaccctgctgggcgaagagaatttccagaaagggatgcagctttacttcgagcgtcacgacggcagtgcggccacctgcgacgattttgttcaggcgatggaagacgcctctaacgtggatctgtctcatttccgccgctggtacagccaggccggtacgccgattgtgacggtcaaagacgactacaacccggaaaccgagcagtacacgctgaccatcagccagcgcacgccgccaacggccgagcaggaagagaaacatccgctgcacattccgttcagcgttgagctgtacgacaacgaaggcaacgtgatcccgttacagaagggcggtcacccggtgcataacgtgctgaacgtgacccaggcagagcagacctttatcttcgataacgtctatttccagcccgttcccgccctgctgtgcgaattctccgcgccggtgaaactcgaatacaagtggagcgatcagcagctgacgttcctgatgcgtcacgcgcgcaacgatttctcgcgctgggatgcggcacaaagcctgctggcgacctacatcaagctgaacgtcaaccgttaccagcagggccagccgttgacgctgccggttcatgtggcagacgcgttccgtgccatcctgctggatgagaacattgacccggcgctggcggctgaaattttaacgctgccgtctgcgactgaaatcgccgagctgtttgacatcattgatccgattgccatcgtcgccgtgcgtgaagcgctgacccgcacgctggtgaccgaactggcagatgagttcctcgccatttacaacgccaacaagctggacgcgtatcgggtggaacatgcggatatcggtaaacgttccctgcgcaatacctgcctgcgctatctggcgtttggtgaggcagagctggcgaacacgctggtcagcaagcagtaccacgaagccgataacatgacggatgccctggccgcgctggctgcaagcgttgccgccgagctgccgtgccgcgatgcgctgatgcaggagtacgacgacaagtggtatcaggatggtctggtgatggacaagtggttcatccttcaggccaccagtccggcagccgatgtactcagcaaagtacgtagcctgctgaagcaccgttcgttcaccatgagcaacccgaaccgcgtccgctctctgattggtgccttcgccagcagcaacccggccgcgttccatgccgaagacggcagcggttatcagttcatggttgaaatgctgaccgagctgaacagccgtaacccgcaggtggcgtctcgtctgattgagccgctgatccgcctgaaacgttacgatgcgcagcgtcaggcgaaaatgcgcgccgcgcttgagcagctgaaagggctggaaaatctgtctggcgatctgtacgagaagattgctaaggccttagcgtaa

SEQ ID NO: 1155 - DNA, 1050 bp, Enterobacter cloacae
tcccctcccggtttgcacaccgggaatccaggagagttcatgtactaccccttcgttcgtaaagcccttttccagctcgatcctgagcgcgctcatgaatttacatttcagcagttacgccgtattacaggaacgcctctggccgcgctggtgcatcaaaacgtgccggaaaaaccagttcagtgcatgggcctgactttcaaaaatccactgggcctggcggccggtctggacaaaaatggcgaatgcattgatgcactcggtgcgatgggctttggctcgatcgaaatcgggacggtaacgccgcgtccgcagccgggaaatgacaagccacgtctgtttcgcctggttgaagccgaagggctgatcaaccgcatgggctttaataaccttggcgtcgatcatctggttgagaacgttaagaaagcccattttgatggcgtgctgggtataaatattggcaaaaataaagacacgccggtcgagcagggtaaagatgactatctgatttgtatggaaaaagtctatgcctatgccggttatattgcggtgaatatttcctcgcctaacaccccagggctgcgttcattacaatatggcgaagcgctcgacgatcttcttagcgccattaaaaataaacaaacggcgctacaggcgatccaccataaatatgttccggtcgcggttaagatcgccccggatctttcggcagaagaattgatccaggttgccgacagtttagttcgccataatattgatggtgtgattgcgaccaatacgacactcgatcgctctctcgttcagggaatgaaaaactgtgacgaagcgggtggattaagtggccgtccggtacaattaaaaagcaccgaaattattcgcgcactctccgcggaattaaaaggccagctgccgattattggcgtgggtggcattgactccgtcatcgctgcacgtgagaagatggcggcaggcgcatcgctggtgcaaatttattccggctttatttttaaagggccgccgctgattaaagaaatcgtcacgcatatctaa

SEQ ID NO: 1156 - DNA, 1404 bp, Enterobacter cloacae
cttgctgatttagaatttgatcccgctcacatgttatcctctcaatccccctcaatttatactgtcagccgccttaatcagacggtgcgtttgctgcttgagcaggaaatgggacaggtctggatcagcggtgaaatctctaacttcacgcagcctgcttccggccactggtactttacgctgaaagacgacaccgctcaggtgcgctgcgcgatgttccgcaacagcaaccgtcgcgtgacgttccgtcctcagcatggccagcaggttctggttcgcgccaacattaccctgtatgagccgcgcggcgattatcagattatcgtcgagagcatgcagcccgccggtgaaggcttgctgcaacagaagtacgagcagctaaaagccatgctttcggctgagggattgttcgaccagcagtttaaaaaaccccttccctcaccagcccactgcgttggggttatcacgtcgaaaaccggtgcggccctgcacgatattttgcacgtccttaagcgccgtgacccttccctgcccgtcattatctacccgactgccgttcagggtgacgatgcgccggggcagatcgtgcgcgccattgagctggcgaatgcgcgtcaggagtgtgatgtcctgatcgtcgggcgcggcggcggctcgctggaagacctgtggagctttaacgacgagcgcgtggcgcgggcaatctttgccagccttatcccggtggtgagcgccgtcggtcacgaaacggatgtgacgattgccgattttgtcgcggatttacgcgcgcccacgccgtccgcggcggcagaggtagtcagccgtaaccagcaggagctgctgcgtcagatccagaacgggcagcagcgcctggagatggcgatggactacttcctcgccaaccgtacccgccgctttacccagcttcaccatcgtctgcaacagcagcatccgcaattgcgtctggcgcgtcagcaaaccgtgctggaacgtctgcgtcagcggatgaacttcgcgctggataaccagcttaagcgggcggtatctcgccagcagcgcatgacgcagcgtctgaaccagcagaatccacagccgaaggtttatcgcgcacaaacgcgtatccagcagcttgagtatcgcctcgcggaaaatatccgctcacgcctgagcgccacccgcgagcgttttggcaatgcggtcacccatctggaagccgtcagcccgctctccacgctggctcgcggctatagtgtgaccaccgcgacggacggcaaagtgctgaaacaaacgaaacaggttaaagccggggatgtgctcaccacccggctttctgacggctgggtcgagagtgaggtaaaagagatcaaaccggtgaaaaaaacgcgccagcgtaaaagcggataa

SEQ ID NO: 1157 - DNA, 1107 bp, Enterobacter cloacae
aaaaaacgcgccagcgtaaaagcggataaatcttcgccggttacaaactatactgctgctattgccttttttgataaggagagcagcatgccccatcttcatagcgtcatccctccgtatattcttcgtcgtattatcgaaagcggttcagagccccagcagcgctgcgcccgtcagacattaacccatgtgcaaaccctgatggcgcatatgccgggcaaacccgccgcgccgcatgtgaataaagccggtcagcttgagcgtgacatctacgatgcgaaacagactcaggagctgccgggtagccaggtgcgctatgaaggccagccctccaacggcgatgtggcggtggatgaagcgtacgattatctggggatcacccatgatttcttctggaaggagtatcagcgggattcgctcgataataaggggctgatcctgaccggtaccgtgcattacggccgtgagtatcaaaacgccttctggaacggccagcagatggtctttggcgatggcgacggggaaatcttcaaccgcttcaccattgccatcgacgtggtggcgcatgagctgagccacggtgtgacggagaccgaagccgggctcatttactttgaacaatctggcgcgctgaacgagtcgttatccgacgtgtttggttcgctggtgaagcaatactatcttaagcaaaccgccgaccaggcagactggctgattggcgaagggctgctggcagcggggattaacggcaaagggctgcgctcaatgtctgaacccggcaccgcctacgacgatcccctccttggcaaagacccgcagcccgcgcacatgaaagattttattaaaacgcgcgaggataacggcggcgtacaccttaactctggcatccccaaccgggcgttttacctggccgcaacggcaatcggtggctacgcctgggaaaaagcgggttatgcctggtacgacacggtttgcgatcgcaacctggcgcaggatgcggattttgacgctttcgcaaaactgacgatcgcccacggcgagaaacgctccggtagcgacgttggggcggccattaaacaagcctgggaacaggtgggagtactgtaa

SEQ ID NO: 1158 - DNA, 437 bp, Enterobacter cloacae
actttgcccgcgttcactttatctctgccctgcacgggagtggtgtcggcaacctgttcgaatccgttcgtgaagcttatgacagctctacccgccgtcagagcacggcgatgctgacccgtatcatgaacatggctgctgaagaccaccagccgccgctggtgcgcggtcgtcgcgtgaagctgaaatatgctcacgccgggggatataacccgcctatcgtggtgatccacggtaaccaggtgaaggatctgccggactcctacaaacggtacctgatgaactacttccgcaagtcgctggacgtgatgggtacgcctatccgtattcagttcaaggaaggggaaaacccgtttgcgaataaacgcaacaccctgacgccgaaccagatgcgtaagcgtaagcgtttgattaagcacattaagaaaagcaaataa

SEQ ID NO: 1159 - DNA, 1599 bp, Enterobacter cloacae
ccgttcggcgtacatgctggtgtttacaagcacgacacataccttttcgggagaattatgcaatcctctgttaatcaaaaagagagccgaaccttcttcggccatccttatccgctcggttctctgttcttcaccgagatgtgggagcgtttctcgttttacggtattcgcccgctactgatcctgtttatggccgccaccgtgtatgacggcggaatgggcctggcgcgtgaaaacgcctcggcgattgtcggtatttttgctggcaccatgtacctcgccgcgctgccgggcggctggctggcggataactggctcggccagcagcgggccgtctggtacggttcgattttgattgcgcttgggcacctgtcgattgccctgtcggccatcatgggcgacaacctgttcttcatcggcctgatgtttatcgtgctcggctccggcctgttcaagacctgtatctcggtcatggtggggacactgtacaaaaagggcgatgcgcgtcgtgacggcggtttctcgctgttctatatgggcatcaacatgggctcgttcattgcccctctgatttccggctggctgattaaaacccacggctggcactggggctttggtatcggtggtattgggatgctggtcgccctgattatcttccgcgtgtttgccgttccggccatgaagcgttacgacagcgaagtcggtctggactccacctggaacagtccggtagtgaaacgtaacggcgtgggcgcctggctgctggcgctggctgtgggtgttgcaatcatcgttacgttgattgcccagggcgtgattgtgattaatccggtcgcggtcgccagcgtgctggtgtatgttattgccgcctccgtcgcgctctacttcatctatctgttcatcttcgccgggctgaatcgcaaagagcgcgcaaggctgctggtgtgctttattctgctggtctccgccgcgttcttctggtccgcgttcgagcagaagccaacctccttcaacctgttcgccaacgactacactaaccgcatgatcggtgattttgaaatcccggcggtgtggttccagtcgattaatgccctgttcatcattctgctggccccggtatttagctgggcatggccgaagctggcgagcaaaaacattcgtccgagcagcatcaccaagttcgtgatcggtattctgtgtgcagcggcgggctttggcctgatgatgctggcggcgcagaacgtactgagcaatggtggggcaggggtttctccgttctggctggtgggcagtatcctgatgctgacgctcggggaactgtgcctgagtccgattggtctggcgaccatgaccctgctggcgccggaaagaatgcgcggccagatgatgggcctgtggttctgcgccagtgcgctgggtaacctggctgcggggctgattggcggtcacgtgaaggccgaccagctggatatgctgccagacctctttgcccgttgctccatcgcgctgctgatttgtgctgcggtactgatcgtcctcattgttccggtacgtcgcatgctggaaaatgcgcaaactaaaccggctaccgaagcctga

SEQ ID NO: 1160 - DNA, 1491 bp, Enterobacter cloacae
ccacccaggtcagagatattgcccatgctacgtatcgctaaagaagcactgacgtttgacgacgtcctcctcgttcccgctcactccaccgttctgccgaatactgccgacctcagcacgcagttgacgaaaaccattcgtctgaacattcctatgctctccgcagcaatggacaccgtgactgaagcgcgtctggctatcgccctggcacaggaaggcggcattggctttatccacaaaaacatgtctatcgagcgtcaggcggaagaagttcgccgcgtgaagaagcatgaatccggtatcgtgtccgatcctcagaccgttctgccaaccaccacgctgcacgaagtgaaagccctgaccgagcgtaacggctttgcaggctacccggtagtcactgaagacaacgaactggtcggcatcattaccggtcgtgacgtgcgtttcgtgactgacctgaaccagcctgtaagcgtctacatgacgccaaaagagcgtctggtgaccgtgcgtgaaggcgaaacccgcgacgtggtgctggcgaaaatgcacgaaaaacgcgttgagaaagcgctggttgtggacgcgaacttccacctgcgcggcatgatcaccgttaaagatttccagaaagcagagcgtaaaccgaacgcctgtaaagacgagcatggccgtctgcgcgtcggcgctgcggttggcgcgggcgcaggtaacgaacagcgcgttgacgcgctggttgccgcaggcgttgacgtgctgctgattgactcctcccacggccactccgaaggcgttctgcaacgtattcgtgaaacccgtgctaaatacccggatctccagattatcggcggtaacgtggcaacaggcgcaggcgctcgcgcgctggcggaagcgggttgcagcgcggtgaaagtgggtatcggccctggctctatctgtaccacccgtatcgtcactggcgtaggcgtgccgcaaatcacggcggtttctgacgcggttgaagcgctggaaggcaccggcattccggttatcgctgacggcggtatccgcttctctggtgacatcgccaaagcgatcgccgcaggtgccgcagccgtgatggtgggctccatgctggccggtaccgaagaatctccgggtgaaatcgaactctaccaggggcgttcttataaatcctaccgcggtatgggctccctgggcgcgatgtccaaaggttcctccgaccgttacttccagaccgataacgctgctgacaaactggtaccggaaggtatcgaaggtcgcgtggcgtataaaggccgcctgaaagagatcattcaccagcagatgggcggcctgcgctcctgtatgggtctgaccggctgtggtaccattgacctgctgcgtaccaaagcggaattcgtacgcatcagcggtgcgggtatccaggagagccacgttcacgacgtgacgatcaccaaagagtccccgaactaccgtctgggctcctga

SEQ ID NO: 1161 - DNA, 348 bp, Enterobacter cloacae
tcgtcctcattgttccggtacgtcgcatgctggaaaatgcgcaaactaaaccggctaccgaagcctgatactattcagtctgccggggcagttgtcctgtcccggcccaactcaacaggagagagcatgtcgattacctgtccggattgccacgcagcgctcgagccgcaaaacggtatcgcgcactgcgacagctgcaataaagatattcccctcgaagcgcgctgccctgactgccatcagccgcttcaggtactcaaggcctgcggcgcggtggattacttctgtcagaacggccacgggctgatctcaaaaaaacgcgtcgagttcgtcagggctggggcttaa

SEQ ID NO: 1162 - DNA, 1686 bp, Enterobacter cloacae
cgatcaccaaagagtccccgaactaccgtctgggctcctgataaatttccgcgcccggctcaatgccgggcgctttgttttgtttcacttgcctcggaattagcgtcaatgacggaaaacattcataaacatcgcattctcatcctggactttggttctcagtacactcagctggtggcgcgccgcgtgcgtgagctgggcgtttactgtgagctgtgggcgtgggatgtcacggaagcacagattcgcgaattcaatccaagcggcatcatcctgtccggcggcccggaaagcaccaccgaagagaacagcccgcgcgcgccgcagtacgtgttcgaagcgggcgtaccggtgttcggcgtttgctacggtatgcagaccatggcgatgcagctgggcggccacgtagaaggctctaacgagcgtgagttcggctacgcacaggttgaagttgtcaccgacagcgcgctggtgcgcggtatcgaagactccctgaccgcagacggcaagccgctgctggacgtgtggatgagccacggcgacaaggttaccgccatcccgtccgacttcgtgaccgttgccagcaccgaaagctgcccgttcgccatcatggcgaacgaagaaaaacgtttctacggcgtgcagttccacccggaagtgacccatacccgtcagggtatgcgcatgctggagcgcttcgtgcgtgacatctgccagtgtgaagccctgtggaccccggcaaaaatcatcgacgacgccgtggagcgtatccgccagcaggttggcgatgacaaagtgatcctcggcctctccggtggcgtggactcctctgtgaccgcgatgctgctgcaccgcgccatcggcaaaaacctgacctgtgtcttcgtggataacggcctgctgcgcctgaacgaagcgaagcaggttatggacatgtttggcgaccacttcggtctgaacatcgttcacgtggaaggcgagcagcgtttcctggacgcgctgaaaggcgagaacgatccggaagcgaaacgtaagatcatcggtcgcgtgttcgtggaagtgttcgacgaagaagcgctgaagctggaagacgtgaaatggctggcgcagggcactatctaccctgacgtgatcgagtctgcggcctccgcaaccggtaaagcgcacgttatcaaatctcaccacaacgtgggcggcctgccgaaagagatgaagatgggtctggtggaaccgctgcgtgagctgttcaaagacgaagtgcgtaaaatcggtctggagctggggctgccgtacgacatgctctaccgtcacccattcccgggcccgggcctcggcgtacgcgtgctgggcgaagtgaagaaagagtactgcgacctgctgcgtcgcgcggacgcgatcttcatcgaagagctgcacaaagctgacctgtacaacaaagtgagccaggcgttcaccgtgttcctgccggttcgttctgtaggcgtaatgggcgatggacgtaagtacgactgggttgtttccctgcgtgcggtggaaaccatcgacttcatgaccgcgcactgggcgcacctgccgtatgacttcttaggccgcgtgtctaacagaataatcaatgaagtcaatggcatttcccgcgtggtgtatgacatcagcggcaagccaccggcgacgatcgagtgggagtaa

SEQ ID NO: 1163 - DNA, 510 bp, Enterobacter cloacae
acatattctgccgatttgccctcatacttctgtatgggatgcgtggttgagatgttcgctttgacgtacactttgaaaaaaaccaggaggcacagcatgaaagagaacgacattgtcgagattctgacgaccacgcgctctatcgcgctggtcggcgcgagcgataaaccggatcgcccaagctatcgggtcatgaaataccttctggaccagggatatcacgtgatcccggtctcgccgaaggtggcggggaaaacgctgctgggtcagcagggctatgcgacgctcgcggacgtgccggaaaaggtggatatggtggacgtttttcgtaattcagaagcggcctggggcgtggcgcaggaagcgatcgccattggcgcgaaaacgctgtggatgcaactgggcgtgattaatgagcaggcggccgtgctggcacgcgatgccgggctgaaagtggtgatggatcgctgtccggcaatcgatattccccgtctggggctggcaaaataa

SEQ ID NO: 1164 - DNA, 702 bp, Enterobacter cloacae
gttgcctattttcctgctaacggatccgttagtaagaaatatcgtggttactgtatgatttttaatggaattatcatgaaaaagatatcttatgagcggatttatcaatctcaagaatacctctctccgctgggcgaaattcatcatcgcgccctgtttggcggttataccctggccgtggatgaagcggtgttcgcgatggtgtctgacggcgagctgtaccttcgcgcctgtgagcaaagtgcaaaatattgtgtaaaaaacgcttcctcttttctgaccctgatgaaacgaggacgcccagtgctgcttaattactaccgtgtggacgaaggtctgtggcaaaacagggaaaaactgcttcagctctcctcgtttgcgctcgatgccgccaggaaagagcgctaccagcgccatcagcgtaaccggcttaaagatctgccgaacctgacctttcagattgaggtcctgcttatggaggcgggcattaccaatgaagagacgctacgacagttgggggcgaagacgagctggctgaaaatgcgctcgaagaataaagcgctgagtatccgggtattgttcgcgcttgaaggcgcgattgaagggttacatgaagcggcactcccggcggatattcgccgggagcttacggagtggtttaatgcgctgcctgagtcgcagggccatcattccgccaggtag

SEQ ID NO: 1165 - DNA, 2076 bp, Enterobacter cloacae
cctcgtggatcccggcaggatatggaactgaaagcaacttcaatgggcaaacgcctggcgcagcacccttacgacaaggttgtccttctcaatgcgggagtgaaagtctccggggaacgccacgaatatcttattccgtttaatcagctactggccattcattgtaaacgagggctggtatggggggagctggagttcgtcttgccggcagacaaagtggtgcgactccacgggaccgagtgggcggaaacccaacgcttccactaccatctgaacacgcgctggcaacagtggagccaggagatgagcgtgatagccgcacaggtgctgcaacaggtgctggacgatatcgcgctaagcaatacgcagcagaagtggctgacgcgccagcaaaccgccgggcttcagcataaaattgcccaggcgctgacggcattgcctttaccggtggcgcggcttgaggaatttgataactgccgcgacgcgtggcggaagtgtcaggcctggctgaacgatatcgagaaaagccgtctggcgcataaccaggcctggactgaggcgatgcttacgcaatatgccgattttttcagtacggtggaatcatcgcccctcaatcctgcccaggcgcgcgccgtggtgaatggcgagcagtctcttttagtgctggcaggcgccgggagcggcaaaacgtcggtgctggtggcacgcgcgggctggcttctgacaacgggcgaggcggttgccgaccagattttgctgctggcctttggtcgcaaggcggcgcaggagatggatgagcgcattcaggcgcgtttgcatacccaggatatctcggcgcgcacgttccactccctcgctttacacatcattcaacagggcagcaaaaaagtccctgttgtcagcaagctggagaacgacgctcaggctcgccagacgctgtttatcaaggcatggcgtcagcagtgcagtgaaaaaaaggcgcaggcgaaaggctggcgtcagtggcttgaagaggaactcaactgggaggtgccggagggcagcttctggcaggatgaaaagctggcgcgccggctgggctctcgtcttgaccggtgggtaagcctgatgcgcatgcacggcggctctcaggcggagatgatagaaagcgcaccggagtcgatccgcgccgtgttttctaagcgggttaagctgatggcgccgatgctgaaagcgtggaaaaccgcgctgaaagacgaaaacgcggtcgatttttcggggctgatccatcaggccattatcattctggagaaagggcgcttcgtcagcccgtggaaacacattctggtggatgagtttcaggacatctcgccgcagcgcgctgcgctgctttcggcgctgcgggcgcagaataaacacacgtcgctgtttgccgtgggcgatgactggcaggctatctaccgtttcagcggggcgcaactttctctcacgacggccttccaccactattttggggaaggcgatcgcagcgatctggacaccacctaccgcttcaactcgcggattggcgaaatagccaaccgttttattcagcagaacccgcatcagctgtcgaaaccgcttaacagcctgaggtctggggataaaaaggccgtcacgctgctggcggacgatcagctggaaccgctgctggataaactgagcggctatgcgaaaccggatgaacgaattctggtgctggcgcgttaccaccacctcaagccgacggcgctggaaaaagcggcgacgcgctggccaaaactacagctcgatttcatgaccattcatgccagtaaagggcagcaggccgactacgtgattgtggtggggctaaaagaggggagcgacggtttcccggcgccggcgcgggaatccgtgatggaagaggcgttattacctgttccggaagatttcccggatgcagaggagcggcgcttactgtacgtggcgataacccgcgcgcgccatcgcgtgtggctcttgttcaacaaagaggagccgtcggtgtttgtcgatattttgaagagtattgacgtgccggtggcgagaaagccgtaa

SEQ ID NO: 1166 - DNA, 759 bp, Enterobacter cloacae
gggcaaatcggcagaatatgtctatatgttagtaaacgtgtttatcgaaaaattttgatacattcttaccgggtagtttgtctacaggagtcagctatgaaaaccggcattgcctgggctgtggttgcgttaatcatgccggtttgtgttttcgcaactactctcagactcacaaccgacattgacctgctggtgctggacgggaaaaaagtctccagctccctgctacggggcgcagacagcatcgagctggataacggcccgcatcagctggtttttcgggtggaaaagaccattcgcctcgccgacgacgaacagcaggtgtacatttcgcctccgctggtggtcagctttaatacccagcgtatcagccaggtcaattttcgtctcccgcgccttgagacagaaaaggagtcactggcatttgatgcctcgccgcgcattgaactggtggacggggattccatgcccatcccggtaaagctggatattctggcgctgacaaaaaggccaaagggaactgactatgaagcggacaccgagacctacaacagggccagcaggcgcgcctcgctgccccagttcgccaccatgatggcggatgacagtaccctgctttcgggcgtatcggagctggatgtactcccccctcagtcgcagacccttactgagcaacgtctcaagttctggttccagaatgccgatccggacacgcgcgcccgttttctgcaatgggcaaaacaacaaccttcgtcgtaa

SEQ ID NO: 1167 - DNA, 255 bp, Enterobacter cloacae
tgtgtaaagcgagggagtggaacgtgcgcgccgagatatcctgggtatgcaaacgcgcctgaatgcgctcatccatctcctgcgccgccttgcgaccaaaggccagcagcaaaatctggtcggcaaccgcctcgcccgttgtcagaagccagcccgcgcgtgccaccagcaccgacgttttgccgctcccggcgcctgccagcactaaaagagactgctcgccattcaccacggcgcgcgcctgggcaggattga

SEQ ID NO: 1168 - DNA, 1197 bp, Enterobacter cloacae
caaattatgagtgtacgtttagtgttagccaaagggcgcgagaagtcattactgcgccgtcatccctgggtcttttccggcgcggttgcccgcatggaaggtaaagccagcctcggtgaaaccatcgatattgttgaccatcaggggaaatggttagcacgcggcgcatactcgcctgcatctcagatccgcgcgcgcgtctggacgttcgataaagaagaagccatcgatatcgacttctttgtccgtcgtctgcaacaggcgcagcagtggcgtgagtggctggcaaagcgtgacgggctggacagctatcgtctgattgccggagagtccgacgggctgccgggcgtgaccattgaccgcttcggcaatttcctggtgttgcagctgctgagcgccggggcggaataccagcgtgccgcgctgattagcgccctgcaaaccctgttcccggaatgtgccatttacgaccgcagcgacgtggcggtacgtaaaaaagagggcatggagctgacgcaaggcccggtcaccggcgaactgccgcctgccctgctgcctattgaagagcatggcatgaagctgctggtggatatccagggcggccataagaccggttattacctcgaccagcgtgacagccgtctggcaacgcgccagtacgttgccgataggcgcgtgctgaactgcttctcttataccggcggctttgcggtctctgccctgatgggcggctgtgcccaggttgtgagcgtcgacacctcacaggaagcgctggacgtggcgaaacagaacgttgagctgaacaagctggatctgagcaaagcggagtttgtgcgcgacgacgtgttcaaactgctgcgtaaataccgcgaccagggcgagaaatttgacgttatcgtgatggacccacctaagtttgtagaaaataaaagccagctgatgggcgcttgccgtggctataaagacattaacatgctggcgatccagctgctgaacccgggcggcgtactgctgacgttctcctgctctggcctgatgacgacagatttattccaaaaaatcatcgccgatgccgcaatagatgcgggtcgtgatgtacaatttatagagcagttccgtcaggccgccgatcacccggtgatcgctacctacccggaagggctgtatctgaaagggtttgcctgtcgcgtcatgtaa

SEQ ID NO: 1169 - DNA, 348 bp, Enterobacter cloacae
tgtgtatgtaatgtttcccgggaggtgactatgattgccagcaaattcggtatcggccagcaggtccgccacaccttgctcggatatttgggtgtggtcgtggatatcgacccggagtattcccttgatgaaccgtcagcagacgatctggccgttgacgcagagcttcgcgccgcgccctggtatcatgtggttatggagggcgacgatggtcagcctgtccatacctatcttgccgaagcgcagctgagtggtgaactacaggatgagcatccggaacaacccactatggacgagcttgctcagaccatccgcaaacagttacaggcaccaagactgcgtaactaa

SEQ ID NO: 1170 - DNA, 453 bp, Enterobacter cloacae
gggtttatgcgtaccgttctgaatgtgttgaattttgtccttggcggttttgccaccaccctttcctggctttttgccaccctggtgagcattgtgctcatcttcacccttccgctgacgcgctcctgctgggaaatcaccaaactgtccctcgttccttatggaaatgaagccgtgcacgtggatgagctggagccggaaagaaaaaatgccctgatgaataccggcggcacgctgctgaatattttatggctgatcttctttggctggtggctgtgtctgatgcatattttcgccggcatcgcccagtgcattacgattattggcattccggttggcatcgctaatttcaaaattgccaccatcgccctgtggccggtaggacgccgagttgtcccggtcgaagtcgcgcaagccgcgcgtgaagccaatgcccgtcgtcgttttcagtaa

SEQ ID NO: 1171 - DNA, 2178 bp, Enterobacter cloacae
ggactggccgctctcatgctaagccccctgcttcgtcgctatacatggaacagtaactggctgtataacgtcaggatttttatcgccctctgcggcaccgtcgctctgccgtggtggctgaatgatgtgaagctcaccatccccctcacgcttggggtggtggccggtgcgctggcggatctcgacgaccgcctggccggtcgtttgcgtaatctggtcatcacgctggtctgcttctttattgcttccgcctccgttgagctgcttttcccgtggccctggctgtttgccttagggctgacggtgtccaccagcggcttcattttgctcggcggcctcgggcaacgctacgccactatcgcgtttggcgccctgctgattgccatttacaccatgctgggcgtctctctttacgagcagtggtatcagcaaccggtcctgctgatgttgggtgctatctggtataacctgctgaccttaaccgggcatcttatttttccggttcgtgccttacaggacaacattgcccgcagttacgaacagctggcccactatctggagctgaaatcccggctgtttgatccggatattgaagaggacagtcaggcgcccctgtacgatctggcgctggcaaatggccagctggtcgccacgctgaatcagaccaaagcgtctctgctcacccgtctgcgcggcgatcgcggtcagcgcggtacacggcgcacactgcactactattttgtcgcccaggatattcacgagcgcgccagctcctcgcatgtgcagtacgctgacctgcgcgagaaattccgctatagcgacgtgatgttccgtttccagcgcctgctgtcgatgcagtctcaggcctgccagcaacttgcgcgctcaatactgctgcgcacgccctatcagcacgatccgtgctttgaacgcgcattcagccacctggatgcggcgctcgatcgcgttcaggccagtgggacatcaccggaacagttcaaagccctgggattcctgctcaacaacctgagagccattgatgctcagctcgccaccattgagtctgaacaggcgatggcgatgccgggcaatgacgctgacaaccagcttgccgacgacagtctcaacggtttcagcgatatgtggctgcgcctgagccgtcattttacgccggaatccgccctctttcgccatgcggtaaggatgtcgctggtactgtgcgtcggctacgcgtttatccagataacaggattgcaccacggctactggatcctgttgaccagcctgtttgtctgccagccgaactataacgctacccgccatcggctcgcgctgcgtattgtcgggacattagtcggggtcgccatcgggctgccggtgctttactttgtgccatccgtagaagggcaactgctcctgattgtgattaccggtgtactgttcttcgctttccgcaatgtgcagtatgcccacgccacgatgttcatcacgctgctggtgctgctctgcttcaatctgctgggtgaaggctttgaggtggccctcccccgtgtgattgacacgctaatcggctgcgccatcgcctgggcggcggtgagttttatctggcctgactggcgtttccgaaatttaccgcgcgtgtccgacagagcaatgaacgccaactgccgctacctggatgctattcttgagcaataccatcagggtcgcgataaccgtctggcctatcggattgcccgtcgcgatgcgcataacactgacgcagagctggcttccgttgtctcgaatatgtcaactgagccgcgcgctacggcagaaatccgtgagacagccttccgcctgctgtgtctgaaccacacgttcaccagctatatctctacccttggcgcccaccgagagaaactgacgaatccggacatcctggcgctgctggacgacgccgtttgctacgttgatgatgcgcttcatcatcaacctgcggatgagccacgggttcaccaggcactggatgaactggtgcaacgtatcgcacaccttgatccaggcaccgacaacaaagctccactggtccttcagcaaattggcctgcttatcgctttgctgccggaaatttgtcggctgcgacagcagatcgctacctggcggaatgatggccctgcgactcaggcagcgcattaa

SEQ ID NO: 1172 - DNA, 483 bp, Enterobacter cloacae
cgaggtaacctcacggataagattatggaactgacaacacgcacacttccggcgcgcaagcacattgctctggttgcgcacgatcactgtaaacaaatgctgcttaactgggttcgtcgccatcagcctcttttacagcatcatgccctttctgctacgggaacaaccggcaacctgatccaccgcgaaaccggtctggaagtgaatgccatgctgagcggcccgatggggggtgaccagcaggtaggcgctcagatttcagaaggtaaaattgacgttcttattttcttctgggatccgctgaacgcggttccgcatgatccggacgttaaagcgctgctgcgtctggcgacggtgtggaacattccggtagccaccaatctttcaacggcagatttcatcattgaatcgccgcagtttaacgatccggtggagattttgatcccggattatcagcgttatcttgcggagagactgaagtag

SEQ ID NO: 1173 - DNA, 672 bp, Enterobacter cloacae
ggaaataagatgaaaaaacgcgtactcgttattgccgctctggtgagcggcgcactggctgtttcaggctgcacaaccaacccttacaccggtgaacgcgaagcgggcaaatccggcattggcgcgggtattggttccctggtaggcgctggcgttggcgtactctcctcctccaagaaagatcgcggcaaaggcgcgctgattggcgcagcggcaggcgcagccctgggcggcggcgtgggttattacatggacgtgcaggaagcaaaactgcgtgacaaaatgaaaggtacgggcgtaagcgtgacgcgcagcggtgacaacatcatcctgaacatgccaaacaacgtgacctttgacagcagcagcgcgacgctgaaacccgcaggcgcgaacaccctgaccggcgtggccgcagtgctgaaagagtacaataaaactgccgtgaacgtgattggttacaccgacagcaccggcagccaggatctgaacatgcgtctgtcgcagcagcgcgccgattccgtggccagctcgctgatcacccagggcgtagaagcgaaccgcatccgcaccagcggcatgggtccggctaacccgatcgccagcaacagcacggcggaaggcaaagcgcagaaccgccgcgttgaaattacgttgagtcctgtgcagtag

SEQ ID NO: 1174 - DNA, 585 bp, Enterobacter cloacae
cctatgcaacgttgcggctgggtaagccaggatcagctttatatcgattatcacgacaaggaatggggcgtaccggaaaccgacggtaaaaaactatttgaaatgatttgccttgaaggccagcaggccgggctgtcgtggatcaccgttctgaaaaagcgtgagaactatcgcaaagccttccaccagttcgatccggctgcggttgccgccatgaccgacgacgacgtacaaaagctggttctggataccggtatcatccgccatcgcggtaaaattcaggccattattggtaacgcgcgtgcttatctggcgatggagcaaaatggcgaacccttttcagcatttgtctggtcgtttgtggataacgagccgaaggtgacgcaggccgccacgcttgcagagatcccaacgtcgacccccgcctcagatgccctgtcgaaagcgctgaaaaaacgcggctttaagtttgtgggcaccaccatctgttactcctttatgcaggcctgcgggctggtcaatgaccacattacgggctgcttctgccatccggagggccaccatgatccgcaaatggcaaagtga

SEQ ID NO: 1175 - DNA, 1170 bp, Enterobacter cloacae
aagcaaaacggcaaccccgttgccgttttagtatttgcgccctctcctgtaggagagggttggggtgagggcatcagaccgccacccggcaaattgcttgattcgccagattttcccgctaaggtattctcactaaattcagggaaatcagcgatgatcaaaccaacccgggccaccatcagcgacgtggcgaaagccgccaaaaccggtaaaaccagcatttcacgctacctcaacggcgagaaacacctgctgtccgatgcgctgctggcgcggatcgaacaagccattgccgatctcgactaccgtcccagcctgatggcgcgcggcctcaagcggggacgcacccgcctgattgggcttatcatcgccgatatcactaacccctactccgttaacgtactcagcggcatcgaagcggcgtgccgggaaaaaggctttaccccgctggtctgtaacaccaataacgaagttgatcaggagttgcattacctcgatctgctgcgcagctatcaggtggaagggatcgtggtcaatgccgtcgggatgcgcgaagaggggctaaatcgtctgcaacaatcgtctctcccgatggtgcttattgaccgcaaaatcccggaatttgcctgcgatgtggtcgggctggataacacccaggcggccaccactgccaccgagcacctgattgaacagggtttcgaagccattctgttcctgagcgaaccgcttggcatggttaacacccgtcgggaccgcctggctgcatttcgcgccacgctggcgcgttatcccggtgtgatcgccgaaaatgctgaaatccccctccatgaagccggacagctggataataccctgcgccagttccatacccgccatcggggaatgcgtaaggcggtgatctccgctaacggggcgctgacgcttcaggttgcccgctcgcttaaacgcattggcctgcactggggcagcgacatcggcttgctcggctttgatgaactggagtgggctgaacttgctggcgtaggcattaccaccctcaaacaacccacctggcagatcggctatgccgcggttgaacaagtggttcgccgcattgaaggcacccgcgacgccgtacgcgagcaggttttttctggcgagctgatcgttcgcggctctactgcccgttaa

SEQ ID NO: 1176 - DNA, 942 bp, Enterobacter cloacae
accatgcacaagacgctggacgttatcactatcggcgaggccatggcgatgtttgtcgccaccgaaacgggcgagctgagcgcagtggagcactttatcaaacgcgtggcaggcgccgagctgaatgtcgctaccggccttgcgcggctggggctgaatgtcggctgggtgagccgcgtgggcaatgacagctttggccatttcgttctcgactcgctgaaaaaagagggcattgatgccgcaggcgtcacccttgacggacgcttcccgacgggctttcagctgaaatctaaagttgaaaatggaaccgatcccatcgtggagtatttccgcaaaggctcagcggcaagccatctctccgtggatgattatcacgccgcgtatttctcctccgcgcgccacctgcacctgagcggcgtggcggcggcgctctcggccagctcgtacgatttactcgatcacgcggcttcggcaatgaaagcgcagggcaaaaccatctcctttgatccgaatctgcgcccggtgctgtggaaaagcgaagcggagatggctgagaaactcaaccgactggcgtttcaggcggactgggttctgccgggcataaaagagggaatgatcctcactggcgaaagcacgcccgaaggcattgctgatttttacctcaacagaggggtaaaagccgtggtgctgaaaaccggtgccgacggcgcatggtttaaaactgccgacggtgagcaaggcgctgtcgctgcggtaaaagtcgacaacgtgatcgataccgtgggcgcgggcgatgggtttgccgtcggggtcatcagcgccctgctggagggcaaaccgctgtcgcaggccgtggcgcgaggcaacaaaattggttcgctggcgattcaggtgcagggcgacagcgaaggattaccaacacgagcagagctcggcgtctaa

SEQ ID NO: 1177 - DNA, 1338 bp, Enterobacter cloacae
gccaccgtgtaccctacagacaacggcggcaacaacctcaacaacagaggcaagcctatgaacagttcgaccaatgcagtaaaacgctggtggtacatcatgccaatcgtgtttatcacgtacagcctggcgtacctggatcgtgccaacttcagtttcgcatccgccgccgggatcaacgaagacctcgggatcaccaaaggggtctcgtccctgctgggcgccctcttcttcctggggtatttcttcttccagatccccggcgcgatttacgctgaacgccgcagcgtgcgaaagctcattttcatctgcctgatcttatggggtgcctgtgcgtcgcttactggcgtggtgaataacattcctgctctggcggctattcgctttattctcggcgtggttgaggcggccgtcatgccagcaatgctgatttacatcagcaactggttcacaaaatcggagcgttcacgtgctaatacgttcctgatactcggtaacccggtcaccgtgctgtggatgtcggtggtttccggctatctgatccagtccttcggctggcgcgagatgttcatcatcgaaggggttcccgcgattatctgggccttctgctggtgggtgttggtgaaagataagccagcccaggcgaaatggctttctgaagacgaaaaagccgcactccaggcgcagctggataaagagcagcaggggcttaaagcggtgcgtaactacggcgaagccttccgctcccggaacgttattctgctgtgtgcacagtattttacctggagtattggcgtgtacggttttgtgctgtggctgccgtcgattatccgcagcggcggtgaaaaccttggcatggtggaagtgggctggctgtcatcggtgccttacctggctgcgaccatcgcgatgattatcgtctcttgggcatcggacaagctgcaaaaccgtaagctgttcgtctggccactgctgctgatcgctgcttttgccttcattggctcctgggccgtaggcgcgaaccacttctgggtctcgtacactctgctggtgattgcgggtgcggccatgtatgccccgtatggtccgttctttgccatcatcccggaaatgctgccgcgtaacgtcgcagggggcgcgatggcgttgatcaacagtatgggtgcgctgggttcgttctttggctcgtggtttgtgggctatcttaacggtgccaccggcagcccgtcggcctcttacatctttatgggggtggcgctttttgcctcggtatggcttactctgattgttaagcctgctaataatcaacagctacccgtcggcgcacgccacgcctga

SEQ ID NO: 1178 - DNA, 1002 bp, Enterobacter cloacae
atccttttaaaatcaacggagattagcatgaagccgtccgtcattttgtacaaagcactgcctgaagatctgcaaaaacgcctggaggaacactttaccgttacccgggtaaagaacctcagcccggaaaccgtggcacagcacgccgacgcgtttgccagcgccgagggcctgctgggttcgagcgaaaaggtggatgcagcgctgctggagaaaatgccgaagcttcgtgctacctcaaccgtttcggtgggatacgacaatttcgacgtggatgcgctaaacgcccccaacatcctgctgatgcacacgccccatgccctgacggagaccgtcgccgacacgctgaatgccctggtgcttaacaccgcccgtcctgttatggaaattggcgagcgcgtgaaagcgggcgaatggaccaaaagcattggcccggactggttcggcgtggacgttcatggcaaaacgctggggattgttgggatgggccgtatcggtctggcgctggcacagcgcgcgcattttggcttcaacatgcccattctgtataacgcgcgccgtcaccacagtgaagctgaagaacgtttcaacgccctttattgcgagcttgatacgctgttgcgggaagccgactttgtctgcctgatcctgccgctgacggatgaaacgcgtcatctcatcggcaaagcggcgtttgaaaagatgaagaaatcggccattttcatcaacgcgggtcgtggtccggtggtcgatgagaaggcgctgattgaggcactgcaaaacggtgagatccacgccgctggtctggacgtgtttgaacaagagccgctgccggtggattctccgctactgaccatgccgaacgtcgtcgccctgcctcacatcggctctgcaactcatgaaacacgctacaacatggcggcgaccgccgtggataacctgattgccgcgctcggcggtaaagtggataagaactgcgttaacccgcagatacaacagtag

SEQ ID NO: 1179 - DNA, 507 bp, Enterobacter cloacae
ctgttccatctcagagagcagcagcatgtcatcaacgttctttccgcggttacgcggctcggcgccaatctgctcgcggtaggcgatgttatccgccatggtgttggtgtagaaccacatctcactttgcatggcgaacagatcggagctaaatccaagctgcttcagaacagcaaacacgttttgctctttgagagtgcgctgaggattatcactcgcaccgccctcacgaacaaacatacagcgcaacgagagcttcgtggcggtatcgcaggagtagccgcggtaagctacaagattcttttcctgcgccagtttcggggtggtatcgcggtcataaccgaggatacccatatgatcccagcgcgtcgtttcgccgataacgaagaccacgtaagtatcatccagcccgtcagccggagcctggtaggtgaactttttggttgggttaatcagcgatttcacatcgctggattcgtccgcctgagcccaggcataaagacctaa

SEQ ID NO: 1180 - DNA, 552 bp, Enterobacter cloacae
aaaaacgcggctttaagtttgtgggcaccaccatctgttactcctttatgcaggcctgcgggctggtcaatgaccacattacgggctgcttctgccatccggagggccaccatgatccgcaaatggcaaagtgagaacaccgcgccgcttttgagtctgtggctggagagcaccaccgaggcgcatccgtttatcgacgcaagttactggcaagcgaatgaagcggtagtgcgggatgaataccttcccgccgccgagacctgggtctgggaagaaaacggtaccctgtgcggttttatcagcgtcatgcagttccagttcgtgggggcgctgtttgtcgccccggcgttcatcggaaaggggattgggcgtgcgctgctgaaccacgttcagcagcactacccgtatttaaccctggaggtgtaccagaaaaacgtgcgggcggtgaatttctatcatgctcagggttttcgcatcgaagacagcgcctggcaggatgatacccaacacccgacgtggatcatgagctggcaggcggatcaaacgccgtaa

SEQ ID NO: 1181 - DNA, 231 bp, Enterobacter cloacae
gtgacgggatccgccctggcgttttctgcattcatcagggcgcatggccggatctggcgctggaaggagggcggtatttgtaagaacggcgccttaaacgtgctgacccaagatctccccagctcgaagctggggaatggctgcgcggggaatacggcgctggcatgggtggagaaatatgaggggccggcgcttacccttacggcgtttgatccgcctgccagctcatga

SEQ ID NO: 1182 - DNA, 375 bp, Enterobacter cloacae
catatatcgccgaactcggctctttctggagtcgctttgatgatgataaaaaaaatcagtggtcgccatgctgcttctggcctggtgggtgtttcagtctgcctgcttttttgtcacaccgcttttgcgtggcaacaggaatatatcgtttcagatgcacaaagtaatacgacggaacgttatacatgggacgccgatcaccaacctcgttatgaagatattctcgcggagcgtattaaccgcacccagaatgcctacggggtttaccctgaacgatccctccggttcggatgcggaaaccgttctgagcgttggctggaattttcccgtggcgggacatttcaccaccgggcccgtcatggcgtggcgcactga

SEQ ID NO: 1183 - DNA, 324 bp, Enterobacter cloacae
gatccttatctcgcccgtctggagaaaacgaagcagggccaggatcttaaaccggtctatgaccaggtgtatgagaaagtcgtgaccaagccgtcaaacgctttgcaaccgctgatcccggcggcgcaggtctttactcagcagttggtccaggtgggtgactttattagtgaacaaggtacgcaggtgagctttgtctctaacggtatccagttcccgacctcccagcaggcgagccagtataacgcgctgatcggtccgctcgcgtcccagcatcaggcctttagccaggcctggagcgcagcggtcgctgctacggaataa

SEQ ID NO: 1184 - DNA, 294 bp, Enterobacter cloacae
cccttccttcatcgcttaaaaatctgtaacgcaatccatcaagccggaaggcacaatatatttgttaataaggtaatttctatgtctgctaaaatgactggtctggtaaaatggttcaacgctgataaaggtttcggcttcatcacacctgacgatggctctaaagacgtgttcgtacacttctctgctatccagaacgatggctacaaatctctggatgaaggtcagaaagtttccttcaccatcgaaagcggcgctaaaggcccagcagctggtaacgttgtaagcctgtaa

SEQ ID NO: 1185 - DNA, 534 bp, Enterobacter cloacae
aaaaaatcagtggtcgccatgctgcttctggcctggtgggtgtttcagtctgcctgcttttttgtcacaccgcttttgcgtggcaacaggaatatatcgtttcagatgcacaaagtaatacgacggaacgttatacatgggacgccgatcaccaacctcgttatgaagatattctcgcggagcgtattaaccgcacccagaatgcctacggggtttaccctgaacgatccctccggttcggatgcggaaaccgttctgagcgttggctggaattttcccgtggcgggacatttcaccaccgggcccgtcatggcgtggcgcactgatggcgccccccctgtaacggtgaatgcgtttgaggatacaaccaccacgcagtcgcttaccgatcccctctggcatgccagcgtgaactcattgggttggcgtgttgatacgcagtatggtgatttacacccctgggcgaagatcagctataaccagcaaactgaagaagaatatttatatacgctgggattgagcgccaaattttaa

SEQ ID NO: 1186 - DNA, 1287 bp, Enterobacter cloacae
gattcggcgggtctttataccccttcccccagggttgtttgcatgaaatatattaggtctcttacccagcaaagattgtgtctgatgctggctgtctatatcggtttgtttctgaatggcgcggtgctgttcagacgagtggaaggttatttcgaacacctcactgtaagaaatggaatttttgccgcgattgaagtgtttggctcaattctggcgaccttcttcctgctacgtctgctctcgctttttggcagacgtacatggcaggttctggcctcgctggtggtgattatctccgccgccgcaagctattacatgacattcatgaatgtggtcattggctacggtattgtggcctcggtgatgaccacggacatcgacctctcgaaagaggtggtgggtcaagggttcatcctgtggacgattctgacctgcctgatcccgctcttctttatctggagtaacacctgccgctacaccctgttacgccagctgcgtacccggggacagcgcatccgcaacgtcgccgtcgttcttctggcgggtctgctggtgtgggcgcctattcgcctgatggaaaaacagcaaaaaaggatcgaaaaagcgacaggcgtggatatgccaagctacggcggcgtggtggctaactcgtatctgccgtctaactggctgtcggcgttaggtctttatgcctgggctcaggcggacgaatccagcgatgtgaaatcgctgattaacccaaccaaaaagttcacctaccaggctccggctgacgggctggatgatacttacgtggtcttcgttatcggcgaaacgacgcgctgggatcatatgggtatcctcggttatgaccgcgataccaccccgaaactggcgcaggaaaagaatcttgtagcttaccgcggctactcctgcgataccgccacgaagctctcgttgcgctgtatgtttgttcgtgagggcggtgcgagtgataatcctcagcgcactctcaaagagcaaaacgtgtttgctgttctgaagcagcttggatttagctccgatctgttcgccatgcaaagtgagatgtggttctacaccaacaccatggcggataacatcgcctaccgcgagcagattggcgccgagccgcgtaaccgcggaaagaacgttgatgacatgctgctgctctctgagatggaacagtcactgaaaaaccatccgcagggtaagcatcttattgttctgcataccaaagggtcacactacagtcttcacgccaggggtcgaggctaccgcgctatgcga

SEQ ID NO: 1187 - DNA, 2232 bp, Enterobacter cloacae
attgcctcaatgaaaggccgaaacacctgcacgcaaccaggagcgcacgctttgagcacctcaacaaaaaccattctgaccgccgcccactgggggccgatgctggtcgaaaccgatggcgacactgtgctgtcgtctcgcggggctttgccttcgcgccatctcaactctttacagaccgtcgttcgcgatcaggtacacagcaagacccgcgtccgctggccgatggtgcgtaaaggctttctggcgtcaccggataaaccgcagggtattcgcgggcaggatgagttcgtgcgcgtgagctgggacgatgcgctggcgctgatccatacgcagcataaacgcatccgcgacagctatggcccgtcgtccatttttgccggctcctatggctggcgctcaaacggcgtgctgcataaggctgcaaccctgctgcaacgctatatgagcctggccggaggatataccggccatctgggtgattactcgaccggcgcggcgcaggcgatcatgccgtatgtcgtgggcgggaatgaggtttatcaacagcagaccagctggccgctggtgctggagcatacagaggtggtggtgctgtggagcgccaacccgctcaataccctgaaaattgcctggaatgcgtctgacgagcagggcgtttcctacttcgatgcgctgcgcaaaagcggcaagcgcatcatctgtatcgatccgatgcgctctgaaaccctggatttcttcggcaacagcgcggaatggatcgcgccgcatatgggcaccgacgtggcgatgatgctgggcatcgcccacaccctggtggagaacggctggcacgacacggaatttctggcgcgttgtaccacggggttcgataaatttgccgactatctgacgggacaaagcgacggtattgccaaaaccgcagagtgggccgcggcgatttgcggcgttaatgccgttaaaatccgcgaactggcggcgttattccatagccatgtcacgatgctcatgaccggctgggggatgcagcgccagcagtttggcgagcaaaagcactggatgctgttgacgctcgccgcgatgcttgggcagattggcacacccggcggcggttttggtctttcctatcactttgccaacggcggcaacccgacgcgtaaagccgcggtgctggcgtccatgcagggctcggtgcagggtggcgtggacgctgtggataaaattccggtggcacgcattgttgaagccctggagaaccccggcgggttttatcagcacaacggtcaggatcgccatttcccggatattaagtttatctggtgggcgggtggggccaacttcacccatcaccaggataccaaccgcctaatccgcgcctggcagaaaccggagctggtggtgatctcggagtgcttctggactgcgtcagcgaaacatgccgatatcgttttgcctgccacgacctcgttcgagcgtaacgatctcaccatgacgggggattacagcaaccagcatatggtgccgatgaagcgcgtcgtggctccccgggatgaagcgcgggatgatttcgacgtctttgccgacctgagtgaaatgtgggaagcgggcgggcgggagcgtttcaccgagggcaaaacggatctgcaatggctggaaacattttaccagattgccagccagcgcggggctgcgcagggcgtgtccctgccgccatttgctgagttctgggaggcgaatcaactcttcgaaatgccagaaagcgagcagaacgcgcggtttgtgcgctttgctgacttccgtcgcgatccggagaatcacccgttaaaaaccgaaagcgggaagattgtgatctacagcgaacgcatcgccagctttggctacgcggactgtccgccgcatccggcgtggctggagccggacgaatggcatggcaatgcgcagccggggcagcttcagctgctgtctgcccatcctgcccatcgtctgcacagccagctcaactattcggctctgcgcgagcagtatgcggtggcgggtcgtgagccgatcgcgctgaatagcgacgatgcaaaggcgcgggggattaacgacggcgatctcgttcgggtctggaacgcgcgcgggcaggtgctggcaggcgccgtggtgagtgacgggatccgccctggcgttttctgcattcatcagggcgcatggccggatctggcgctggaaggagggcggtatttgtaa

SEQ ID NO: 1188 - DNA, 1224 bp, Enterobacter cloacae
tttatcttgcaggacactgccatgaacacatcaacttataaccgcacgcgttggctgacgctattcggcaccatcgttacccagttcgcactgggatcggtctatacctggagcctgtttaacagcgccctgtccgataagctcggcgcgccgataagccaggtggcattctccttcggcttgctgagtcttgggttagcaatttcctcttccgtggcgggcaaacttcaggaacgtttcggcgtgaagcgtgtaaccatggcatccgggatcttgctgggcttgggattcttcctgacggcatattctaacaacctgatgatgctgtggctgagcgccggggtgctggtggggctggcggacggcgcaggttatctgctgacgctgtctaactgcgtgaagtggttcccggagcgtaaagggcttatctccgcatttgccattggttcatatggcctgggcagcctcggcttcaaattcatcgatgcgcatctgctggcctcggttgggcttgagaaaacctttatgatctggggcgtgattgtgctggtaatgatcctcttcggcgccacgctgatgaaagatgcgccgcagcaggaagtgaaaaccgttaacggcgtggtggagaacgatttcaccctcgctcagtccatgcgtaagccgcagtactggatgctggcggtgatgttcctgacggcctgcatgagcggtctgtatgtcatcggtgtggcgaaagatatcgcgcagggaatggtaaaactggacgcggcgacggcggcgaacgccgtaacggtcatctctatcgctaacctctcgggtcgtctggtactgggtatcttgtctgacaaaatcgcccggatccgcgtgattacgctggggcaggtgatctccctggtgggtatggcagcactgctgttcgctccgctgaacgaggcgacattctttgcggcgatagcctgcgtagcctttaactttggcggcactattaccgtcttcccgtcgctggtgagcgagttcttcggcctgaacaacctggcgaaaaactacggcgtgatttatctcggcttcggtatcggcagtatttgcggttcactgattgcctcgctgtttggtggcttctacgtgacattctgcgtgatatttgccttgctgattatttcgctggcgctgtccaccacgattcgtcagccgcagcgcgaggtatataaagaagcgcatgcatga

SEQ ID NO: 1189 - DNA, 1194 bp, Enterobacter cloacae
aagtgtgcaactatgcttactactctcatctaccgaagccacctgcgagctgatgcaccaattcaatccattattgacatggtcagtgaagccaattcccgaaatgaacgtgcgggagtaactggtgttttacttttcaatgggattcatttcttacagcttcttgaaggtgatgaagcagctgtaatgcaaatctatgaaaagatttgcctagatacacttcactttaacattgtagaactcttatccgattatgccccctatcgacgatttggccgctcaggcatggaattaattgatataagactattcagtaaagaagagtgtctggacagggttcttcaacgtggaacaacccaacataaaatgctttacaacgacagagccttaaggtttttccgtacatttatagattctgctgagacagataactattatgaacttcctgataggttcagttggtttttttcatccgatcaaatagatgtatcatcagttgatcccgccattatcgaagacatgtatgcagttatagaccctctcgctgcccagattcattcttttgtcttgaatgctaaatcagataatgacgttataaaagtcaataatttactttttgatttggaatcgaagaaagatttgttaaaaattgcagggggtttcattacctcttcacaacgagtatcaataacactcctgcctttaaccttactgagggtgccgaatgcgattgagattttgctcgattacatcagagaaagtaacttacacccagaacaagttttagttgaattttctgagagcgaaataatccctgaaattgatgagttcgcgcattccgtgcagattctcaaaagctgcggtttaagtgttgctattaatgactttggtgtgggaaatgcaggtttattgtttctttcgaaatttcagcctgagaagctcaaaatacaccctcaactaatccataatatacataaggacggctctaagcaggcgatactacaaagtttaatacgttgcggcgaacttttagagataaggatttgtgcaacaggtgtcgaacaaccagaagaatggatgtggctagaatccgctggtatattttgcttccagggcaatcttttttcaaaatatgataaaaatggatatttgaagatcttctggccagaatctaatgaattcatacaatgttaa

SEQ ID NO: 1190 - DNA, 858 bp, Enterobacter cloacae
gggcgggaagttagaactcaccattaccgagttggagaacgcatgaatcttgaaaacaccctcaaatatcacttcgccaaatcgacgatgattagcgactctccgcgcgctacggcgtcagactcattaagcggaacggatatcatggccgctatgggcatgacgcaggaacgggcagcattgggttacagcgcttttctcgggaagatgggtatcagcaacaatgaccgggagagggcgatcgaattgttggcccagtatgcgctgaccaagtgcgatcgggttgctgcacttcgcaaactggatgccagggttaagccattagtgatgcaccagctggcctccttcgcttttgaagattattctcgcagcgccgccagcgtgaaacagtgtgactgctgctcgggtcagggattcattgaggctgatgttttcacgatgaaatcgcactacaccatgaagcttccacagtgggcaaaagaccttaagcaatctccgagttatttcgaggttaagcgccaggtcaaagaagtcgctaaggtactttgctcgacctgcaaggggaaaaaagttgtcagttgcgcctgcaaagactgccacgggcgcggtaaagcagtgaatcaggatctcactgaaaagcagggggtgccggttctggccgactgtaagcgctgcggcggacgtggatatgagcgtatcccctcaactgaggcttacgctgcggtgcgccagataacggatacaatcagcctagatacctggaagaagtctgttaagcccttttacgatcagctaatcaccaaatttgacatcgaagaggcatgggccgatgcgcagttgaagcagataacaaaatag

SEQ ID NO: 1191 - DNA, 699 bp, Enterobacter cloacae
cggggtgctggaatgaaaaaccttgccgagagcattcgcaattttgaccgggaacaggcttgccgcgtggcgcacaatctgcctgagcagtacaccgaacgcgaacaaacgcagcaggtggcgcagattatcaacggcctgtttgtacagctggcggccgcgtttcctgcaagcctggttaaccgaagccaggacgacgttgacgaaatccgccgccagtgggtgctggccttcaaagaaaacgggataaacaccatggagcaggttgaagccggcatgcgtatggtgcgtcgccaggagcgtccattcttgccatcgcctggccagttcatcaagtggtgcagggaagggcgctgcgtgctgggggtcaccaccgcagacgtgatggctgaatactggaagtggcgcaagctggtgtttcggtacccgagcagtgagcagtacccctggccgaagccggtttattaccacatttgcctcgagctgcggcgtcgcggaactgatggccaactcagtcacaaagagcttgagcgtgaggccggtgatattctggataggtgggaaaagcgggtgctagccgggaagccgattccgcctattcgtcgggcgttggctgcgccagttgctccgaaagggccgacaccggcggagcttttgaaaactaaatatcaacggatgaaagcagatggcagggcatag

SEQ ID NO: 1192 - DNA, 312 bp, Enterobacter cloacae
cgatcctgtgaggcatctttttattttaaacgactcaaaaaggtggaaataacgatgaagcgtccaaactggtttcaagtttccgataaaggtggcaaggctatagcagcgctccatcattacgccactactggtacaggtttacctgccgagctgatccatttaatttttttaagagtttcccagatcaatggttgtgcacactgcatagatatacatactcgcgatcttatcaagagtggcatgtccgtcgaaaagattgtattgtgcctgttctggcgagaaccttcctattttattctccggatatag

SEQ ID NO: 1193 - DNA, 486 bp, Enterobacter cloacae
gatggcgattctggagatagtcaaaggattagcctaatgaaagagattgatgtcggttttacgcacgttgcgtttgttgttagagatttggataaaagtattgatttttacggccgttatgctggcatggaagtcgtacacaggcgagagcctgaccttccggaggcacgtaaagtcgcgtggttaagtgacctaactcgcccttttgcgcttgtccttgtccaggttgatgctgtgactgacacccctttaggtaattttggtcacttgggagtagcttgttcaagcattgaagaaatcgacaataaaatagcgatggccaggatggagggcatcttgcgaaaagaacctgttcagacaggggaaccggtaggttattatgtcttcttcgctgatcctgatggtaacacacttgaactttcttatggtcagaaagtcgggatcgaggcttttcgtcattatgatacagtgcctgcatctcagtaa

SEQ ID NO: 1194 - DNA, 474 bp, Enterobacter cloacae
gcgcagcctaaacccggattacgtgacctggactgtaagtgcattcttgccgacctcaaatacaccagcgcgcccggacagccgctggcgaaaccggatgtgggggtgaacgtgaaaacatatcaaatcactttgccctggccgccgagcaataaccggtattaccggcacaaccgcgggcgcacgcacattagcgctgatggcgttgcgtaccgctatgcagtcgccagcgtcattcgaagcgcccggcttaatatccgcacggccgcaccactcaaaatccgtattgaatgtcacatgcccgaccgccgacgccgcgatctggataacctgcagaaagctgcatttgacgctctaaccaaggcgagattctggctggatgactgccaggttgtcgactatcgcgttgtgaaaatgcctgtcgttaagggcgggaagttagaactcaccattaccgagttggagaacgcatga

SEQ ID NO: 1195 - DNA, 894 bp, Enterobacter cloacae
agaggcgcttcaggtggctcttgggcgaaagtactgacgacagaccagaagcgggaagccgtgatgttgatgtgtgatgcgaccggtctgtcgcaacgtcgtgcctgcaggcttacaggtttatccctgtcgacctgccgctatgaggctcaccgtccggctgctgatgcgcatttatcagggcgcatcactgagctggcactggagcgcaggcgttttggctaccgtcgtatttggcagttgctgcgccgtgaagggcttcatgttaatcataagcgcgtgtaccggctttatcacctcagtggcctgggcgtaaaacgcagaagacgtcgtaaagggctggcaacagaacgtctgccgctgctccgtccggcggcgcccaatctgacctggtcgatggatttcgtcatggacgcactttccaccggtcgcaggatcaagtgtcttacctgcgtcgatgatttcacaaaggaatgcctgacggtcactgttgcctttgggatttcaggcgttcaggtcacgcgtattctggacagcattgcactgtttcgaggctatccggcgacgataagaactgaccaggggccggagttcacttgccgtgcactggatcaatgggcctttgagcatggtgttgagttgcgcttaatccagccgggcaagccaacgcagaacggatttattgagagctttaacggacgatttcgcgatgaatgtttgaatgagcactggttcagcgatatcgttcatgccaggaaaattattaatgactggcggcaggattataacgaatgccgcccgcactccacgctgaattatcagacaccgtctgaatttgcagcgggctggagaaagggtcattctgagaatgaagattccgacgttactaactga

SEQ ID NO: 1196 - DNA, 459 bp, Enterobacter cloacae
gcgaaatatggttcagcgttcccgggaatggggcggcatccagaagggggattatctgtggcaatttcaaatcccaggaagccggcggaagaacttcaagtggttggcgtggatttttcaggccaggccgatgtatggaacgtgaagctgttccgctgggtggacaacaaagaagattccgcatcttaccgaaagaacgtcgaacagctggtgcccgcgatcatatatgtattaccacttcgataccgcgaccgtgtcgtaaagtacgactcgtttgcgtaccggatggccaggttggaaaaagaagtgagtgaggcgaagcaagctttgatgctcgatgcaccgaagaaggtaaagctgaaggagttaggcgaggggattttcgaaatgttccgtgtagatccggatgtaacagcgccgctgctggcgatggtcacaaccatgctgggggcaatgtga

SEQ ID NO: 1197 - DNA, 990 bp, Enterobacter cloacae
aggcgaaagccggtctgcgtgaacagaaccgactttcaggtgcaaaaacggagtgtaattgcggagctaagtatgtcaaatacagctgaaattatcaatttcccccacagaaccgaacaaccgggaggtcgtatggccgacctgtcgaacgggtataccaaggtcgctaacgagatccaacagcttaagcctcgtctgagaatgtcaggccgggaatggcaatgttttgaggcggtgatctggcttacctacggctggaacaagaagcaggaccgcgttacgaacacggtgattgctgagcttacagggctgagtgattcgcatgtttctgatgcgctcaaatcgctcgctgaacgcaaaattatcttcagtcagaagcagggcgtgatgaaaacggtcggtataaatactgacctttccgcctggattttagacaaaccaaaaacgggaaaagtcttcccgaaatcgggaaaagtgttaccgaaaacgggaaaaaccttcccggaaacggtagacacccaagactataacaagaacaatattaaaagatcctcgtctcggaattctgacgaatcccgaaaccagaaaactcaaaaatttctctcacgccatcctgaagctgcagacgggatatacaccccagcgggtaaatcatggggatccgctgatgacctcaaggccgctcgctggatttacgacaggcttctcaccgtcaacgcatcgctatccgagccaaactgggctgaatgggcaaacaccatcaggctgatgcgcgtccaggataagcgtacgcactacgaaatctgtgacctgttccagtgggctaaccgggacgaattctggaaagacaacatcctgagcccttcgagtctgcgcaagcagtgggatcagctcactaccaagcggctgcgtgcaaccggaacggcaaagccatcccggagcggcatcgacctgcttaacaccgactggattgacggggtgctggaatga

SEQ ID NO: 1198 - DNA, 267 bp, Enterobacter cloacae
atatactgtatatgcatacagttgttcattgcggagggaaaaatgaaaatcgagttaaccattgatcgcatgaagaaacttcctgttggagctatacctgcgctcgagtcagaactgctcaaaagacttagcaagcagtttgatggttgccagattacgattaagcgtgccagtaatgatggtttgactgttttcgggggcgacaagaaagaggtcgaacatatcgtgcaggagacttgggaaagcgcggacgagtggttttattaa

SEQ ID NO: 1199 - DNA, 294 bp, Enterobacter cloacae; identical to SEQ ID NO: 235

SEQ ID NO: 1200 - DNA, 783 bp, Enterobacter cloacae
tactggccgaaaaacaagccggaagcccagttccagctgatgaacctgctttctctgctgccggtcggctgcgatatttttgttgtcggtgaaaaccgcagcggggtgcgtagcgcagagcagatgctcgaagcctgggcgccgctgacgaaaatcgacagcgcccgtcgctgcggcctgtaccatggtcgtctggaaaaacagaccactttcgatgccgacgccttctgggacgagtaccagcttgaaggcctgaccattaaaaccctgccgggcgtgttcagccgtgatgcgctcgatacgggcagtaagctgttgctgtccaccctgacgcctcataccaagggcaaagtgctggacgtcggctgtggcgcgggcgtgctgtcaacggttctcgccagtcactcaccaaaagtgcgtttaaccctgtgtgacgtgagcgctccggcggtagaagccagccgcgccacgcttgctgcgaatggcattgaaggcgacgtgattgccagcaacgtcttctccgacgtgaccggtcgctttgacatgatcatgtctaacccgccgttccacgacggaatggagaccagccttgaagcggcgcaaacgctgatccgtggcgcaacccgtcacctcaacagcggcggtgagctgcgtattgtggcgaacgccttcctcgcatacccgaaagtactggatgaaacctttggcttccacgaagtgatcgcccagacgggccgctttaaggtctatcgcaccgtgatgacgcgccaggcgaaaaagtaa

SEQ ID NO: 1201 - DNA, 938 bp, Enterobacter cloacae
tatcgaaaacccttttcacagttaaaagaagtaatgcctactatgactcaagtcgcgaaaaaaattctggtaacgtgcgccctgccgtacgccaacggctcaatccacctcggccacatgctggagcatatccaggctgatgtctgggtccgttaccagcgaatgcgcggccacgaggtgaactttatctgtgcggacgatgcccacggcacgccgatcatgctgaaagcgcagcagctgggcatttccccggaacagatgatcgccgaaatgagtcaggagcatcagaccgattttgctggctttgacatcagctatgacaactatcactccacacacagcgacgaaaaccgcgagctgtcggagctgatctacacccgtctgaaagagaacggtttcattaaaaaccgcaccatttctcagctgtacgatccggaaaaaggcatgttcctgccggaccgtttcgttaaaggcacctgtccgaaatgtaaatccccggaccagtacggcgataactgcgaagtgtgcggcgcgacctacagccccaccgagcttatcgaaccgaaatccgtggtttccggcgcgacgccggtgatgcgtgactccgagcacttcttcttcgacctgccgtcgttcagcgaaatgctgaaggcgtggacccgcagcggtgcattgcaggagcaggtcgcgaacaaaatgcaggagtggttcgaatccggtctgcaacaatgggatatctcccgcgatgcgccatactttggcttcgaaatcccgaacgcgccgggcaaatatttctacgtctggctggatgcgccgattggctacatgggctccttcaagaatctgtgtgacaagcgcggcgacaccgtaagcttcgacgaatactggaagaaagattccgatgccgagctgtatcacttcatcggtaaagacatcgt

SEQ ID NO: 1202 - DNA, 1101 bp, Enterobacter cloacae
atgaaatctatgaataaaaactttactgctatttttgtaatgggcattgtcttagcgggtacaatgagccaggctgaagccgcgaatacggtttgggacgatcagcaaatcactaatattgtaaatgaccatcaggatcaaattacacaaaacaacgctgatagtattaaccgtgatagcgcaacggataaccgcttaacgcaggttaacgacgaccttcagtccacaaaactgggcgtgttagtcgtggataaaatggctaacgacgcacatcagaaagcgttgcttgctggcgcacttgccgataccgccagtctgaaaagtgagacggccttacagggtgtggcgactaacggcacagccattatcaaccttcaacacgtcgataatattcaggatagccgccttactgctctcgaaaatgcacctaaacccatcaacggtgcagatggagcgaaaggtgataaaggggataccggtgcgactggcgcaaagggtgataaaggggataccggcgcgactggcgcaaagggcgataaaggggataccggtgtaactggcgcgaagggtgaaaaaggcgatgctggcgcgacaggtatgaaaggtgataagggtgatactggcgcacaaggcattgcgggaagaaacggtcgcgacggtgcagacggtcataacggtaaagatggtgtgacaaccaccgtgacacaacgacagctggatacagctacccaggcgaaggtcgctaaaaatagcatggctgttactgccgccacgcaggatctgcaagccaccaggcagtcattacaggcaatgaatactaacaccagccagcaatttaaatctctgcgtgatgaagtggacaataataagaagcaggctaatgccggtatttcaggggcgatggcgatggcgggtttgccacaagtgcaaaccaatcagcgcgtcatgtcctctgctggtggtgcgacttacaacggtgagagcgcgcttgctgtcggtgcgtccgttaactttaattcccatgtcatcgcgaaagtgagcttctcagatgacactgcgaataatatgggcgcttcggttgggattggtatgggcttttaa

SEQ ID NO: 1203 - DNA, 1401 bp, Enterobacter cloacae
cgaagcggcggttgtaggagtgatatgatgacggataaagtccgtattgacaccgtagatgcccacaaaagcaacgaaacctatctggcccgtcaggccgaatttgaatctaacgtcaggagttatccgcgcaaactgcctttagcgatcacaaaagcagaaggcgtgtggatcaccgatgcagataataaagaataccttgactgtttagctggcgcaggcaccctggcgcttggccacaatcatcctgatgtgctgaaaagcatccaaaatgtcattaccagcggcttgccgttacataccctggatctgaccacgccgctgaaagacgcgttttcagaataccttctctctctgttgcctggtcagggcaaagagtactgcctgcaattcactggcccgtccggggctgatgccgttgaagcggcgctgaagctggcgaaaaaagtgaccggtcgtagcggtatcatcagtttctctggtggttaccacggtatgacccacggcgcactgtccgtcaccggcaacctgtctcctaaagaagcggttgacggtatgatgccagaagtccagttcatgccttacccacacgagtaccgttgcccactgggtatcggtggtgaagcgggcgtgaaggcgctgacctactacttcgaaaatctgattaacgacgttgaaagcggcgtgcgtaaacctgccgcggtgatcctcgaagccgttcagggtgaaggtggcgtgaacccggcacctgttgagtggttgcagcgcatccgtaaagtcactcaggaacacggtatcctgctgatcctcgacgaagtccaggctggctttgcccgtaccggtaaattctttgccttcgaacacgcaggtatcgagccagacatcatcgtgatgtctaaagcagtcggtggcggtctgccgctggccgtgctcggtatcaaaaagcagttcgatgcatgggcgccaggccaccataccggtaccttccgcggcaaccagctggcgatggcaaccggtctgacgacgctgaagatcctgaaagaccagaatatcgcgggcaaagtggccgcacagggcgaatggctgaaaggccagctgaaagagatggcgaaacgctatccggttatcggtcacgttcgcggcctgggcatgatgatcggtattgagatcgttaagccgcacgaagccgctgaccacatgggttgcttcccgggcgacggcgagctgtctgcactgattcagaagaagtgcttcgaagcaggcttgattctggagcgtggcggccgtaacggtatcgttctgcgtctgctgccttctctgctgatcagcgatgacgagctgaaagtcttcctggataaattcgagcaggcactgcttgctgcgggcgttagcccggcgtaa

SEQ ID NO: 1204 - DNA, 1485 bp, Enterobacter cloacae
ccggagttattgattacgatgtctgattcaaacccaattttgttctcctctgcgcagagcattgaagcttaccagcaggcgattgaacaaagcactcaggctgtgatgcagtggctgaaacagcctgagatgtaccagggcaaaacggtcgcggagctgcgcgaccgtattaagctggatttcaacccgaaagggctgggcaacgaagcggcgattgaacgcgccgtggagttcttcctgaaagacagcttgtccgttcatcacccgcagtgtgtggcgcacctgcactgcccaagcctggtggttagccaggcggcggaagtactgattaacgccaccaaccagagtatggactcctgggatcaaagcccgtccgcaaccatcatcgagatcaaactgatcgagtggctgcgtacccgcgtgggttatcaggctggcgacgcaggcgtcttcaccagcggcggtacccagagtaacctcatggggctgatgctggcgcgtgacgcgttctttgcgcgtcagggccattctgttcagcaggacggtctgacaggcgatctgcgtaagatccgcgtgctgtgttcggaaaatgcccacttctccgtgcagaaaaacatggcgctgatgggtctgggctaccagtccgtggtgcaggtgaaaacggacgaattctcccgcatggatctcaccgatctggcggcgaaaatcgaacagtgcaacgcgaacggcgagcagatcctggcgattgtggccacggccggtacgaccgatgcgggtgctatcgatccgctgcgtgctattgctgagctggctgcgaaacagaatatctgggtgcacgttgatgcggcctggggcggcgcgctgctgatgtctgagcagtatcgtcactacctggacggtatcgagctggtggattccgtcaccctggacttccacaagcagttcttccagaccatcagctgcggtgcgttcctgctgaaagaagcgcgtcactatgagctgatgcgctatcaggcggcctatctgaactctgagttcgatgaagaagcgggtgtacctaacctggtctccaaatctctgcaaaccacgcgccgtttcgacgcgctgaaactgtggatgagcctggaagcgctgggtcaggagcaatacgcggcaatcatcgatcacggcgtgacgctggcacagcaggttgcggcttacgtgaaagagcagtctgctctggaactggtgatgcaaccccagctggcaagcgtgctgttccgcttccgtccgcaggcgcaaatggatgacgccggtattgccctgctgaaccagaaaattggcgatgcgctgctggagtctggccgtgcaaacgtcggtgtgaccgagcataacggtatcacctgcctgaagctgaccctgctgaacccaaccgtgacgctggaggacgtaaaaatcctgctgtctctggttgagcgtaccgcgcaggaagtgatggcgaagtaa

SEQ ID NO: 1205 - DNA, 399 bp, Enterobacter cloacae
actgtctgccatccgtttgcggatctgcacacaaaaagtatcagtaacgatatgactggagaaaaaatggctaagcgtaaattgttgcttctgggtgtattagtgtcactggcgggggccgcgcacgctgcaccgcaagcgtcgacagcgccttccggcatcaaggcctacgaagaacaagagtttattgccgattttacgaagttcaaaattggcgacaccgcgcccgcgcagtatcagacgcccgagtacaccatcaaacagtaccagctacgtaaccttcctgcgcccgatgccggcacacactggacctacatgggcgagaattatgttctgattggcgatgccgatggcaaaatctacaaagcctataacggagatattttctatcaccgctga

SEQ ID NO: 1206 - DNA, 492 bp, Enterobacter cloacae
ttggcgatgccgatggcaaaatctacaaagcctataacggagatattttctatcaccgctgatacgatcctaatccgtccgtggcaggagagcgatcgccctttcctgcgcacgctgttcctccacgcccggcgtgaagcctggccgtggctggacagttctgcgtggcagcttgaagattttgacgcggcaaccctggacgaagagatttgggtggcggagcaggatgggcaccgacttggctttgcctcagtctggacgaacgataattttctgcacaacctgtttgtcgatccgcagtatcagcgtctgggagtgggtcatttgttactggaacaggtacagaagacgtttaccaatacaggcgcgctgaagtgtctggtgaagaatgaacgggctattgcgttttaccatcgccacggctggcacattgaagcgacgggagattctccggacggggagtattatttgatgcactatcggcttgggtaa

SEQ ID NO: 1207 - DNA, 2250 bp, Enterobacter cloacae
agccagccaggaatgggcacgtcgtttaggtcagaaaggaatgaagcattaatgtcgtcttacacaacagacaattatggtgcagcggcaccccaacaacatgaagtcgatctcgttcgtttgctcgtcgagatgatcgaccaccgcacgatgattctgtgcgtgacattcctgttcaccctatgcgccggtctctatgcctgggttacaccccctgtttatcaggcggatgccatggtgcaaatagaaagcaaacaggataacagtctgcttaaagggttgagtcagctgggcaccgatgtttcgccggatgttgcccctgaaattttactgctgaaatcacgcatgatcctcggcgagaccgtcgacaaattaggtctgacgcagcaggcaaagcagcgcgttttgcctgtggtggggcgtctctggcagcgtctgcaagggcgtgggcagggtaagatcacgttaggcgaactccagatcccgcaggtggaaggcaaagcgcaagagctcacgctgaccgtacaggaagcgggaaaatatcacctgaagggcgaaaacattaaggcagaaggtcgggttgggaaaacgctggtcacgcaagggatcgttctgctggtgacgtcgattgaggcgacgccaggcacgcaattttcgcttaaatcgttgacgcggctggagacgatcaacgccctgaagaagagcctcacggttacggagtcggagaaacagagtggtatcgtgaccttaaccctgacgggtgaagatcctgacaacatcgcccgggtgctgaatgcgattgctgacaattatcttcagcaaaatatcgcgcgccaggaggctcaggattctcgtagtctggattttttacaagagcagttgccgaaaatcagagcggatctggatcaggctgaagcacggctgaatgcttatcgggcgcagcgtgactcggtggatctgtctttagaggcaaaatccgtactggatcaggtagttaacgttgagaaccagctaaatgagctgacgttccgggaggcagagatctcccagctctttaaaaagagtcaccctacctatcgtgcattgcatgaaaagagacagacccttgagcgggaacgggatcgcctgaataaccgtgtgtcagctatgccctccacgcagcaggagattttacgcctgagccgcgatgttgagtcgggccgcaccatttatttacagctattgacgcgtcagcaggagctgaatatttcccgctccagcgctgtcgggaacgtgaggatcattgatgaggcggttacgcacccggatccgataaagccgcgaaaagcgttaatcatcattcttggcgcgctgttcggcctaatgctcgcaatggggaccgtgctggtacgccaggcgttcaaacgtgggatcacgctttccgagcagctggaagcgcaggggctgccggttctggctacgttgccacgttcccagtggctgtggagtaaaacgcatttgcgcagaaaaaatccgttctctcgtcgctggaaacacaaaacctcggatgtgcctttcctgcccgtcgatcgccctgctgatatgtttgttgaagcggtacgcgggctgcgaaccagtctgtatttcgccatgatggaagctgagaaccgcattgtgatgatttctggccccactcaggactgcggaaaaacgctggtggcgacgaatctggcggccgtcgccgggcagagcggtcagcgggtgctgtttattgatgcggatatgcgccagggctatgttcataatatttttggcctggagaaccgctacggattgtcctgcctgctcgaagggaaatgcgactttacagaggtcattcagcatgctgaaaaagcggggattgacgtcatcacctgcggcccggaacccctgcgtccgttagaattgctgttaagcgaacgcttccttgacatcatgtcctgggttaacgagcaatatgacattgtcatcattgatactccgccggtcctggccgtcaccgatgcctcgctggtcgccagagcagccggaacaacgctaatggttgcccgtttcgataaaaccagcgtgaaagagatggagaataccgttaaacgtctccagcatgttggtgtgaaggtcagcggcacaatcctcaacgatattgttaaatccgcagcgctgttttacagctcggggtacagccagtgtgactacggttatgcttcgaggaaaaaaggagacaggcgttag

SEQ ID NO: 1208 - DNA, 504 bp, Enterobacter cloacae
tgccagcgtagggaagtcagatgcctacccggtcatcgcttcttcacgcacggcaggagcgaaaccatgcagcctgacctgctcgactcacacgttttacatcaattccgaacccgttccccgctcacgcactgtatgaccaacgatgtcgtgcagaccttcaccgccaacgtgctgctcgcgctgggcgcttccccggcaatggtgatcgaagccgaggaagcggaacagtttgccgcgcttgccgatgctctgctcatcaacgtgggtacactcaccgcaccgcgcgcccagtcgatgcgtcgggctattgagagcgctgtagccgcgggcacaccctgggttctggatccggttgcggttggcgcgctggcgttccgcacccgtttttgccagcaaatattatcccttaaacctgcggccattcgtggaaacgcctccgaaatcctcgcccttgccggaatgagtgcgggcgggcggggggttgattccaccgatacggca

SEQ ID NO: 1209 - DNA, 492 bp, Enterobacter cloacae
ccttaccgaaacggttcgttacatcagatcgtggccgcaataatgttcaaatcaatactcgtggtttgcaccggaaatatctgccgttctccgattggggagcggcttttacgccagcacctgcccgacagacatatcgcctcggcggggatatacgggcttgaggggtgcccggcggatgacagcgcccaggacgtcgcctggcggcatgggatctccctcgacggtcatgtggcgcgccggctgacacgcaatctgatgcagggatccgatcttatcctggtgatggagccggaacatcttcgcttcattgcggccatggcgccggagagcaggggaaagtcgctgctttttgggcaatggctggagccgcaggatatccccgatccctaccgtaaaagccgggaagcgtttgaatatgtgttcgggctattgggtaaagccagccaggaatgggcacgtcgtttaggtcagaaaggaatgaagcattaa

SEQ ID NO: 1210 - DNA, 1140 bp, Enterobacter cloacae
ggtcttattcacaagaacaaaggagtcgggatgagttctcaatcccaggccaaatcaccggaagccttacgagcaatggtcgccgggacgctggctaattttcagcatccaaccctgaagcacaatctcacgacgctgaaagcgcttcatcacgtcgcatggctggacgatacgctgcacatcgagctacagatgccgttcgtctggaccagcgcctttgatgccctgaaagagcaaaccagctctgagctgctgcgcattaccggcgcaaaagcaattgactggaagctaagccacagcatcgccacgctcaagcgcgtgaaaaatcagccgggcgttaacggcgtgaagaacatcatcgccgtcagctctggcaagggcggggtgggtaaatcatctaccgccgtgaatctggcgcttgcactggcggcagaaggggcgaaggtcggcattctggatgcggatatctatggcccgtccattccaaacatgctgggggcggaaaaccagcgtccaacttcgccggacggcacccacatggcgccaatcgtggcgcacggtctggcgaccaactccattggatatctggttactgacgataacgcgatggtctggcgtggcccgatggccagcaaagcgctgctgcaaatgttgcaggagacaatgtggcctgacctcgattatctggtgctggacatgccgccgggcaccggtgatatccagctgacgctggcgcagaacattccggttaccggcgccgtcgtagtcaccacgccgcaggatatcgcgctgatcgacgccaaaaaaggcatcgtcatgttcgagaaagtaaaagtgccggtactgggtatcgtcgagaacatgagcatgcatatttgcagcaactgcgggcaccatgagcccatctttggtaccggcggtgcggagaagctggctgcgcagtatcacacccagctgctggggcagatgccgctgcatatttccttgcgtgaagacctggacagcgggaaaccaacggtggtcagccgcccggacagcgaatttgcccagatgtatcgccagcttgcagggcgcgttgcggcgcagctctactggcagggggaagtgatcccgggtgaaatcgccttccgcgcggtgtaa

SEQ ID NO: 1211 - DNA, 1203 bp, Enterobacter cloacae
aatggaaagaatcatttcggtacgtattcgataatcaatactataaaaagatatttttactcaatgaaaaacacaacagtcttttcgatattgtttttaattattacgccattatctggctgcgtattttcaccgggtcagcatctggatcttgctggaaaacaggtgatgaccacagaaaatgcaaacgatcgtctggagaagcggattgatgtttatcctcttacgccttcgttaattgaaaaattgcgaccatcggccctgaaatctcaggcaaatcctaagctggatgaacaggtcaaaaactgggaataccgtatcggcgttggggatattttgaccgtcaccgtctgggatcaccctgaactgacaaccccggcagggcagtatcgcagcgccagtgacaccggtaactgggttaatgccgacggtacgcttttctatccttatgtcggtaaattgcaggtggcaggcaaaacggtcgcacgggtacgcgaggagatcacggcccggctgaacaatgtcattgaaagtccgcaggtggacgtcagcgtcgcctctttccgctcgcaaaaagcctatgtgacgggcgaggtggtgaagtcggggcagcaggctatcaccaatatcccgttaacggtaatggatgccgtgaacgccgcaggggggctctctgccgacgcggactggcgcaatgtcgtgctgacgcataatgggaaggatatgcgcctatcgctatatgcgctgatgcagcatggcgatctcacccaaaataagctgctctatcccggcgatattctgtttgtcccccgtaacgatgcgctgaaagtgttcgtcatgggcgaggtcgttaaacagagcacgctgaaaatggatcgcagcggcatgaccctggccgaagcgctgggcaatgcgggtgggctgaaccagaatatggccgatgccaccggaatttttgtcattcgttcgctgccgaaaagcgagcgttcagagaaaattgccaacatctaccagctcaatgctcaggacgcatcagccatggtgttaggcaccgagtttcagcttgagccttatgacattgtctatgtcaccactgcaccactgtcccgctggaatcgcgtgatatcacagcttgttccgaccatcagcggggtgcatgaccttaccgaaacggttcgttacatcagatcgtggccgcaataa

SEQ ID NO: 1212 - DNA, 840 bp, Enterobacter cloacae
gctatcactgacgcacaaatgaaagacagcatcagcaactatattctctcctgggtagaagaaaataactttactattttacacatcggtgatttggttgcagatattggatacagcagaagaaccatcgaaacatggtttaaagagaagtatcggctctctttaggtgaatatattctccgacggaggttaagccgtgccgccattatgctgagaatgacgtcgattccggtgacggatattgcgtatttattccattaccagagcagtcagggattttccagagcctttaaaaaaatgatggggctgacaccctctgagtacagatgtgccagagggtggaattttgacatcttacagccctcttttttattaagcgaacatgaaacgcctgagctcgaggtctgctatctggatgaaacgtttatctatacgcatgaatttatcgaacacgatcatctttttgatacctcagtgcatgatattactaaaaaaatcaaaaagctcctgacagaaaaccgccatgatatcgataaaattattctgatgccccgccgccccgagttaggcaaaagccgatcgtatctggtcgaggtattaatatcgtacgcgttacaaagcgacacggtgacaaataaaaaatcctgcattgtgcgtgggagatacgcaagaatgccctttagcggtagctgggaaatctacagcgcgtttaacaagattgccttcgttaaggcgatggtaaatcaacgcctgacgttgcgcgacggtatttacctgatgaaaattaatgggtacagcgatgagtgtgtcgattttgatgttttcatccccatcctgtaa

SEQ ID NO: 1213 - DNA, 762 bp, Enterobacter cloacae
atggatgctatgaactcccgacaacaaatcattttgcagatggtgatcgatcagggacgcgtaagcgtggtcgatctcgctaaagccaccggcgtttctgaagtcaccattcgtcaggatctgaatcttctggaaaaacagagctacctgcggcgtgcgcacggatatgccgttccactggacagcgacgacgttgaaacccgcatgatgaacaattatgcactcaagcgggagttggcggagtttgctgcatccctggtgaataacggtgagaccgtctttattgaaaatggcagcagtaacgcccttctggcgcgcacgcttgccgatcaaaaagacgttaccatcatcaccgtaagcagctatattgcccatctgttgaaggatactcgctgcgaggtgattctgctgggcggcatttaccagaagaaaagcgaaagcatggtggggccattaacgcgccaatatgttcagcaggttcacttcagtaaggcattcataggtattgacggctggcagcccgacaccggctttaccggccgcgacatgatgcgttcagacgtggttaacgccgtactcgccaaagagtgtgaagcgattgtgctgaccgacagttctaaatttggcgccgtacacccttatacgatggggccggcctcgcgcttcagccgtgtaatcacggatgagcgtttgcgtgatgaatatcgccagcaattagaacaagacggtctgactgtcgatattgtaaaaaaaacggcctga

SEQ ID NO: 1214 - DNA, 243 bp, Enterobacter cloacae
  unsure (150)
  unsure (159)
caggtggcgttggataatttacgggcgactttggcagccgcagggtgtacttttgacgatttgattgatgtcaagacatttcataccgatcctgaaaaccagttccccgccatcatggaggcaaaaaaactggcgtttccgcaccccccntacccaaantggacagcaataggcgttaactggcttgcgggttttgatttcgaaattaaggttatcgccaggatccctacgcccgcgaattaa

SEQ ID NO: 1215 - DNA, 1002 bp, Enterobacter cloacae
gatcaaggaacgcccatggaacaacgccgtttttccggcaaaggccactggtatcatgaaacccagtcgaatcattcgcagacggacgttctgccgctggtgcccgaagccgctaacgtcgacgaccgttttttgctcgatttagccctgcccgatgacattctcgcaagctgtgctggttggcttgcgcctgcccgaaccctgtgtcatcttttgttcccgcttgatactcccgtgagccgtctgcatacgctcagcgcctacgacaggctgagcacggcattaacggttgcccaggcgtgtggtgttcagcggctctgtaaccactacgctgccctgctcgcccctcttccggggccggactcctcccgggaaagcaatcgacgccttgcagaaattacccagtatgcccgccagttagcaagctcacccgatgtgatcgatgacaaagcccaaaaccagcttgatgaggttggactcacaacgtatgacattgtgcttatcaaccagatcatcggctttgtcggttttcaggcgcgagtggtcgcggtatttcaggcattgcttggccatccggtacgctggttgcccgggcaccacattcagccccatacgctgccggttagcttcagcagatggaccgccacgctacctgcggtagagctaaaatatgccagtgcgcttcagcttgaggcgctctcacgctggcaggcggaaccggcgcttgaagcgctcacccctgtgctgtgtcatgagccgatgctgcttaatctgacgggcgaaattctgcttaaccatccgctaagtgaaggccccgcgtcttcgatgatctcagccgctcttgcgctgctcgtcgcctctccggatcgctttagcgccacccagttaacgcccctgaccgggtcaggtctctcgccagagaaggccatcaatctgctaacccgagatgcattttatggctggctgaaccgtctgcgcgtggcgctcggcaaagaggaataa

SEQ ID NO: 1216 - DNA, 813 bp, Enterobacter cloacae
gcaatgaatataaggattaaagctatgggttttctttccggtaagcgcattctggtgactggcgttgccagcaaactgtccatcgcatacggcatcgcacaggcaatgcatcgcgaaggcgctgagctggcgttcacctaccagaacgacaagctgaaaggccgtgttgaagaatttgccgcgcagctgggttccagcattgttctggaatgtgacgttgcacaagacgaaagcattgatggcatgtttgctgaactggcaaaagcatggccgaaattcgacggttttgttcactccatcggcttcgctcctggcgaccagctggacggcgactatgtgaacgcggttacccgtgatggcttcaaaatcgcccacgacatcagctcctacagcttcgttgcaatggcaaaatcctgccgcgcgatgctgaacccgggcgcagccctgctgaccctgtcctacctcggcgcagaacgtgctatccctaactacaacgttatgggtctggcgaaagcgtctctggaagccaacgtgcgctacatggcgaacgcaatgggtcctgaaggcgtgcgtgttaacgctatttctgcgggtccaatccgtaccctggccgcttccggtatcaaagatttccgtaaaatgctggcacactgcgaagcggttaccccgattcgtcgtaccgttaccatcgaagatgtgggtaactctgcggcattcctgtgctctgacctttccgcaggtatttccggcgaagtggttcacgttgacggcggcttcaacatcgctgcaatgaacgagctggaaatcaaataa

SEQ ID NO: 1217 - DNA, 1941 bp, Enterobacter cloacae
aacattatgtttcaggacaacccgctgctagcgcagcttaaacagcaactgcattcccagacgccgcgtgcagaaggggtcgtaaaagccacggaaaagggctttggctttcttgaagttgacgggcagaagagctacttcattccgcctcctcagatgaagaaagtgatgcatggcgaccgtatttcggccgttattcataccgaaaaggaacgagagtctgccgagccggaagcactgatcgaacctttcctgacccgctttgtcgggaaagtgcataaaaaagacgatcgtctttccgtcgtgccggaccatcctctcctgaaagatgctattccgtgccgcgccgcgcgtggcgttgagcatgattttgttgagggtgactgggcggttgctgagatgcgccgtcatcctttaaaaggcgatcgcggtttctacgccgagcttacccaatacattaccttcggcgacgaccatttcgtcccatggtgggtgacgctggcgcgccacaacctcgaaaaagaagcacctgatggcgtggcgactgaaatgcaggacgaaggtctggaacgtcgcgatctgacggcgctggactttgtcaccattgacagcgccagcaccgaggatatggacgatgcgctgtatgccgaagagacagccgatggcaaactgcatctgaccgtcgccatcgccgaccctaccgcatggattgtcgaaggcagcaagctggacgagatggccaaagtgcgctcgttcaccaactacctgccgggctttaacattccgatgttgccgcgtgaactctccgacgatctttgttcgctgcgtgcgcatgaagtacgtccggtgctggcatgtcggatgaccattgcggctgacggtaccattgaagaagatattgaattcttcgccgccaccatcgaatccaaagccaagctggcctatgacgacgtgtccgactggctggagaacacgggcaactggaaacccgagtcggacaacattgccgcacaaattcgtctgttgcaccgcgtctgcctgagccgcagcgaatggcgtcaaactcacgcgctggtcttcaaagatcgtccggactaccgttttgtgctgggtgaaaaaggtgaagtgctgaatatcgtcgctgagccgcgccgtattgccaaccgcatcgttgaagaagcgatgatttccgccaacatttgtgctgcacgcgtgctgcgcgacaaattaggctttggcatttacaacgtgcacaccgggtttgatccggcgaacaccgaagcgctggctgccctgctgaaaacccatgacgtacacgtcgatcctgaggaagtgctgaccctgcaaggtttctgcaaactgcgccgcgagctggacgcacagccgtcagggttcctcgacagccgtattcgccgcttccagtcctttgcggaaatcagcaccgagcctggcccgcacttcggccttggccttgaggcttatgcgacctggacctccccgatccgtaagtacggcgacatggttaaccatcgtctgctgaaagcgatcatcaaaggggaatctgttgcccgcccacaggatggtacgacattgcagatggcagaacgtcgccgtctcaaccgtatggcggagcgtgatgtcggcgactggttgtacgcgcgcttcctgaatgataaggcagggactgatacccgtttcccggctgaaatcattgacatcagccgcggcggtatgcgcgttcgcctggtggataatggcgccgttgcctttattcctgccccgttcctgcatgccgtccgcgacgaactggtttgtagccaggaaaacgggaccgtgcaaattaaaggcgaaacggtttacaaggtcactgacgtgattgatgtcaccatcgctgaagtgcgcatggaaacccgcagtattatcgcgcgccctgtcgcctga

SEQ ID NO: 1218 - DNA, 2025 bp, Enterobacter cloacae
tttgtgcgctactcagcagccgcgggagaaaacgtgatggacgatctggagcagaatttgctgtttcgttacatgggtacgcatagcccctggtggcgactgacagcagacagcaatgctctgcatcttgctgccagtgaaagcgctgacatcattcaggtggttgcgctggatgatgaacaggccgcgctgatccgccagctcaccgtaatcacctccagcattgccatgaccctgcctttgtacggtgtggacgttcccgttcatcttgtcggccgtaaaattaacaaaaatgagtgggcaggaacggcatcagcctggaacgataccccttccgttgcgcgcgacctggcgcaggggctctccttcgccgaacaggtagtttccgaggctaactccgtgattgtgatcctcgaccagaacgggaatattcagcgcttcaaccgtttaagtgaagaatatacgggcctgaaggaacaggaagttatcgggcaaaacgtgttcaaactgtttatgagccgcagcgaagccgcggcctccaaacgcaacatcaccggtttttttcgtaacggcagctcgtacgaagttgaacgctggatcaagacccgcaaggggcagcgcctgtttctcttcagaaataaatttgttcacagcggcagcggaaaaaatgaaattttcctcatctgttcaggtaccgacataaccgaggagcgtcgggcccaggagcgcctgcgcgttctcgccaatacggatacgattaccggtttgcctaaccgaaatgccatccatgagctgatctctgatgccatcaccgctcggggtgacacgcaggttggcgtagtttacctcgatctggataattttaaaaaagtgaacgatgcctatgggcatatgtttggcgaccagctgctacaggccgttgcgctggcgatcctgagctgcctggacgaaggacaaaccctggcgcgcctgggtggggatgagtttatcgtgatggccaccgatacctcgcagggcgcgctggaagcgatggcgtcgcgaatactgacccgactgcgtcaacctttccgcatcgggctgattgaggtttacaccggctgctcgctgggcatcgcgcttgcgccccagcacggtaacgatcgcgaaagcgtcattcgcaatgccgacaccgccatgtacaccgccaaagaaaatggccggggcaaattctgcgtcttctcgccagagatgaaccagcgcgtatttgaatacctgtggctggataccaacctgcgtaaagcgctggataacgatcagctgttaatccactaccagcccaaaatgacctggcgcggcgaagtcagaagtctggaggcgctggtgcgctggcagtcgccagagcgtggcctgatcccgccgatggagtttatctcctatgccgaggaatcagggctgattgtgcctctgggccgctgggttatgcttgatgtggtgcgccaggtagcaaaatggcgcgacaaggggatcaacatgcgcgtcgcggtcaacgtctccgcccgtcagctggcggaccagaccatcttcagtgacctgaagcaggcgctgaaagacctgaattttgaatactgcccgattgacgtggaattaaccgaaagctgtctcattgaaaatgaagaactggccctgtcagtgatccagcaatttagccgcctgggagcgcaaattcatctggatgactttggtacggggtactcttccctgtcgcaactggcgcgcttccctatcgatgccattaagcttgaccagtctttcgtgcgggatatccataagcagtccatttcacagtcgctggtgcgtgcgatagtcgccgtggcccaggcgttaaatttgcaggtcattgctgaaggggtggaaagtgcaaaagaagacgcctttctgacgaagaatggcgtcaacgaacggcagggttatctttttgctaagcccatgcccgctgccgcattcgagcgatggctaaaacgttatcagaccaggaatgtccgttag

SEQ ID NO: 1219 - DNA, 243 bp, Enterobacter cloacae
atcgataattcaggagaaagtattatgacctttaccagcaaaaaattagccgccgctgttgtggcaatcactgtagcaatgtccctgagcgcttgctctaactggtctaaacgtgaccgtaacaccgcgattggtgccggtgctggtgcgcttggtggtgcggtattaacggatgatagtacgctgggtacattaggtggtgctgccgtaggtggtattatcggtcaccaggtgggcaaataa

SEQ ID NO: 1220 - DNA, 351 bp, Enterobacter cloacae
tgcatcactgaaaaagggggcataatgcgtgacgccaacagtcgtctggtctattcaacggataccgggcgcattgaagagccaaaagagaaagctgaacgtccaaaaggcgatggtatcgtgcgaattcagcgccagaccagcggcagaaaagggaaaggcgtttgccttgtcaccggcattgacctggatgatgcagacctggtaaagctcgccgctgagcttaaaaagaagtgcggatgcggtggggcagtaaaagacggcattattgagattcagggcgataaacgagatttaattaaaacgctgctggaagccaaaggaatgaaagtcaaactggcgggcggctaa

SEQ ID NO: 1221 - DNA, 870 bp, Enterobacter cloacae
gggggggggaggctattcttcattcccgcggttaagacatttgattctgtgcatttaccccgagggcaggtagaatgcacgccgtttatctgttccgcgccgctgcgcgcccatagacgaaaagggctggtcatgacgtctgttacatcctccacttcccgcgtagttaccgattctcccgtagttgttgctctggattacaataaccgtgacgccgcactggcctttgttgatggcattgatccccgcgattgccgtctgaaagtaggcaaagagatgtttacgctgttcggcccacaaattgtccgcgatctgcatcagcgtggtttcgacgttttcctcgacctgaaattccacgacattccaaataccactgcgcacgccgttgctgcggcagctgaactcggcgtgtggatggttaacgtacatgcatcgggcggggcacgcatgatgacggctgcgcgcgaagcgctggtgccgtttggtaatgacgctccgcttctgatcgccgtcaccgtgctgaccagtatggatgaatccgacctgcgcgacctgggtgtgacgttgtcacctgccgaacatgcagagcgtttggcgcgcctcacgcaacagtgtggtctcgatggcgtgttctgttcggctcaggaggcggttcgcttcaaatctgaattaggccgcgattttaaactggtgacgccaggtattcgaccggcaggcagcgagtcaggggatcagcgacgcatcatgacgccagagcaggcgctgagcgcgggtgttgactatatggtgattggtcgcccggtgacgcaatccgctcatccggcagagaccctgaaagcgattaatgcatcactgaaaaagggggcataa

SEQ ID NO: 1222 - DNA, 1407 bp, Enterobacter cloacae
aattgcgcgagggtcgataacggctatgccattttgcgtctttatctgtgtgcggtaagaaggaagatgaaaaatataacgttggccgaaaaactgatcatgctgtcaggtgcggcgctttttgcgcttataatcgcggtgaactccttttgcgtgaatgataatcctggtttcagggtgcctatgaccacctatttgatcgtcatgattgcgctgttctttctggataccattatctttatttttatccagatgctgtatgcctccgaccgatcgcgtttttccttattcattctgagcctggcatttcttagtgggctggtttatttcattgagacgatcattgtcattcagcttccggagcatgctggttttacccaggcggcaaaaaccaacgatacggcggtattctatttttttcggcagctgagctttatcgtattactggcgctggcggtccgtgtggaaaaaatcacgagacgatccacgctcagattccgaaataagatcagcatgacgttagcattaatgatgacactggttatgtttccgatgctggcccattatctcagcagctaccatccggcctggacattaacgattgcagcatacgaagatgaacatcattatcctgtctgggatatcaggtacttaaacgttctgatcctgctctggtcggctttactttgttatatgatctctgtgacacgcctggcgtccgggatctggaacagtattattgtggtttgcctttccgccatcgtttacaattttttcctcttactgcttgatacctacaatctgtcgctctggtatatcagccgggcagtagaggtcctcagcaaattatttgtgatttgtaccttaatgttccatgtctttaacctgttgaaaattttcggcgatcgggttgatcgcgatccgcttactcagatctacaaccgtaaatatttttatgaggcacttccgcgggtccgctccctcaggacagaaaaggggaccagcattatgatgctggacatcgacaactttaagtcgattaacgataactggggccatcttgtgggggatcgcgtgattctggcggtcgtggatattatcaaagacagcattcgcgataacgacatctttgcccgactgggaggcgaggaatttggtctgctgctgccggataccgacggtaagcaggctatggccgtcgcggagcgtattcgccagaacgttcaacagcgcaccgggccgggctatcattatgctctccctgtaaaggtcacattaagtatcggcgtgtgctcagccattcagaataacgtcaacggcaatgatattatgcgagacgtggacgaggcgttgtatgaggctaagcacaacggtaaaaacagaattgttaccagacaggctgaatga

SEQ ID NO: 1223 - DNA, 915 bp, Enterobacter cloacae
tctaaaactgcgcgcaacgcgcttttttataagaggaattcgactatgacagttatcaaccagacaacctgcacattgtttactgatgctgaacgattcactcaactggcggcttattatgaggccgaacggcgtacggtgtggatgatgttacgtgccacgccacggccttgcttcaaccatgcgctgatcgaggagatcatgaatctctcctggctggttcgacagtccggatttgtcgttgatttttgggtcaccggatcgctggtccccgacatctacaataccggcggtgatttacagttcttcgttgagtgcatcaaaaacaaccgacgcgaagcgttacgcgcctatgcccgggcctgtgtggactgcgttcatgccgcctcgcgagggtttgataccggcgctgtcacgctggctatggtggaaggaagcgctttagggggcgggtttgaagccgcgctggcgcatcatttcattctggcccagcgcgatgcccgattaggctttccggaaatcgcgttcaatctgttcccgggcatgggcggctattcactggtggcgcgtcgtgccggcatgaaaatggcggaggcgctgatctacaaaggtgagacgcatacggcggaatggtatgagcagcatggtcttgtggatctcttatttgagccgttacagagctatgtttcggtgcggacgtttatcgacacgctacagccgaagctgaacggcgtaagggccatgctgcgtgcacgtacgcgcgtgctgccacttccgcgaagcgagttgatggacattactgaggattgggttgatgccgccttctgccttgaaccgaaggatatcgcctacatggagcggctggttatgctgcaaaatcgccatcaggcgacgggcttacgcaaagccagctaa

SEQ ID NO: 1224 - DNA, 1323 bp, Enterobacter cloacae
aatagtctccttaacttatttctacgaaccaggaacgacgccatgagcaagtctgaaaacctctacagcgcagcccgcgagcttatcccaggcggcgtaaactcaccggtgcgcgcctttaccggcgtgggtggcaccccgctgtttatcgaacgtgcggatggcgcatatctgtatgatgtggatggtaaagcctatgtcgattacgtcggctcctggggcccgatggtactgggccacaaccacccggcgatccgcaacgcggtgattgaagccgctcagcgcggcctgagcttcggtgcgccaaccgagatggaagtcaaaatggcggagctggtcaccgagctggtgccgacaatggacatggtacgtatggtgaactccggtacggaagcgaccatgagcgccatccgtctggcgcgcggctttaccggccgtgacaagattatcaagttcgaaggctgttaccatggccacgccgactgcctgctggtaaaagccggttccggcgcgctgacgctcggtcagcctaactctccgggcgtgccggctgacttcgcaaaacacaccctcacctgcacctataacgatctggacaccgttcgcgcggcgttcgagcagtatccgcaggagatcgcctgcattatcgttgagccagttgcgggcaacatgaactgtatcccaccgcagccggatttcctgccgggcctgcgcgcgctgtgcgatgagttcggcgcgctgctgatcatcgacgaagtgatgaccggtttccgcgtcgcactggcgggggcgcagtcatactacggcgtcgagccggatctgacctgcctcggcaagatcattggcggcggcatgcctgtcggcgcgtttggcggccgtaaggacgtaatggacgcgctggcgccaaccggtccggtttaccaggcgggtacgctctccggtaacccgattgcgatggcggcgggctttgcctgtctgaccgaagtggcgcagccgggcatccaccaaaccctgacggaccggacgacgcagctggcaaacggtctgctggaagccgcagaagacgcgggtattccgctggtggtaaaccacgtcggcgggatgttcgggattttcttcaccgaggcgaaaaccgtgacctgctatcaggacgtggtgaaatgcgacgtggaacgcttcaaacgcttcttccacctgatgctggaagaaggcgtgtatctggccccgtcagcgtttgaagcgggctttatgtccgtggcgcacagcgaagaagatatcaataacaccatcgacgcagcgcgtaaggtgtttgcgaagctgtaa

SEQ ID NO: 1225 - DNA, 587 bp, Enterobacter cloacae
tgctgtatcagagcttcccgcaggcggagcgcgctgttccggcgcaggcggcctatatgacgctgtggaccatgcagcaggtggttcagcgcggtaccggtcgtcagctgggggcgaagtatcctggtctgcatctggcgggtaaaaccgggaccaccaacaacaatgtcgatacctggttcgccggtattgatggtcgtgaagtggtcatcacctgggtggggcgcgataacaaccagccgaccaaactgtatggcgcgagcggtgcgatgtcgatttaccagcgctacctcgcgaatcagtctccggtgccgctgaacctcgttgctccggaagatatcgtcgatatgggcgtggacagctcgggtaacttcatttgcggcggtggcgtgcgtacgctgccggtctggacgaccaacccggatgcgctgtgccagcaaagccagccagaagaaccgacaggtaacccgttcgatcagtcttctcaacctcagcagccgcagcagcaacagccgcagcagcaggaagagaagaaagacagcgacggcgtcgccggctggatcaaggatatgttcggcgggaactaa

SEQ ID NO: 1226 - DNA, 2334 bp, Enterobacter cloacae
accctcaattcttgtagggccgcatatcgcttgctatgccgtcagcgtttcgcatattattctgcggtcataataataattctcgtttacgttatcattcaccttttccatcagagatccatcatggcgctttccaatactgctcagccaattaacacgtcgctgcgtaaactcgcagtcgtcgtagccacagcggttgccggcatgtctgcttacgcacaggccgctgaaacccccaagaaagaagaaaccatcaccgtgactgccgcaccggctgcacaggaaagtgcctggggtcctgcaccgacgattgcagcaaagcgcactgcaacggcgacgaaaaccgatacaccgatcgagaaaaccccgcagtctatttccgtggttacacgtgaagagatggacatgaaacagccgggaacggttaaacaggcgctggcctataccccaagtgttttcgcaacgcgcggcgcatcaacaacttacgatgtggtttcgattcgtggtttcacgacctccagcaccgtgaataccaaccagtatctggatggtatgaagttgcagggagacaactactctgaagcgtccatggatccgtacttccttgagcgcgtagagctgctgcgtggcccgacgtctgtactgtatggcaaaagccatccgggcggcgtagtgagtatggtcagcaagcgtccaaccacggaaccgttgaaagaaattcagttcaaaatggggacggataacctctggcagaccggttttgatttcagcgacgcgattgacgatgacggcgtgtggtcctaccgtctgaccggtctggggcgcagtgaaaatgcgcagcaggaaatggtgaagtctactcgttacgcgattgcgccgtctttcagctggcgccctgatgataaaaccgatttcactttcctgagcaacttccagagcgatccggatgcgggttactacggctggctgccgcgtgaaggtaccgttgtgccttactatgatgctaacggaaaagcgcacaaactgccgaccgacttcaacgaaggcgatgaagacaataaaatctcccgtcgtcagaaaatggtgggttacagcttcgcgcatgaattcaacgacaccttcaccgtgcgtcagaacctgcgttataccaaaatcaacacgctttaccgttcagtttacggtaacggctatatcgccccggcccagatcagccgcgcgtacgtgcgctcagatgaagacctcaactcgttcacggttgatacacagctccagtcgaaattcgcgaccggcgccgttgaccataccctgctgacaggtgtggattaccttcgtatgcgcaatgacattgatgctgactacggtaccgccgatccgatcagtatgaacaatccgcagcacggcaatgcgaacgttaatgtgaacttcccgtatgccatgctcaatcgccaggagcagaccgggctctatgcgcaggatcaggcggaatgggataagtgggtactcaccttgggtggccgctatgactttgcgaaaacgtctgccttcaaccgtaataacggaaccaccgcggaaattaacgatcaggcatttacctggcgcggggggattaactacctgttcgataacgggattacaccatacttcagctacagtgaatctttcgaaccgctctctggcactactcagggtggtaaaccgttcgatccggcacgcggcaagcaatatgaagcgggcgtgaagtatgttccaaaagatctgcctgttgtggtgacggcagcggtataccagctgaccaagaacaataacctgaccgccgatccggcgaacccgaccagcggcttcagcgtgcagggcggtgaaatccgctcccgtggctttgagctggaagcgaaagcggcggtgtcggctaatgtgaacgtgacggcggcctacagctacaccgatgcggaatatacccacgatacctggtatgaaggtcgtcgtccggcagaagtaccgcgcaacatggcatccctgtgggcggattacaccttccacgagacggcgctgagtggcctgaccgtcggtgcaggcgcgcgttacatcggtaacacggtgacgtactactcctcagcgtcgcctaaagcctatgagtcctttaacgtcgcgggttatgccctggcggatgcgaccgtgaaatacgatctggcgcgcttcggtctgccgggctcttccgtcggcgtcaacgtgaacaacatctttgaccgtgaatacgtctccagctgctacagcgagtatgcatgctactggggagcaggacgccaggttgttgccacggcgaccttccgcttctaa

SEQ ID NO: 1227 - DNA, 2142 bp, Enterobacter cloacae
gcgcgagatgcaaaccctgatggcgactccgctctggcaggcaatgccgttcgtccgcgagcagcgcttcctgcgcgcgccagcggtatggttctacggcgcgacgctgtcggccatgcattttgcccgcgtgctggacaatgcactgggaggcaaggcatgagcacgcgtatggcccgtttcccgatgttactgttagcaatcatttttctggctgccctggcgttaaccggctttaacctgaccacggcgttgccgcgcgaacagtgggcagccgcgtttgccgcaccggatatcgataatattcagcaaatgctgttccactacagcctgctgccgcgtctggctatctccctgctggtcggggcgggactgggactggtgggcgtactgtttcagcaggtgctacgtaacccgctggcggagccgaccacgctgggcgtggcgacgggggctcagttggggatcaccatcaccactctctggaccctgccgggagcgttaacctcgcagtttgccgcgctggcaggcgcatgcgtggtcggtgcgctggtctttggcgtggcctggggaaaacgtctctcgccggtcacgctgatcctcgcggggctggtcgtcagcctctactgtggggcgatcaaccagctgctggtgctgtttcaccacgaccagttgcaaagcatgtttatgtggagtaccggcacgctcacccagaccgactggagtatcgttcagcgcctgtggccgcagctgtttggcggcgtggtgctgacactgctgctgctgcgtccgctcacgctgatgggcctggacgacggcgtggcgcgcaatctcgggctggcgctgtcgctggcgcgtctggcggccctgaccctggcgattgtgctcagcgcgttactggttaacgccgtcggcatcatcggctttatcggcctgtttgcgccgctgctggcaaaaatgctcggcgcacgccgtctgctggcgcgcctgatgctggcgccgctgattggtgcgctgatcctctggctttccgatcagctcattctctggctgacgcgcgtctggatggaagtttccacgggctcggtgacggccctgatcggtgcgccgctgctgctgtggctcttgccgcgcctgcgcagcattagcgccccggcaatggatgccggcgataaagtacatgctgagcgtcagtcggtggtgtggttcagccttgccggactggcagtgctggttatcgcctcgtttgccgcactctcgctgggacgcgacgccacgggctggcactgggcgacgggggatttgttgcatgaactcatgcagtggcgctggccgcggatcttctccgcgctgattgcgggcgtcatgctggcggtggcgggctgtattatccagcgtctcaccggcaacccgatggcaagcccggaagtattagggatcagctccggggccgcgtttggcgtagtgttgatgttgttcctcgtgccgggaaatgcattcggctggctgatgcctgccgggagtatcggtgcggcagtcacgctgatgattatcctgatcgcctccgggcgcggcggtttctcgcctcaccgcatgctgctggccgggatggcgctgagcaccgcgtttaccatgctgctgatgatgttgcaggcgagcggcgatccgcgcatggcgcagatcctgacctggatctccggctcgacgtacaacgccaccggcagccaggtggtacataccgggatcgtgatgatcgtactgctggcgatagtgccgctgtgccgccgctggatgaccattctgccgctgggcggggacaccgcgcgcgcggttgggctggcgctgacgccaacgcgtatcgccctgctgctgctggccgcgtgcctgacggcgacggccaccatgaccattggcccgctcagttttgtcggattaatggcgccgcatatcgcccgtatgatgggcttccgcaggactttgccacatatcgcgatctctgccctgacgggcggggcgatcctggtctttgctgactggtgcggaaggatggtgctgttcccgtatcagatcccggcgggcctgctgtcgacctttatcggcgcgccgtactttatctatctgttgagaaagcagagtcggtaa

SEQ ID NO: 1228 - DNA, 825 bp, Enterobacter cloacae
aatccctgcggccatttgtatgacgaaacagaacaggtaatgaacgagaacactccgtcttttgaacaacagcagtttacgcgcgcgaagcgccgggtcagcatccggcggctgctcaaccgtgacaaaaccccgttggccattctgctggcagctgccgttgtgggcacgctggccggtctcgtgggcgtcgcgtttgaaaaagccgtcaacgcggtgctcaactggcgcataggcaccgtcgccagctttgcggatcgggaatggctggtctgggtgtgggcctttggcctttcggccctgtttgccatggtgggctatttcctggtacgtaaattcgcacccgaagcgggcggctcggggatcccggaaattgaaggggcgctggaggagctacgcccggttcgctggtggcgggtacttcctgtgaaatttatcggcgggatgggaacgctcggggcgggcatggtgctcggtcgggaagggccaacggtacagctgggcggtaacgtcgggcgcatggtcggcgatctgttccgtatgcgcagcgccgaagcacggcatacgttgctggcgacgggggcggcggcggggctgtctgcggcgtttaacgcgccgctggcgggtatcctgtttatcattgaagagatgcgcgcccagttccgctacaacctgatctccattaaagcggtgtttaacggcgtgattatgtcgagcattgtctttcgcgtctttaatggcgaaggggcggtgattgaagttggcaagctgaccaatgcgccggtcattcttcactacgacgcagcagatgccacctacccccac

SEQ ID NO: 1229 - DNA, 975 bp, Enterobacter cloacae
cgaaacgctggaacatatctacggtattcctatgggcatcctgcctcacccggccggggctgcacccgtgagctttgtctactgatgctggattcaactttcattagccgccgtcgcctgctgacggccatggcgctctcaccgctgctgttaaagatgggcccggcccgcgctgccgctatcgatccgcaccgcatcgtggcgctggagtggttgcccgttgaactgatgatggcgctgggcgtgacgccttacggtgtggccgatattcccaactacaccctgtgggtgaatgagccaaaactgccggactccgtcatcgacatcggtctgcgtacggagccgaaccttgagcttctcacccagatgaaaccgtcttatttattctggtctgcggggtatggtccgtcggaagagaccatggcgaagattgcgcccggacggggcttttcctttagcgacggtaaaaagccgctgaccatggcaaaaaattccatccacgagatggcgcagttcctcaaccgtgaggctgaggcgaaaaaacatctcgatgaatttgatgcgctgattgattccctcaagccgcgctttgcccaccgtggcgatcggcctttgctgatggtgaccctgctggatgcccgccatatgctggtctttggaaataactgtctgttccaggaagtgctcgacagctttggcattcgcaatgcctgggaaggcgagatgacgttctggggcagtaccgccgtggggattgaccgtctggcggcgtttcgtgatgtggacgtgctgtgctttgaccacggcaatgagcgcgagatgcaaaccctgatggcgactccgctctggcaggcaatgccgttcgtccgcgagcagcgcttcctgcgcgcgccagcggtatggttctacggcgcgacgctgtcggccatgcattttgcccgcgtgctggacaatgcactgggaggcaaggcatga

SEQ ID NO: 1230 - DNA, 933 bp, Enterobacter cloacae
atacgtctccagctgctacagcgagtatgcatgctactggggagcaggacgccaggttgttgccacggcgaccttccgcttctaacctctttatgggcacggttcgccgtgccctttttatttaagttggctgacatgcaggataacaaaacgcaatccgactccaccttcacgctcaataatctctcctttcgcgtacccgggcgcaccttgctgcatccgctctctttgacgtttcccgcaggtaaagtgaccggtttaatcgggcacaatggttccggtaaatcgacgctgctgaagatgctgggccgtcatcagccaccgtccgagggcgacattttgctggatgaccagccgctggcgagctggagcagtaaggcctttgcccgcaaggtggcctatctgccgcagcagttgccgcaggcggaggggatgacggtgcgcgagctggtggcgattggacgttatccgtggcacggtgcgctcgggcgttttggcgttgctgacagagagaaagtggaagaggcgatcgcgctggtgggattaaaaccgctggcgcaccgtctggtggatagcctgtccggtggcgagcgtcagcgcgcatggatcgcaatgctggtggcgcaggacagccgctgcctgctgctcgacgaacccacgtcggcgctggatattgctcatcaggttgacgtcctggcgctggtgcatcgcttaagtcagcagcgcggcctgacggtgatagccgttctgcatgatatcaacatggcggcacgctattgcgactatctggtagcgctgcgcggcggtgaaatgatcgctcagggtacgcctgccgaactgatgcgtagcgaaacgctggaacatatctacggtattcctatgggcatcctgcctcacccggccggggctgcacccgtgagctttgtctactga

SEQ ID NO: 1231 - DNA, 2499 bp, Enterobacter cloacae
attattgctggtggaatgaagaaaatttccaccggagctgacaacggaggaaccgacatgtcacaagatcctttccaggaacgcgaagccgaaaaatacgcgaatcctatccccagccgcgagttcatcattgaacacttaacaaaacgcgaaaaacccgccaatcgtgaagaacttgccgttgaattaaacattgaaggtgaagagcaaattgaagcccttcgccgccgcctgcgcgccatggagcgtgacgggcagctggtctttactcgtcgccagtgctacgcgctgccagaacgcctcgacctgctgaaaggcaccgttattggtcaccgcgatggcttcggcttcctgcgcgtggaaggccgtaaagacgacctgtacctctcatccgaacagatgaagatgtgtattcacggcgaccagatcctggcgcagccgctgggtgcagaccgtaaaggccgccgcgaagcgcgcgtggtccgcgtgctggtgccgaaaaccagccagatcgttggccgttactttaccgatgcgggcgtaggctttgtggtgccggacgacagccgtctgagcttcgacattctcatcccgcctgaagaggtaatgggcgcacgcatgggctttgtggtggtggttgaactcacccagcgcccaactcgtcgcacaaaagcggtgggtaaaatcgttgaagtgctgggcgataacatgggcaccggcatggccgtcgatatggcgctgcgcacccatgaaattccgtacgtctggccgaaagcggttgaagaccagatcgaaaacctgcgtgaagaagtgccggaagagtccaaagcaggccgcgtggatctgcgcgatctgccgctggtcaccattgatggtgaagacgcccgtgacttcgatgatgccgtgtactgtgagaaaaaacgtggtggtggctggcgtctgtgggtggctatcgcggatgtgagctactacgtacgtccacacacgccgctggataacgaagcgcgcagccgcggtacatcggtctacttcccgtcgcaggttgtaccgatgctgccagaagtgctctccaacggcctgtgttccctcaacccgcaggtggaccgcctgtgtatggtctgcgaaatgaccatctccagcaagggacgtctgacgggctataagttctacgaagcagtgatgagttcccatgcgcgcctgacctataccaaggtctggcatatgttgcagggcgatcaggatctgcgcgaacagtacgcgccgctggtcaaacacatcgaagagctgcacaacctctacaaaacgctggatcaggcgcgcgaagagcgcggcgggatctcctttgagagcgaagaagcgaagtttatcttcaacgctgagcgtcgtatcgagcgtatcgagcagacccagcgtaacgatgcgcacaagctgattgaagagtgtatgatcctggcaaacatctcggcggcacgtttcgttgagaaagccaaagagcctgcgctgttccgtattcacgacaagccaaccacggaagccgtaacctcgttccgctccgtgctggctgaactcggcctggagctgcctggcggtaataagcctgagccacgcgattacgccgagctgctggaatccatcagcgatcgtcctgacgcggaaatgctgcaaaccatgctgctgcgctccatgaagcaggcgatttacgatccggaaaaccggggccactttggtctggccttacagtcgtacgcgcactttacctcgccgatccgccgttatccggatctgtccctgcaccgtgcgatcaagtatctgctggcgcacgagcagggtcataaaggcaatacgaccgaaaccggagggtatcactactccatggaagagatgctgcagctgggccagcactgttccatgaccgagcgtcgtgcggatgaagcaacgcgcgacgtggcggactggctgaagtgtgactttatgctggatcaggtgggtaatatctttaaaggcgtgattgccagcgtcaccggctttggcttcttcgtgcgtctggatgagctgtttatcgacggtctggtgcacgtttccagcctcgataacgattactaccgcttcgaccaggtcggacaacgtctgatcggcgaatccggcggccagacctaccgtctgggcgatcgggtggaagtgaaggttgaagccgtgaatatggacgaccgaaaaatcgacttcagcctgatctccagcgagcgcgcgccgcgtaacgtcgggaaaaccgagcgtgagaaagcgaaaaaaggtggcaacggtaaagcgggcggcaagcgacgtcaggcaggtaaaagagtaaactttgagccagacagcgctttccgtggcgagaagaaacagaagcccaaggcggcgaaaaaagacgctcgtaaagcgaaaaaaccgtcgaccaagacccaaaaaatagcggccgcgaccaaagcgaagcgcgcggcgaagaaacagcaggcggagtaa

SEQ ID NO: 1232 - DNA, 795 bp, Enterobacter cloacae
tttcccctcaccctgaccctctccccaacgggagagggaaaatatttattacgagaaccatcaatgagtgaaatgatttacggcatccacgcggtgcaggccctgctggagcgcgcgccggagcgttttcaggaagtttttattctgaaagggcgagaagataaacgtctgatgccgctgatccacgcgctggaagcgcagggcgtagtgatccaactggcgaaccgccagtatctggatgagaaaagcgaaggagctgtacaccagggcattatcgcgcgcgtgaagccaggccgtcagtatcaggagaacgatctgccggatctgatcgctgagctggataacccgttcttcctgatccttgatggcgtaaccgacccgcataacctgggcgcgtgcctgcgtagcgccgatgcagcaggcgtgcatgcggtgattgtgccaagagatcgttccgcgcagcttaacgctaccgctaaaaaagttgcctgcggcgcggcggaaaacgttccgctgatccgcgtgactaacctggcgcgcaccatgcgtctgttgcaggaagagaatatctggatcgtcggcacagccggtgaagcggatcacaccctgtatcagagcaaaatgaccggccgcatggcgctggtgatgggggcagaaggtgaaggcatgcgtcgtctgacgcgcgagcactgcgacgagctgatcagcatcccgatggcaggcagcgtgtcgtccctgaacgtttctgttgcgacgggtatctgcctgttcgaagcggtgcgtcagcgcgggtag

SEQ ID NO: 1233 - DNA, 1392 bp, Enterobacter cloacae
ccgcaattggcatattttagggtcaaaaagtgctgtatatctgaaaaagcgatggtagaatccatttttaagcaaacggtgattttgaaaaaaatgggtaacaacgtcgtcgtactgggcacccaatggggtgacgaaggtaaagggaagattgttgatcttctgactgaacgggctaaatatgttgtacgctaccagggcggtcacaacgcaggccatactctcgtaatcaacggtgaaaaaaccgtcctccatcttattccatcaggcattcttcgcgaaaacgtcaccagcatcatcggtaacggcgttgtgctgtctcctgctgcgctgatgaaagagatgaaaggtctggaagaccgtggtatccctgttcgtgagcgtctgctgctctccgaagcctgcccgctgatcctggactatcacgtggcgctggacgtggcgcgtgaaaaagcgcgtggcgcgaaagcgatcggcactaccggtcgtggcatcggcccggcatacgaagataaagtggctcgtcgcggtctgcgcgtcggtgacctcttcgacaaagcaaccttcgctgaaaaactgaaagaagtgatggaatatcacaacttccagctggtgaacttctataaagccgaagccgttgactaccagaaagtgctggatgacgtcatggcgattgcagacattctgaccggtatggttgttgatgtgtccgatctgctggaccaggcgcgcaagcgtggcgatttcgtcatgttcgaaggtgcgcagggtaccctgctggacatcgaccacggaacctatccgtacgttacgtcctctaacaccaccgcgggtggcgtggcgaccggctctggcctgggtccacgttatgtggattacgttctgggcatcatcaaagcgtactccactcgcgtgggtgcaggtccattcccgaccgaactgtttgatgagaccggcgagttcctctgcaagcagggtaacgagtttggcgcgaccaccggtcgtcgtcgtcgtaccggctggctggacgccgttgccgtacgtcgcgcagtgcagatcaactccctgtctggcttctgcctgaccaagctggacgtactggacggcctgaaagaagtgaaaatctgcgttggctaccgcatgccagatggccgcgaagtgaccaccactccgctggctgctgacgactgggaaggcattgagccaatctacgaaaccatgccgggctggtctgagaccaccttcggtgtgaaagagcgtagtggcctgccaaaagccgcgctggactacatcaagcgcattgaagaactgaccgaagtgccgatcgatattatttctaccggcccggatcgtactgaaacgatgatcctgcgcgacccgttcgacgcataa

SEQ ID NO: 1234 - DNA, 501 bp, Enterobacter cloacae
ctatctggctggtttatcatcattaatgaatatctctgcggtttaaccgcgttttccctttttcctgaggttgatgtgcagttaacaagtttcaccgattacggcttacgcgcgctgatttacatggcgtcgttacccgatgggaagatgaccagcatctctgaagtcacagaggtgtacggtgtgtcccgtaatcatatggtcaaaataatcaatcaacttagtcgtgccggatacgttgctgccgtccgcgggaagaatggagggatccgtctcggtaaaccggcacagagtatccgtattggcgatgtggtacgtgaactggagccgctctctctggtgaactgtagcagcgcgttctgccacattacgcccgcttgccgcctgaagcaggcgctttcaaaggccgtgcaaagttttctcaaggaactggataactacacgctggccgatttggttgaagagaatcaaccgctttataaattattgctggtggaatga

SEQ ID NO: 1235 - DNA, 1695 bp, Enterobacter cloacae
cccccctcccatgcagcgtgcatgccctctgtccatacttacctttattgccaattaaaggagggagacagcatgcactggcagactcataccgtttttaatcaacctgcaccgctatcgaacagcaacctttttctctctgattgcgccctgcgcgatgcggtagcgcgcgaaggggctgagtgggatgtggatcttcttgccagcatcggacagcagttgggtacggcggagtcgctggagctgggcaggctggcgaacgttaatccgccggagctgctgcgttatgacgccacgggagagcggctggacgacgtccgctttcatccagcatggcatcttctgatgcaggggctttgcgccaaccgggtgcacaacctggcgtgggaggaggaggcgcggaaaggatcgttcgtcgccagggccgcgcgttttgtgctgcatgctcaggtggaggcgggaacgctatgcccggtgaccatgacctttgcggccacgccgctgttgctacagtcgctacccaaaccgtttcacgactggttaacgccgctgatgagcgatcgctacgatccccatctcgcaccgggggcgcaaaagcgcggcctgctgatcggcatggggatgacggaaaagcagggcggttcggacgtactcagtaataccaccaaagcagagaaatgcagtgatggcagttaccggctggtggggcacaaatggtttttctccgtgccgcagagcgatgcgcatctggtgctcgcgcaggcgaagggcgggttgtcctgcttttttgtcccgcgtttcttacccgacgggcaacgcaatgccgtgcgccttgagcgtctgaaggacaagctcggtaaccgttcaaatgccagcagtgaggctgagttctttgatgcttacggctggctgctgggcgaagagggtgaaggtgtccggcaaattctgaagatgggcgggctgacgcgctttgactgtgcgcttggcagccacggactgatgcgccgtgcgctctcggtggcgctttatcatgcccatcagcggcagaccttcggcaaaaatcttatcgaccagccgttaatgcgcgacgtgctaagccgtatggcgctggtgctggagggacacacggcactgctgttccgactcgcccgggcgtgggacaaccgcaccgacccgcaggaagccgcatgggcgcggctattcactccggcggcaaaatacagcgtctgcaaagcgggcataccgtttgtggcagaggcaatggaggtgctgggcggcgcaggctattgcgaagagagtgagcttccgcggttgtaccgtgaaatgcccgtcaacagcatctgggaaggctctggcaatattatgtgcctggatgtactgcgcgtactggcaaagcagtcgggcattctcgacctgctcgccgatgatttcgcgcaggtaaaaggccaggacaggcacttcgatcgcagctggcggcagctacagcagaagctgcgtaaaccgcaggaagcgcagggcagggagatcgcgcggcagctctttttactcggggccggaagccagatgctgcggcacgcaacgccgcccgtggcgcaggcgtggtgccgcatgatgctggatacccggggcggcacgctgatgagcgaacaggtgcaaaacgacctgctgctgcgcgccacgggccgggtcggttaa

SEQ ID NO: 1236 - DNA, 186 bp, Enterobacter cloacae
cccgctcgcattagttcagcccggcgtgaagatggaaggctcggcccgatgctttatccgcgcgcatggcgccggatgatcgccaccatgagccaactgccggataatattttgcgtcgttttggcggtggtcttgtggttgctggtatcgttatctactacatgttgaggaaaacgattggctga

SEQ ID NO: 1237 - DNA, 1383 bp, Enterobacter cloacae
agacgctatatcacgcagtaccagcctgttaaaaatgcggaaggccaggttatcgggattatctttgttggcgtcgacatcacccattcctggaacgtcatgcgcgagaaaatccttaaccgtcgtctgggcaagagcggtcacttctttgtactggatcgcagcagcggtaaaacgcgcggacagtatctgttccatgccagcgaagagggcaaactgcccaactgggacacggcgacacagcagcagcttctgagtgataaagccggcacgctggaacgcgtgagcgcggatggccgtacgctcaaagtcgcctacacgccgctgccgggctggaactggaccatcgtgggtgaagtggataaagccgtactgctttcaagcgtcaccacgctgcgcgatcgcttcctgatggcgggcgtggtgctatccgcgctcttcgcgggcctgttcgttatcctcattcgccggatgctaacccgcccactgcgcgcagtgatcgcgcttgcccggcagtatgccgcaggcgatcttcgcgccagcctgccggtaacccgccaggatgaagtcggccagctgattgatgccatcaacgggatcgggggcggcctgcaaaaaattgtgttgcaggtccgcgaggccgcaagcgaaatccatctggggactaacgcgctggcttcagataccggcgagatctctgaacaaatcaacaaacaggccagcagcgttgaggagacctccgccagcatggagcaattagccgccaccgtgcagcaaaatgccgccaacatggagcaaactcagcagctggtgggggaaacctcgcgcgcggtgcatcagggtggagagacggtgacccacgcagtttccaccatggatgatattcgtgatgcatcgaaacgcattgaagacatcacccgcgtgattgagtccatcgctttccagaccaatatcctggcgctcaatgcggcggttgaagcggcgcgggcgggcgagcacgggaaaggtttcgcagtggtggcgcaagaggtgcgcgccctggccgcacgcagcgccaacgcggtaaaagagattgagcagctgattggcgacacgctgaacaaggtgagcgaaggccatgcgctttctgagcagacgcgtctggcgatggatgccatcattgttcatatcgataacatcagccagcttgttaccgagatcaaccacgcctcccgcgagcagtctgcggggattggtcaggtgaatctggcgatgacgcacatcggtgaggcatcgcacatcaatgccgatcgtatctcacgcagcgagcagacggcgcagacgctgcgcgagaagggttcacatctcacccggctggtgagcctgttccagcttaaagcttaa

SEQ ID NO: 1238 - DNA, 1347 bp, Enterobacter cloacae
ggccagaccaaagtggccccggttttccggatcgtaaatcgcctgcttcatggagcgcagcagcatggtttgcagcatttccgcgtcaggacgatcgctgatggattccagcagctcggcgtaatcgcgtggctcaggcttattaccgccaggcagctccaggccgagttcagccagcacggagcggaacgaggttacggcttccgtggttggcttgtcgtgaatacggaacagcgcaggctctttggctttctcaacgaaacgtgccgccgagatgtttgccaggatcatacactcttcaatcagcttgtgcgcatcgttacgctgggtctgctcgatacgctcgatacgacgctcagcgttgaagataaacttcgcttcttcgctctcaaaggagatcccgccgcgctcttcgcgcgcctgatccagcgttttgtagaggttgtgcagctcttcgatgtgtttgaccagcggcgcgtactgttcgcgcagatcctgatcgccctgcaacatatgccagaccttggtataggtcaggcgcgcatgggaactcatcactgcttcgtagaacttatagcccgtcagacgtcccttgctggagatggtcatttcgcagaccatacacaggcggtccacctgcgggttgagggaacacaggccgttggagagcacttctggcagcatcggtacaacctgcgacgggaagtagaccgatgtaccgcggctgcgcgcttcgttatccagcggcgtgtgtggacgtacgtagtagctcacatccgcgatagccacccacagacgccagccaccaccacgttttttctcacagtacacggcatcatcgaagtcacgggcgtcttcaccatcaatggtgaccagcggcagatcgcgcagatccacgcggcctgctttggactcttccggcacttcttcacgcaggttttcgatctggtcttcaaccgctttcggccagacgtacggaatttcatgggtgcgcagcgccatatcgacggccatgccggtgcccatgttatcgcccagcacttcaacgattttacccaccgcttttgtgcgacgagttgggcgctgggtgagttcaaccaccaccacaaagcccatgcgtgcgcccattacctcttcaggcgggatgagaatgtcgaagctcagacggctgtcgtccggcaccacaaagcctacgcccgcatcggtaaagtaacggccaacgatctggctggttttcggcaccagcacgcggaccacgcgcgcttcgcggcggcctttacggtctgcacccagcggctgcgccaggatctggtcgccgtgaatacacatcttcatctgttcggatga

SEQ ID NO: 1239 - DNA, 411 bp, Enterobacter cloacae
gatttttgccgaaggtctgccgctgatgggcatgataaagcgccaccgagagcgcacggcgcatcagtccgtggctgccaagcgcacagtcaaagcgcgtcagcccgcccatcttcagaatttgccggacaccttcaccctcttcgcccagcagccagccgtaagcatcaaagaactcagcctcactgctggcatttgaacggttaccgagcttgtccttcagacgctcaaggcgcacggcattgcgttgcccgtcgggtaagaaacgcgggacaaaaaagcaggacaacccgcccttcgcctgcgcgagcaccagatgcgcatcgctctgcggcacggagaaaaaccatttgtgccccaccagccggtaactgccatcactgcatttctctgctttggtggtattactga

SEQ ID NO: 1240 - DNA, 1311 bp, Enterobacter cloacae
ataatttattcttaccctgtttttgtgaggatcgttatgcaacaggatgcgcacaagcgtgcattaattgcaggctccatcggtaatttcatcgagtggtatgaatttgcggtctacggttttctggcaacggtgattgccagaaacttcttccagcttgagggggaagcggagctcaccagcctgatccttacctgggcctcgttcgccatcgctttcttcttccgtccgctgggtgcggtggtctttggccgcattggcgacaggattggccgcaaaccgacgctgattatcgtgctggtattgatgacgctcgccaccgctgccatcggtattgtgccggtctacgccagtatcgggattgccgcgccgctgatcgttacgctcctgcgtattctgcaaggactgttcgcgggcggtgagtatggcggtgcggtctcattgatgacggagttcgccccgcgcggcaagcgcggtctttacggggcatggcagtccttcaccgtggcgctcggactgttagcgggcgcaggtattgtcgcgttgctctctgccctgctctcccctgaagccttgcacgcctggggctggcgcattccgttcttcctggcgttgccgatgggtgcggtcgcgctatggctgcgggtgagcatggaagagacgccgagctttgtgcagcaacgggaaaaaccggttgttactcaggccaccaccgccgccacgttcaaaaccatcctgatgggcattggccgcgtgatggtctggtctgcggcgggctatacctatctggtgattatgccgacctatctgcaatctgcgctgcacaccggttttaaccaggcgctgctgattgcggtgatttctaacattgggtttgcgctcacgatcattccgtcgggcatgctgagcgacaggatcgggcggcggacggtgatgattatctccaccgtgctcctgctgatcctcgccctgccgctgctgaaaattttgcaggcggaaaccagtacgctggcggtcaaagcgattgtggtgctgattgcgggaggtctggttgggatgctggcagggccggggccggcaatgctgtctgagatgttcccgacgcgcgtgcgttataccgggctggggctggcctattctctgtcgaatgcgatcttctcgggctgcacggggctgatcattaccgggctgattaaagagacgggcaatctggatattccggcgtactacgtgatggcaacggcggtggtgagtattttcgcgctgatgacgctgaggaaggatgaccatttacggtcgttagaggagtga

SEQ ID NO: 1241 - DNA, 732 bp, Enterobacter cloacae
acttcagataggcacgcgcggcgatatatgtcaggatcgttttttttatcaggagtatcagcaatggctgaaggcccattaaatgaaagcgagatggcgtggctggaagagacattaatctcttacggtcacgacgatgcatccgtgattgacgtgtccgaactggacggcatgcttaccgcagtactttccggtcccgttgtggtggagcccgacacctggctggtggcggtctggggtggtgagaaatatattcctcgctggaaaaacgatcgtgagatgaaccgttttatcgatctctgctttaagcacatgaacgatattgccgagcgtttgagcgaatacccggatcagtttgaaccgctgtttggctataacgacgttgacggtcagagctataccgtggtggaagagtggtgctatggctacatgcgcggcgtggcgctgacggactggtcatccctgccggaagcgctggaagcggacctggcggtgattgccctgcacgggacggaagagaacagcgagaagctggatgcgctgaccgaagaggagtatatggccagcatcgagagcattcagcctgcggcgctgcgtttgtatgactactgggtggctaacccgcagcagccggaagcgaaaaagccgatcgtgaacgggtcgaagctggggcgtaacgacccgtgcccgtgcgggagtgggaagaagtttaaaagctgctgcctgcattaa

SEQ ID NO: 1242 - DNA, 264 bp, Enterobacter cloacae
tctgctttttatttacgagaggtaaccatgtcaattcacggacacgacgtgctgaatatgatgattgagtcaggtgagcggtatactgaggagagtctggttgaggcgatacatgcccgctttggcgaagcggcgcgtttccatacctgttcagcttcagagatgacggccgcggagctggtggcgtttctggcggcgcgcggaaaattcattccggcagcagacggattttccactcacgaaagtaaaatttgccgtcattaa

SEQ ID NO: 1243 - DNA, 933 bp, Enterobacter cloacae
aattttcatttaagggacgttatgtctttaccgccattgtatgcactgcgtgcgtttgaagttgctgcgcggttgaactccttcagtaaagccgctgaaacgctcaatattacgccgggtgcggtcagcagacatgttcgtacccttgaactgtggttcgactgcgagcttttcaaaaggcaaggtcctcgcgtggaggtcactgaagccgggcgagtgcttgccggacagctgaacgagagcttcacgagcattgaatgggcctgccgggcatttcgcagtgaaaaccacctgctgcggttaaaagcacccagcaccctgaccatgagatggcttctcgacgtgctgcgatcttttcgcaacaaccatgcaaaaccacaggttgagattgccagcgtctggatggacattgataccgttgatttcaatcttgagccctacgactgcgccatccttcttggtaatggccgttttggtgacacaacggaaagtcagctgctttttcatgaatggcttatcccggtttgtactccatcacttatcgaaccggcccggcaacggcttccgcaatgtgatttgatccatccttcacccgacagacgtgactggcggcgctggctgcgaagaacaggattgttcccggggctcgatatgagcagcggtatggtcttcgatacccttgaacagggaagtattgccgcgatgaacgggcacggcatcgctatcgccgacctgcatctcacgcttgatgccctgaaaagcggcctgctggcccttgccgttcagggaagctattgcgacaggggatggctactacctcgtctggccaaaaaattcactcaaaagagagagcattcagcatcttctggcctggctgcaaaaccataccccggtcgttccggcgctggatatcgattatctggaatacgatga

SEQ ID NO: 1244 - DNA, 342 bp, Enterobacter cloacae
accatgaaacgtataatcatagccggaacgatcctgttgctcgctgggtgcagtatcaaccgtcaggcagaaatcagcagtacggatgccccaaacggaattgtgcgcctcgactatggccaggccatgctgcaaaacgcctggtctgatgagtatgttaataacggtacggcaaccaaagcctgtcaacatatgggctacgccaccgcgtcagcctacgggcagccaattaaaacctgcaccctgatcagcggttcactctgtctgaacgaaagtgtgaccattcagtataaatgtcagggatatgctgttacctcttccagccagaatccgtggtattaa

SEQ ID NO: 1245 - DNA, 1293 bp, Enterobacter cloacae
agtgtaaggaacaacgcgatgacctctgacggtttttccctgaagcgctgcattctggacgcaattttttccggaatgatcgccctgattattttcggcccgattgcgggtgtgatactggatggttacagctttacctttggcggccagcggctggcgtggattgttggcacggtgatggtgggacgttttttgctgagcgccttttcagctacggcggccggaagacgtttacagacgcggtttgaatccgacaatgcgggcgtgtatgtccggccgccggcgtataaaagccgcatgcgctggatcattccgctgattgtcacgctggcgatctgcttcccgtttgtagcaacgaaataccttctgacggttgccattctcggactgatctacgtcctgctcggtcttgggctgaacattgttgttggcctggcagggctgctggatctgggttatgtcgccttctatgccatcggcgcttacgggctggcgctcgggtatcagtatctggggcttgggttctggagcatgctgccgctggcggcgctaatggccgcgggcgcaggcgccctgcttggctttccggtgttgcgcatgcacggggattatctcgccatcgtcacgctcgggtttggcgagatcatccgcctggtgctgaacaactggcttaccttcaccggagggcctaacggcgtttcagcccctgccccaaccttttttggccttgagtttggccgacgcgccaaagaaggcggcgtccccttccacgagttcttcggcctgacctataaccccaacatgaagtttattttcatctatgcggtacttttcctggtagtcatgctggtgctctacattaaacaccggctgacccgaatgcccattggacgggcgtgggaagcgctccgtgaggatgagattgcctgccgttccatggggctgaatcacgttctggtcaaactctcggccttcaccctgggcgcatcgacggcaggtatcgccggggtgttttttgccacctaccaggggtttgttaacccgacctctttcaccttttttgaatcggccctgatcctcgccattgtggtcctgggcgggatgggctccaccgtcggcgtcgtactggccgcctttgtgctgaccgtcacgccggaactgctgcgcagctttgcggaataccgggtgctgctgtttggcatgctgatggtggtgatgatgatctggcgtcctcgcggtctgatccgcatcaaccgcagcggatttaccgtgcgtaaaggagtggcgccatga

SEQ ID NO: 1246 - DNA, 1287 bp, Enterobacter cloacae
tttgacgagacggggcttttcccttactctgcgccgcagaatgagtcgcggtatggaagcgttgtagaggaaagcgtgaagaacagaactctgggaagtatttttatcgtcgccggaacgacaattggcgcaggaatgttggccatgccgttggctgccgctggcgtcgggtttgggattaccgtagtgctgctgggcggtctgtgggccctgatgtgttacaccgcgctattattgctggaggtttatcagcatgtccctgccgatactggcttaggctccctggctgcacgctatcttggacgctacgggcagtggatcgccggtttcagcatgatgttcctgatgtacgccctgactgccgcttacatcagcggcgccggggagctgattgcgtcaagtatcaatgacggcttcggtgcgtcgctttcaccggaaacaggcgccattgtctttacgctgatcggtggcggcgtggtttgcgcgggcacatcgctggtcgatctgtttaaccgttttttgttcagcgccaaaattcttttccttgttgtgatgctggtgctgctggcaccgcatgttcacaagattaacctgctctccctcccgctggagaaaggtctggcgctttcggccatcccggttattttcacctccttcggttttcacggcagcgtaccgagcatcgtgagctatatgaacggtgatattcgcaagctacgccgcgtctttgttatcggcagcgccattccgttgattgcttacctgttctggcagctggtaacgctgggcagtattgattccaatacttttatcggcctgatggcagagcattctggtctgaatggattcctggttgccctgcgtaacgtggtggcctcttcacacgtggagctggcggtacatctgtttgcagacctggcgctggcaacctccttcctcggcgtggcgcttggcctgtttgactatatggcggatctgttccagcggcgcaataccgttgcgggacgcttacagacgggggcgatgaccttcctgccgccgctggccttcgcgctcttttacccgcgcgggtttgtgatggcgctggggtatgccggcgtggcgttatcggtactggccctgctgctgccttccctgctggcgtggaagagccgccagcaacatccgcagcaggggtatcgcgtggcgggcggtacgccaatgctgtgcgtggtgtttgggtgcggcgtggcgattattctggtgcagattttgattgcagcggggatgctgccggaagtgggataa

SEQ ID NO: 1247 - DNA, 996 bp, Enterobacter cloacae
agaagtgccataacgggacggaatctgctcagcgccggcaggtctgactgtcggcgtaaccctttattcaggtgcgcgaccatgagtacattctttctgcaacaactcattaatggcttaacgctggggtcggtctacggtcttatcgccatcggctacaccatggtgtacggcatcatcggtatgatcaatttcgcccacggcgaagtgtatatgatctccgcctatctctcggccattggcctggccctgctggcgttttttggactccactcctttccgctgctgatcctggggacgctggttttcaccatcgtggtcactggcgtttatggctggacgattgagcgcatcgcctataagccgctacgcaactcgacgcgtctggcgccgctgatttcggccatcgggatgtcgttgatactgcaaaactacgtccagctcagccagggcccgcgccagcagggcgtgcccaccatgcttgatggcgtgctgcgttttcaccttggcgaagggtttgtccagataacctataccaaagtctttatcctcatcgcctcgttcgcgggcatgctggtgctgacctggattatcaaccgtacccgcttaggacgcatgtgccgtgcggtacagcaggatcgtaagatggcctccatcctgggtatcaacactgacagaataatttcgctggtgtttgttatcggcgcagccatggccgggctggcgggcgtgctaatcaccatgaattacggcacctttgatttttacgtcgggtttgttatcggcatcaaggcctttacggcggcggagctgggcggcatcggctctctgcccggtgcgatgcttggcgggctgattctgggcgtcgcagaagcgcaattctccgggatggtgaactcggattataaagacgtgttctcgtttggattgctggtcttaattctgatcttccgtcctcaggggctgctgggccgccctgtcgtggctaaagtgtaa

SEQ ID NO: 1248 - DNA, 765 bp, Enterobacter cloacae
aaaagttattgccgcgtatctgggcaccgacgaaagcgaggtaaatctgtgagcgaaccgatgcttcagtttcaggatgtggatgttttctacggggtgatccaggcgttgaagcaggtttcgcttgaggttaacaaaggggaaaccgtggccctgattggcgctaacggcgcggggaagtcaacattactgatgtctgtctttggtcagccccggatccgcaacgggcagatcctcttctgcggcgaggatatcagccacaaatctacccactatgttgccaccggcggcatcgcgcaggcacctgagggacgacgcattttcccggatatgtctgtagaagagaacctgctgatggggacaatccccgtcggcaatcagcatgcagcggaagatatgcaaagcatgttcgacctcttccctcgcctcaaagagcgacgtaaccagcgggcgatgacgctttcaggcggtgaacagcaaatgctggctatcgcccgcgcgctgatgagccgtcctaaacttctgctgctggatgaacccagcctcggcctcgcgccaattgtggttaaacagatcttccagacgctgcgcgaactggcccgtaacggaatgacgatttttctggtcgagcagaatgcgcaccacgcgctgaagttgtccgaccgcggctatgtgatggttaacggccagattcggttaagcggcagcggcgaggcgttgctgaaggatccggaggtgaggaaggcgtacctgggtggagtgtga

SEQ ID NO: 1249 - DNA, 555 bp, Enterobacter cloacae
ataacaaattatagtgtcgctcatcgtgaaccagaattaataaaccggagctgcaccatgttaaaaactgaaatgatcgacaagctcaatgcgcaaatgaatcttgagcttttttcttccctgctttatcagcagatgagcgcctggtgcagctatcacagctttgaaggagcggccgccttcctgcgtcgtcatgcccaggaagagatgacgcacatgcagcgtctgtttgattacctgacggacaccggcagcctgccgcgtattgataacgtggcatccccttttgccgaatacggctctcttgatgaactgttccgcgccacctatgagcacgaacagctgatcacccagaaaattaatgaactggctcatgccgccatgaccagccaggattatccaacctttaatttccttcagtggtatgtggctgaacagcacgaagaagagaagctatttaaatccgtactggataaattatctctggcaggtaaatccggggaaggtctgtacttcattgataaagagctgtcgacgctcgacacgcagaattaa

SEQ ID NO: 1250 - DNA, 1281 bp, Enterobacter cloacae
tgttctgcgcgcttcgcggtgcgtgggatcctcgccgtattaagcatgagattgcttctaaagtgcattttgttctcgctcttgtttttggatttacgatgccatcaggcgttcgggtttatacctggtgcaaaaacctctttgctaaggaacataataatgtcgctgaaatttaccaaaactcccctctccctggtgctggccggttgtctggtgacggccttttccgcgcaggccgatatcgtcatcggcgtggccgggccgttcacaggcccgaacgcaacctacggcgatcaatactggcatggcgctacgcaggcggcggaagacattaacgccgccggcgggatcaacggtgagaaaatcaaactggttcagggcgacgacgcctgcgagcccaaacaggccgtcgccgttgccaaccgcttagtcgatcaggataaggtgaaagcggtcgtcggccacttctgctcttcgtcgaccatgcccgcctccgaggtctatagcgatgccgggatcctctccatcactcccggctcaacgaacccactgattaccgaacgtggcatgagcgacatatttcgcatgtgcggacgtgacgaccagcagggccaggtcgccagcgattttattcttgataagctgaaagccaaacgggtggtcatcatccacgataaagacacctacggtcaggggctggcggatgccactaaagcggcgctggcgaaacgcggcgttaaggaggtgatgtacgaagggttgtcccgcggggagaaagactttaacgcgctggtgaccaaaatcggcgcacaaaaaccggacgtggtgttcttcgggggctgtcacccggaagcgggcccgctggttcgccagatgcgtgaacagggcgtgcaggcgaagttcttctcgggagactgtatcgtcaatgaagagatggtcaccgccgctggtggggcacagtacaccaacggtatttacatgaccttcggtaaagatccgcgcctgatcccggacggaaaagccgtcatcgagaaattccgcaccggtaaatttgaacctgaagggtacaccctctacgcctacgcgtctgtgcaggctatcgcggcggcattcaaggccacgcaagggacggattccgcaaaagccagcgagtggctgaaggccaaccctgtcgacacggtgatgggtaaaaaagcctgggacagcaaaggtgacctcaaagtctctgactacgtggtctaccagtgggatgacaaaggcaaatataaagaagtgccataa

SEQ ID NO: 1251 - DNA, 888 bp, Enterobacter cloacae
aggagtggcgccatgaacgcaacgattttacgtgtagaacatctgatgatgcacttcggcgggatcaaggccttaaacgacgtcaatcttgaggtgcagcgcggctccattaccgcactcattgggcctaacggcgctggaaaaacgaccgtctttaactgcctgaccggtttctaccgggcctccggcggcaacattctgttcaatgcacgaaataaaaccaccaatgtcattcaggtgctcggccagaaattccagccgggcgactggctcaacccggcgcagcttggtcaacgcctgttctataaaatgtttggcggcacgcatctggtgaaccgcgcgggtcttgcgcgcacgtttcagaacatccgcctgttccgcgagatgtccgttgtggaaaacctgctggtggcacagcacatgcgcgtcaaccgcaatctgctggcgggggtgctgaacacccctgcgtatcgtcgggcagaaaacgatgcgctggaccgggcgttttactggctggaggtggtggatctggtggattgcgcgaaccgtctggccggggaaatgtcctatggtcagcaacgacgcctcgaaatcgcccgcgccatgtgtaccggcccggagatgatttgtctcgatgaacctgctgccggcctgaacccggtggagacgcacaagctgagtgagatcatccggttcctgcgcgaccaccatgacatcacggttttgctgatcgagcatgatatggggatggtgatgggcatttcagatgacatcattgtgctcgatcatggcgatgtgattgccagaggtaaaccggctgagatccagcacaatgaaaaagttattgccgcgtatctgggcaccgacgaaagcgaggtaaatctgtga

SEQ ID NO: 1252 - DNA, 885 bp, Enterobacter cloacae
gcgctgatcccgctatactgtccccttttgtgtggaaataagcgaccgctgcccatgttgatgatcacctcttttagcaacccgcgcgtcgcccaggcgtttgtcgactatatggcgacgcagggcattatcctgactattcagcagcatacacagacggatgtctggctggcagacgaaagccaggctgggcgcgtgaacgccgagctggcgcgtttcctggaaaacccgggcgacccgcgttatctggcggcaagctggcaatccggccagaccggcagtggcctgcactatcaacgttttccgtttctcgccaccctccgcgagcgcgcaggaccgtttacgctgcttttaatggtagcctgcatcatcgtcttcattattatgagcgtggtgggtgaccagagcgtgatgattgccctcgcatggccgtacgatccctccctgcaatttgacgtctggcgctacttcacgcatgcgctgatgcacttctcggtgatgcatatcctctttaacctgctgtggtggtggtatctcggcggggcggtggagaagcggctcggcagcggcaagctgattgtgatcacccttatcagcgccctgttaagcggctacgtgcagcataaattcagcggtccatggttcggcgggttatccggcgtggtgtacgccctgatgggttacgcctggctcagaggcgagcgcgacccggatagcggcatctatttacaacgtggattaataacctttgcgttaatatggcttattgccggatggtttgatctgtttggtatgtctatcgccaatggtgcgcacgttaccggcctggcggtcgggctggcgatggcgttggccgatacgctccatgcgcgaaagcgaacataa

SEQ ID NO: 1253 - DNA, 243 bp, Enterobacter cloacae
agctttgcgatgggccacacgccgggcgcgttccatctcaccaacgacacgctgggcgcgtttatgcgcgataacgacttcgataccccggtgatggtgatgtgctatcacggcaacagcagtaaaggcgcggcgcagtatctgctccagcagggttacgaggcggtatacagcgtcgatggcggcttcgatgcctggcatcgtcatttcccggcagaagttgaatacgcgtttgagcgctga

SEQ ID NO: 1254 - DNA, 903 bp, Enterobacter cloacae
tatggcttattgccggatggtttgatctgtttggtatgtctatcgccaatggtgcgcacgttaccggcctggcggtcgggctggcgatggcgttggccgatacgctccatgcgcgaaagcgaacataattcccagggatatttcatgaaacaaacacaacgtcatgacgccattatcgaactggtaaaaaaacagggatacgtcagtactgaagagctggtggagcagtttgccgttagcccgcaaaccatccgtcgtgacctcaacgacctggccgatcagaaccgtattctgcgtcaccacggcggtgccgcgctgccgtccagctcggtgaacacctcatggcatgaccgtaaggcgacgcaaacggcagagaaagagcgtatcgcccgtaaagtggcgagccagatcccgaacggcgcgacgctgtttattgatatcggcaccacgccggaagcggtcgcccatgcgctgctgaaccacgagaacctccgcgtggtgaccaacaacctgaacgtggccaacacgttgatgcagaaagacgatttccgcatcatcctcgcgggcggcgaactgcgcagccgcgacgggggcattatcggcgaagcgacgctcgattttatctctcagtttcgcctcgatttcggcattctggggatcagcggcatcgacaccgacggctcgctgctggagtttgattaccacgaggtgcgcaccaagcgcgcgatcattgagaactcacgccacgtaatgctggtggtggatcactccaagtttggtcgtaacgcgatggtgaacatgggcagcatcagcatggtggatgcggtttatactgatgtgatgccaccggcgggcgtgatgcaggtgattaaagataataatttgcagttagagttatgttga

SEQ ID NO: 1255 - DNA, 2433 bp, Enterobacter cloacae
cgccaaatgtgttttctctctacaggatgccgattccctatgtcacagcctactttcaacaaagctcaatttcaggctgccctgacgcgtcagtggcagcgttttggccttcatgctgcaaacgagatgacgcctcaccagtggtggcaggcggtgagcggggcgctcgcagaacagctggacgctcagcctgtggcgaagcctgtgaaaggccagcgtcacgtcaactacatttcgatggagttcctgattggccgtctgacgggtaacaatctgctgaaccttggctggtatcaggaggtcggtgacgtgctgaaagaacacgacatcaacctgaccgatctgctggaagaagaggttgacccggcgctgggtaacggcggtctgggacgtctggcagcctgcttcctggattccatggcaacggtgggccagtcggcgattggctatggcctgaactatcagtacggcctgttccgtcagtcatttgccgacggccatcagatggaagcgccggacgactggcaccgcaatacctatccgtggttccgccacaacgcgcagctggatgtgcaggtcgggattggcgggaaagtcacgaagcagggactctgggaaccggcgttcaccattaccggtgaagcctgggacctgccggtactcggctaccgtaacggcgtggcgcagccgctgcgtctgtggcaggcgaagcacgcgcatccgtttaacctgaccaaattcaacgacggtgacttcctgcgcgccgagcagcaggggatcgacgccgagaagctgactaaagtcctctatccgaacgataatcatctggcgggtaaaaagctgcgtctgatgcagcagtacttccagtgcgcctgctccgtggcggacattctgcgtcgacaccacctggcgggccgcaagctggctcaactgccggacttcgaagttattcagcttaacgacacgcatccgaccattgccatcccggaactgctgcgcgtgctgatcgacgagcatcagctgagctgggacgacgcctgggccatcaccagccgcaccttcgcctacaccaaccacaccctgatgccggaagcgctggagtgctgggatgagaagctggtgaaaacgctgctgccgcgccatatgcagatcatcaataagattaacgaccagttcaaaacgctggtggagaaaacctggccgggtgacaaagccgtctgggcgaagctggccgtggtacacgacaaacaggtgcgcatggcgaacatgtgcgtggtcagcggctttgcggtgaacggcgtggcggcgctgcactcggatctggtggtcaaagatctcttcccggaataccaccagctgtggccgaccaaattccataacgtgaccaacggcatcacgccgcgtcgctggatcaagcagtgcaacccgctgctggccggcctgctggacaaaaccctgaagaaagagtgggccaacgacctggaccagctcatcaacctggaaaaactggccgacaacgcgaagttccgcgagcagtaccgcgccattaagctggagaacaaggttcgtctggctgagttcgtgaaaatgcgcaccgggattgagatcaacccgaatgcgattttcgatatccagatcaaacgtctgcacgagtacaaacgtcagcacctgaacctgctgcacattctggcgctgtataaagagatccgcgagaatccacaggccgaccgcgttccgcgcgtgttcctgttcggtgcgaaagcggcgccgggctactacctggcgaaaaacattatcctcgccattaataaagtggcggcggcgatcaacaacgatccgaaagtgggcgataagctgaaggtggtgttcctgccggactactgcgtttctgcggctgaaatgctgatcccggcggcggatatttccgagcagatctctaccgccggtaaagaagcgtccggtaccggcaacatgaagctggccctgaacggtgcgctgaccgtcggcacgctggacggtgcgaacgtcgaaattgccgagaaggtcggcgaagagaacatctttatcttcggccatactgttgaagaagtgaaagccatcaaagccaaagggtacgacccggtgaaatggcgtaaaaaagacaaagtgctggatgcggtgctcaaagagctggaaagcgggaagtacagcgacggcgacaagcacgcgtttgaccagatgctgcacagcatggacaaacagggcggcgacccgtacctggtgatggctgacttctcggcttatgttgaagcgcagaagcaggtcgacgtgctgtatcgcgaccaggatgcctggacccgcgcgtgtatcctgaacaccgcgcgctgcggtatgttcagctctgaccgctcaatccgtgattatcaggctcgtatctggcaggcaaaacgctaa

SEQ ID NO: 1256 - DNA, 2091 bp, Enterobacter cloacae
ggaagcgcgatggagagtaaacgtctggacagtgccgcgcaggcggcgggaattagcctcagttacatcaatgcgcacggcaaaccgcagtctattggtgcggacaccaaaagacgtttgctggatgccatgcacaaaaccgatgcgaaagcgtcgggtgcgccggtgccgaacgtgaaggtctttaccgcgggcaaaaagatgccgctggcggtggaagggcgcggcgagttcagctggctgctcaccaccgaagaggggcatcagcacaaaggccatgccacaggcggcaaaacccttaaccttccggcgaagctgccggagggctaccacacgcttacgcttacccgggacgaccagcgttttcactgtcgggtgatcgtggcgccaaagcgttgctatgagccgcaggcgctgcttgaaggcaaaaagctgtggggcgcctgcgtgcagctctataccctgcgttcggacagcaactggggcattggcgattttggcgacctgaaaaagatgctggcatccgtgggcgagcgcggcggcgcgttcatcggcctcaacccgatccacgccctctatccggccaacccggaaagcgccagcccgtacagcccgtcgtcccgtcgctggctgaacgtgatttatatcgacgttaacgcgttagacgatttcaaaaacagcaaagaggcgcaggcgtggtggaagcttgagaccacccaacagatgctgaaacaggcccgcgatgcggactgggtcgattatgcctccgtgaccgcgctgaaaatggcggcgctgcgtctggcatggaagggctttgcgaagcgtgacgacgagcagatggcagccttccgccagtttgtgatgcaggaaggcgagagcctttactggcaggcagcgtttgatgcgttgcatgcgtatcaggtccaggaggatgagatgcgctggggctggccggtgtggccggaagcgtatcagtccgtggataccccggaagtgaaggcgttctgtgagacgcatgccgacgaggtggatttctatctctggttgcagtggctggcgtacagccagtttgctgcctgctggcaggtgagccagggctataacatgccgatcggtctgtatcgcgatctggccgtcggcgtggcggaaggtggggcggagacctggtgtgaccgtgaactttactgtctgaaagcctccgtcggtgcgccgccggatattctgggcccgcttggtcagaactggggcttaccgccaatggatccgcacgtgatggcggcgcgtgcctacgagccgtttatcgacctgctgcgcgctaacatgcagaactgcggcgcgttgcgtatcgaccacgtgatgtccgtgctgcgcctgtggtggatcccgtacggtgaaacggctgaccacggggcgtacgtgcaatatccggtggacgatttgctctcaatcctcgcgctggagagtaaacgtcatcagtgcatggtgattggcgaagatctcggaaccgtgccggtggaaattgtcagtaagctccgcgacagcggcgtctactcctacaaagtgctctattttgaaaacgaccatgagaaaaccttccgcgcgccgaaagcgtaccctgaacagtcaatggcagtcgcgacgacgcatgatcttcctacgctcagaggctactgggaaagcggcgacctgacgctcggcaaaacgttaggtctctacccggatgaagaggttctgcgcgggctatatcaggatcgcgagctggcgaagcaggggctgctggacgcgctgcataaacatggttgtctgccgaagcgcgccgggcataaggcgtcgctgatgtcgatgacgccaatgcttaatcgtggcttacagcgctatattgccgacagcaacagcgcattgctcggtctgcaaccggaagactggattgatatggcggagccggtaaacatccccggcaccagctatcaatacaaaaactggcgacgcaagctgtccaccacgcttgaggcgatgttcgccgatgacggggtgaacaggttgattaaggatttggacaagcgcagaagagcggtgggtaataagcggtag

SEQ ID NO: 1257 - DNA, 267 bp, Enterobacter cloacae
ctttcccgccaatcccgacctgcacatccagctgcgcgttgtggcggaaccacggataggtattgcggtgccagtcgtccggcgcttccatctgatggccgtcggcaaatgactgacggaacaggccgtactgatagttcaggccatagccaatcgccgactggcccaccgttgccatggaatccaggaagcaggctgccagacgtcccagaccgccgttacccagcgccgggtcaacctcttcttccagcagatcggtcaggttga

SEQ ID NO: 1258 - DNA, 2760 bp, Enterobacter cloacae
ttacgaagcgcaaaaaaaataaattctctcgttccccacagtgaagtgaaaactatgttgattccgtccaaattaagtcgcccggttcgtcttgaccatactgtggtccgcgagcgcctgctggctaaactttccggtgcgcataatttccgactggcgctggttacgagtcctgcgggttatggaaaaacaacgctcatttcgcaatgggcggcaggtaaaagcgatcttggctggtactccctggatgaaggtgataaccagcaggagcgttttgccagctatttaattgccgcgattcagcaggcgaccaacggacactgcgtcaccagcgaggtgatggtgcaaaagcgccagtacgccagcctgtcctctcttttctcccagctgtttatcgagctggccgaatggcatcgcccgctgtatgtggtgattgatgattatcatctgatcaccaacccggttattcacgagtccatgcgtttcttcctgcgccatcagccggaaaacctgacgctggttgtcctgtcgcgtaaccttccgcagttgggcattgccaacctgcgggtgcgcgatcagcttctggaaatcggcagtcagcagctggcctttacccatcaggaagcgaagcagttctttgactgccgtctgacgtctccgattgaggcgtctgaaagcagccgcctgtgcgatgacgttgccggctgggccacggcgcttcagctgattgccctctccgcgcggcaaaacaacagcccgacgcatcagtccgcacgccgcctggcgggcatcaacgccagccacctgtcggattatctggtggatgaggtactcgacagcgttgacctctccacccgccatttcctgctgaaaagctccctgctgcgctccatgaacgacgcgctgattgtgcgcgtcaccggtattgaaaacgggcagctccagctcgaagagattgaacgtcagggtctgttcctgacgcgcatggacgatcacggcgaatggtttagctaccatccgctgtttggcagcttcctgcgccagcgttgccagtgggaactggccgcagagttgcctgacattcaccgcgccgccgccgaaagctggatggcgcaaggtttcccgagcgaggctatccaccatgcgctggccgccggggatgccggtatgctgcgcgatattctgctcaaccacgcgtggggactgttcaaccacagcgaactgacgctgctggaagagtcgttaaaagcgctgccttgggaaagcctgctggagaatccgcgtctggtgctgctccaggcctggctgatgcagagccagcatcgctacagcgaagtgaacaccctgctggcgcgcgccgagcaggagatggaaagcgagatggataccaccctgcacggcgaatttaacgccctgcgcgcacaggtggcgattaacgacggggacccggatgaagctgaacggctggcgatggtcgcgctggatgagctgccgctggcgaatttttacagccgtattgtggccacctcggtacacggcgaagtgctgcactgtaagggcgatctcacgcgttcgctttcactcatgcagcaaaccgaacagatggcgcgccgccacgatgtctggcattacgccctgtggagcctgatccagcaaagcgagattttatttgctcaggggttcctgcaagccgcctgggaaaaccaggagaaagcgttccagctgatccgtgaacaacatctggaacagctgccgatgcacgagttcctgttgcgtattcgcgctcagctgctgtgggcatggtcgcgtctggatgaagcagaaagctgcgcccgccagggtctgaatgtcctttcgagcttccagccgcagcagcagctccagtgtctggctctgctggtgcagtgctcgctggcacgcggcgacctggataatgcccgtaaccaccttaaccgcctggaaaatctgctcggcaacggacagtaccatagcgactgggtctccaacgccgataaggtcagggtgatttactggcagatgaccggcgataaaaagtccgccgccaactggctgcgtcacacgcctaaaccggaatttgccaataaccacttcctgcaaagccagtggcgcaatattgcccgcgtgcagatcctgctgggtgacttcgagcctgccgagattgtgctggaagagttaaacgaaaacgcccgcagcctgcgcctgatgagcgatttaaaccgcaacctgctgctgttaaaccagctttactggcaggcaggacgtaaaaacgatgcccagcgcgtactgctggaagcgttgcagctggcgaaccgcaccgggtttatcagccactttgtgattgagggtgaagtgatggcccagcagctgcgccagctgattcaactcaacacgctgccggaactcgatcagcatcgcgcccagcgcattctgcgcgagattaaccagcatcatcgccataagtttgcgcacttcgatgagaactttgttgaacgtctgctgaaccatccggaagtgccggagcttatccgtaccagcccgctcacccagcgtgaatggcaggtgctggggctgatctattccggctacagcaacgagcagattgccggcgagctggcggtggcggcgaccaccatcaaaacgcacattcgcaatctgtatcagaagctgggcgtggcgcaccgtcaggatgcggtgcagcatgcgcagcagctgttgaagatgatggggtacggagtgtaa

SEQ ID NO: 1259 - DNA, 189 bp, Enterobacter cloacae
atcacccggagtacgcggatcttccagccccgtgtgaagatctcccacgtgaacgatccgggcttctggctgttcaaggagtacttcaacctgaccatcggtgaaaccatcaagtcctggtccgcgctggaaaccattatttcggtgtgcggtctggtcggggtgctgctgttgaatatggtggtttga

SEQ ID NO: 1260 - DNA, 1053 bp, Enterobacter cloacae
aagaaggaacacagaatgaagtatgtgaatctgggtcgtagcggtttgcaagtctcccgtctttgtctcggttgtatgagctatggtgaacctgaacgcttgcctcaaccctggtccctggatgaaaaggcgtcacgtccgctcattcgtcaggcgcttgaagcgggcattaatttttttgataccgcgaatatctactcgggcggaagttctgaagagatcactggaaaagcgctgagagaaatggccagacgcgatgagatcgttgtggcgacaaagaccttctttccgtggcgcaactcccccaataccgggtttctttcccgcaaggccatttttcagtctattgacgatagcctgatgcgcttaggcatggattacgtggatctctttcagattcaccgctttgaccactccacgcctgttgaagagaccatggaggctctgcatgacctcgttaaatcaggaaaagtacgttacatcggcgcatcatctatggaagcctggcgctttgcaaaaatgcagcatacggcagagcttaacggctggacccgatttattacaatgcaaccgcaatacaacctgctttaccgggaagaagagcgcgagatgctgcccctgtgtgaagaccagggcgttggtgtgatcccctggagtccgatggcacgcggcaggctcacgcgcgactggagtgtcacgtcccgacgaacgcaaaacgatgcctttgcgttaaaaatgtatgagaacgcagccctgctggacaagcccgttattgatgttgttgccagcattgctgaaaagcacgatgtgccaagagcccatgttgcaattgcctggttgctatcaaaaacggtcatcacagccccgatcatcggcgcgacgaaaccagaacatctttccacggctatcagcgcactggacttttcacttagcgatgccgaaatcatggaactcgaggcacactatctgccgcatcctgtcgacgggatcattcccccacttccggatacgccaccttcactcacaccgccttcagcaatacaggactgttaa

SEQ ID NO: 1261 - DNA, 1023 bp, Enterobacter cloacae
gtggatggacttgtgaaaaaaattcagcaacggattagccctggtcggtctatggtgtatatcatttccgtatcaatacattcgggccttaacgcacaaggaaaacggttctgtatgcaaataagcagagcggatgtcgccgatctcatttatttcatggctattgcacgtcatcgcagtttcagccgtgcggcgattgaattaggtgtcagtgcatcagcgcttagtcatgccctgaaggggctggaaaccaggctcggtgttcgcctccttaatcgcacgaccaagagcgttacacctacggctgcaggtgaagaactggttcagtctgtacttcaacctttcgacacgatagaaggcgcgcttgaatcgcttaaccggtatcgtaatacccctaccggacgtatccgaatcaatgctgccgttgaagcggccaatcttttgcttgcgccagttatgcccgcgtttatggatcgctatcccgatattgaaatcgatattgtggccagcaaccgtatggttgacgtcactgatgcgggcttcgatgccggtatccgctatggtggcaccgtcccggaagacatggttgcccggcgtttatctgccgatattcgctgggttatcgcagcatcccccgactatcttgaacgctacggaacgcctgaatatccggatgatttattacaccatcgctgtataagcaatcgtctcggcgacgatcggatttatcgctgggaacttgagcgagacggcgaaacgtaccaaatcactgtgccaggctctgtgacggtcaatcaggctgaaacgggccttgtggccgtattaggcggagccggcctgatgtattttccggagcctcttgttgcaccctatgtgaaggatggacggctccgcctggtgcttacggagtggtccccgctggaggaaggttttcatatctattattcaagccgccggcaactaccgaccgggcttcgccttctgattgagttcatccaggaggccaggccgctggggttgtga

SEQ ID NO: 1262 - DNA, 537 bp, Enterobacter cloacae
agagtgaggcccgatatgaaacctgccgataaacccgtgctgtgtgtcgtttccagccatccgattaaaggcgcatccggtgtaccaaccggttttttcctggctgagctgacgcatccgctgaaagtagtggaagatgccggactaaaaacgacgatagccagcattcgcgggggacagccgccggtggatggatttgacctcagtgaccctgtcaacgcctggttctggaacgaaaccgattttcagcagcgcctggccacaacgcctgcgttatctgagctgaacggttccgattacagcgccgttttctttgcgggcgggcatggaaccatgtgggatttccgcgacagccaggatgcccagcgtattatccgcgaagtgtatgaaagtgatgggattgtcgcagccgtctgccacggacctgcggctctggttgactcaaagctcagcagcggcgaatacctggtgaaaggcaaaaacgtggcggcctttaccaacaaggaatcttcaccagcggggcggaaggagcagcgt

SEQ ID NO: 1263 - DNA, 186 bp, Enterobacter cloacae
gtggtgtccatgagcggtaagggttatcctaaagcgtttaaaattgaagcagtcaaacaggttgttgagcgtggttattctgtttccagcgtaacaacacttctcgatatcaccactcacggcctttacgcccggataaagaaaattgccgtaggtttccattgtcctcagtgcatccggcaatga

SEQ ID NO: 1264 - DNA, 528 bp, Enterobacter cloacae
aagcagtggcgcgcgtattcttcccgcgcttgcgcgcgcaatgagataggtaaaggccatcgcaacatcgcgctggttatcgataacgagacggatgacgcaagcaagcgaatggtcgaaggttatcgcaacgtgttgcagaactactcatttccgtttaatcgccagttggtattaacagccaatgagaatgtcgaacgcgcgctgttgacgcttattaatagtctgagcaagttctcttccatcgtagttaagcgtgatgcttatgctgcagaggccatgcgcctgttccgcgaatttaatattgccgtgcctcaggaggtttccctcctcagtcttgaggattcaccgttggccacgcagttatacccgcaactgacctgcatttcctggccaatggaatccctcctgcaccagtgcgtacagcgcattaaaagcatcgttgagggtcgtccgcttcgcgaaacggaactgccaccgataattggtaagcttacgcctcgccagtcggtgctggaaatgagttaa

SEQ ID NO: 1265 - DNA, 1068 bp, Enterobacter cloacae
acacgttgtgctttgttattcttgaaaattatgcgctctggccgtcggtcagggcggaacattcacctaacggagccgtgtatgaactatacgcatcttggccgcaccggcctgaaagtcagccgcctttgtctcggaaccatgaattttggtgacgtcaccgacgagaaaaccagcgcccgcattctggatgaagcgcttgaggcaggtataaatttcattgatacagcggacgtgtatggcaccgaacaatcacccgatatccagcaaggctcggggctgtccgaagagattattggtcgctggatccagcaggggggacgccgtgaccgtatcgttctggcgacgaaagtctatcagccaatggggccaggtccgaacgatcgccgtctttctgcttaccatattcgcaaggcctgcgaggacagtttgcgacggcttaagaccgaccatattgacgtctatcagatgcatcacatcgatcgctatacgccatgggaagagatctggcaggccatggaactccttgttcagcagggaaaagtgctttatatcggtagcagcaatttcgcgggctgggacattgcgactgcgcagtcagttgctacggcccgtcattcccttggcctggttgctgagcaaagtctctacaatctgactgcccggactgttgagctggaggtcattcccgcatgccgtcattttggcctgggactgattccctggagtccacttgccggagggttgcttggcggcgtactgaaaaagatggaaagcgggcgccgtgcaaggcccgcgttttcccgtctaatcgaacagtatcgtccacagctggaagcctacgaaggattatgtgaggacctcgacgaaaccccttccgatgtggctcttgcctggctcctgcagaatcctgtcgttactgctccacttatcgggcctcgtacggtcgagcaactccgggaggcgcttcacgcaacgacaatcacgctatcagacgacaccatgagctgtctcgacgaaatctggcccggacccgggggagaagcgccccaggcttatgcctggtaa

SEQ ID NO: 1266 - DNA, 453 bp, Enterobacter cloacae
aagagggagagtcccgtggtcagcgtttgtaaagttgaaatccagaacttccgatctattcgtttgctgacctggctgccttcgccagggctcaactgtctcattggccctggggacagtggcaagaccacaattcttgacgctatagatttgtgcctgggggcgcgacgtaatgtcagtttcagcgacaccgatttttttggtctcgatgtgactcagcccatcagcattaccttggccctggggtcattgccggatgcactgaggacaatggaaacctacggcaattttctttatccgggcgtaaaggccgtgagtggtgatatcgagaagtgttgttacgctggaaacagaataaccacgctcaacaacctgtttgactgcttcaattttaaacgctttaggataacccttaccgctcatggacaccactcattaagccatcttaaatga

SEQ ID NO: 1267 - DNA, 909 bp, Enterobacter cloacae
gaacacattatgaataacgccctgtataaccagatacgcatctttcagagcattgcacgtgagggcaatatttcggcagccgcaagaaaactggaaattacgcctccctccgtcagcaatgcgcttaagctgctggaagatcatattggccatccgctttttgtgcgtacgacccgccgtattgagctgacggaaaccgggcagctgttgctggaacagaccgctgcggcggtggagtcgctggaacattcgcttgaaagcattcgcgaccagaatcaggagccctctggtatcgtgcgaatcacgctctcgcgttttgcctatctgttaattcttaagcctgcaatggcgaaattctgtcagcaatatccgggtatacagcttgaaatttcggtttacgacggtaccgtgaatgttatcgaagagcgttttgatcttgggatccgttttggcgatatcctcgaaggtggggtggtggcgcggccgttaatgaaaccctttcgtgaagggttatatgcatcctcagcttatatcagcgagcatggaatgcccgaggtgccggctgacctcagtcaacacaagctcattggctaccgttttattactaacaaccgcatccttccgttgattctgaacgatcgcggagagcagttgacggttgagatgccggggcagttaatcagcaacgatattgacgttatggcagacgggatccgtaacggcctgggaatcggacgtttgtttgaacccatcttacagttacagccggacagggagcgctttatacccgtgatggagagctactggaaaacctacccgccagtgtatctctattaccccaaaaacgcgggtaaaacgaaaagagtgaaggccctgattgattttctgatatccgctacggggcgataa

SEQ ID NO: 1268 - DNA, 1290 bp, Enterobacter cloacae
gctgtctcgacgaaatctggcccggacccgggggagaagcgccccaggcttatgcctggtaatgaccaaattaatgaatcctttcttcgctatagggagttccagtttatgagcaagatgatgcatgaccagcattctgcttccgtacccgcttcccgggatcgtcgcaattttctgatcgccggcgccggtctggcgttggccgctaccacccttggcaggagcggagcagtgatggctaaaccggctggtcaggacacgtcgagcgccccttcgggtgctgttcccgtccagaaggagaccttaaccacgcgtaaactcggctcgctggaggtttccagcatgggactcgggtgtctgcctatggtggggtattacggcggtggtccgcgcgatcgtaaagccatggtttcgcttatccgggccgccttcgaacaaggcatcacgttctttgatactgccgaggtgtatggcccccatctcagtgaagaatttgtcggggaagcactggcccccgttcgcgatcgtgtggtgattgccactaagttcggtttcggcgtggaggaggggaagccaacctccctcaacagccatcctgaccatattcgccgtgccgtagagggctcgctgaagcgtctgaaaacggaccatatcgatcttctttatcagcatcgccccgatccgaatgtgccgattgaggatgtggcggaaaccgtgaaggcgttgatccgggagggtaaagtgaaacactggggattgtcggaagcgagtgccgggacaatccgccgcgcacatgcggtactccctgtgactgcagtacagagtgagtatgccatgtggtggcgtgaaccggagacgcggatatttccaacgctcgaagagctgggtatcggctttgtaccttactgcccgaccgcccggagtttccttgccggggcagtcaatccaagccagcggttcgacagcacagatcggcggcataacctgccacgcttccagcccgatgccctggccaaaaacatggtactgcttgaattcgcgcagtcgtgggcccgccgcaaaaacaccactccggttcagttcgcgctggcctgggtgatggctcagcggccatggatagtccccatcccgggtacgacgcaatatccgcacctgatagaaaatagcggtgcaccgcaagtccggttgacggacagcgagttacgcgaaatcgatgcagcgcttgccaggatcccattgcagggcggtcgcgcagatccgtttaccgaaagtcagtttgataaaagttaa

SEQ ID NO: 1269 - DNA, 975 bp, Enterobacter cloacae
gtaaagtctccctctgtgtttttgccggggataaaccacatgaatggactaaatcataacgcgcttacgcgcagtgccgtccccataccgccctgcgagcgttctcttcagaccgtggaggcccagccgtacttcagcgtttcagaggcgtcgctcgtgctcgaaggggcggtgttcgatcggaacaataacctgctgtttgttgatgcggcgacggggcgcgtgtttaagctcaccccggagcggcagctttccattgtccttaaggagaataccttcggtgcttccggcctggcggtacacaaagatggacggatctttatcgcgtcggtgggcgatatgcagcgtggttctgttcgggctatcgaacccgacggcacccgtgagcagatgattgttgatcctgaagggggatttcttgccaacgaccttgtctttgataatcagggcggattttattttacagacagccggggaaattcagccgatccacagggtggggtgttctacgttagtcccaacgtcgggtcaattcacgccatcctgcccggactcgctgtcgggaacggcttagcgattgaccctgacggtactctgatatgggccactgaacacgctaaaaacaggcttcatcgcgtaagattgtcagacgccaccacgattgccccctttggttcggttgttacctatcagttcaccgggcccgctccagatggagcccgagtcgacagcgaaggcaatgtgtatgtggcaatctcaggccagggtcgcatcatggtcttcaaccgcaacggactgccgattgggcaaattgtgctgcctgaccgcgacaaaggtcgtaaccttaaatcgacaagcctggctatccgacccggacatcacgagttgttcattgtcaccaacagcgggaccgaacctggtggagcgatgatttttcgatcgggcgcattcgcgccggcaccgcttcccttttaa

SEQ ID NO: 1270 - DNA, 561 bp, Enterobacter cloacae
cgcctgtcggggaaacccgcgtggtgtaaagcaacttgcccgcgggaaaagggggacaaaattgaatcaacgtgccaaattgttataaggtgcgctctatttggacgtgtgaaattcccgatgaagaacattcctttttggcaaagcaaaactttcgacgacatgaccgacgcggagtgggaatcgttgtgtgacggctgcgggcagtgctgcttgcataagttgatggatgaagattcggacgagatttatttcaccaacgtagcctgcaagcagttaaacatcaaaacctgccagtgccgcaactatgagcgccgtttcgaatatgagccggactgcatcaagttaacccgtgaaaatctaccgacctttgagtggctgccgcatacctgcgcgtatcgcctgctggcggaagggaaagatctgcccacatggcatccgctgttgacggggtcgaaagcggcgatgcacggcgaacgtatttccgtgcgccacattgcggtgaaagagtccgaggtgcgggactgggaagaccacattatgaatcaccctaatcggtga

SEQ ID NO: 1271 - DNA, 894 bp, Enterobacter cloacae
gacaagacatcagtatacgcaaaaatggcggcagagcgggggattaagccatttgtaaatttcataaaaatgaaacggcgatccctcttttctgtctctgctgcgctatctgcctctgcacgcctctggtatgatgagtgcaatttgctaaagctgtgtaatggaaatctcactatggtcattaaggcgcagagcccggcgggtttcgcggaagagtacatcattgaaagcatctggaataatcgtttccctgcgggatcaattctacctgctgaacgcgaactctctgaactgattggcgtcacccgtaccacgctgcgagaagtgctccagcgtctggcgcgcgatggctggttgacgatacagcatggcaaacccactaaagtgaataacttctgggaaacgtccgggctgaacattctggaaacgctggcgcgtctcgatcacgaaagcgtaccgcagctgattgataatctgctttccgtgcgcaccaacatcgccaccattttcatccgcaccgcgtttcgtcagcaccctgaagatgcgctgaaggtacttgctaccgccaatgaggtggaagaccacgcggatgcctttgcgaccctggattacaacgtgttccgtggtctggcgtttgcttccggcaatccggtttacggtttgatcctgaatggaatgaaagggttatatacgcgcattggtcgtcactactttgctaaccctgaagcccgcagtctggcgctcggcttctatcataaactgagcaaactctgcaccgaagggctgcacgatcaggtctatgaaaccgtgcgtcgttacggccacgactccggtgaaatctggcaccggatgcagaaaacgctgccgggtgatttagcgattcagggccggtaa

SEQ ID NO: 1272 - DNA, 1335 bp, Enterobacter cloacae
ttagatgattgttcttttgctcataatggagtggctatgcgtgttgtcatactgggaagtggtgtcgttggcgtaaccagcgcctggtatttaagtcaggcgggacatgaggttaccgttatcgatcgcgaatccggtccggcgctggaaaccagtgcggcgaatgcggggcaaatctccccgggctacgctgcgccgtgggcggccccgggcgttccgctgaaggcgatcaaatggatgtttcagcgacatgcgccgctggcgatcagcctcgacggcacgcagttccagcttaagtggatgtggcagatgctgcgcaactgcgacacccgccactatatggaaaacaaagggcgcatggtgcgtctggcggaatacagccgcgactgcctgaaggcgctgcgtgcctcaacgggcattgaatatgaaggacgccagggcggcacgcttcagctgttccgtaccgcgcaacagtacgaaaacgcgacccgcgatatcgccgtgcttgaagatgcgggcgtaccgtatcagctgctggaagccagccagctggcgcaggtggagccagcgcttgccgaggtcgcgcacaagctgacgggcggtctgcgtttaccgaacgatgaaaccggcgactgccagcttttcacccagcgtctggcgcgcatgtgtgagcaggccggggtgaaattccgcttcaatacttctgtcgacaaactgctgtcggaaggggagaagatttacggcgtgaagtgtggggaagaggtaatcaaagccgatgcctacgtgatggcgtttggctcctactcaaccgcgatgctgaaagggatcctggatatcccggtctatccgctgaaaggctactccctgaccattcctgtgaaagaggacagcggtgcgccggtctcgaccattcttgatgaaacctacaaaatcgccatcacccgcttcgataaccggatccgcgtcggcggcatggcggaaatcgtgggctttaatactgagctgcttaaaccgcgtcgtgaaacgctggagatggtcgtgggcgatctcttcccgcgcggcggcttcattgagcaggcgacgttctggaccggcctgcgcccaatgaccccggacggcacgccgattgtgggccgtacgccatacaaaaatctgtggaccaacaccggccacggtacgcttggctggaccatggcctgcggttcgggccagctgctgagcgacctgatctccgggcggacgccggcaattccgtttgacgatttgagcgccgcacgctatcaatcagggtttaccccatcgcgtccacaacacctgcacggcgcgcataattaa

SEQ ID NO: 1273 - DNA, 1080 bp, Enterobacter cloacae
ggagtcgcaatgtcccgtcctattctggcccagctggatttgcaggcgctgaaggataacctgcaaattgttcgccgtgctgcgccgggttctcgtgtctggtcggtggtgaaagccaacgcctacggtcatggtatcgaccgtatctggagtgcgctcggcgccaccgatggttttgccctgctgaatctggaagaggccatcctgctgcgcgagcgcggctggaaaggaccgatcctgctgctggaaggattcttccatgcgcaggatctgcctctgctggataagtaccgcctgacgaccagcgttcatagtaactggcagatcaaggcgattcaggacgcgaagctgcatgccccgctggatatctatctcaaagtgaacagcgggatgaaccgtctgggctttcagcctgaacgggtgcacacggtctggcagcagcttcgtgcgctgaaaaatgtcggtgagatgacgctgatggcgcatttcgccgatgcggaaaagccggacggaattgccgatgccatggtccgcattgagcaggcggcagaagggctggactgtccacgttcgctgtcgaactcagcggcaacgctctggcatcctgaagcgcactacaactgggtgcgtccggggatcgttctgtacggcgcgtcaccctcaggtcagtggcaggatatcgctaacagcggcctgaagccggtgatgacgttacgaagcgagattatcggcgtgcagacgttaaaagcgggcgatacggtgggctatggcagccgttatcgggcagcgggcgaacagcgtatcggtatcgtggcggggggttatgcagatggttatccgcgcatcgccccgagcggcacgccggtgtgggtcgatggcgtgcgcaccggcacggtaggcaccgtctcaatggacatgctggccattgatttaacgccgtgtccccaggcggggatcgggtcaccggttgagctgtggggcaacgaggttaaaattgatgatgtggccgctgcggcgggcaccgttgggtatgagctgatgtgcgcgctggcaccaagagtgcctgttgtgacagtgtaa

SEQ ID NO: 1274 - DNA, 633 bp, Enterobacter cloacae
ccggctataaggatagatgacgtgaaattgagatggtttgcttttttgattgtgctgctcgctggctgtagttcaaaacatgattatcaaaatcccccctggaaccctgaagtgccggtaaagcgggccatgcagtggatgccgatcagcgaacaagccgggaaggcctggggcgtgagcccgcgtctgatcacggcgatcattgccgtggagtccggcggcaacccgacgctggtgagtaaatcgaatgcggtggggctgatgcagttaaaagcctcgacggcgggaagagaggtctatcgctacatgggctggaagggacagccatccaccagcgagctgaaaaacccggagcgtaatatctctatgggaaccgcttacctgagcattctcgaacatggcattctgaaggggattgacgatccggaagtgatgcaatatgcactggtggtgtcgtacgttaacggagccggcgcgctgctccgaaccttctcatccgatcgcaaagaggcgatagaagagattaacgatatggataaagatgaattcttcgagcacgttgtgaagaatcatccgtcagcacaggctccacgttatatctggaaagtccagaaagcgatggacgctatgtaa

SEQ ID NO: 1275 - DNA, 771 bp, Enterobacter cloacae
cccagagacagtctgtcatctatcgaggagccatctggcgtgagtagctacagtgagcagttcctgaaacaaaatccgctggctgtattaggggtgttacgcgacctgaaaaaaggcgaggtgccgctgcgcatcaactggtcaaccagccagtttatcagcaagatcctggacgtgacggcagagcacctgatcgtcgatctgggtagccagagcgatgaaaaccgtgccgcgctacaggcagagaatctctcggtgatggccgaaacgcagggggcgaaagtcgagtttgtgctgcctcgtctgaccgcgatcgcgtaccaggatttgcctgcgtttatcgctcccctgcccgctaacctctggttcgtgcaacgccgggagttttttcgcatcagcgctccgcttcacccggcctatttctgtaaggcaaaaatgccggacaaaaaagagatccgctttcgtctcttcgacctgtcactgggcgggatgggcgcgttaatggatacgccgaagccggaagggctggtggaaggtatgcgttttagtcagattgagctggatatgggcggatggggacgcttctggtttgacgcccagctgattgccatcagcgagcgcaaggtggtggacagcaaaaacgaaaccattaccacgccgcgactgagctttcgctttctgaatgtcgggccaggcgccgaacgcgaactacagcgcatcatcttctcactggagcgtgaagcgcgggaacgcgcgaataaagtgcgctga

SEQ ID NO: 1276 - DNA, 939 bp, Enterobacter cloacae
attctcattcagcaaggaattgccatgcctcagtttcatctcatcgcaccgtcaggctactgcatcaatcaggaggcggcacagcggggcgttcaacgcctgctggaaatgggccatcaggtagaaaatcagacaattatcccccgccgcatgcagcgttttgccggtacggaggcgcagagactgagcgatatcaacagcctggcgacgctggaaggtgaaaacaccattgtgctggccgtgcgcggcggctatggcgcaagccggctgctggagagcatcgactgggccgggctggccgcgcgccagcagcaggatccgctgttaatctgcggacacagcgatttcacggcgatccagctcggcctgctggcgttgcataacgtcattacctttagcggcccgatgctggccggtaactttggcgcgccggagctggatgcgtttacgcaggaccatttctggcgcgccctgcaaaacccgacgttcaccatcgagtggcaaggcaatggaccgcactgggaatgtgaaggacagctgtggggcggcaacctcgcgatgctggtgtcgctaattggtacgccgtggctgccgcagatcacggatggcatactggtgctggaagatatcaatgaacacccgttccgtgtcgaacgcatgctgttgcagctgtctcacgccgggatcctggatcggcagtcggccattgtgctgggcagttttagcggttcagcccccaacgattacgatgcaggctattccctggaaacgatgattgatttcattcgttcccgcctggatatcccggtgatcgctggcctggatttcggccatgagcagcaaaccgttacgctgccgctgggcgcccgggcgcaccttgtacacgataattcaggcagtcggttaacaatcagcggtcatccggtcttaaaggcataa

SEQ ID NO: 1277 - DNA, 552 bp, Enterobacter cloacae
gcatgttccagggaaatgattatgttgcgatttttgaaccagtgctcacgcggtcgcggagcgtggttgttgatggccctgaccgcctttgcgctggaaatggtcgcgctgtggtttcagcatgtgatggggctgaaaccttgcgtactgtgtatttatgagcgttgtgcgctgttcggcattatgggcgcgggtctggtaggtgcgattgcacccaaatcaccgttacgctatgcggcaattgccatctggctgtacagcgccgggaaaggcattgcgcttgcctgggagcacacccaaatgcagcttcacccgtcgccgtttatgacctgcgattttgccgcccgcttcccgagctggctgccgctggataaatggctgccgcaggtgtttgtggcctccggtgactgctctgtacgccagtgggaattcctgacgctggagatgccgcagtggctggtgggcatttttgtcgcctactttgtggtggcgctgctggtgctgattgcccagccgttcaaaccaaagaaacgcgatctttttggaaggtaa

SEQ ID NO: 1278 - DNA, 1752 bp, Enterobacter cloacae
ggtgggagtaagacgacattgggtgccacagcgataatcagtcttttcattctgggttccatcctggtaaccttcagcattttattaagttcattttcatcgcgccttggcatacctattcttgtcattttcctggctatcggcatgcttgccgggatcgacggtatcggcggtatccccttcgataattaccctttcgcctatatggtgagtaacctcgcgctggcggtcatcctgctggacggcggtatgcgcacccaggcaagttcgttccgcgtggccttaggcccggcgctgtctctggcgaccgtcggggtgctgatcacctctggcctgaccggtatgatggcggcctggctgtttaacctcgatattatggaaggcctgctgattggcgcgattgtcggctcgaccgatgcggcagcggttttctcgctgctcggcggcaaggggctgaacgaacgcgttggctccacgctggagattgaatccggcagtaacgatccgatggcggtgttcctgaccatcactctgattgagatgatccagcagcacgaaaccggcctgagctggatgttcgcctggcacatcctccagcagtttggcctggggattatcattggtctcggcggcggttacctgttacagcagacgatcaaccgtattacgctgccttccggcctttacccgctgctggccctgagcggcgggatcctgatctttgccgtaaccaccgcgctggacggcagcggtattctggcggtttacctttgcggtttcctgttgggcaaccgaccgattcgcaaccgtcacgccattttgcagaacttcgacggtctggcctggctggcgcagattgccatgttcctggtgctgggcctgctggtgacgccgtcggacctgctgcctatcgccgtaccggcgctgcttttgtcggcctggatgatcttcttcgcccgtccgctgtcggtgtttgccgggctgctgccgttccgcgggtttaacctgcgtgagcggatatttatcagttgggtgggtctgcgcggcgcggtgccgattattctggcagtgttcccgatgatggccgggctggacaacgcccgcctgttctttaacgtcgccttcttcgtggtgctggtgtcgctgctgttccaggggacgtcgctgggctgggcggcgaaaaaagccaaagtggtggtaccgcccattggctggccggtctcccgcgtggggctggatattcaccctgagaatccctgggaacagtttgtctaccagctaagcgccgataagtggtgcgtgggcgcgtccctgcgcgatctgcatatgcccgctgaaacgcgcattgccgccctgttccgggataacgccctgcttcacccgaccggcagcacgcggctgcgtgagaacgatattctctgcgtgattggccgcgagcgcgacctgcctgccctcggcaagctgttcagccagtcgcccccggtggcgctggatcagcgtttcttcggcgattttatcctcgaagccagcgcccgctttgcggatgtggcgctgatttatggcctggaaggtggactagagaatcgcgataaccagcaaacactgggtgaaattattcagcaattattaggggctgcgccggtcgtcggtgaccaggtggagtttgccgggatgatctggacggtagccgagaaagaagataatgcggtgcgcaaagtcggcgtaaggccgatggaggaagaggcggagtag

SEQ ID NO: 1279 - DNA, 1581 bp, Enterobacter cloacae
aaggaggctctccagtcagagagagcgaccaacaacgagggcgcgctaatggctacactagattccatgtccagggacagcacccgtctgagcgatggacccgactggaccttcgagttgctggatgtctacctggcggagatcgaccgggtggccaaactctatcgtctggatacctacccccatcagattgaagtcatcacctcggaacagatgatggacgcttactccagcgtcgggatgccgattaactatccgcactggtcgtttggtaaaaaattcattgagacagagcggctgtataagcacgggcagcagggattggcgtatgaaatcgtcattaactctaacccatgtattgcctatctgatggaggagaacaccattaccatgcaggcgctggtgatggcgcacgcctgctatggacataactcgttcttcaaaaataactatctgttccgcagctggacggacgccagctcaatcgttgattacctcatcttcgcccgtaactacattaccgactgcgaagagcgctacggcgtggacgaggttgagaaactgctggactcctgccacgcgctgatgaactacggcgttgaccgctataagcgtccgcagaagatctccttgcaggaggagaaagcccggcagaaaagccgcgaggagtatctgcaaagccaggtgaatatgctgtggcgcaccctgccaaaacgtgaagaggagaaaaccgtcgccgaggcgcgtcgctacccttccgagccgcaggaaaacctgctctactttatggagaaaaacgccccactgctggagccctggcagcgtgagatcctgcgcatcgtgcgcaaggtgagccagtatttctatccgcagaagcaaacccaggtgatgaacgaaggctgggcgaccttctggcactacaccattctgaaccacctgtatgacgagggaaaagtctctgaacggtttatgatggagtttctgcacagccacaccaacgtggtgttccagccggcatataacagcccgtggtacagcggcattaacccgtacgcgctcggctttgccatgttccaggatatcaagcgtatttgtcagtcgcccaccgaagaggacaaatactggttcccggatattgccggttccgactggctggaaacgctgcacttcgcgatgcgtgattttaaggatgagagttttatcagccagttcatgtcgccgaagattatgcgtgatttccgcttcttcaccgtactggatgatgaccgcaacaacttcctggagatctccgcgatccacaacgaagagggctatcgcgagatccgctcgcgcctgtcgtcccagtacaatctgagtaatcttgaaccgaacattcaggtgtggaacgtggatctgcgcggcgatcgctctctgacgttgcgctatattccgcacaaccgcgcgccgctggataaggggcgtaaggaagtgctgaagcatgtgcatcgcctgtggggatttgacgtcttgctggagcagcagaacgaagatggcagcgtggagctgctggagcggtgtccggcgcggttgaatacgctgtag

SEQ ID NO: 1280 - DNA, 1620 bp, Enterobacter cloacae
tgtcttgtcttatttgacggggaaaggacgtctgtcgtggaaatttcatttgggcgcgcgctgtggcgcaactttttaggtcagtcacctgactggtacaaactcactttactggtattcctggtcgttaatcccgttatctttttgctggatcccttcgttgccgggtggatgttggtcgccgagtttatctttaccctggcgatggcgctgaagtgctatccgctgttgcccggcgggctgctggcgctggaagccgtggtcattggaatgaccagcgcggagcatgttaaaaacgagatagcgtcgaatcttgaagtcctgctgctgctgatcttcatggtggcggggatctactttatgaagcagcttctgctgtttatcttcacccgtttgctgctgagcattccgtcgaaaacgctgctctcgctggctttttgcctcgccgcagccttcgtctctgcattcctggatgcgctgacggtcgtggcggtagtgatcagcgtcgccgtcggcttttacgggatttaccaccgggtggcctcgtctcgtcctggcgataacttgcaggacgacagccacgttgaggcgcacaaccgcgatgtgctggaacagttccgcgcatttctgcgcagcctgatgatgcatgcaggcgtggggacggcgctgggcggcgtgatgaccatggtcggggagccgcaaaacctgattatcgccaaagcagctgagtggcattttggcgaatttttcctgcgcatggcgccggtcagcgtacccgtgctggtctgcgggttagccacctgtgtgctggtcgaaaaattcaacctctttgggtatggcgcgacgttgcccgatcaggtccgccaggagctgcataagtttgacgagcagagccgcaaacaacgcacgcgccaggagacgctgcgcctgattgcacagggtttcatcggcgtgtggcttatcgctgcgctggccttccaccttgccgaggtggggctgattggcctgtcggtaattatccttgcaaccagcctgggcggcgttacggacgaacatgctattggaaaagcctttaccgaagcgctgccgtttaccgctctgctggcggtgttttttgccgtcgtggcggtgattattgaccaacatctgttcgcgccgatcatcgcgtttgtgcttcaggctacgccagattcgcagctaacgctgttctatttgtttaacggtctgttgtcctctatatccgataacgtctttgtcgggacggtatacatcaatgaggccaaagccgcgatggagcaagggattgtcagcagtgaacagttcgagctgctggcggtggcgatcaacaccggaaccaacctccccttccgtggcaaccccgaacggtcaggcggcattcctcttcctgctgacctcggcgctggcaccactcatacgactttcttatggaagaatggtctggatggcgctgccgtatacgctggtgcttaccctggttggtttactgtgcatcaaaattactctcgttccctgtacgcaatggttattgcaagcaggtatacttgcggcgcattaaaattcgtttacactgcgctgtctaagcatgttccagggaaatga

SEQ ID NO: 1281 - DNA, 375 bp, Enterobacter cloacae
cgctgttctatttgtttaacggtctgttgtcctctatatccgataacgtctttgtcgggacggtatacatcaatgaggccaaagccgcgatggagcaagggattgtcagcagtgaacagttcgagctgctggcggtggcgatcaacaccggaaccaacctccccttccgtggcaaccccgaacggtcaggcggcattcctcttcctgctgacctcggcgctggcaccactcatacgactttcttatggaagaatggtctggatggcgctgccgtatacgctggtgcttaccctggttggtttactgtgcatcaaaattactctcgttccctgtacgcaatggttattgcaagcaggtatacttgcggcgcattaa

SEQ ID NO: 1282 - DNA, 186 bp, Enterobacter cloacae
aattcgtttacactgcgctgtctaagcatgttccagggaaatgattatgttgcgatttttgaaccagtgctcacgcggtcgcggagcgtggttgttgatggccctgaccgcctttgcgctggaaatggtcgcgctgtggtttcagcatgtgatggggctgaaaccttgcgtactgtgtatttatga

SEQ ID NO: 1283 - DNA, 585 bp, Enterobacter cloacae
ataatgaccgattacttactgctctttgtcggaactgtgctggtgaataacttcgtactggtgaagttccttggcctgtgcccgtttatgggcgtctccaaaaagctggagacggcaatgggcatggggctggcaaccaccttcgtgatgacgatggcctccatttgcgcatggctgattgatacctggatcctaatcccgctcgacatgctctacctgcgcactttggcctttattctggtcattgcggtcgtggtgcaatttaccgaaatggtggtgcggaaaaccagccctgccctgtatcgcctgttgggtatttttctgcccctcatcaccactaactgtgcggtgctgggcgtggcgctactgaatatcaaccttgggcataatttcctgcaatcggcgctgtatggtttttccgccgcggtcggtttttcttttgttatggtcctgttcgcctcgattcgcgagcgtctggccgcggcggatattcccgcgccgtttcgcggtaacgccatcgctctggtgaccgcaggtttaatgtctctggcctttatgggctttagtggtctggtgaagttgtaa

SEQ ID NO: 1284 - DNA, 2106 bp, Enterobacter cloacae
aactacgcccggttgaaacgactaccgaaaactggaagtgggaccttcagaccattccggttcgcaatattcctgtggaacaacatgcttaagttattttctgccttcagaaaagagaagatctgggatttcgacggcggcattcatccgcctgagatgaaatcgcagtctaacggcacgccgctgcgccagatcccgctggcgacccgttacgttatgcccctgaaacagcatatcggcgcggaaggcgaattgtgcgtgaaagaaggcgatagcgttcttcgcggccagccgctgacctttggtcgcggacggatgttgccgatacatgccccgacttccggtaaggtggtggctgttgccccccataccgttgcccatccgtcggcgttgtctgagctgagcgtgatcattgaagccgatggtgaagaccgctggatcgagcgtgacggctggagcgactaccgttcccacagccgtgaagcgctgattgaacgcattcatcagttcggcgtggcgggtctggggggcgcaggcttcccgaccggcgctaagcttcacggcggcggcgataaaatcgaaacgctgatcatcaatgccgccgagtgcgaaccgtacatcaccgccgatgaccgtctgatgcaggactgtgccgcgcaggtggtggaaggtattcgcattcttgcgcatatcctgcaaccccgcgaagtgctgatcggtattgaggacaataaaccgcaggccatttcgatgctgcgtgcggttctggcggacagccatgatatcgccctgcgcgtgatcccgaccaaatatccgtccggcggggcaaaacagctgacgcagatcctgaccggcaaacaggtcccccacggaggccgttcgtccgacatcggcgtgctgatgcaaaacgtggggaccgcctacgcggtgaaacgtgcggtgattgacggcgagccattgaccgagcgcgtcgtcacgctgaccggcgagtccgtctcccgtcccggcaacatctgggcgcgtctgggtacgccggtgcgtcatctgctggaacaggctggcttctgcccgggtaacgatcaactggtcattatgggcggcccgctgatgggctttaccctgccgtggcttgatgtgccggtggtgaagattaccaactgcctgctcgccccttccctgacggagatgggcgaaacgcaggaagagaaaggttgcatacgctgtagcgcctgtgcggacgcatgcccggcagatttactgccgcagcaattgtactggtacagcaaaggccagctgcacgataaagcccaggcgcataacctggctgactgtattgaatgcggtgcctgcgcctgggtctgcccaagcaatattccgctggtgcagtatttccgtcaggagaaagctgaaatctacgccatctccatggaagaaaaacgtgccgctgaagcgaaggcccgctttgaagcgcgccaggcgcgactggagcgcgagaaacaagcccgtcaggaacgccataagcaggctgccgtgcagcctgcggcgaaagatcaggatgccattaacgcagccctggcccgcgtgcgcgagaagaaagccaccgccgcccagacggttgtgatcgctccgggagaaaaaccggacaacagcgaagcgattgcagcccgcgaagcgcggaaagccgaagcacgcgcgcgtcaggcggagaaagcgcaaaacgccaaaccggaagccgacatcgacccgcgtaaagcggcggtggaagcggctattgccagggcaaaagcccgcaaagccggtcagcagacagtggtggttgaacaggaagcgacggatccgcgcaaggcggccgttgaagccgctatcgcccgcgccaaagcacgtaaagcggcacagctacaacctgccgaagagagtgaagcccctgtcgatccgcgtaaagccgccgttgaagcggccatcgcccgggccaaagcacgaaaagcggcacagcaggacgaactgcctgcggccgctaatgacgatccacgcaaagccgcagtcgccgccgcgattgcgcgcgttcaggcaaagaaagccgcgcagcaagccgttaacgaggattaa

SEQ ID NO: 1285 - DNA, 1053 bp, Enterobacter cloacae
atggttttcagaattgcaagttccccttatacccataaccagcgccagacatcgcgtattatgatgctggtgtgcctggccgcgctgccaggtattgccgtacagtgttggtttttcggctggggtacgcttttccagttagttctgggttgcgccagtgccgtcgcagcggaagccgcgatcctgaagctgcgcaaaatggaggtgactcgcatcctgagcgataactccgccctgttgaccggcctgttgctggccatcagcattcccccgttcgccccgtggtggatggtggtattgggaacggtgtttgcggtgatcatcgccaagcagctgtacggcgggctgggccataacccgtttaacccggcgatgattggctacgtagtactgctgatctccttcccggtacagatgaccagctggctgccgccgcatgagatcgccgccacggtgcccggctttatggatgccctgcacgttatctttaccggccacaccgcgctgggcgcagatatgaacgcgcttcgcatgggcgtggacggcataagtcaggccactccgctcgataccttcaaaacctccctgcgtgccggacaaagcgtggagcaggtgatgaaatcgtctatttacagcggcgtactggcaggtgctggctggcagtgggtcaatctggcctacctgttgggtggcgcgttcctgctgcaacagaaggcgatccgctggcatattccggtgagcttcctggtgacgctggccgtctgctcgacgctcggctgggttatctcacctgagtcactggccagcccgcagctccatctgctctccggcgcgaccatgctcggggcattctttattctgaccgatccggtcaccgcctctaccaccaaccgtggtcgtctgattttcggcgcgctggcaggcttgctggtctggcttattcgcagctttggcggctatccggacggcgtggcatttgccgtgctgctggctaacatcaccgttccgctcatcgactactacacgcgtccacgcgtgtacggtcatcgctaa

SEQ ID NO: 1286 - DNA, 696 bp, Enterobacter cloacae
ggagtgaccatgagccaggttaaagaggttatcgtccagggtctctggaagaacaactccgcactggtgcagctgcttgggctatgtccgctactggcggtgacgtctaccgccaccaacgcgctcgggctggggctggcgaccacgctggtgctgaccctgactaacttttccatttctgttttgcgccgctggacgccgtcagaaatccgtattccgatttatgtcatgatcattgcgtcggtggtcagcgtcgtgcaaatgctgattaacgcctacgcatttggcctgtaccagtcgctcgggatcttcattccgcttatcgtgactaactgtattgtcgtaggccgcgctgaagccttcgcggtgaaaaacaatccggccatatccgcgctggatgggttttccatcggcatgggcgcgactgccgccatgttcgtcctcggctctctgcgtgaaattttgggcaacggtacgctcttcgacggtgcggacgcgctgcttggcggctgggcgaagtcgctgcgtattgaggtgttccatacggacaccccgttcctgctggccatgctacctcctggcgccttcattggccttgggatgatgctggcgttaaaatacctgattgatgaaaaacgtaaacgccgcgccgctgaacgcagcgtacaggaagggatccccgagaaagcagtatga

SEQ ID NO: 1287 - DNA, 1548 bp, Enterobacter cloacae
acacccccgttaatatgggatgtaaaaaaagaggtatatgtgtctactgcaaacaataaaccaacagatgagagcgtaagtcttaacgctttcaaacagcctaaagcgttctatctcattttctctatcgaattatgggaacgttttggctactacggcctgcaagggatcatggcggtttacctggttaaacagctgggtatgtctgaagccgattccatcacgctattctcttccttcagcgccctggtgtatggcctcgtcgctatcggcggctggttaggcgataaagtcctcggtactaaacgagtcattatgctgggcgccgttgttctggcgattggctatgggctggttgcctggtccgggcacgatgcaggtgtggtttacatgggcatggctaccatcgcggtaggtaacggcctcttcaaggcgaacccatcttccctgctctctacctgctacagcaaagatgacccacgtctggacggtgcatttacaatgtactacatgtccatcaacatcggctccttcttctctatgctggcaaccccatggctggccgcaaaattcggctggagcgtagcgtttgcgctgagcttcgtgggtatgctgatcaccgttgtgaacttcctgttctgccgtagctgggttaaagactatggttcaaaaccagacttcgaacccgtgcacatgggcaaactgctggcaaccatcgtcggcatcgtgatcctggccgctgtcgccacctggctgctgcataaccagggcgttgcacgtgccgtactgggcgtggttgcgctgggtatcgtgattatcttcgcgaaagaagccttcgcgatgcagggtgcggcacgtcgtaagatgattgtggcgttcattctgatgctggaagcaatcatcttcttcgttctgtacagccagatgccaacgtctctgaacttcttcgctatccgcaacgttgagcactccatcctcggtatcgcgttcgagccggagcagtatcaggccctgaacccgttctggatcatgattggtagcccgattctggccgctatctataacaagatgggcgaccgtctgcctatgccgcacaaattcgctatcggtatggtgctgtgctctggcgcattcctggtgctgccgctggggacgaaattcgcgaccgacgcgggtatcgtttctgttaactggctgatcctgagctatgcgctgcaatccatcggtgaactgatgatctccggtctgggcctggcgatggttgcgcagctggtccctcagcgtctgatgggcttcatcatgggtagctggttcctgactaccgctggcgcggccatcatcgcaggtaagattgcgaacctgatggcggtaccagacaacgttaccgacccgctggtttccctgaatgtctacggcaccgtgttcatgcaaattggtatcgcgaccgccgtgattgccgtactgatgctgctgaccgcacctaaactgaatcgtatgacgcaggacgacgacaaatccgctaaagcgattaaaaccgcgaacgcgtaa

SEQ ID NO: 1288 - DNA, 639 bp, Enterobacter cloacae
catagctggaacctcagcaaaaaggagttaccgatgaaactgttctataaaccgggcgcctgctctcttgcttcccatattacgcttcgcgagagcggtaaagatttcacgctggacggcgttgacttgatgaaaaagcgcctggaaaacggggatgacttttttgcgattaacccaaaagggcaggttccggccctgctgctggatgatggcaccctgctgaccgaaggggtggcgattatgcaattcctggcggacaacgtaccggatcgtcagctcctagcccccaccggcagcattgcgcgttataaaacgctggagtggctaaactatattgccaccgaactgcacaaaggctttacgcccctgttccgcccggacacgccagaagagtacaaacctaccgtgcgcgcgctgctggagaaaaagttgcagtacgttaacgacgcgctgaaagacgaccagtggatctgtggctcgcgtttcactatcgccgatgcctatctgtttaccgttctgcgctgggcgcgcgcggttaagttgaacatggaaggattagaccatgtcgcatcgtatatgacgcgcgtggcggagcgtcctgcggtggcggcggcgctgaaagcggaagggttgaattaa

SEQ ID NO: 1289 - DNA, 345 bp, Enterobacter cloacae
ttcttcgcaaagaaaactcctaatttcgtcgcgttacccgagtggacagtttacgtctttattaatccgtttattattcgaacgcattacctttatgggtattacccttttatatggaaacttattaatatgacagttcaggactatttattaaaatttcgcaagatcaattcccttgaaagcctggaaaaactgtttgaccatctgaactacacgctgtcggataatcaggacatcatcaatatgtaccgcgctgctgaccatcgtcgcgccgaactggtctctggcggtcgtctgttcaatgtgggggaagtgcctaaatccgtatggcgttacgttgtataa

SEQ ID NO: 1290 - DNA, 780 bp, Enterobacter cloacae
ttttcggcgcgctggcaggcttgctggtctggcttattcgcagctttggcggctatccggacggcgtggcatttgccgtgctgctggctaacatcaccgttccgctcatcgactactacacgcgtccacgcgtgtacggtcatcgctaagggtcgcgccatgctaaagacaatgcaaaaacacggcgtcacgctggcgatcttcgccgccgccctcaccgggctgaccgcgctggtaaatgaactgacgaaaaccaccattgcagagcaggcaatgaagcagcaaaaagcgctgttcgatcaggtgatcccatccgatctctacgataatgacctgcaaaaaagctgctttgtcgtgcaggctccgcagcttggtaaaggaccccatcgcgtttatattgcccgcaagggcgataaccccgtgggcgccgtcatggaagccaccgcgccggacggttactccggtgcgattcagctgctggtgggcagcgatttttccggcaccgtactgggtacgcgcgtgacggagcatcacgaaacgccgggccttggcgacaaaattgaaacacgcttaagcgactggatcttacacttcgccggaaagatgattcatggcgaggacgatcctgctttcgcggtgaaaaaagatggcggcgaatttgaccagttcacgggcgccacgattactccgcgcgcggtggtcaacgccgtaaagcgcgccgggctgtatgccgaaacgctgcccgcgcagatcaatcatctttccacctgtgaggagtga

SEQ ID NO: 1291 - DNA, 468 bp, Enterobacter cloacae
catttcgcgcagactatgggagagcgtatgaccgcattgcctggagagagaattgggggctggttaatcgccccgctggcatggctgctggtggcattactaagcgcttcactggcgctgttgctttacaccaccgcactggttacgcctcatgctatccagacactgatgtcccagagtgcgctcaatattgcgacgtggtttgtgtcgttcgttttcgcgatcgcgatgtggtactacacgctgtggctgactatcgccttcttcaaacgccgcaaaagcgtgccaaagcattacattatctggctgctggtctccgtgctgctggctgtcaaagcgttcgctttctcgcctgtgtctgacgcgctggcggttcgccagttactgtttccgctactggcgacggcgcttctggtcccttatttcaagcgttcgacgcgcgttaagaagacctttgtcaacccgtaa

SEQ ID NO: 1292 - DNA, 597 bp, Enterobacter cloacae
tggtctggtgaagttgtaatgagtgctatctggattgccatcgcgtccatcagcgtgctgggactcgtctttggcatcattctgggttacgcctcccgccggtttgcggtggaggacgatccggtggttgaaaaaattgatgaacttttacctcagagccagtgcgggcagtgcggctaccctggttgccgcccttacgctgaggcggtgggagtgcagggagaaaagatcaaccgctgcgcgccgggtggcgaagcggtcatgcttaaaatagctgccctgctgaacgtcgatccccagcctgtcgacggcgatgaacaggcccaggagcctgttcgtgcccttgctgttatcgacgaagccaactgcattggctgcacaaaatgtattcaggcgtgtcctgttgacgccattgtgggcgcaacgcgcgcgatgcataccgttgtggcggatctgtgcaccggctgtaatctctgcgtggcgccctgcccgacgcagtgtatagaactacgcccggttgaaacgactaccgaaaactggaagtgggaccttcagaccattccggttcgcaatattcctgtggaacaacatgcttaa

SEQ ID NO: 1293 - DNA, 672 bp, Enterobacter cloacae
acgcagcgtacaggaagggatccccgagaaagcagtatgaataaagagaaacgcattgcgatcctgacgcgcctgcgcgatgagaatcctcatccaacgacagagctgaactttaactcgccgtttgaactgttgatcgcggtgctgctctctgcacaggcgacggacgtgagcgtcaataaagccacggccctgctctaccctgtcgccaatacgccgcaggccatgctggagctgggcgttgaaggtgtgaaatcctatatcaagaccattggcctgtttaacagcaaggccgaaaacgtcattaagacctgccggatcctgctggagaagcacggcggtgaagtccctgaagatcgcgccgcgctggaagcgttgccgggcgtcgggcgtaaaacggcaaatgtggtgctgaacacggcgtttggctggccgaccatcgccgtggatacccatatcttccgcgtctcaaatcgcacccgtttcgcgccgggtaaaaacgtggaagaggttgaagagaagctgttaaaagtcgttcctgcggaatttaaggtggactgccaccactggctgatcctgcacggacggtatacctgtattgcccgtaagccacgctgcggttcctgcattatcgaagatctctgcgaatacaaagaaaaagtctatccctga

SEQ ID NO: 1294 - DNA, 1371 bp, Enterobacter cloacae
cgcacaccgcgctggcgctttattctatggtcctttcgcatcaggcgaaaagtcgtgtaccggcaaaggtgcagtcgtttatacatggagaatttgatggcaagcagtaacttgattaaacaattgcaagagcggggcctcgtggcccaggtgacggacgaggaagcgttagcagagcgactggcgcaaggcccgatcgcgctctattgcggcttcgatcccaccgctgacagcttgcatttggggcatcttgttccattgttatgcctgaaacgcttccagatggccggccataagcctgtcgctctggttggcggcgcgaccggtctgattggcgacccaagtttcaaagccgctgagcgtaagcttaataccgaagataccgtgcaggagtgggtggataagatccgtaaacaggttgcaccattcctggatttcgactgcggtgagaactctgcgattgcggcgaacaactacgactggtttggtggcatgaacgtgctgacgttcctgcgtgacatcggcaaacacttctctgttaaccagatgattaacaaagaagcagtgaagcagcgtcttaaccgtgacgaccaaggtatctctttcaccgagttctcttacaacctgttgcaggggtatgactttgcctgcctgaacaagctgcacggcgtatctctgcaaattggcggttccgaccagtggggtaacatcacctccggtatcgatctgacccgtcgcctccaccagaatcaggtgtttggtctgaccgtgccgttgatcaccaaagcagacggtaccaagttcggtaagaccgaaggcggcgcggtatggctggatccgaagaaaaccagcccgtataaattctaccagttctggatcaacacggcggatgccgacgtttatcgcttcctgaagttcttcacctttatggatatcgaagaaatcaatgcgctggaagaagaagacaagaacagcggtaaagcaccacgcgcccagtacgtgctggcggacgaagtaaccaaactggttcacggcgaagaaggtctggcggcggcgaaacgcattacggcgagcctgttcaacgggaccctgagcgatttaagcgaagcggatttcgaacagctggcgcaggatggcgtaccgatggtggagatggaaaaaggcgccgatctgatgcaggcgctggtggactccgagctccagccgtctcgcggtcaggcgcgtaaaaccatcgcctctaacgcgatcaccattaatggcgaaaaacaggccgatccggaatacacctttaccgagaacgaccgtctctatggtcgctacacgctactgcgtcgcggtaagaaaaattactgcctggtctgctggaagtaa

SEQ ID NO: 1295 - DNA, 927 bp, Enterobacter cloacae
ttaaaagtatgcaggggcgtgggaaaccacgccccttttgttttgacagggtttggtaagtacaacatgaagaacatcctcgccattcagtcccacgttgtgtttggacatgctggcaacagcgctgcggaattcccgatgcgccgcctcggcgttaacgtctggcccctcaataccgtccagttttcgaatcacacccagtacggtaaatggaccggctgcgtgatgccgccgtcgcatctgacggaagtcgttcagggggttgcggatatcgaccagcttaaacgctgcgatgccgtactgagcggctatctgggatcggcggagcagggggaacatatcctcggcattgtgcgccaggtgaaagcggcaaaccccgcggcgaaatatttctgcgatccggtgatgggacatcctgaaaaaggctgcatcgtagcgccgggcgttgcggagtttcatgtccgtcatgcattgcccgccagcgatattattgcccccaacctgattgaactggagatcctcagcgagcatccggttaacagcgtagaagaggctgtaagcgcctctcgcgagctgatcgcccaggggccagagattgtgctggtgaaacacctggcacgcgcagggttgagccaggaccgttttgaaatgctgctggtgacgaaggatgaagcctggcatatcagtcgaccgctggtggatttcggtgcacgtcagcctgtcggggtcggggacgtgaccagcggtttgctgctggtgaagctattgcagggcgcgagcctgcgcgatgcgctggagcacgtcaccgcagccgtttatgaaatcatgattgcgacgaagacgatgcaggaatatgagctccaggtcgtcgcggcacaggatcgcatcgcgaagccggagcactattttagcgcaacgcagctatag

SEQ ID NO: 1296 - DNA, 1134 bp, Enterobacter cloacae
ggaaagcgcatgaaatcgggtcgctatatcggtgtgatgtctggtaccagtcttgacggtgtggatgtcgttctggccgccattgatgaaaacatggtggcgcagcaggcaagcctgacctggccaattccggtctcgttaaaagaagagatcctgaacatctgccaggggcaacagctgacgctttcccaactgggccaactggatgtgcgtctgggggcgctgtttgctgatgcggtactggccctgatgcagcaggaaagactccacccgcaggacatcgtggcaataggctgccatgggcagaccgtctggcatgaacctgtcggcgaggcgccgcacacgatgcaaattggcgataacaaccagattgtggcaaaaaccggcgtaacggtggtgggtgatttccgtcgtcgtgatatggccctcggcgggcagggggcgccgctggttccggcatttcatcaggcgctgctggcgcacccggtaaagcgcatgatggtcctgaacatcggcgggaatcccaacctgtcgatgcttattcccgggcaacccgtgcgggggtacgataccggacccggtaatatgctgatggatgcctggatctggcgtcagagcggtaaagcctatgacaaagacgcgcagtgggccagccaggggaaagtgatccttcccttgctgcaaaccctgttaagcgatcctttctttgctctgcctgcgccaaaaagcacggggcgggaatatttcaactacggctggcttgaacgtcagctggcgcgcttccccggccttgcgcctcaggatgttcaggctacgctgacggagctcaccgcggtgtcgatctctgaacaggtgttgctgagcggcgggtgtgagcgcttgctggtatgcggaggcggaagccgaaacccgctggtgatggcacgcctcgccgccttgctgccgggcaccgaagtcacgaccactgatgaagccgggatcagcggagacgatatggaagcgctggccttcgcctggcttgcctggcgtacggttgccggtctgccgggtaatttaccctccgtaaccggtgcgcgggaggcgagcgtcctcggggccattttccccgcaaacccgcgccataatcagagttaa

SEQ ID NO: 1297 - DNA, 360 bp, Enterobacter cloacae
gccctccaggaccaggatagtcttcggaatctgcccatgaaaaaacttcttctcattgctgtaccttttcttatgaccggatgcagcgtctataaccagttcgttgagcgtatgcaaaccgatacgctggaatatcgttgtgatgaaaaaccgctgacggtgaagctgaacaacccgcgtcaggaagccagctttgtttatgacaataagttgttgacgctgaagcagggaatgtcggcctccggtgcgcgctactcagacgggatctacgtcttctggtcgaaaggcgacagcgccaccgtctacaagcgtgaccgcattgtgctgaacaattgtcagcttcaaaatccgaagcgttga

SEQ ID NO: 1298 - DNA, 687 bp, Enterobacter cloacae
cgccacccaatctcactttcagctaacgccatgtcagataacgacgaactacagcaaattgcgcatctgcgccgtgaatacaccaaaggcggtctgcgacgccaggatcttcccgccgaaccgctggtgctttttgaacgctggctgaagcaggcctgcgaaacgaaactggtcgacccgaccgcgatggttgttgccacggttgatgaaaatggtcagccgtatcaacgcatcgttcttctcaagcattatgacgagaaagggctggtgttctacaccaacctgggcagtcgtaaagcgcatcaccttgaaaataatccgcgtattagcctgctcttcccgtggcatatgcttgagcgccaggtgatggttaccggcaaggcggagcgcctctctacgctcgaagtggtgaaatatttccacagccgcccgcgcgacagtcagatcggtgcctgggtctctaaacagtccagccgaatctcagcccgcggcgtgctggagagtaaattcctcgaactcaaacaaaagtttcagcagggtgaagtaccgctgccgagtttctggggcgggttccgcatccccattgagcagatggaattctggcagggcggtgaacaccgtctccacgaccgctttttataccagcgcgacaacggtggctggaaaatcgacagactggcaccgtaa

SEQ ID NO: 1299 - DNA, 1158 bp, Enterobacter cloacae
tgcgaggtaacaaaaaacgctgtcgtgagatgctattttaactcacagggcacattattaatgtgtgcgttaagcacaaggccagtgataaataagcgcacagcgagggggaaaacgatgagtgaaaacatccgcgtcggtcttattggctacgggtacgcaagcaaaacctttcatgcaccgctggttgccggcacgccgggaatggaactagcggccatcacaagcagcgatgagactaaggtccgcgccgactggccagctgtgccggtggtaacggagcctaagcatctgtttaacgatcctaatattgaccttattgtcattcctacccctaacgacactcatttccccctggcgaaagcggcgctggacgcaagcaaacatgttgttgtcgataagcccttcaccgtgacgttgtcacaggcgcgcgagctggatgcgctggcgcgaagtctgggtcggttattatcggtctttcacaaccggcgctgggacagcgatttcctgacggtcaaagcgctgctcaacgaaggcacgctcggcgaaattgccttttttgagtcgcacttcgatcgttatcgtccgcaggtgcgagatcgctggcgcgagcaggcgggaccgggcagcggcatctggtatgacttagcgccgcatcttctcgatcaggccgttcatctgtttggtctgcccgtaagcatgacggtcgatttagcgcagctcaggccgggggcgcagaccaccgactatttccatgccattttgagttatccgcagcggcgcattgtgctgcacgggacaatgcttgcggcggcggaatcggcccgctatatcattcatggggcgcgcggcagctatgtgaagttcggcctggatccgcaggaagagcgcctcaaaaatggcgaacgcttaccgcaggaggactggggctacgacatgcgcgacggggtggtgacgcgtgcggagggtgaggcgctggttgaagagacggtattgaccctgccggggaactatccggcgtattacgccgcaattcgtgacgcgctgaacggttcaggtgaaaatccggttcccgcaagccaggcaatccagattatggagctcattgagctggggatcgaatctgccaaacatcgcgcaacgctctgtctggcataa

SEQ ID NO: 1300 - DNA, 774 bp, Enterobacter cloacae
tttaagcgcatcgctgttggtcagctggctgaagaaaaggacggtataatgatttccctgaaaaatgtttctaaatggtatgggcactttcaggtgctgaccgactgctcaacagaagtgaaaaaaggcgatgtggtggtggtatgcggtccgtccggttccggtaagtccacgcttatcaaaaccgttaatgggctggaacctgtccagcagggcgagattgtcgttaacggcaccaaagtgaatgaccgcaaaaccaaccttgcccagcttcgctcccacgtagggatggtgttccagcattttgagctgttccctcacctctccatcattgagaacctgacgctggcgcaggtgaaagtgctgaagcgcgacaaaaaagcggcgcgcgaaaagggcctgaagttgctggaacgcgtcgggctgtctgcacatgcggataagttcccggcgcagctttcgggcggccaacagcagcgtgtggcaatcgcgcgtgcgctgtgcatggatccggtggctatgctgtttgatgagccgacgtccgcgctcgatcctgagatgatcaacgaagtgctggacgtcatggtggagctggcgcacgaagggatgaccatgatggtggtgacgcacgaaatgggcttcgcccgtaaagtgcccaaccgcgtgatcttcatggacgaagggaaaattgttgaagactcaccaaaagaagagttcttcgcaaatcctaaatctgaacgtgcaaaagacttcctcgccaaaatcctgcattaa

SEQ ID NO: 1301 - DNA, 534 bp, Enterobacter cloacae
acagccatcctgaactgcacagcaacactcgcccgtatcgtcatcatgggcggggcaatggggctggggaactggacgccagcagcagagttcaacatcttcgttgacccggaagccgcggaaatcgtcttccagtcgggcctgccgattgtgatggcggggctggacgttacccaccgcgcacaaattatggtgcaggacatcgaacgatttcgtactgtgggtaacccggttgcaacgaccgtggcagagctgctcgatttctttatggagtatcacaaagccgagaagtggggcttccacggcgccccgctgcatgacccatgcaccatcgcctggctactgaagccggaaatgtttaccacggtcgagcgttgggttggtgtggaaacacaggggaaatatacccagggaatgacggtggtggactattactcgctaacgggaaacaagccgaataccacggtgatggtggatatcgatcgggaagcgtttgtggatttgctggcggagcggctggcttattatatgtag

SEQ ID NO: 1302 - DNA, 507 bp, Enterobacter cloacae
tatttttttacaacggaaaagaatgaaatgactatcccggcacatatttggctcatcgatgacaatggctcacctttgataggagagtgtttaatgccatcacgattgggttccactgagcttaagtcctttgatcattcggtatggattcctacagaccataatacagggaaactgactggaacacgtcttcatgtaccgattagatttaaaaaagagatagaccggctcacaccctatctattcagagccgtatgcgaaggaagaatactgaaagaagctttaataaaaatgtataaaattaatgatgcaggaatagaactggaatatttcaatataaagctggaaaatgtaaagataactcaaatctcccccgttctatttccagtaggtattgcaagtaagcatatggaagaagttgaaattcgctatgagtctatagaatggaagtacactgaaggaaacataatgtacaaagactcgtggaatgaaagggtcacagcctaa

SEQ ID NO: 1303 - DNA, 1035 bp, Enterobacter cloacae
ctgatgatcaggttgtatcctgaacaactccgcgcgcagctcaacgaagggctgcgcgcggcctatctgctactcggcaacgaccccctgttactccaggaaagccttgatgcggttcgccatgcggcagccgcgcagggtttcgatgagcatcatacgttccagatcgataacagtaccgactggaacgctatcttctcgctttgtcaggccatgagcctgtttgcctctcgtcagacaatccagatcctgctgcctgagaatggtcctaacgctgccatcaatgaacagctggctatgctggtgagtttgttacacggcgatctgctgcttatcgtacgcggcaacaaactcacaaaagcgcaggaaaacgctgcctggtttacccggctaacccccagtgcggtgcttgtctcctgccagactccagagcaggcgcatctgccaaaatgggttgccgcgcgagcaaagcagcacaatttgcagctggatgaggccgccagtcagctcctgtgctactgctacgaaggcaaccttctggcactggcgcaggcgctggacaggctcgccctgctgtggcccgatggcaagctgacgctgccgcgcgtggaacaggcggtgaatgatgccgcgcactttacccccttccactgggttgatgcgctgctgtcggcgaaaagtaaacgtgctctgcacatcctgcaacagctgcgcctggaagggagtgagccggtcatccttctccgtacgctccagcgcgaattactgctgctgaacaaccttaaacgccagtcagcacacacgcccctgcgcgccttattcgacaaacatcgcgtctggcaaaaccgtcgggcgatgaccacggaggcgataaaccgcctgagccaggagcagttgcgtcaggcagtgcaacttctgatgcgcgccgaactgacgttaaaacaggattacggtcagtctgtctgggcggagctggagagtctctctttgctgctctgccataaggctctggcagacgtatttatcgatgggtga

SEQ ID NO: 1304 - DNA, 1914 bp, Enterobacter cloacae
tttaagcagcggatgaaactacagaattcttttcgcgactatacggctgagtccgcgctgtttgtgcgccgggcgctggtcgcctttacggggattttgctgcttaccggcgtgctgatcgccaacctctataatctgcaaattgtccgctataccgattaccagacccgctcaaacgaaaaccgtatcaagctggtgcccatcgcgcccagccgcggcattatctacgatcgtaacggcacgccgctggcgcttaatcgcaccatctaccagatagagatgatgcccgagaaagtggataacgtgcaggataccctgaacgcgctgagaagcgttgtcgacctgactgatgacgatatcgctgcgttcaaaaaagagcgcgcacgttctcaccgcttcacctccattccggtaaaaaccaacctgacggaagtgcaggtcgcccgttttgccgttaaccagtaccgtttccccggtgtggaagtcaaaggctataaacgccgctactatccttacggctccgcgctgacgcacgtcattggttacgtctccaaaatcaacgataaagacgtcgaacgccttgataaagatggcaagctggctaactacgccgcaacccatgatattggcaagctggggatcgaacgttattacgaagatgtgctgcacggtcagaccgggtatgaagaggttgaagttaacaaccgtggccgtgtgatccgacaactgaaagaggtgcccccgcaggcggggcatgacgtctatctgacgctcgacctgaagctacagcagtatatcgagacgctgctggcgggtagccgtgctgcggttattgtgaccgacccgcgtaccggcggcattctggcgatggtttcgatgccaagctacgatccgaacctcttcgtggatggcatctccagcaaggattactccggcctgctcaacgatccaaacacgccgctggtaaaccgcgcgacgcagggggtttatcctccagcttcaacggttaaaccgtatgtggccgtgtctgcgctgagcgcgggcgtcatcacccgtaataccagtctgtttgaccccggctggtggcagttgcctggctctgagaaacgctaccgcgactggaaaaaatggggccacggccatctgaacgtgaccaaatcactggaggagtcggcggataccttcttctatcaggtcgcctacgacatgggtattgaccgtctgtctgaatggatgagcaagttcggctacgggcattacaccggtatagatttggcggaagagcgttccggcaacatgccaacccgcgaatggaagctgaagcgctttaaaaaaccctggtatcagggtgacaccattccggtggggatcggccagggctactggacggcaacgccgctgcaaatgaacaaggcgatgatgatcctcatcaacgatggcgtcgtgaaagtgccgcacctgctgcaaagcaccgttgaagacggcaaaaaagtgccatggatacagccgcacgagccgccggtgggtgacattcattccggatactgggaaatcgcgaaagacgggatgtacggtgtagccaaccgccctaacgggacggcgcacaaatatttcgctggcgcaccgtataaggtagccgcgaaatcaggtacggctcaggtcttcggtcttaaagcgaatgaaacttacaacgcacataaaattgccgaacgtctgcgtgaccacaagctcatgacggcgtttgccccttatgataacccgcaggttgcggtggcgatgattctggagaacggcggcgcaggcccggcggtgggtaccatcatgcgtcaaatcctcgaccacatcatgctgggtgacaacaacaccgaactgccagctgaaaacccggcagccgctgcggcggaggaccaataa

SEQ ID NO: 1305 - DNA, 528 bp, Enterobacter cloacae
tggccgggtttggtatcgtcatgtcgatccatacccacaggaaaatgttgtccaaaagcgtataaaaataaggggatcgcaatgcgtaagcagtggctggggatctgcatcgcagcaagtttacttgccgcctgtacaagtgatgatggtcagcaacaggcaaccgtcgcgccgccgcagcctgcggtctgtaatggcccgattgtcgagattagcggtgccgatcccgtttatgaaccgctgaacgccagcgtgaatcaggattatcagcgcgacggtaaaagctataaaatcgttcaggatccttcccgtttcagccaggctggctttgctgccatctatgacgctgagcccggcagcaacctgaccgcgtcgggtgaaaccttcgatccgatgcagatcacggctgcacacccgacgctgcctgttccgagctatgcacgcatcactaacctggcgaatggccgaatgatcgtggtgcgtatcactcttcaccacgtggctagaagcctccgcccttcgaattag

SEQ ID NO: 1306 - DNA, 828 bp, Enterobacter cloacae
gtggtcgttccccactcagcgcaaaaattgagcttctcaccaatcttcgagggtagcgctgctacccttttttttctggagtttactatgtcaattgactggaactggggcatctttctgcaacaagccccgttcggcaacaccacctatctcggctggctgtggagcggctttcaggttaccgttgcgttatcgataacggcgtggattatcgcgtttcttgtcggttcgctgttcggtattctgcgtaccgtccctaaccgttttctctcttcaattggcacgctctatgtggaactgttccgtaacgttccgctgatcgtgcagttctttacctggtatctggtgatcccggaactgctgccggaagatctcggcatgtggtttaaggccgagctggatcctaacgtacaattttttgtctcctctatgctgtgtctggggctgttcaccgctgcgcgcgtctgcgagcaggtacgtgccgccatacagtcactgccgcgcgggcaaaagaatgcggcactggcgatgggcctgactctgcctcaggcctaccgttacgtactgctgccgaacgcttaccgcgtcatcgttccgccgatgacctccgagatgatgaacctggtaaaaaactcggctatcgcctcaaccattggtctggtagatatggcggcgcaggcgggcaaactgctggattattccgctcacgcatgggaatccttcacggcgatcacgctcgcctatgttctgattaacgcattcatcatgctggtgatgaacctggttgaacgcaaagtacgcctgccgggcaatctggggggcaaataa

SEQ ID NO: 1307 - DNA, 675 bp, Enterobacter cloacae
atgtacgattttgactggagttccattgttccctccatgccctatctgctggatggactggcaatcaccttaaagatcaccgttatcgccattatcgtcggtattgtctggggcaccctgctggcagtgatgcgcctgtcgagctttaagccgctcgcctggtttgccacggcttacgttaacgtgttccgctccattccactggtcatggtgctgctgtggttttatctgattgttcccggctttttacagaacgtactgggactgtcgccaaagaccgatatccgcctgatctctgccatggtggcgttttccatgtttgaagccgcctactactcagagatcatccgcgccggtattcagagtatctcgcgcgggcagtccagcgctgcgctggcgctcggtatgacgcactggcagtctatgaagctcattattctgccgcaggcgtttcgcgccatggttccgctgctgctgacgcagggcatcgtcctgttccaggatacctccctggtctacgtgctgagtctggcagacttcttccgtaccgcctccaccattggcgaacgtgacggaacgcaggttgagatgatcctcttcgcgggcggggtctattttgtgattagtttaagcgcatcgctgttggtcagctggctgaagaaaaggacggtataa

SEQ ID NO: 1308 - DNA, 609 bp, Enterobacter cloacae
attgctgaatctggtcgttggctaagcgcgggaggaaacgtgcgacaactggcaacaatactcttatctctggcggtgcttgtcaccgctggctgcggctggcacctgcgcaacaccacggcagtgcctgcgcagatgaaaacgatgatcttcgactcatccgatccgaacggaccgctgagccgggccattcgtaaccagctgcgtttgaacgatgttgaactgatcgagaagggaaccctgcgtcaggatgttccttcgcttcgcgtcctgaaatcaacgctggcaaaagacactgcgtcaatcttccaggatgggcggacggcggaatatcagatggtgctgaccgttagcgcggctgttctgatgccaggtaaagatatttaccctatcagtaccaaagtctaccgttcgttcttcgataacccgcagacggcgctggcgaaagacgccgaagagcagattatcatcaaagagatgtacgataaggctgcggaacagctgatccgtaagctgcctaccattgccgcgtcgacgaaaaaaggcgctgacgtcatcgaaacaccggatgcccgcacgccggatatgccaacgtcgctgggtaactga

SEQ ID NO: 1309 - DNA, 753 bp, Enterobacter cloacae
aacaggattacggtcagtctgtctgggcggagctggagagtctctctttgctgctctgccataaggctctggcagacgtatttatcgatgggtgatatgcattctttacaggcaatgtatggcgggaccttcgacccggtgcactatgggcatcttaagccggtagaaatcctcgcgaatttgattggcttgcagcgggtgatcatcatgcccaacaatgttccgccgcaccgtcctcagccagaagcaaccagcgagcagcgtaaagcgatgctcgcgctggctatcgccgataagcctctcttcacgctggatgagcgtgaactgcgcagggataccccttcctggacatcgcaaacgctgcgggagtggcgcgctgagcaggggcccatgaaaccgctggcgtttatcatcggccaggattccttgctcaactttcccagctggtaccagtacgaaaccattctggaaaacagtcatctgctggtctgccgccgtccgggctacccgctgaccatgcgcgacgcgcagcatcagcagtggcttgacgcacatctgacggacaatatagaagacctgcacagtctccccgccgggaaaatttacctcgctgaaacgccgtggtttgatatttccgcgaccctcatccgcgagcgtctccagcagggtttagactgtgacgatctcctcccctcgcccgtgctggcctatatccttgcgcacggtctgtatcagaaaagtacagatgtctga

SEQ ID NO: 1310 - DNA, 252 bp, Enterobacter cloacae
gacaactgggaaatcgtcggtaccgcccagtcgaaagaagcctacggctgtatgctgcgtaaaggtgacgaggacttcaagaaactgatcgatgacaccatcgctcaggcgcaaacctccggcgaagcggcaaaatggttcgacaaatggttcaagaacccaattccaccaaaaaacctgaacatgaactttgaactgtctgacgacatgaaagcgctgttcaaatcaccaaacgacaaagctcttaactaa

SEQ ID NO: 1311 - DNA, 582 bp, Enterobacter cloacae
atctctttttctattcggcgtcacatcgcagcgttaaccttgtcacaaataatgctgagaatggagaacgctatggcacagccaattattctcgactgcgatccgggtcatgatgacgcgatcgcactcgtccttgctcttgcttcccctgaactggacgtaaaagctgtcacctcctccgccggaaaccagacgccggataaaaccttgcgaaacgtgttgcgcatgttgacgctgctgaaacgcaccgatattcctgtcgcaggtggtgccgttaagccgctgatgcgcgagctgatcattgcggataacgttcacggtgaaagtgggctggatggtccggcgctgccggagccggatttcgcaccgcaaaactgcactgccgtcgagctcatggcgaaggtgctgcgtgagagtgcagagcccgtgacgctggtggcgaccggcccgcagaccaacgttgcgctgctgctgaacagccatcctgaactgcacagcaacactcgcccgtatcgtcatcatgggcggggcaatggggctggggaactggacgccagcagcagagttcaacatcttcgttga

SEQ ID NO: 1312 - DNA, 2712 bp, Enterobacter cloacae
attcctgcaaagtgcatttgcgtgaaaggctgttttgacgcgggcgtttgggctatgctatgcggatctgaattaccacatccattggctacatttgtagctgtattgaacacaggaccactggctgccatgcaagagcaataccgcccggaagagatagaatcaaaagtccagcaacactgggacgagaagcgcacctttgaagtaaccgaagacgagagcaaagagaagtattactgcctgtcgatgcttccctatccttctggtcgactacacatgggccacgtgcgtaactacaccatcggtgacgtgattgcacgctaccagcgcatgctgggcaaaaacgttcttcagcctatcggctgggatgcgttcggcctgcctgctgaaggcgcggcggtgaaaaacaacacggcaccggctccgtggacgtacgacaacatcgcgtacatgaaaaaccagctgaaaatgctgggcttcggctatgactggagccgcgagctggcaacctgtaccccggaatactaccgctgggagcagaaattcttcaccgagctgtataaaaaaggcctggtgtacaagaagacctctgccgttaactggtgcccaaatgaccagaccgttctcgcgaacgaacaggttatcgatggctgctgctggcgctgcgacaccaaagtagagcgtaaagagatcccgcagtggtttatcaaaatcaccgcctacgctgacgaactgctgaacgatctggacaatctggaccactggccagataccgttaagaccatgcagcgcaactggatcggccgttccgaaggtgtggaaattaccttcaacgttgagaactacgatcagaccctgaccgtctacaccacccgcccggacaccttcatgggcgcgacctacctggccgtggccgcaggtcacccgctggcgcagaatgcggcagaaaacaatccggagctggcgactttcatcgacgaatgccgcaatactaaagtggccgaagccgacatggcgacgatggagaaaaaaggcgttgataccggctttaaagctattcacccgctgacaggcgaagcgatccctgtctgggccgccaacttcgtactgatggaatacggcacaggcgccgtgatggccgtgccgggtcacgaccagcgcgactacgaatttgccaccaaatacggcctgaccatcaagcctgttattcttgctgctgacggctctgaacccgatctctctgagcaagcgctgactgaaaaaggcaccctgtttaactccggtgagttcagcggcctgagcttcgaagagggcttcaacgccatcgccgacaagctggcctccctgggcgtgggcgagcgtaaagtgaactaccgtctgcgcgactggggcgtttcccgtcagcgttactggggtgcgccaatcccaatggtgacgctggaagatggcaccgtgatgccaacgccggaagatcagctgccggtgatcctgccggaagacgtggtcatggacggcatcaccagcccgatcaaagccgatcctgagtgggcgaaaaccaccgtcaacggtcagccagcgctgcgtgaaaccgacacctttgacacctttatggaatcctcctggtactatgcgcgctacacctgcccacagtacaaagaaggcatgctggattctgatgcagcaaactactggctgccggtagacatttacatcggtggcattgaacacgccatcatgcacctgctctacttccgcttcttccacaaactgatgcgtgacgcaggcctggtcaactccgacgagccggcaaaacagctgctgtgtcagggtatggtgctggcagatgcgttctactacgttggcgcgaacggcgagcgtaactgggtttctccggttgatgcgattgtcgagcgcgacgagaaaggccgtatcgtgaaggcgaaagacgctgaaggtcatgaactggtttataccggcatgagcaagatgtccaagtctaaaaataacggcatcgacccgcaggtgatggttgagcgttatggtgcggataccgtgcgtctgttcatgatgttcgcctccccggcagatatgacccttgagtggcaggaatccggcgttgaaggggccaaccgcttcctgaagcgcgtctggaaactggtttacgagcacacctctcagggcgatgcgccagcgctgaacgtagctgcactgactgaagatcaacaggcgctgcgtcgtgatgttcataaaaccattgcgaaagtcaccgatgatattggtcgtcgtcagaccttcaataccgcaattgcggctattatggaactgatgaacaagctggcgaaagccccgcaggatggcgagcaggatcgcgcgttaatgcgtgaagcgctgctggcggtcgttcgcatgctgaacccgttcacgccgcacgttagctttaccctgtggcaggagctgaaaggcgaaggcgatatcgacaatgcgccgtggccagtggcggatgaatccgctatggtggaaaacaccacgctggtggtggtgcaggttaacggtaaagtgcgcggtaaaattaccgtcgcggtcgacgcaaccgaagaacaggttcgcgagcgcgcaggccaggagcatctggtcgcgaaataccttgagggcgttaccgtacgtaaagtgatctacgtacctggtaaattgctgaatctggtcgttggctaa

SEQ ID NO: 1313 - DNA, 405 bp, Enterobacter cloacae
catttgtcccgcgactggcgtcagttcaggtatactgactggccacgaattcatagttgtacaatctcattcacccagggggaaaacttgcagggtaaagcactccaggattttgttatcgacaaaattgatgacctgaaaggtcaggacatcatcgctatcgacgttaagggtaaatccagcatcaccgactgcatgatcatctgcaccggcacctcaactcgtcacgttgtttcgattgctgaccatgttgttcaggaatcgcgcgcggcagggctgcttccgctgggcgttgaaggtgaagcgaccgctgactgggtggttgtcgatctcggcgatgtgattgtccacgtcatgcaggaagagagtcgtcgcctgtatgagctggaaaaactctggggttaa

SEQ ID NO: 1314 - DNA, 471 bp, Enterobacter cloacae
tgcgtgaagttgcaactggtcgccgtcggcaccaaaatgccggactgggtacaaaccggttttactgagtatctgcgtcgtttcccaaaagatatgccgttcgaactggtggagatcccagcaggaaagcgcggcaagaacgcagatatcaaacgtattctcgataaagagggagagctgatgctggctgccgcaggcaaaaaccgcatcgtgaccctcgatatcccgggcaaaccctgggatacgccgcagctggcgcacgaactggagcgctggaagcaggatggtcgggacgtcagtctgttgattggcggaccagaggggttatctcccgcctgcaaagcggcagcagaacaaagttggtcactctcggcgctgacgctgccccacccgcttgtacgggttctcgtggcagaaagtttgtatcgcgcatggagcatcactaccaaccacccttatcaccgcgagtaa

SEQ ID NO: 1315 - DNA, 1149 bp, Enterobacter cloacae
aaacccggcagccgctgcggcggaggaccaataatcatgacggataatccgaataaaaaatcgctgtgggacaagatccacatcgacccagccatgctgctgattctgctggctctgctggtctatagcgccctcgttatctggagcgccagcggccaggatatcggcatgatggagcgtaaaatcggccagatcgccatgggtctggttattatggtggtgatggcgcaaataccgccgcgcgtgtacgagggttgggcgccctatctctatattttctgtatcattttgttggtggcagtagatgctttcggcgccatctcgaagggggcacaacgctggctggatctggggattgtccgcttccagccgtcggaaatcgccaaaatcgccgtcccgctgatggtggcgcgctttattaaccgcgacgtctgcccgccgtcgttgaaaaataccgccattgcgctggtgctgattttcctgccgacgctgctcgtggccgcacagccggacctcggcacctcgattcttatcgccctctccggcctgttcgtcctgttcctgtccggcctgagctggcgtctgattggtatcgccgtggtgctggttgccgcgtttattcctatcctctggttcttcctgatgcatgattaccagcgtcagcgcgttatgatgctgctcgatcccgagaccgatccgctgggcgcaggctatcatattattcagtcgaagattgcgattggctccggcggcctgcgcggcaaaggctggctgcacggtacgcagtcgcagctcgaatttttaccggaacgccacaccgactttatctttgccgttctggctgaggagttagggctggttggcatcctggttctgcttgcactctacgtgctgctgatcatgcgaggtttgtggattgccgcacgcgcccaaaccacctttggtcgcgtgatggcaggcggattaatgttgattttgttcgtttatgtcttcgtaaatattggtatggtgagtgggattctgccggttgtcggcgtaccgctgccgctggtgagttacgggggctcggcactgatcgtgttgatggccgggtttggtatcgtcatgtcgatccatacccacaggaaaatgttgtccaaaagcgtataa

SEQ ID NO: 1316 - DNA, 525 bp, Enterobacter cloacae
ggtctattattagagacagttacttacccgggaggcaaaatgatgaacaaggttgctcaattttaccgtgaactggtagcgactctgacggaacggctgcgtaacggcgagcgtgatatcgacgcgctggtcgaacaggcacgcgcacgcgtgacgcaaacgggtgagttaacgcgaaccgaagtggaagaggtaacgcgcgccgtgcgccgcgacctggaggagttcgcgcgaagctatgaagagagccaggacgagatcgccgacagtgtttttatgcgggtaattaaagagagcctgtggcaggagctggcggatattaccgataaaactcagctggagtggcgcgaggtgttccaggatttaaaccaccacggtgtctatcacagcggcgaagtagtggggctggggaacctggtgtgtgagaagtgccaccaccatatcgccgtttatacgccggaggtgttgtcgctgtgtccgaagtgcgggcacgaccagttccagcgtcggccgtttgagccgtag

SEQ ID NO: 1317 - DNA, 444 bp, Enterobacter cloacae
ttgtacgcgcagaacacttgttgttctgaaacggaggccgagcctggcatgaacactttttttaagctcaccgcgctggctggcctgtttgctataacaggccacgctttcgctgtggacgatattacgcgtgttgatcaaattccggttctcaaggaagagactcagcacgcgacggtgagtgagcgcgtgacgtcgcgctttactcgttcgcactatcgtcagttcgatctcgatcaggccttttcggccaaaatctttgaccgttatctgaacttgctggattacagccataacgtactgctggccagcgatgtcgaacagttcgctaaacgcaaatccgaagtgggtgatgagctgcgctccggaaaactcgatctgttctacgatctgtacaacttatcgcaaaatcgccgtttcgaccgtctcttcacctcggaatga

SEQ ID NO: 1318 - DNA, 354 bp, Enterobacter cloacae
aaattcgggcgtaaaccaccagacgtcaccgggcaaaatggaccagctgtggtctgcattcaccgcgtcacgcagctcctgcggcaacccgttccaggcggcgaaataccagaacagcagctgcaccagcagcggcgtattgcgaaacagcgatacccagccgctgacgaacgacgtcccgagacgtcccccggaaagccgcaaaagcataaagaacaaggcgagcaggcttgccagcataatccccgccagcgtcacccacagagtggtgagaaatccggagaggatccagtgcaggggctgtccggccagcaccccctgccagtccagagcgggcattacagttgctcctga

SEQ ID NO: 1319 - DNA, 843 bp, Enterobacter cloacae
acgctaataaatacacacaggaaccacatcatgaaaaagacactgacactgatcgccgccgcaaccctgagcgccctgagctttgcctcctgggcggacacgctcaccgtgggggcgtccaataccccccacgcggaaattctggagcaggctaagccgattctggcgaagcaggggatcgatctggagattaaacccttccaggactacatactgccaaacactgcgctggcggggcatgacattgacgccaactatttccagcacatcccttacctgaacagcgtgctgaaagatcacgcgggcgataaggattatgattttgtcagtgcgggcgcaatccacattgagccgatcggtatctattcaaaaaaatacaaatcgctgaaggatctgccggaaggcggcaaaatcatcatgcgtgatgcggtttccgaggaagggcgtattctctccatcttcgaaaaagagggcgtgatcaagctgaagccgggcatcgataaagtgaccgcgcgcatcagcgatatcgtggagaacccgaaaaagctgcaatttacccctaacgtcgaagcgtctctgctgccgcagatgtacaacaacgacgaaggtgctgcggtggtgatcaacgccaactacgcgattgatgctggcctggatccggtccacgatccaattgcggttgaaagcggtgagaataacccgtacgccaacatcattaccgttcatcgcggtgacgagaagaagaaggatatcgtcgcgctggtgaacgtgctgcactccaaagagattcaggactggatccgcaccaaatacaaaggcgcagtcatcccggttaacaactaa

SEQ ID NO: 1320 - DNA, 228 bp, Enterobacter cloacae
ggcaacggagtgatggcaatgggaaatgtgaccaaagacgaagcgctgtaccaggagatgtgtcgggtggtaggcaaggtcgttctcgaaatgcgtgatttagggcaggagccgaaacatattgtcattgcgggcgtactgcgtaccgcgctggcgaaccagcgcgttaagcgcagtgagttgaccaccaaagcgatggaaacggtggttaaagcgctggccggctaa

SEQ ID NO: 1321 - DNA, 1032 bp, Enterobacter cloacae
cgaataagaatgatcgtactcagcaatatttcgaaggtctttgacaacggaaagctggcgctgacagccgttgataacgtcaacttgacgatagagcagggacagatttacgggatcatcggttacagcggggccgggaaaagtacactgatccgtctgctgaacggtctggaaaagcccagcgccggcagcgtcaccattaacggtcaggatatctccgccgcgaagggagaagcgctgcgtcaggcacgcctgaaaatcagcatggtgttccagcactttaatctgctctggtcgcgcacggtgaaggaaaacatcgccttttcaatgcaaattgccggtgtgccaaaagcgcaaattcaggctcgcgttgccgagctggtggagctggtcggcctgaagggacgggagaatgcttacccgtcgcagctgagcggcgggcaaaaacagcgtgtgggcattgcccgcgcgctggccaatcatccggacgtactgctgtgtgatgaagccacctcggcgctggatccacaaaccaccgatcagatcctcgatctgctcctggacattaaccgtcgctttaacctgaccatcgtactcattacgcatgagatgcacgtggtgcgcaaaatctgcgaccgcgtggcggttatggagaacggtaaggtggtggaagagggggacgtgctgagcgtgtttacgcatccgcagcagccgatcacccggcagtttgtccgccaggtgagccagtacgcggaggaagagaccttcaataccgaactggcaaacgatctggaaggcacggtgatcaggctgaccttcaccgggcacagcacgcacaggccgatcgtcggtgaactgaccctgcgctacggcctgccgtttaacatcctgcacggcaaaatgacgcaaaccgcccacggtgttttcgggcagctctgggtgcacgtggtggcatcggacgaacaactgaacaatatcctcgccgacctgaagcaaagcgatattgaaggcgaggtaatcaagcatggctga

SEQ ID NO: 1322 - DNA, 663 bp, Enterobacter cloacae
agaactctttccgcacctgaagtgggatcagctttgggctgcaacccaggagacgctttacatgactgcgctttcccggcgtggcgacgtttgttcctggggatcgcgctcggtctggcgctgtttttaaccgcccgcggcgggttattccacaaccgcacggtttacagcgtgatgtcgattgtggtgaacgtgttccgctcgattccgttcatcattctcatcgttctgctgatcccgttcaccaagaccgttgtggggaccattctcggcgctaacgctgcgctgcccgccctgattgtgggcgcggcgccgttctacgcccgtctggtcgagattgccctgcgagaagtggacaaaggggtcattgaggccacgcgttcgatgggcgcgcggctgagcacgttagtgtttcgggttttattgccggaatcctcacccgcactggtttcaggtatgacggtgacgctgattgcgctggtgagctacagcgcaatggcaggggtgataggtgccggcggtttgggaaatctggcttatctggaaggattccagcgcaaccatggtgacgtcacgctggtggcaacggtgaccattctgatcatcgtgttcattatccagttctgcggcgatgccattacttcactgttagataaacgctaa

SEQ ID NO: 1323 - DNA, 864 bp, Enterobacter cloacae
cggggtaaaacaaaaacaacgggatggcgtatgactatggctgcaaaaatgaaagggtttaaaaaacgggcgcaggttctgggattagtggcttggggcctggtttcagcgcaggcgcaggccgatcggctggcggatatcaaggcagcaggcgtggtgaaagtggccacgtttgatgctaatccaccctttggctcgattgatgccaaaacgcatgagatcgtgggttacgatgtggacttcgccaaagcgctggcgaaatcgctcggcgtcaagcttgaactggtcgccaccaatccggctaaccgcattccgctgctacagtccggaaaagcagatctcatcgtggcggatatcaccatcaccccggaacgcgcacaggtcattgatttctcgacgccttacttcgtcaccggccagcagttcctggtcccggcaaaatcaccggacaagcttgatgactatagccgggcacgcattggcgccgtaaaaggtacgacgggtgaacaggcgctgcaccagcgttttccgcagtcccgcgtcctctcttacgatgacatcccgctggcgctgacggcactgcgcaatggcaacgtgcaggcaattacccaggacagcaccattctggctggtctgctggcgcaggcgccggataaagccgacttcaaaatcctgcccgacctgctcagtaaagaagagattggcgtgggggtgaaaaagggtgaaacggcgctgctgaaagccgttaacgatgagctggttaacctggagaaaaacggccaggcggcaaaaatctatgacgtctggttcggtccaggcagccctgctccacagcctcgtaactttaaaatagaagcccggtaa

SEQ ID NO: 1324 - DNA, 909 bp, Enterobacter cloacae
gatgcagttcgcccgggaaattgccgatcgaatcgtctttatcgacggtggacacattctggaaaccgcgtccccggcgcaatttttcaaccaaccgtcgcatccgcgtgcgaggcggttcctgcaaaaagtgctggatccgctgcgtcaggagcaactgtaatgcccgctctggactggcagggggtgctggccggacagcccctgcactggatcctctccggatttctcaccactctgtgggtgacgctggcggggattatgctggcaagcctgctcgccttgttctttatgcttttgcggctttccgggggacgtctcgggacgtcgttcgtcagcggctgggtatcgctgtttcgcaatacgccgctgctggtgcagctgctgttctggtatttcgccgcctggaacgggttgccgcaggagctgcgtgacgcggtgaatgcagaccacagctggtccattttgcccggtgacgtctggtggtttacgcccgaatttttatgctccgcctgggggttaggcgtatttacctcagcgtttttaattgaagaagtcgaatcggggctccgttccgtacctgccgggcaacgggaggcggcgctcgcccagggattttcctcatggcgtctgtttcgctacattcttctgccacagggactcgctaacgcctggcaacccgtcgttggccagtaccttaacctgatgaagctctcctcgctcgcgagcggaattggcttcgccgaactgacctaccaggttcgccagatagaaagttacaacgcccatgccctggaagcctttaccgtcggtacggtgctctacttacttaccgggatggtgacggggagcgtgctggtgcgcctcggcccccattcagggaggaaaaatcatgatccccggatttaa

SEQ ID NO: 1325 - DNA, 828 bp, Enterobacter cloacae
aagcccggtaatatgctctcaggtttattttcgcactccgcggccaatgccgcggatttttcacgtctggaacaggccagcgttgagtttcgccatgtggacaaacgctacggcgaccatccggttttaaccgacattaatctcaccatcatgccgggtgaagtggttgccattctcggcccttcgggttccggaaaatcgaccctgattcggcttatcaaccagcttgagagcctgagcggcggggagattctggtcgaccacaagccgaccggacagctttccggcagcaggctacgtcagttacgcagccgcgtcgggtttgtattccagcagttcaatctctatgcccaccttaccgccagccagaacatcaccctggcactggagcacgttcacggctggaaacccatgcccgcccaggagcgcgcgctggcgctgctggagaaggtcggcatgctggagaaggcgcaccgctaccctgctgaactttccggcggacaacagcagcgcgtggcgattgcccgcgctctggcctcgtcgccgcaaatcattctctttgacgagccaacgtcggcactcgacccggagatgattggcgaagtgctgttggtgatgaaagcccttgcccacagcgggatcaccatgattgtcgtcacccatgagatgcagttcgcccgggaaattgccgatcgaatcgtctttatcgacggtggacacattctggaaaccgcgtccccggcgcaatttttcaaccaaccgtcgcatccgcgtgcgaggcggttcctgcaaaaagtgctggatccgctgcgtcaggagcaactgtaa

SEQ ID NO: 1326 - DNA, 735 bp, Enterobacter cloacae
cggggagcgtgctggtgcgcctcggcccccattcagggaggaaaaatcatgatccccggatttaacgttattgtcgaaaacctggattatctgctttggggacgtgcgattgcgggagaacccggcggcgtactgctctcactgctgatggccgctggcgccgccgcgcttgccctgcccggcgggattgtgctggcatgcgtcgcctggcgctatcccggcgtggtgcgcagtgcgctgtttgcgtgggcagagttgattcgcgggatccccctgatcttcgtaatattctggatgtggtatctgctgccgctgataaccggcagggatctccctggcgcgacgaccgtcacgctggcgctggcctggtttaccgcggctgcggtgatgcattcggtattagccggactgagagctctaccgtcgggccagaatgaggccgcgctttctcaagggttcagtacgcagcaaacgctgtggcgcgtgctgctgccgcaggcgctgagaaatattctgccgtcgctggtggggatttttatcagcctgctgaaggatacgtcgttggcgtttatcgtgaacgttcctgaactgaccacggtggcgggacaggtcaacaaccgggtgcaaatttacccggcggccatttttatctttacgggtgtgatctattacctgctctgctgctcgcttgagctgctcgcaaagcgctggcgcgttagccggccagcgctttaa

SEQ ID NO: 1327 - DNA, 876 bp, Enterobacter cloacae
ctccgcggcggtgcgcccccggagcgagatttccatatccttcccaacttaaagactaagactgtcatgaaaaagacgaaaattgtttgtactatcggcccgaaaaccgaatccgaagagatgctgagcaaaatgctggatgccggcatgaacgtgatgcgtctgaacttctcccacggcgactatgctgaacacggtcagcgtatccagaacttgcgcaacgtgatgagcaagaccgggaaaaaagcggcaatcctgctcgacaccaaaggtcctgaaatccgcactatcaaactggaaggcggtaacgacgtttccctgaaagcgggccagaccttcaccttcaccaccgacaaatccgttgtgggtaataacgaaatcgttgccgtgacctacgaaggcttcaccagcgacctgtctgttggcaacaccgtgctggtagatgacggcctgatcggcatggaagtgaccgctatcgaaggtaacaaagttatctgtaaagtgctgaacaacggcgatctgggcgaaaacaaaggcgtcaacctgccgggtgtgtccattgctctgccagcgctggctgaaaaagacaaacaagacctgatcttcggctgcgaacaaggcgtggacttcgttgctgcctcctttatccgtaaacgttctgacgtggttgagatccgtgagcacctgaaagcgcacggcggcgagaacatccagatcatctccaagatcgaaaaccaggaaggcctgaacaacttcgacgaaatcctcgaagcgtctgacggtatcatggtagcgcgtggcgacctgggcgttgaaatccccggttgcagaagtgtcttcaccacgggagccgggacgaaccgaatcaagcggggg

SEQ ID NO: 1328 - DNA, 1602 bp, Enterobacter cloacae
ttatctgccatttgcatatcaggtcacactcacccggcgaaatcggttaattttgcagcactttatgcggatttagccatcctcacatccggacaactttacgtcttgctgtctttccatctgaaaatacaaggattattcctttctgttcttaaacctggtgaaacgttctttattgagaaaatttcatggttctatcatccggtcatcacctcttcacaggacatgaccatgacgctttaccactccgtcaccgaactgattggccgtacgccgctcatccagctgcacaagctggacaccggcccctgctcgctgtttctgaagctggaaaaccagaatcccggcggctcgattaaagaccgcgtcgcgctgtcgatgattaacgaagccgagcgtacgggccagctaaggcccggcggcaccattattgaagctacggcggggaacaccggcctggggctggcgttgatcgcggcgcagaagggctactcgctgatcctggtggtgccggacaaaatgagccgcgagaagattttccacctgcgcgcgttaggggcgcaggtcgtgctgacccgctcggatgtgaacaaagggcatccggcctattatcaggattatgcccggcggctggcgaacgaactgccaggcgcgttttatatcgaccagttcagtaacgcggccaatccgctggcgcatcgcaccactaccgcaccggaactgtttgaacagcttgacggccagatcgatgccatcgtcgtcggcgtggggtccggcggtacgctgggcggcttacaggcgtggtttgcagaacattcgccgcagacggaatttgtgcttgccgatccggccgggtcggtactggcggaccaggttgagaccggacgctatcacgatgccggctcgtggctggttgaagggattggcgaagactttattcctccgctggcgcacatcgagggggttaaccgcgcctggcgcattaccgatcgcgaggcgttcaccaccgcccgcgatctgctaaaaacggaagggatcctggcaggctcctccaccggcacgctgctggcgacagcgctgaaatattgccaggcgcagactacgccaaaacgtgtggtcaccttcgcctgcgacagcggcaataaatacctctcgaagatgttcaacgacgactggatgcgccagcaggggctgatttcgcgtccgcaggcaggcgatctctcggactatattgccctgcgccacgatgaaggcgcgacggtgactgccgccccggacgacacgctttccaccgtgctggcccgcatgcgcctgtacgaaatctctcaactgccggtgctcgataacaacaaggtcgtcggcatcatcgacgagtgggacctgctgcgacacatcgggggagatgccgatcgcttctccctccccgtgacggcggccatgacgcgtcaggtcgaatatctggataagcaggccccggagagcgccctgtacgccatctttgaccgtggcctggtggcgattatttatgacggaaaccgctttctgggtttgatcacacgcagtgacgtactcaccgcctggcgtaaccgcctgacaaaataa

SEQ ID NO: 1329 - DNA, 1158 bp, Enterobacter cloacae
aaggagcaaaagatgaaaaacctggccaccctcagcgttcacagtggtgagtatcacgacccgcacggcgccgtgatgccgccaatttacgccacgtctacgtttgcgcaaccggcaccgggtgaacataccggctacgaatactcccggagcggcaacccaacccgccatgcgctggagaccgccatcgccgaactggaaggcggcacgcgcgggtacgccttcgcgtcagggctggcggccatttccaccgtgctcgaactgctggatcaagacagccatatcgtcgccattgacgacgtgtatggcggtacgtatcgcctgatcgaaaacgtgcgcaagcgcagcaccgggttacaggtgagctgggttaagccggacgatgtagccggacttgaggccgccattcgcccggacacgcgcatgatctgggtggaaacgccaacgaacccgctgctgaaactggccgacctggaggccatcgcggacattgcccggcgccataatgcgatcagcgtggcggataataccttcgcctccccggtcattcaccggccgctggaggcggggttcgacatagtggtccactccgccaccaaatatctcaacggtcattcagacgtggttgccgggctggctgttgtgggggcgaataaggatctggcggagcgtctgggctatctgcaaaacgcgattggcggcgttctggatccgttcagcagcttcctgacgctgcggggcattcgcaccctctcactgcgcgttgagaagcacagcgccaatgcgctggcgattgcgcaatggctggagcagcatccgcaggtagacagcgtgttctatcccgggctggcgtcacatccccagtatgcgctggcccgcagacaaatggcgctgccgggcggcatgatctccgttgtgattaaaggcgatgcgcagcgcgcgacagaggtgatccgtcatcttacgctctttaccctggcggaaagccttggcggtgtggagagtctggtgagccagccctacagcatgacccacgcctccattccactggcgcagcgtcttgcaaacggcattgtgccgcagcttatccgcctgtcggtggggattgaagatgcgaaggatctgatcgccgaccttaaacaagcgctgaaaaagtga

SEQ ID NO: 1330 - DNA, 855 bp, Enterobacter cloacae
gggcgggaagcccaccaaggtaaaggaggttttgagaaaatgggaattggagcatcactgaaacagttaggccctcagggaatgcagatcagcgacgacgtgaagggaacttctccggaccgccttacaggaacagacgtaatggcggcgattggtaccaccagcagccgtgcgcgcttcggcctggcggcgttcttcggtaaagcgggaatcagcaaaacggatgaacagctcgcagttcaggcgctggcgcgatatgcgatggatgtcgcaccgaagaatgttcgcaaagcagctggtgggcagttcggatggtgcatgcagatgctggcgcagtttgcctttgctgattactcccgttcggccgccaccagcgcgacgtgtcacagctgttgcggtaccgggcgaacaacccgcgagcagattacccgcaaagtttcttacccatggggtaaagcgccatactgggcctgccgctctcgtgctgttcgaccatctgactgggagcagtggacggaggtaacagaggttgtaccggcggtctgtgatgtttgcgaaggcaagggaacgatcagcgcccggtgcaggtgcggcggtaaaggtgaagtgctggatcgcaaagcgaccaaagaacgtggcgcaccggttttcaaaacgtgtgaacgttgctctggtaatggcttctctgctatctcctcggcgacggtacaccgtgccattctgaagcgtctcccggacctccatcagtcctcatggtcacgcaactggaaacccttttatgaaatgctggtggacacgctgcgccagggggagcgtcacgcggcagtagagtttgagaaggcgacaacttattaa

SEQ ID NO: 1331 - DNA, 363 bp, Enterobacter cloacae
gtgctaatgccagcggccatcccccgcgcctgtcgtaagcgtggctgctccgggactacaaccgaccgctctggatattgcgaacatcaccgcaatgaaggctggcagcagcatcagcgagggcagagcaggcatcagcgaggttatggcagtaagtgggacaggctgcgccaaatcgttctcgacagagataaacacctttgtcaggaatgcctgcgaaatggaaggtatacacccgctgagacggtggaccacatcaagccgaaagctcacggcggtactgacgatctctctaatctggaatcaatttgccgcggctgccataaagccaagacagcacgcgaacgcctgaacagaaattaa

SEQ ID NO: 1332 - DNA, 1770 bp, Enterobacter cloacae
cccgctggccgagtttatgaaagcgagggattaatggctaaggttgcagaaggcatccgctacgccgagagggtggtggcgggggaaattattgcctgtgagtatgtgcgccttgcctgtcagcgttttcttgacgatctggcacacggcgaagagcgcggtattttcttcagtgaaccgcgcgcgcagcacattctgaatttctataattttgtacctcacgtaaaaggcgcactggcagggcagcctattgagctgatggactggcatgttttcatccttattaatatttttggttttgttatcccgctggtgaacgaagagacgggggaaaccgtcctgcgtaatgacggcagcggtcggccggtgatggttcggcgttttcgtacagcagatgttgaggtggcccgtaaaaatgccaaatcaacgctttgctctggcgtggggctttatatggctggcgcagacggcgagggcggggcggaggtttattccgctgcaaccactcgtgaccaggcgcgaattgtttttgaagacgcgaaaaatatggtcaagaaggcgaaagccactcttgggcggatcttcgaattcaacaagctcgctatctaccaggagcaagccgcctccaaattcgagccattatcatcagatgcgaacaacctcgacggcctgaacatccactgcgccattgtcgacgagctgcatgctcacaaaacgcgtgacgtctgggacgttctggagacggcaaccggcgcgcgtctgcaatcgctgcttttcggtatcaccacagccgggttcaacaaagaaggcatctgctacgaattgcgtgattacgccatcaaggtgctgcgtgggctggtaaaagacgatacgttttttgccatcatctacaccttagatgaaggtgacgatccctttgatgaaaaagtctggcagaaggcgaatccggggctgggtatctgtaagcgctgggatgacctgcgccgcctggctaaaaaggcgaaagagcaggtttcggccagaattaactttttcaccaagcacatgaatatctgggttaccgctgagtcagcctggatggacatgatgaaatgggaaaaatgcgagtttatcgccccgcagcacgaacttaaaacctatccctcctgggtgggcgttgacctttcaaacaaaattgatatctgtgcggccgcgaaagtctggcgcgcgccagatggccacgttcatgcggatttcaaattctggctaccggaaggacgccttgagaaatgttcacgccagatggcagagctctatcgtaagtgggccgggatggacaagctgatccttaccgacggggatgtaatcgaccatgctcagattaaggaagagctacagctgtgggttgctggcgagagcctgaaagaaattggcttcgacccgtggagtgcgacgcagttcagcctagcgctggcagaagaagggttgccgctggtggaagtgccgcagacggttcgcaatttctctgaggcgatgaaagaggtcgaagcgctggtatacggtggccgattccatcacagcgatcacccggtgatgaactggatgatgtccaacgtaaccgtcaaaccggaccggaacgagaacatattcccgaataagtccacacctgaggccaaaattgatggccctgcggccttgttcacagcaatgagccgcgttctggttaacggtggcaacgaccagcaggatctctccggattcttcaataatcccatcatggtaggtttctga

SEQ ID NO: 1333 - DNA, 876 bp, Enterobacter cloacae
aacaggccgcttaggagcactttcctgatgagcaaaaaacaacttccggtagcaccggcgggtcgcccctgcgcgcgcgttacctgtgaaacattaccgtccgcactggaccgctgggacggcgggatcaaagctgcggccaccgacgacaacagtatttctgtttttgatgtgatcgggcaggactactggggtgaaggcgtaacagccaaacgtatcgccggtgcactacgggcgatgaatggcgccgacgtcacggtcaatatcaactcccctggcggtgacatgttcgaaggcctggcaatctacaaccttttgcgagaatacgaaggccgtgtgacggtgaaggtgctcggtattgccgccagcgccgcctcagtcattgcgatggccggggatgatattcagatcggtcgtggtgccttcctgatgatccacaactgctgggtctacgcgatgggtaaccgccatgactttgcggaactgtcacagtctctggagcccttcgataacgctatggcagacatctacgcggcgcgttccggccttgatatggcagctgttcagaaactgatggacgccgagagttatatcggtggcagtgacgctgtggcgaagggactggcagacagcctgctttctgctgatgcggtcagtgatggcgatgaatcacctgcggccgcgcttcgcaaacttgatgcgctgctggctaaaaccaacaccccgcgctctgagcgcagaaaactcattaaagccttatccggtggcatgcctggcgctgtcaccaccaacgacggtacgccgggcgctgccgaagatatcaaacctgaaaccctcaattcacttgaaaacgctcttgcggcgttagtcaaataa

SEQ ID NO: 1334 - DNA, 1221 bp, Enterobacter cloacae
ggaccatttatgtctgaagtaaacgaaattctgaaaaaagtcactgccagcattgaagatgcaaccagcaaattcaacgcgaaagcagaagaggcactgaccgaagcgaaaaagaatggtcagctctcagctcagaccaaagatgttgtagataaaatggcgacagagctcaacgctcttaaggaagctgaaaaaacccttaaggccagccttggtgagctggaacagcatgttgcccaaatgccattgaacaacgctgctaaagttaccgaaactgttggacaggtggtgattaatagcgaggcgctgaaggcctttgccgcgagcgttgaaggcaataagcgcgtaagcgtcccagttcacgcggccttgctttctacagatgttgcagatggcgtggttgaaccacagcgactgcctggcatcgacactgcaccaaaacagcgtctcttcattcgtgatctgattgcgcctggccgcacatcttcaccggctattttctgggtgcagcaaacgggctttaccaatgcagcgaaagtcgttgcagaggggactgccaaaccttacagcgatattgaattcgcaactaaaatcacgccggtgacaaccatcgcgcacatgtttaaggcatccaagcagatccttgacgatttcgctcaactccagtctacggttgacgctgagatgcgttacggcctgaaatatgttgaggaacaggaaatcttgttcggcgacggaactggtgtgcacctgcacggcatcgttcctcaggcctcagcattcgacccggcattttctgttgagagccagaacgggattgatgatctgcgcctggcaatgcttcaggctcaactggctcgtttccctgcatctggccacgttctgcacttcatcgactgggcgaaaattgagctcacgaaagacagtctgggccgctatatcctggctaacccggcatctctgactggccctacgctttgggggcttccggtggtagcaactgaggcagcagctttccagggcaaattcctgacaggcgcattcaatgccgcagctcaactgttcgatcgtgaagatgccaacgtggttatctccaccgaaaacgccgacgacttcgagaaaaacatgatctccattcgctgcgaagaacgtctggcgctggctgtgaaacgccctgaggcgttcgtttacggttcattcagcaccggcgcgggtagctga

SEQ ID NO: 1335 - DNA, 666 bp, Enterobacter cloacae
atgaaccgggagacaaagcaaatgctgaccctcagtaaattccagcaagcaacgggaaccagtgcggaactggccggaaagtggtttccagtcgtgctcgctgcaatgcagaagtacgacataagcacacctttaaggcaggcgcacttcctcgcacaggttgggcatgaatcatctggcttcgtgcgtgtggaagagagcctgaattaccgctacggcgcattgctggcaatgttcggcaatcgaatcagtcaggaagatgctttcagatatggtcgtgttgattctggccaaaatcctcatccggccgaccagaaaatgattggcagcatcatctacgccaaccggaacgggaacggtgatcgcaacagtggtgatggatatcgttaccgcgggcgcggcctgattcaggtgacggggaaagcgaattacgccgcgctggtgaagcagcttggcgttgatatcgtgaagagcccggaactgcttactcagcctcaatatgcggctgaatccgcagctgcctggtggagcaatcacggacttaacgctatcgctgactcagatgatgttagccgcatcaccagaatcatcaacggtggtaccaacggactggaggacaggaaagcccgcttgaccaaagctaagggggttttatgttcgggttaa

SEQ ID NO: 1336 - DNA, 948 bp, Enterobacter cloacae
atcatgggtcagaaaatcattacgttgtccggcgctgcgacggatgttctttatgcgctgtttttccgtggcgcgcttcagtctggtgacctaccagctaaatcaggcgctgctgagcttcgagagctgggattcgctgaaacacgccataccgcgacagagtatcaaaaggaaaattatttcaccttcctgacggctgaaggtcaggcgtttgccattgagcacctggccaatactcgttttggtgtgaagcagtattgcagcgcaatcaatattggagttgagctggataccacagacgcacaaaaggctattgatgatctggacgacaaaatccgaaacagcgatgcattcaaagtcctgaaagatggctggtctttcgaaaagaacgggacgctggtgattaataacggccaggtgttcattaccgatgcgaagattagcgatggcgtattgtctacaaactataacgtaaagttgaacgacgccgataaaggcaagccgcacgaagctggcatgaccctcggagttgaagaaggaaagcagcaggcaacgtttaaggctgatcgctttaaggtccatgaagccgctcaatcagccagcaataatgaagagacggccttcaatggtggtctggcttttggtggtttccctggggcaattagtcatgatggagctaatcccgctgatggcaataatgccaccgctgaaccaatcagttcaattgcttcagcgacaggcacagccaccaaggcgcgactaaccgacgagatgcaagaactggttctcaaggctgtacgtgaaagcgatctgttcacatcccttcagactgcgatagctgccaaggcagcgtcaaccgccggcctgcaacaggcagtgaatgacgcagtgagcaatgctattcgcaacgcactgaagcctggcggtctgctctatggtaagtgctaa

SEQ ID NO: 1337 - DNA, 486 bp, Enterobacter cloacae
gagttttcgattatgtctggaccaccgaaaaccccgacccatctacgtttggtgaggggtaacccatctaaacgcccgatcaatgagaacgaaccaaaacccccttcaggggtacccccaacgccgaagcatttcgacaagcaggggaaatactggtttaaacggatggccgacgagcttgatgctatcggtgtgatgtctcagctggacgccagagcccttgagctgctggttgaggcttataccgaataccggcatcactgcgacacgcttgaagttgagggctacacctaccggaccgaaacgcagaacggggatgtgctgatcaaggctcaccccgcagccatcatgaaagctgatgcctggaaacgtctgcgcgccatgcttggtgagttcggcatgacgccagccagccgcacgaaagtgaatgcaaaaggtcctgatgcggttgacccgctggccgagtttatgaaagcgagggattaa

SEQ ID NO: 1338 - DNA, 1326 bp, Enterobacter cloacae
tcccatcatggtaggtttctgatgaaaaaaaacaaacggccaggcagggttaaaagtgctctgcttaactggcttggtgtgcctatcagcctgactaccggcacattctgggaggaatggtttggtaccagcagcagcggaaaggtggtaacggccgataaagccatccagctatcggctgtgtgggcatgcgtaagactgttaagcgagtctatttcaacccttccgctgaaaatatacgttcgacagcctgacggttcgcgtaaagcggcaaccgatcatccggcctattcgatactgtgccgccgacccaattcagaaatgacaccatcacgctttatgttgatggtggtcgccagtatttgcctgcgcgggaacgccttcattgagaagaaattcatcgcaaaccgcctggtttcgctggtgcctttgctgccgcagaacatggtggttaaacgtctcacgaccggggcgctggaatacaaatacactgaaaacggtaacgagcgcgtcattcccgtcaaaaacatcatgcacattcgcgggttcggtcttgacggtgtttgcggcatgatgccgatgaaaacaggccgggatgtgatcggttctgcaatggcggttgaagagtccgcggcgaagatattcgaacagggcctgcaaagttcagggtttctctcttctgataaagctctggatgatactcaacgtgaaaaacttcgcggttacatggcggcgtttacaggctcaaaaaacgccgggaaaatcatggttcttgagggaggcttgacgtaccagggcgtaaccatgaacccggaagatgctcagatgctcgaaagccgcgcctttagcattgaggagatctgccgctggtttcgcgttccgcctttcatggtcggtcacaccacgaagcaaagtagctgggcatccagtctggagggcatgaacctccagttcctgacgcacaccctgcgacccctgctggtgaacatcgaacaggaaattggacggtgcctgctggacagcgatgatgaggttttcgcggagttctccgtagaaggactgctgcgcgccgacagcgcgggccgtgctgcgtactataccagtgcgctccagaatgggtggatgtcccgtaatgacgtgcgccgtcttgaaaatatgccaccgattgaagggggtgacatttacaccgttcagctcaacctgacgcaactgaaaaatctcgaaagcagcaatcctgctgttcaggctctggccctgagagagctgcataaccacatattccctgacatttcctttgaacaatctccgctgaaacaggccgcttag

SEQ ID NO: 1339 - DNA, 471 bp, Enterobacter cloacae
ataatatcgatctttttcaatagcttacgtgtttgcagagatctaattctcatgctaaaccttattctctctcaattatttaatgaaagaggtatagcaatgtcatggagagtcattagctcggtaatttgtcctaacacgggaatcgtttattcaagcatcttgggcctcaagttcttgaaactcattatttggtatgaaagcgatgtctatttgtaccccggtgacagaatatatccgacaaaaaatggcgtcttcattaatggtgtgttcaagcctatatcgatatataacatatcaccttataacgagatgttgtggagtgaaattaaaaacaagatggcatgcccatacaaccgaaaccagcaagaagagatatgcacatacgcggtgcattgcaacgcgcggaaatgcccgcatgggtttaccacgaatccactgattgtcagcacagctaaatccagacattaa

SEQ ID NO: 1340 - DNA, 1335 bp, Enterobacter cloacae
aagacgtgtagtgaagcccctgtttcggtgagattaatgaaaaagctgtttgtgcagttttaccttctgctgtttgtctgctttctggtgatgaccatgctggtcgggctggtctacaaattcaccgcagagcgcgcgggcagacaatccctcgacgatctgatgaaaagctcgctctacctgatgcgtagcgagttgcgagaaataccacctcatgactgggcgcgcacgttaaaagagctggatctgaatctgtcgtttgatctgcgtatcgaacccatgaaggattttgatttagcgccgcctgcgatgcagcgtctgcgcgatggagacatcgtcgcgctggacgagaaatataccttcattcagcgtattccgcgcagccattatgtcctggccgtcgggccggtgccctatctctattacctgcaccagatgcgcctgctggatctcgccctgctgggctttattgccatctcgctcgctttccctgtattcatctggatgcgaccgcactggcaggacatgctgaaactggaatccgccgcacagcgttttggggagggtcatttaactgaacgcatacatttcgacagtggttccagttttgaccggctcggtattgcctttaaccagatggccgataacatcaacgccctgattgccagcaagaagcagctgatcgatggcattgcgcatgaactgcgcactccgctggtacgcctgcgttatcgcctggagatgagcgagaacctcaccggggcggaatcgcaggcgctcaatcgggatattggccagcttgaagcgctgattgaagagctgctgacctatgcccgcctcgatcggcctcagacggagttgcacctcagtacaccggatctccccgtctggctacagacgcatattaacgatgtgcagagcgttaaccctcagcgaaaactgctgacagccattacccccggcgcgtacggcgcactggacatgcgcctgatggaacgcgtgctggataatctgatgaacaacgccatgcgctacagcgaaacgacgctgcgcataggtttagatttgcagggaagccaggcgattctgtgtgtggaagacgatggccccggcattgagccggcggagcgtgaaaaagtttttgagccgtttgtgcgcctcgatcccagccgcgaccgggctaccggcggctgtggtctggggctggctattgtccgttctattgcccaggcgatgggcggttcggttcgctgcgaagcgagcgagctgggtggggcccggttcgtctttagctggccgatctatcacaacattccccttcccgtacctgcctga

SEQ ID NO: 1341 - DNA, 1419 bp, Enterobacter cloacae
ttattctggatttggacttttcataacaggaagccaatggaaaagaaacttggcctgagtgcgttaactgcacttgtattgagctcaatgctgggcgcgggcgtattcagtttgccgcagaacatggcggccgtcgccagcccggccgcattactgattggctggggcattaccggtgttgggattttgctgctggcattcgccatgctgctgctgacccgtatccgaccggatctggacggcggaatattcacttacgcccgggaaggtttcggcgagctgatcggcttctgctccgcctggggttactggctgtgcgcggtgatcgccaacgtctcctatctggttatcgtcttctcggcgctcagcttctttaccgatacgcccgaactgcgcctgtttggcgacggtaatacctggcagtccatcgtcggcgcctcggtactgctgtggattgttcactggctgattttgcgcggcgtccagaccgcggccagcattaacctcgtggcaacgctggccaagctggtgccgcttggcctgttcgtcgtgctggccttcctcgccttccgtctcgatgtctttacgctcgatttcagcggcattgcgctgggcgttcccgtctgggaacaggtgaaaaataccatgctgatcaccctgtgggtgttcatcggcgttgaaggtgccgtcgtagtctctgcccgcgcgcgtaacaagcgcgacgtgggacgcgccacgctgctggccgtactggcggcgctgggcgtttatctgctggtgacgctgttgtcgctcggcgtggtggcacgccctgaactggcggaaatgcgtaacccgtccatggccgggctgatggtgaaaatgttgggtccctggggagacgtgattatcgcggcgggtctgattgtctccgtttgcggcgcctatctgagctggaccattatggcagcggaagtgccgttcctggccgccacgcataaagcgttcccgcgcctgtttgcccgtcagaacaaaaacagtgcgccatcggcctctttgtggctcaccaacatcagcgtgcaggtctgtctggtgctgatctggctcacaggatcggactataacacgctgctgaccatcgcctccgagatgattctggtaccctatttcttagtgggcgcatatctgttaaaaattgcgacccgcccggcacactatgcggtaggtgtcggcgcctgtatttacggtctatggttgttgtatgcttccggaccgatgcatctgctgctgtccgtggtgctctacgcaccgggcctgctggtgtttatctacgctcgccgtacgcatcagcttgataatgcccttaagcgccgcgaaatggcgttgataggtttgctgttagtcgctgccgtaccggcaacgtggatgttaatgggatag

SEQ ID NO: 1342 - DNA, 735 bp, Enterobacter cloacae
actgaaaaggagattacgatgggacacacgcagcaacgcccaatattgatcactggcgcaggccgtcgcatcggcctcgcccatcactttctcaaccttcgccatccggttatcgtcagttaccgcacggaatatccctccattgaaggtctacgaaatgccggagcagtctgcattcaggcggatttctccacggatgaaggtatactcgccttcgcggacaaagtgaaatcgaccacccacgggctgcgggcggttattcacaacgccagtacctggcttcctgaaaaagcaggacattcgctcagcgaaacgctcgcctgcatgatgcagatccacgttaatgcgccttatctgctcaaccatgccctacaggatctgctgcgcggacacggtcatgccgcaggcgacattatccatttcaccgattacgtggtagagcgaggaagcgacaaacacatcgcctatgcggccagcaaagccgcgctggataatatgacccgctctttcgcacgcaagctggcgcccgaggtaaaggtcaacgcgattgctccggcgatgattttatttaacgaaggcgatgatgccgagtatcgtcagcaggcgctcaacaagtcgttaatgaaaattgcgcccggtgagaaagaggtgatcgacctgatcgattatctgctgaccagctgttacgtcacgggccgaacgtttgccgtggacggtggccgcccgctgcgctag

SEQ ID NO: 1343 - DNA, 765 bp, Enterobacter cloacae
gattgcgcggtgtatgttgacgttttttgcgatgacagacgttgtatgaataagattgtttatgttgaagatgaacccgaggtggggcaactgatcgccgcttatctgggtaaacatgatatggaagtggttgtcgagcctcgtggcgatcgcgctgaagacgtcgtgacccgcgaaaatccggacctggtgttgctggacatcatgctgcccggaaaagatggtatgacgctatgccgggatctgcgcacgaagtgggacggtccgatcgtgctgctgacctctctcgacagcgatatgaatcatattctgtcgcttgagatgggcgcgaatgactacatcctgaaaaccacgccgccagcagtcctgcttgcccgtttgcgcctccatctgcgtcagcgtgccagcggcgcggagcgtgaagcgtctgccccctctttaacgccgcacaaagcgatgcgcttcggcacgctttctatcgacccggtcaaccgacaggttatgctttccggggagctgattgcgctctcaaccgcagattttgacctgctgtgggagctggcaacccatgccggtcaaattatggaccgggatgcattactgaaaaatctgcgcggcgtaagttacgacggaatggatcgtagcgttgatgtggcgatttcgcgtctgcgtaaaaaactgctagataacgccacggaaccttaccgcattaaaaccgtacgcaataagggctatctgtttgcaccgcacgcctgggaaacctga

SEQ ID NO: 1344 - DNA, 990 bp, Enterobacter cloacae
caacaacaccagtacatggtttgcgcaaggcgaaggattatttttatgaagcttaagaacacactcctggcgtccgcacttctttccgcgaccgccctgtctgcgaatgccgcgacagagttgacgccggagcaagcggcagcgttaaaaccttttgaccatacggtcattgtgggtcgctataactctattggcgatgccgtcgccgccgcatcaaaagccgccgataaaaacggcgctgcctcgttttacgttgttgaccagtccgatcaaggcaacagcggcaaccagcgcgtgacgattgcgctgtacaaagataatgccccaaaagcagatgaacagaaaaaccgcgtgattaacggcattgttgaactgccgaaagatcaggctgttcagctggaaccgtatgacaccgtgaccgttcagggcttctaccgcagccagcctgaagttaacgatgccatcaccaaagccgcgagagaaaaaggcgcttacgcgttttatatcgtgcgtcaggttgatgccaaccagggcggaaaccagcgcatcaccgctttcatctataagcaagatgcgaaaaaacgcgtagtgcaaagcccggatgccattccagcggattcagatgcgggacgtgccgcgttagcgaaaggcggtgaagaagcgaagaaagtggaaattccgggcgtagcaacgtctgcggcaccaagcgctgaagtgggtcgtttctttgaaacccaatccaccaaaggcggtcgttataccgttacattaccagacggcacgaaaattgaagagctgaacaaagccactgccgcgcagatggtgccgttcgacagcatcaagtttacgggcaactatggcaacatgacggaaatctcctatcaggtggcgaagcgtgctgcgaagaaaggcgcgaagtattaccacatcacccgtcagtggcaggaacgtggtaacaacctgaccatcagcgccgatctgtacaagtaa

SEQ ID NO: 1345 - DNA, 942 bp, Enterobacter cloacae
ttaagggctgccatgacaacttacgatctcatcgaaaggcttaacaccacatttcgggaaatagagcaggcgttactgaccctcacggggcaacttcaggactgccgcctgctggccgcccgcgtcttttccctgcccgaggtggcaaaaggcgcagaacacgacccgctgaacaccattgaggtgacgcagcatgttggcaaggcggcgctggaaatgacgttgcagcactatcgtcgccttttcatccagcagcagtccgaaaatcgcagcagtaaggccgccgttcgcctgcccggcgtcatctgcttgcaaacggatgccgcaacgcgtgaaggaattgaggcgcagattacgcatatcaatacgctaaaagccgcctttgagaagattgtaaccgttgagtccgggctggcaccggctgcccgttttgaatgggtgcatcgccagcttccggggctgatcaccctgaatgcctaccgcacgctgacggtactgcgccatcccgccacgctgcgcttcggctgggccaacaagcacatcattaaaaatttcgcgcgggacgagatcctggcgcagctggaaaaaagcctgaaatcgccgcgaacggtcgccccgtggtcgcgggaacagtggattgaacggctggagcaggagtaccacagcattgcctccctgccagctgatacccgtcttaaaataaagcgtccggtgaaggtgcagcctatcgcccgtgtctggtatgccggtcaacaaaagcaggtgcaatacgcctgcccgacgccgctgattgcgctctatgatgccgatcagggtgcggtggtgccggatatcggggaactgctgaactacgatgctgaaaacgttcagcatcgatataaaccccaggcgcagccgctacagctgattattccgcggctgcacctgtatgtggcgcagtga

SEQ ID NO: 1346 - DNA, 1215 bp, Enterobacter cloacae
tacgcggagttaattccacatatgaatcagggcttgataatgcaaaaactcatcaactcagtgcaaaactacgcctggggaagtaaaactgcgttaacggatctctacggtatcgccaacccggacaacctgccgatggcagagctgtggatgggcgcgcacccgaagagcagctcaaaaattgaagatgccagcggtcaggttcgcagcctgcgtgacgtcatcgacgccgacaaagccgcactgctcggcgataaagtggcgaatcgttttggtgagctgccgtttctgttcaaggtattgtgcgccgaccagccgctctccattcaggttcacccgaacaaaaaagcctctgagctgggctttgccaaagaaaatgccgccggtattccgttagacgccgtagagcgtaactacaaagatcctaaccacaagccggaactggttttcgccctcaccccttttctggcgatgaatgccttccgcgagttttccgagatcatctccctgctgcaaccggtcgccggggctcacaacgcgatcgcccacttcctggaaaacccgaacgcagaagccttgagcgagctgtttgccagcctgctgaatatgcagggcgaggaaaaatcacacgcgctggcggtgctgaaagccgcgctgaacagccagcagggtgagccatgggacaccattcgcgtaatttccgcgttttatccggacgacagcggtctcttctctccgcttctgctgaacgtggtgaagctcaacccgggcgaagcgatgttcctgttcgctgaaaccccgcacgcctacctcaacggcgtggcactggaggtgatggctaactccgataacgtactgcgcgcgggcctgacgccaaaatacatcgacatccctgagctggttgccaacgtgaagtttgtggcgaaacctgctgcggagctgcttactcagccggtgaaaaacggcgcagagctggacttcccgattccggttgacgattttgccttctccctgcacgacctcagcgcagacgaaaccgccattgcacaggagagcgccgcgatcctgttctgtgtggaaggcgaagcgacgttgcacaaagatagcgatcgtctggtgctcaaaccgggtgaatccgcctttgtcgcagcaaacgagtcgcctgtccgggtgagcggcaccggtcgcctggcgcgtgtttttaataagctttag

SEQ ID NO: 1347 - DNA, 1608 bp, Enterobacter cloacae
  unsure (1581)
ccgcctggtttcattttagggataatcgcaatgaaaaaatcggtcgtagcggtaggagtgattgttgctttaggcgtgatctggacgggtgcttcctggtataccgggaaacagctggaaagccgtctggcagagatgatgacgcaggcaaacagcgagattaagcgcagcgcgcctgaagcaggtctggagctgagctatcagaactaccagcgtggcgtgtttaccagccatatgcaggtggtggtgaagccggttgcgggtaatcagaacgcctggctgaaaccgggccagagcgtggtgctggatgaagtggtcagccacggtccgttcccgctggcgcagttgaaaaagtttaacctgatcccctctatggcatccgccagaaccgtactggtgaataacgaggtgacgaagccgattttcgatatggcgaaaaatgagtcgccgtttgagatcaatacccgcatcagctatgccggtgatacgcattccgacatcgacctgaaagccctgaattacgaacaaggcactgataaagtcgccttcagcggcggtaatttccagcttgatgccgatcgcgacggcaagaatgtctccctgaccggcgatgccgccagcggcctggtgaattcagtcaatgaatataaccagaaggtgcagcttaccttcaacaacctgaaagccagcggcaatagccgtatgactgattttgatgagcgtatcggcgaccagaaactgagcctcgataagatcgccattgcgatcgaaggcaaagagatggcggtgcttgaaggcatggatctggacggtaagtctgacgtgtccaaagacggtaaaagcatcaacacccagctggattacagcttgaaaagcctgaaagtacagaatcaggatctgggtaccggtaagttgtccctgaaaatcggcaacattgacggccaggcgtggcacgaattcagtcagaaatacagtaaagagagccaggctctgctgaccgatgccgccctgcaacagaacccacaggcttaccagcagcaggcgatgacggtgctgtttaataacctgccgatcctgctgaagggcgagccggtgattaccgttgcgcccctgagctggaaaaacggcaaaggcgaaaccaacttcaacctgtcgctgttcctgaaggatccggcagccacgaccggcgagccgcagaccctggcgcaggaagttgaccgcagcgtgaaatcgctcgacagcaagctgaccatcccgatggatatggcaaccgagttcatgacgcacattgcgaaactcgaagggtatggtgaagaagatgcaggtaaactggcaaaccaacaagtgaaaggcctggcggcgatgggccacatgttccgcatcacgaaggtggaagacaacaccatttccaccagcctgcaatatgctaatggccaggtgacgctcaacggcgacaaaatgccgctggaaacagtttgtcagtatgtttggtatggccgaacgctgggcatgcctgaaccggccgaaacggctgcgccgccggcagtaccgcagcagtatacgaaaaacccctcgcatgangggttttttattgccgggtggcgctga

SEQ ID NO: 1348 - DNA, 345 bp, Enterobacter cloacae
gggaaaagaatggggctggtgataaaagccacgctgggtgcgctggtcgtgctgctgattggggtgctggctaaaacgaagaactactacattgccgggctgatcccgctgtttcccacctttgcgttaatcgcgcactatattgtggcctctgagcggggtattgaggcgctgcgcgccaccattgtgttcgggatgtggtcgatcatcccgtattttatctatctgctgtcgctgtggtacttcaccggttttctgcgtctgcccctggcgctgggcggggcggtggtctgttggagcctcagcgcctgggtgcttatcttcttctggagccgctttcactag

SEQ ID NO: 1349 - DNA, 1398 bp, Enterobacter cloacae
gtaatgacaatgcatcgccgcgagaaagactccatgggcgccatcgacgtcccggccgacaagctatggggcgcacaaacccagcgttcgctggagcatttccgcatttcgacagagaaaatgcccgtctcgctaatccaggcgctggcgttgaccaaacgcgctgccgccaaagtcaatcaggatctgggcctgctggatgccgataaagccaccgccatcatcaatgccgccgacgaagtgctggcgggcaaacatcccgacgaattcccccttgccatctggcagaccggctcaggcacccagagcaacatgaacatgaacgaggtgctggcgaaccgcgcaagcgagctgcttggcggcctacgcggcatggagcgcaagatccacccgaacgatgacgtgaacaaaagccagagttccaacgacgtgttcccgacggccatgcacgtggcagccgtcatcgcaatccgcgagcagcttatcccgcagctcaacgtgcttaaatctacgcttaacgagaaagcgcaggccttccgcgacatcgttaaaattggtcgtacgcaccttcaggacgccacgccgctgacgctcggccaggagatctccggctgggtggcgatgctggagcacaaccttaagcatatcgacaacagcttgccgcatctggcggagctggcgctcggcggaacggcggtgggcactgggttaaacacccatcccgagtacgcggtgcgcgtggccgaagagctggcgaagattaccgggcagccgtttgttaccgctccgaataaattcgaagcgctggcgacctgtgatgccctggtgcatacccatggcgcgctgaaagggctggcggcctcgctgatgaaaattgccaacgacgtgcgctggctggcctccggcccgcgctgcggcatcggcgaaatcagcattccggaaaacgagccgggcagctccattatgccgggtaaagtgaacccgacccagtgcgaagccatgaccatgctgtgctgtcaggtgatgggtaatgacgtggcggttaacatgggcggcgcgtcgggtaacttcgagcttaacgtctatcgtccgatggtgatccacaacgtactgcaatcgattcgtctgctggccgatggcatggagagctttaacgagcactgcgcggtgggcattgagcctaatcgcgagcgaatcagccagctgctgaatgagtctctgatgctggtaacggcgctgaacacccatattggttatgacaaagcggccgaaatcgctaaaaaagcgcacaaagaggggcttaccctgaaagcctctgcgctggcgctgggctacctgacggacgccgagtttgatgcctgggtccgaccggaagcgatggtgggcagcctcagataa

SEQ ID NO: 1350 - DNA, 1716 bp, Enterobacter cloacae
ctcgcttttaagccgggcagcggaacatctgccctgaataaacagaccgaagcagtaagtgagagaacaatgtcgaataaacccttccattatcaggatcctttccccctcagtcaggatcagaccgagtattatctgttaacccgcgattacgttactgtctctgagtttgaagggcaggagatcctcaaagttgacccgcaggggctgacgttgctggcgcagcaagccttccatgatgcttcctttatgctccgtccggcgcatcagcagcaggttgctgatatcctgagcgacccggaagccagcgagaacgataagtacgttgccctgcaattcctgcgtaactctgatatcgcggcgaaaggcattctgccgacctgccaggacaccggcacggcgattatcaccggtaaaaaaggccagcgcgtctggaccggcggcggtgacgaagcgacgctggcgcgcggcgtttacaatacctacaccgaagacaacctgcgctattcgcaaaacgcggcgctggatatgtacaaagaggtgaacaccggcactaacctgcctgcgcagattgacctctacagcgtcgacggtgacgagtacaaattcctctgcatcgccaaaggcggcggttcagccaacaaaacctatctttaccaggaaaccaaagcgctgcttaccccgggcaagctgaaaaactacctggtcgagaagatgcgtaccctcggcaccgcggcctgcccgccgtaccatatcgcatttgtgattggcggtacgtctgccgaaagcaccctgaaaaccgttaagctggcctcaaccaaatactacgatggcctgccaacggaaggtaacgaacatggtcaggcgttccgcgacgtgcagcttgagcaggaactgctggccgaagcgcagaacctggggctgggcgcgcagtttggcggcaaatacttcgcgcatgacattcgcgtgatccgcctgccgcgccacggtgcttcttgtccggtggggatgggtgtttcctgttcagcggaccgtaacatcaaagcgaagatcaaccgcgacggcatctggatcgagaagctggagaacaacccgggcaaatacatccctgaagaactgcgtaaagcgggcgagggggaagcggttcgcgtggacctgaatcgtccgatgaaagagattctggcgcagctttcgcagtatccggtctcgacgcgcctttccctgaacgggacgattatcgtgggccgcgacatcgcccatgcgaagctgaaagagcgcctggacaacggcgaagggctgccgcagtacattaaagatcacccgatctactacgcaggtccggcaaaaacgcctgatggatatgcttccggctcgttaggcccaaccacggcgggccgtatggactcctacgtcgaccagttacaggccaacggcggcagcatgatcatgctggcgaaaggcaaccgcagccagcaggtgacggacgcgtgccacaagcacggcggcttctacctcggtagcatcggtggcccggcggcggtgctggcgcagggcagtatcaagagccttgagtgcgtggagtacccggaactgggtatggaagcgatctggaaaattgaagtggaagacttcccggcgttcatcctcgtggatgacaaaggtaacgacttcttcaaacagatccagtcttcccagtgttcggcgtgtgtgaagtaa

SEQ ID NO: 1351 - DNA, 939 bp, Enterobacter cloacae
gagtttaagatggttaaagtatatgccccggcttccagcgccaatatgagcgtcggatttgacgtgctgggcgcggcggtaacgccggtggacggttcgctgctgggcgatacggttacggttgaggcggcagagcgcttcagcctgaataacatcggccgtttcgccagtaagctgccgtctgaaccgcgcgagaatattgtttatcagtgctgggaacgcttctgtcaggagatcggcaagaacgtgccggtcgccatgacgctggaaaagagcatgccgattggttcggggctgggctcgagcgcctgctcggtggtcgccgcgctggtggcgatgaatgagcactgcggcaagccgctgaacaacagccgtctgctggcgctgatgggcgagctggaagggcgcatctccggcagcattcattatgataacgtggcgccgtgcttccttggcggcatgcagctgatgattgaagaaaatggcatcatcagccagcaggtgccagggtttgatgagtggctgtgggtgctggcctatccgggcattaaagtgtctaccgccgaagcgcgtgcgatcctgccggcgcagtatcgtcgtcaggactgtattgcccacgggcgtcatctggcgggctttattcatgcctgctacacccgacagccgcagctggcggcgaaactgatgaaagacattattgccgagccgtatcgcacgaagctgctgccgggctttaacgaagcgcgacaggcatccatggatatcggcgcacaggcgtgcggcatctccggctccggcccgacgctgttcgccttatgcgacaagccagacaccgcgcagcgcgtggcggactggctctctaaacactacctgcaaaatcaggaaggctttgttcatatttgccgtctggacacggctggcgcacgagtactgggataa

SEQ ID NO: 1352 - DNA, 1290 bp, Enterobacter cloacae
cgaatgaaactctacaaccttaaagatcataacgagcaggtcagctttgcgcaggcggtaacgcaggggctgggcaaaaatcaggggctgttcttcccccacgacctgccggaatttcagctgaccgaaatcgatgaactgctgaagcaggactttgtcacccgcagcaccaaaattctgtctgcgtttatcggcgacgaaatcccacaggagctgctggaagagcgcgtgcgtgcggcgtttgctttcccggcgccggtgaagcaggtggagcctgacgttggctgtctggagctgttccacggcccgacgctggcgttcaaagatttcggcggtcgttttatggcgcagatgctgacccacatcagcggcgacaaaccggtgaccattctgaccgcgacttcaggcgataccggtgcggcggtggcccatgcgttctacggcctgaaaaacgtccgcgtggtgatcctctatccgaaaggcaaaatcagcccgcttcaggaaaaactgttctgcacccttgggggcaacattgaaaccgtggcgatcgacggcgatttcgatgcctgtcaggcgctggtgaagcaagccttcgatgacgaagagctgaaggcggcgctggggctgaactctgccaactccatcaacatcagccgtctgctggcgcagatctgctactacttcgaagcggtggcgcagttgccgcaggacgcgcgcaatcagctggtggtttccgtgccaagcgggaacttcggcgacctgacggcaggcctgctggcgaaatcactcggcctgccggtgaagcgctttatcgccgccaccaacgccaacgacaccgtgccgcgtttcctgaaggacggaaaatgggcgccgaacgcgactcaggccacgctctccaatgcgatggatgtgtcacagcctaacaactggccgcgtgtggaagagctgttccgccgtaaggtctggcgtctgggcgatctgggttacgcagcggtgacggacgaaaccacgaaagccaccatgcgcgagctgaaagcggtgggctatacctctgagccgcacgcggcgattgcctatcgtgccctgcgcgatcagcttcaaccgggtgagtatggcctgttcctcggcaccgcccatccggccaagttcaaagagagcgtggaagcgatcctgggggaaacgctgccgctgccaaaagagctggccgagcgcgccgacctgccgctgctgtctcatgagctgcccgcagactttgccgcgctgcgtaagctgatgatgacccgagcgtga

SEQ ID NO: 1353 - DNA, 969 bp, Enterobacter cloacae
aagagaaacactatcatgacggataaattgacctcccttcgtcagttcaccactgtcgtcgctgacaccggagatatcgcggcaatgaagctgtaccagccgcaggatgccacaaccaacccttctctgatccttaacgccgcgcagctccctgagtatcgcaaactgatcgacgaggcggtgacctgggcaaaagcacagagcaatgaccgcgcgcagcaggttgtggatgccactgacaaactggcagtgaacatcggtctggaaatcctgaagctcgttcctggccgtatctctaccgaagttgatgctcgcctgtcctacgacaccgaagcctctatcgccaaagcaaaacgcctgatcaaactgtacaacgatgcgggcatcagcaacgaccgtatcctgatcaaactggcctctacctggcagggcatccgcgccgctgagcagctggaaaaagaaggcatcaactgtaacctgactctgctgttctccttcgcacaggcgcgtgcatgtgccgaagctggcgtatacctgatttctccgttcgtgggccgtattctggactggtacaaagccaacaccgacaagaaagagtacgcggcgtctgaagatccaggcgtgatttctgtgactgaaatctacgaatactacaaacagcacggctatgagaccgttgttatgggcgcaagcttccgtaacgtcggcgaaatcatcgagctggctggctgtgaccgcctgaccatcgcccctgcgctgctgaaagagctggcagaaagcgaaggtgctatcgagcgtaaactgtcttacactggcgaagtgaaagcgcgccctgagcgcatcaccgagtccgagttcctgtggcagcacaaccaggatccaatggccgtagataaactggcggacggtatccgtaagtttgctatcgaccaggaaaaactggaaaaaatgatcggcgacctgctgtaa

SEQ ID NO: 1354 - DNA, 537 bp, Enterobacter cloacae
cccgagcgtgatttttgtcgggtggcagctacgccttaccgggcctacaacggctcagaacgtaggccgggtaagcgcagcgccacccggcttttttatggagaaattaaggagaaaaacagcaggaaaaaagcagaaattcccaataaatgcggtcacttagcgtttaggattgcagagaataacatcccccgttcccatcacgtactctccttacatcggcccacgttgggcaagaagaataaggagtcacctatgtctacactgaaacctgcacttatcgcgctttcactgatgctggtcgctccgatggcggtgcaggcagctgaaatcaccctcgtgcccgcggtaaaactgcaaattggcgatcgggataataacgggcactactgggatggcggccgctggcgcgaccatgactggtggaaagcgcactatgactggcgggataaccactggcgtccgcacgatgaacatcgcgatcgtgacgatcaccaccgtcatgacgatcgtcgcccggaccggaagcattattaa

SEQ ID NO: 1355 - DNA, 1350 bp, Enterobacter cloacae
tccacaacacatgcacaatggttcgctatgtcacataatacccgacctctgaatcgacaggactacaaaaccctcacgctcgctgccctgggcggcgcgctggagttttacgatttcatcatatttgtcttcttcgccgccgttgtgggggcgctgtttttcccggcggatataccggaatggctgcgtcaggtgcaaaccttcggcattttcgctgccgggtatctggcgcgtccgctgggcggcattgtcatggcgcactttggcgatctggttgggcgcaagaagatgtttaccctcagcatcctgcttatggccgtgccgacgctggcgattggccttttgcctacctatgagtcgatgggcattatcgccccgttattgctgctgctgatgcgtattctccagggcgcggccatcggcggggaagtgcctggcgcgtgggtgtttgtcgctgagcacgtcccggtgcgccgcatcggcattgcgtgcggaacgctgaccgcagggctgacgatagggatcctgtttggctccgtagttgcaaccatcatcaataccagcatgacgcaacaggccgttcacgactggggctggcgtataccgttcctgctgggcggggcgtttgggctggtggcaatgtacctgcgacgctggttgcaggagacgccaatatttctggaaatgcagcagcggaaggcgctggcgcaagaactgccggtgaaaaccgtagtagtgcggcataaaaaagcggtagtcgtgtcgatgcttctgacctggctgctgtctgcgggtatcgtggtggtcattttgatgtcgccggtctggctgcaaaaacagtacggttttgcgcctgccgtgacgttacaggcgaacagtatcgcgacaattatgctctgctttggctgtctggccgccgggctggcggcggatcgtttcggcgccagcgtgacctttattgtcggcagcctgctgctggccgcgtcgagctgggcattctatcatcttgcgggcacccatcctgaacagctgttcctgctgtacggtgtcgtcgggctgtgtgtgggcgtcgttggcgccgtaccgtacgtgatggtccgcgcctttccgccggaggtacgcttcaccggaatctctttctcttataacgtctcgtatgccattttcggcgggctgaccccgattgtggtgacggtgttgatggggctgtcgccccttgcacctgcgtggtacgtgctggcgttatcgctgatggggctggtattggggatgtggcttcgccagtcagagggacgtcgtgcccgcgacgcgggcacgacagagggatcagtgtttttcaccaatcggtag

SEQ ID NO: 1356 - DNA, 2466 bp, Enterobacter cloacae
aacatgcgagtgttgaagttcggcggtacgtcagtggcaaatgcagaacgttttctgcgtgttgccgatatcctggaaagcaacgccaggcaggggcaggttgccaccgtgctctctgccccggccaaaatcactaaccacctggtggcgatgattgaaaaaaccatcggtggtcaggatgcactaccgaacatcagcgacgccgagcgtatcttcgccgatctgcttcaggggctggccgacgcccagcctggtttcccgctggcgcagctgaaaagcaccgttgaacttgaatttgcccagattaaacacgttcttcacggtatcagcctgcttggccagtgcccggacagcatcaacgcggcgctgatttgccggggtgaaaaactctctatcgccatcatggcaggcgtgctggaagcgcgcggtcaccacgtgacggtcatcgatccggttgaaaaactgctggctgtgggccactaccttgaatccaccgtcgacattgccgagtcgacacgccgtattgcggcgagcaaaatcccgtctgaccatatgatcctgatggcaggctttaccgccggtaacgagaagggcgaactggtggtgctggggcgtaacggctctgactactccgctgcggtgctggcggcctgtttacgcgcagactgttgtgagatctggactgatgtcgacggcgtttatacctgcgatccgcgccaggtgccggatgccaggctgctgaagtcgatgtcgtaccaggaagcgatggagctttcctacttcggcgctaaagttcttcacccgcgtaccatctccccgattgcccagttccagatcccttgcctgattaagaataccggtaatccgcaggcgccgggcacgctgattggcgccagcgcggatgaagatgacctgccggtgaaaggcatttctaacctcaataacatggcgatgttcagcgtctccggcccggggatgaagggcatggtcggcatggcggcacgcgtctttgccgctatgtcccgcaacgggatctccgtggtgctgatcacgcagtcttcttccgaatacagcatcagcttctgcgttccgcagggcgattgcctgcgcgcccgtcgcgcgctggaagaagagttctatctggagctgaaagaagagctgctggagccgctttccattcaggagcgtctggcgattatctcggtggtcggcgacggtatgcgcaccctgcgcggtatctccgccaaattctttgccgcgctggcgcgggccaatatcaatatcgtggcgattgcccagggctcatccgagcgttccatttccgttgtcgtggataacgatgacgccactaccggcgtgcgcgtggtgcatcagatgctgttcaacaccgaccaggtgattgagctgttcctggtgggcgtcggcggcgtcggcggcgcgctgctggagcaggtaaagcgtcagcaggagtggcttaagaagaaacatatcgatctgcgcgtctgcggcattgcgaactcgaaagcgttgctgactaacgtccacggtctgaacctggaaaactggcaggcggagctggaagaggcgaaagagccgtttaacctgggccgcctgatccgtctggtgaaagaatatcacctgcttaacccggtgatcgttgactgtacctccagccaggcggtggccgatcagtacgcggatttcctgcgcgaaggtttccacgtggtgacgccgaacaaaaaggccaacacctcgtcgatggattactatcaccagctgcgtctggcggcgagtaagtcgcgccgcaagtttctgtatgacaccaacgtgggcgcgggcctgccggtcatcgagaacctgcaaaacctgctgaacgcgggcgacgaactaaagcgtttctccggcatcctctccggctccctgtcgtttatcttcggcaagctggacgaagggatgagcctgtcggaagccacccgcgccgcgcgcgagctgggctacaccgagccggatccgcgggacgacctctccggtatggacgtggcgcgtaagctgctgatcctggtgcgcgagaccggccgcgagctggagctttcggatatcgtgattgagccggtgctgccagcagaatttgatgacagcggtgacgtcagcgcctttatggcgaatttacctcagcttgacgatgcctttgccgcacgcgttgcgaaagcccgtgatgaaggtaaggtattgcgctatgttggcaacattgaagaagacggcgtctgccgggtgaagattgccgaagtggatggcaacgatccgctgtacaaggtgaaaaacggcgagaacgctctggcgttctacagccattattatcagccactgccgctggtgcttcgcggctatggcgcagggaatgatgtgacggcggcaggtgtgtttgccgatctgctgcgtaccctgtcatggaagttaggagtttaa

SEQ ID NO: 1357 - DNA, 750 bp, Enterobacter cloacae
gtttgctatcgaccaggaaaaactggaaaaaatgatcggcgacctgctgtaatcattctgcgtgaccgggttcccggtcacgcgtctttcccccgcctctgtctgaattttctctctgcgtgtatcattccctttaatcagtactttttgaatggaatggatatgaataccttacgcatcggcttagtgtcgatctctgaccgcgcctccagcggtgtttatcaggataaaggcatccctgctctggaagcgtggctgggcagcgcgctcactaccccgtttgagatccagactcgcctgatcccggacgagcagccgatcattgagcaaaccctgtgtgagctggtggatgagatgagctgccaccttgtgctgacgacgggcggcaccggccccgcgcgccgcgatgtgacaccggacgcgacgctggctatcgccgatcgtgaaatgccgggcttcggtgaacagatgcgccagatcagtctacactttgtcccgacggccattctttcccgtcaggtcggggtgatccgcaaacaggcgctgatcctgaacctgccggggcagccgaagtcgataaaagagacgctggaaggggtaaaagccgaggacggcagcgttatcgtccacggtatctttgcaagtgtaccgtattgtatacaactgcttgacggtccgtacgtggaaactgacggcaacgtggtagcagcatttcgccctaaaagcgctcgccgcgaaacaatctcctga

SEQ ID NO: 1358 - DNA, 1500 bp, Enterobacter cloacae
gtaacagcatgcacaatcagtggtagcgcttacatattcactttggcatcaacaagagggacgttagtgcctgatttctttttctttatcaacgaagtcctctggggttcgatcatgatatacctgctttcaggagcaggtatctggtttacgtggcgcagcggtctgattcagtttcgctatatccgcaaatttggcagaagtctgaaaaacagcgtcaccccacagccgggcggcctgacctcgtttcaggcgctctgtactagccttgccgcgcgcgtcggcagcggtaacctggccggtgtcgcgctggcgatcggcgcgggcggtccgggcgcggtattctggatgtgggtgacggcgattatcggtatggccacctcctttgctgaatgctcgcttgcacagctctacaaagaaaaagacggcaaaggtcagtttcgcggcggtcccgcctggtatatggctcgcgggttgggaatgcgctggatgggcgttctgttctcgatctttttgctgattgcctatggccttattttcaataccgttcaggcaaattccgtcgcccacgcgctgcgctttgcctttaattgtccggagtggctgacgggcggcgcgcttgcccttctcaccctgctgaccattgtgaccgggctcaaaggggttgcccgcctgatgcagtggctggttccgctgatggcgctgctgtgggtgtcaaccagcctgatggtatgcgcgatacatatcgacgaggtgccgaacgtcatcgtcaccattttccaaagcgcgttcggctggcgcgaagcggcttccggcgcgctgggttacacccttagccaggcactcactgcgggttttcagcgaggcatgttctccaacgaagcgggaatgggctccacgccgaatgccgccgcagcggccgcatcctggcccccgcatcccgccgcgcagggcattgtacagatgattggcgtcttcacagacaccattgttatctgctccgccagcgcgatgatcatgctgctggccggtgccgctgagcaaccgtccggtagtacggcaggcattcattgggtacaacaggcgctggtctccctcgtcggcggctggggcgcgggccttgtcgcacttgtcgtgggactttttgcctttagttccattgcggtgaactatatgtatgccgaaaacaaccttatcttcctgaaagtcaattcgtgtctgacccgcaacgtccttcgcgcgggtgtgctgggaatggttttcgtcggctccctgctcggtatgccgttggtctggcaaatagcggacgtcattatggcgctgatggccatcactaacctgacggccattttgctgctttcaccggttgtggcgctgatcgcgcgcgattatctgcgtcagcgcaagctcggcgtacagcccgtctttgacgcctcacgctatcccgaaatcgagtcacaaattgcccctggcacctgggatgatttgccgcggcaataa

SEQ ID NO: 1359 - DNA, 840 bp, Enterobacter cloacae
cagctatcgatcaattcagggcgattttttgttaaagtcgctctaaatttcctgcaaggactggatatgctgattctgatttcacctgccaaaacgctcgactaccagagcccgctcgccactgagcgttatacccagccggaattgctggactactcgcaacagttgatccacgaagcgcgtaagctttcggctccgcaaatcgcttcgctgatgagcatcagcgataaacttgccgacctgaacgccacccgttttcatgagtggcagcctgacttcacgcccgccaacgcccgccaggcgctgttggccttcaaaggtgacgtctacactggcctgcaagcagaaacgtttagcgaagccgatttcgattttgcccagcagcatctgcgcatgttatccggcctgtacggggtgctgcgcccgctggatctgatgcagccgtatcgtctggagatgggtatccgcctggaaaacgctaaaggtaaagatctgtaccagttctggggcgatgtcattaccgacaagcttaacgcggcgctgcaagcccagggggacaacgtggtgatcaacctggcctccgatgagtacttcaaatcggtgaaaccgaaaaagctggatgcggacattatcaagccggtattcctcgacgagaaaaacggcaaatttaaagtaatcagcttctacgccaaaaaagcgcgcggtctgatgagccgcttcatcattcaaaaccgcctgacgaagccagagcagctcaccggctttaacagtgaagggtatttcttcgacgaggcatcgtcaggaaaaaacgagctggtgtttaagcgtcacgagcaataa

SEQ ID NO: 1360 - DNA, 564 bp, Enterobacter cloacae
  unsure (19)
  unsure (20)
cacccatactgccttttcnncgtctcttgcgcaagaagactgggtttgggcatgaccaccaatctgctgatcctgcacaatatcgggatgttcccgatggacggcattatcctgccgatgggcattttttacggcggtatcgcacaaatatttgcgggcctgctggaatataagaaaggcaacaccttcggcttaaccgcctttacctcttacggttctttctggctgactctggtcgcgattctgctgatgcctaaaatgggcctggcggaggcggcaaacgcccatttcctgggcgtgtacctgggactgtggggcgtgttcaccctgttcatgttctttggcaccctcaaggcgaaccgcgcgctgcaattcgtcttcctgagcctgaccgtcctgttcgccctgctggccatcggtcacctggcggataacgaaggcatcgttcacgttgccggctgggtcggtctggtttgcggcgcaagcgcaatctacctggccatgggtgaagtgctgaacgagcagttcgaccgcaccattctaccgattggtgaaaaacactga

SEQ ID NO: 1361 - DNA, 906 bp, Enterobacter cloacae
acaacgctttttgcggcggcgttagccgtagtaggtttttgtaagaccgcgtctgcggtgacgtatcccctgccgacagacggaagccgtctggtgggtgaaaaccaggtggtgacggtgccggaaggtaacactcagccgctggaatacttcgcggcgcagtatcagctcggcctgtctaacatgctggaagcgaacccgggcgttgacccgtatctgccgaaagcgggtaccgtactcaacattccacagcagctgatcctgccggataccgtgcacgaaggtatcgtgattaacagcgccgaaatgcgtctgtactactacccgaaaggcaccaacaccgtgatcgttctgcctatcggtatcggtcagctgggtaaagacaccccgctgaactggaccaccaaagtggagcgtaagaaagcgggcccaacctggacgccgaccgccaaaatgcacgctgagtacattgctgccggtgaaccgctgccaaccgttgtgcctgccggcccggataacccgatgggtctgtacgcgctgtacattggtcgtctgtatgccatccacggtacaaacgccaacttcggtatcggcctgcgcgtaagccacggctgcgtgcgtctgcgtaatgaagacatcaaattcctgttcgataacgtgccggttggtacgcgcgtgcagttcattaacgaaccggtgaaagcgacgtcagagccggatggcagccgttacattgaagtgcataacccgctgtccaccagcgaagatcagatcaacaacaacgaaatcgtaccgattaagctgaccagcgcggtgcaatccgttacctctcaggcggatgttgacacgaccatcgttgaccaggcgattcagaaccgttccggtatgccggtgcgtttaaactaa

SEQ ID NO: 1362 - DNA, 1008 bp, Enterobacter cloacae
  unsure (982)
tctatgaacgtaaccctgattgatacacttgttacccgcagccggggcttaagcccgtggacgggattctattttttgcaatcgctgttgattaactttgctcttggctacccctttagcctgctttatgccgtcgggttcacctgtattcttcaccttctctggcgaagcgcaccgcgcatgcagaaggtgcttatcgggatttgttctctggttgctgccgcctatttcccgtttggccaggcctatggcgcgccaaactttaataccctgctggcgctccactccaccaatatggaagagtccacagagatcctgacgatctttccgtggtacaactacgtggttggccttttcatttttgccctcggcgtgattgcggttcgccgtaagcccgtcgggaaaaaagcatggggtaaaattgaaagcctgtgcctggcctttagcgtggtgacgttttttgttgcgccggtacaaaatatggcctggggcggcgtgtttaagcttaaagataccgggtatccggtgtttcgcttcgtcaaagacgtggtggtgaataacgaggaagtgctcgacgagcaggcacgtatggccgagctttccaccatgaaagacacctggaacgtgctggcggtgaaaccgaagtatcacacctacgtggtggtgatcggagaaagcgcgcgtcgtgatgcgctcggcgcgtttggcggtcactgggataacacgccgtttgccagcgccgttaacggtacgctgtttaccgactacgtggcggccagcggctcgacgcagaaatcactcggtctgacgctcaaccgcgtggtggatggaaaaccgcagtttcaggataattttgtcaccctggccaaccgggcaggttttcagacatggtggttctctaaccagggacagatcggcgaatatgataccgccatcgccagcataaagaagcgtgccgacgaggtgcacttcctgttcttcntccacgatgcgccgaatccgcgatat

SEQ ID NO: 1363 - DNA, 1110 bp, Enterobacter cloacae
atgaacatccccggcttgcaggccctgaaacgcgatcgctttttccatcttttacttatcactggcgttgggctcagcgtctttgtgcccttcacgccgcacacctggccggcggccatagactggcgcaccattattaccctgagcggtttgatgatgctcaccaaaggcgtggagctgagcggctattttgacgtgctggggcgcaaaatggtgcgccgcttcgccaccgagcgcaagctggccctgttcatggtcttttcggcggcgctgctgtcgacgtttctcactaatgacgtggcgttgtttatcgtggtgccgcttacgctcacgctgcgtaaactgtgcgaaataccggttacccgtctgattatctttgaagcgctggccgtcaatgcgggctcgctgctcacgccgatcggtaacccgcagaacattctgctgtggggacgctccggcctgtcgtttaccgcatttaccgggcagatggcgccgttggcgctggcgatcgtggcgtcgctgctggcggtgggctggtttgctttcccgaataaatcgttgcagtaccacagcggtacaaccggcccccagtggcagccgcgtctcgtctggagctgcctggggctgtatatcgtttttcttatcgcgctggaattaaaccaggcgctggctggcgcgctgctggtggcgtgtggcttcctgttcctcgcccggcgggtgctggtgagcgttgactggacgctgctgctggtgtttatggcgatgtttattgacgtccatctgctgatccagctcccggtattgcagaacgttctccatagcgttggcggtctgtcgcagccgggattatggctgacggcgattggtctctcgcaggtgatcagtaacgtgccgtccaccattttgctgcttaactatgttccccctacggtactgctggcgtgggcggtcaacgtcggcggctttgggctgctgcccggctcgctggctaacctcatcgccctgcggatggccaacgatcgccgcatctggtggcgcttccatttatggtcgatcccgatgctgctctggtcagcggcggtcggtttcggactattccttctcatatag

SEQ ID NO: 1364 - DNA, 1551 bp, Enterobacter cloacae
gagcgaggggagtgcaggagcacactgatgatacacagacgtttacaccccctgatgataatgatgctgctggtgggttgcgccgtcgggccggactaccaacagccagcaccgcccgctaccacgcactggaacgataagggcgacagcgcggtgaaatcgcaaacttcctccgccgccactaacccgcgctggtggaaaaccttcggctcgccgcagctcgacagcctgattgaacgcgccatcgccgggaatctgacgctacagcaaacggtattacgcattgccggcgcgcgcgaacagattaaccaggccggcggggcgtttttcccgtcggtgaatggcaatgtgcaggcgacgcgccagcagcttgggctggaaggggagctgaaatcccacggcgtgtacgaccagttgaataatgtcgatcctgaactgcggggcgcgttaggcccgctgacgcagccgattaacctctatcagggcagcttcgacgcccagtgggaaatcgacctgtggggcaaggtgcgccgtcaggtagaagcggccgaggcgcagcagcgggcagcgatcgagcagcgtaacgatgtgctggtctcgctggaagccgaagtggcgcgggcgtggctacagctgcgtggggcgcagagcatcattgccacgcttaatacgcaaattgaaagcgcacagcagacgctggatctgaccgaaagccgccagcggggcgggctgtcgccgcagatggacgtggagaacgcccgggcgcagctgggcaatcttgaagcccagctgccgcagtatcaggcgcaggaacgccaggcgatgaacgggctggcgatcctccttggtaagccgccgggcgcgctggatgccgaactgcaatccgtacagccgatgcctgccctgccggatattgtgcagaccggtattccgtccaccctcgcacgccgtcgcccggacgtgcgcgaagcggaggcgaatctccatgccgccacggcgcagattggcgtctcggtggcagagctgttcccgagctttaccctctccgggcagtttggcttgcgcaacagcgaatccaactggctaaccgactggagcagccacttctacagctttggcccgcaggtttccataccgattttccagggcggacggctggtctccagcgttaaggtggcgcgcgcgcagcagggggcggcggtgctggactatcgtcagacggtgctgacggcgctcggcgacgttgaaaacgcgctggtgagttatcgcaccgaccagcagcgtgaagcgggcctggcgaaaaccatcgacgcgctgcaaaacgcctttgatctcgccagcgacagctaccggcaggggatcgccagctttattgacgtgctggacgcccagcgtcagctcgctcaggccgaacagcagcgggcgcaggcgcaggtgcagagcgcgcttgatctggtggcgctctacaaagccctcggcggcggctgggagccgtatcagcaggtgcggctcccagactacagcgtctttggcgacgccccgcgcggataa

SEQ ID NO: 1365 - DNA, 726 bp, Enterobacter cloacae
ggaaggacgatggcggcgaagtacatcaccatagcgcgggaaattaaaaaacgcatcatcagccagcagtacgccgccaatgaaccgctgccggaccagttcgcgctggcggcggagttcagcaccagccggatgaccattcagcaggcgatgcgtcagctgattgtcgaagggctggtctatacccgacaggggcagggcacgttcatccgcaaaaatttcctccagctttcccagtgggatctctccggcagcgactacttcggggcgaccaaaacctgggaacatttaggcacggtgagcagtcaggttgtgcacttcgaactgcgcttcccgaacgagaaagagcaggcatcgctgatgataaatccggatacgccgatctatgactttatccgtctgcgtttactaaacggtgagccgatgtctctggacgccacggtaatgccgctcaatctggtccccggtctgaacaaaacccatcttgaaagttcggtattccggtatgtgcaggagacgctggggctgaagatcatgggatcgtatcgggtggtgcgggcgctgaagcccagtgcgctggatatgcagcaccttgtctgcgagccaaccgactcggtgctggaggtagagcaggtgatctatctggaagatggtacgccgctggagtacgcccattgtcactatcgctatgaccatggcggcatcgttatcgtgaataacggataa

SEQ ID NO: 1366 - DNA, 483 bp, Enterobacter cloacae
ggaagcacaatgaaccgtcgcgcaggtaagccaacaacaaaaaaaacgacgcaactggtgaacgttgaagagcatgtggaaggcttccgccaggtgcgcgaggcgcatcgccgggagctgattgatgattatgtcgaactgatctctgatctgattcgtgaggttggagaagcgcgccaggtggatatggccgcacgccttggggtgtcgcagccaaccgttgccaaaatgttaaaacgtctggcgtcggtcgggctgatcgagatgatcccctggcgcggggtgtttctcaccgctgaaggcgaaaaactggcgcaggagagccgcgagcgccatcagatcgtcgagaattttttactggtgctgggcgtcagcccggaaattgcccgtcgggatgccgaaggtatggaacaccacgtcagcgaagagacgctggtgaagttccgcgaatttacgctcaaatacggtccctccgctgaatga

SEQ ID NO: 1367 - DNA, 1590 bp, Enterobacter cloacae
accgaaggtcaccgtggaatgacggatcacagccacgataactggaagccagccagtaacccgtgggcggtggcgattgtggtcaccctggcggtgtttatggaaattctggacaccaccatcgtcaacgtggcgctgccccacgtcgcggggtcgctctcggccagctatgacgaatccacctgggtgctcaccagctacctggtggcgaacggcatcgtgctgccgatttcggcctttctcagccgcctgtttggccgcaaacagttcttcctgatctgtattgtgatgttcaccatctgctcgttcctgtgcggtatcgccaccgagctatggcaaatcatcctgttccgcgtgatgcaggggttctttggcggcgggttgcagcctacccagcagtcggtgctactcgactactttaagccggaggacaggggcaaagcctttggcctttcatccattgccattatcgtcgcgccggtactcggccccacgctggggggctggatcaccgataactactcctggcgctgggtgttctttatcaatatcccggtagggattgtgacggtgctggccatctatcagctgctggaagatccgccgtgggagaaaaagtcggaagagaagctcaccgtcgactggacggggatcggcctgatcgccctcggtcttggctgtttgcaggtgatgctcgaccggggcgaagatgatgattggttttattcgaactttatccgcaccttcgcagtactgacgctggtcggtattatcggcgcgatctactggctgatgtatgccagaaagccggtggtggatctgcactgtatgaaggaccgcaactttgcgatctccagcctgctgatggcggggatggcgatgatcctgtacggcagttcggtggttattccgcagctggcgcagcaggatttgggctataccgccacctggtccgggctggtgctctcgcccggcgcggtactgattgtgctgaccatcccgctggtgctgaagctgatgccggtggtgcagacgcgctggattattgcctttggctttacctgcctggcggtgtcgttcttctggtcccgcacgctgacgccggatatcgatttcgaaacgctggtgctgttccgcagcgctcagtcgattggactggggttcctgtttgtgcccctcaccaccattgcttttatctcgatcccgaggcggcttaacgccgacgcggcggcgctgtttaccatgttccgcaacgtggccggctcgattgggatttcgctctcgacggcggcgatcaccgagcgctcgcaggcgcacagcgcgcatctggcctaccacgcttcgccgtttaatgagcagttccagctggcgatacgcgaaagcgcccaggcgatccagaacttcaccactcaggtgggcgatccgaccggcattgccaccgggcggatgtaccagacgatgatcgagcagtcgcgctttctggcctacatcgacgtcttcaccattctgagcgcggtggccttattactgattccgttttgtttgttgctctcgccggttaagagcgaggggagtgcaggagcacactga

SEQ ID NO: 1368 - DNA, 1398 bp, Enterobacter cloacae
ctagtcataaagggagcaaccatgaacaaatcactgccagccaactttttatggggcaactcggtatccagcatgcagacggaaggggcctggaatgagggcgggaaggggatgtcggtgtatgacattcgggaagccggtgaaaacatctctgactggaaagtggcgaccgactcctaccaccggtaccgggaagatttcgacctgatgcaggatctgggcatgaactgctaccgcttccagatctcctggagccgcatctgcccgcagggtgacggcgagttcaacgacgagggcatcgccttttacgaccgctttattgacgatttgctcgcccgcggtatcgagccgatggtctgtctctaccacttcgatatgccgctggcgctggcgcaagagtacaacggcttcatcgatcgccgcgtggtggacgcctttatccgctacggcaaaaagatgatcgactgcttcgctgaccgggtgaagtactggctgaccttcaacgagcagaacattttccatatgccggaagcttttcgcatttccggttacatgaaaggtgagcaaaccctgcgcgagctgtatgagcttcagcaccatgcgatggtggcgcacatgactctgaccgaatacctgcaccagactaagccgggcaagctgatgggcggcatgctggcgcaccagctgatttatccggccacctgcaaaccgcgcgatatcttctgcgcccagcagtacgacgaattcctcaaccagaacctgctgcgcgtcttcgcgggccagggttacagcccggcggtaatggcggtggtggagcaggagggcttcggcgatatctaccgcgcagacgatctcgcgctgtttgcgcgcacgaagaacgactttatggccttcagctactacgccagcaaaacgctggacagcgatgccatcccggaaggcacgccggttaactattacctgctgcacggcgagaaaaacaatccgtacctgaaggccaccgagtggaactggcagatcgatccgctgggctttcgcaccatcatcacccgctacgccaacgactggcggatgccggtattcccgattgagaacggtattggggtgattgagtcctgggatggcgtgaatccggttgaggacacctaccgcatcgactaccaccgggcgcacatcgaggcgatgaaagcggcaatattcgaggatggggcagaggtgatgggctatctcggctgggggttgattgacattctcagctcgcagggtgacatgcgcaagcgctacggcgtggtctacgtcaaccgtgaaaatcacgacctgaaagacctgaagcgcgtgccgaagaagagctacgcgtggttaaaacaggttatccataccaacggacgcgagatgtaa

SEQ ID NO: 1369 - DNA, 1338 bp, Enterobacter cloacae
tgggaacactccgctatgtctgaaacaaaaataacaccgcacatgcagtcttttgtcgataaatttgtagagttctcggcgcgcctggcaaaccaggtgcatcttcgctccctgcgcgatgccttcgccacggtaatgccgattttcatccttgccggtctggcggtgctggtgaataacgtggtcttcccgtggatttttgcgggcgacacgcttacgcactttaaggtgtggggcgaggcgattatcaacggcacgctgaacatcgccgcgctgctgctggcccctatgatcgcctggtcgctggcgcgcaacaaagatttcgacaatccggtctcggcagtggttatcgccgtcagcagtttcattatcatgatgccgatgcgcttacagattacccccgtcggcagcgaggccacggtgaacgccacccaggtgctgacgttcgccaatatcggctctacggggattttcgccggggtgctgattgggctgctctcaacggaggtcttcatcgctatttcgcggctgaaggcgctgcacatttcgttgggggaaaacgtgcctccggcagtgagcaaatcctttaccgcgctgatcccgacgatcctcacgctctcgctgtttgcggtgctggcggccatactggcgaacgtgctgcacacggatctgatccatctcattacgacatttattcagcagccgctgcggctgatcaacaccagtctgcccgggacgattttcatctacagcttcggtaacttcctgttcacgctcggtattcatcagtcggtggtcaacagcgtggtgctggagccgttcctgctgatcaataccaatgaaaatatgctggccttcgccaacggccagccgatcccgcacatcatcaacaacatctttgtgccgacctttggcatggtgggcgggacgggcagcacaatctcattgctgatcgctatcttcatcttctcaagacagaaatcagcgaagcaggtggcgcgtctgtcgctggcgccgggtctgtttaacatcaacgagccggtgattttcggcctgccgatagtctttaacctgccgcttatgatcccgtttgtgctgctgcctgctatcgggatttactttgcgtggctctgtaccacgctggggttcatgtcgcgctgcgtggtgatgatcccgtggaccacgccgccaattctcagcgcctggctggcgacggcgggggactggcgcgcggtagtggtgcagttggcaatcatcgtatttggtgtattcttctacctgcctttcctcaaagttgccgagcgagtggctttaaaaaacagcgggacagaacactaa

SEQ ID NO: 1370 - DNA, 1098 bp, Enterobacter cloacae
actatggcagaagatcaaaacccacctgctgacgagcaggatcaaaacaataacgagcgcaagcgcccggggaaaaaaccgttaattatccttggtatcgtggtcatcgtgatggtgattgtggcgctggtctggtggtttttaacccgtaacgaagagaccaccgacgacgcctttaccgatggcgacgtagtgaccattgccccaaaaacggcaggctacgtcacagaacttcgcgtacgggataaccagcgcgtgaaaaaaggggatgtgctggtggtgatcgatccgcgtgataccaccgcccagcgcgatcaggctcaggcccagcttgggctggcgctggcgcagctgcatcaggcccaggcgcagctggcgctctcgaaggtgcaatatcccgcccagcgtgatgaagccaaagcccaggtacttaaagcccaggcggatatggccaacgcgcaggcggagtaccgccgtcagcgcggcgttgacccgcgcgcgaccacgcaacaaagtatcgatgccgcgaacgctcagctgcgcagcgcgcaggcggggctggccagcgcccaggcgcagctggaggtggcggagcaggtccagctgcaaatccgccagcaggagaccaacgtcgaagcccgcgaacggcaggtcgatcaggccagagcgcagctggaaaccgccaacctgaacctctcttataccgaagtccgcgccccgttcgacggtttcgtcactaaacgcaacgtccagcccggtacgctggtgcaggccggcacggcgctgttctcgctggtttccccgaacgtgtgggtggtggcgaatttcaaggagtcgcagcttgagcgcatgaagccgggcgacaaagtgaccgtgtccgtcgatgcctggccggatatggagctggaaggccatatcgacagcatccagcagggcagcggctcgcgcttctccgccttcccgtcggaaaacgccaccggtaactttgtgaagatcgttcagcgcgtaccggtgaaaatcgtgattgataaagggctggatccgaacaagccgctgccgctggggctgtcggttgaaccgaaggtcaccgtggaatga

SEQ ID NO: 1371 - DNA, 1062 bp, Enterobacter cloacae
ggggtttcctgtgcggacgccagcacttcgaaaaaccaaaactttgctacgtttattgaaaggcttttcagggataacacgatgacaaaatatcggctcagcaatgaaacgcgtctctggcgctggcaggacggatcaacaccgtgcacaacgcctctcagacaaattattgccgtgaaggattttaacgatgtgaccagcgggactaaaggcggttgggttgaggatgaacacgcgctcgcccaggacggggattgctgggtttacgatgaaaacagcgtggtgtttgccggggccaggatatccggtaacgcccgcctcacccaaccctgcatcgtaagccaccgcgcacacgttggcggcaacggctggcttgacgcggcagaggtgagtcacggggcggtaataagtgacaacgtcaccattcagcactccaccgtacgcggggaatgtcgtatcgcgggtgacgcgcgggtgctgcataatagcctggtgattgcagccaaagggctgacacccgaccgtgagcagatcctgcaaatttatgaccgagccacggtcagccagtcgcgtattgtgcatcaggcgcaaatctacggcgatgccatggtgacctgggcctttgttgagcaccgtgccgaggtgttcgatcgcgccattcttgagggcaacgcgctgaataacgtctgggtgtgcgactgcgccaaagtgtacggcaacgcccgtctgctggccggtctggaggatgatgccatcccgaccgtgcggtacagttcacaggtcgcggaaaacgccctcgttgaaggcaactgcgtcattaaacaccacgtattaataggcggcgaggcgtggttacgcggcgggccaatcctgattgatgacaaagtggttattcaggggcgggcgcgtatcagcggcgatgtcctgattgagcatcaggtggaaataacggacgatgcggttatcgaggcgctggagggtgaaagcattcacgtccggggagccaaagtgatcaacggcgacacgcggatcacccggacgccgctgctgggggcgctatag

SEQ ID NO: 1372 - DNA, 1254 bp, Enterobacter cloacae
aaaataaatacagaaggaaacactatgggctcagaactctccagacaattaacccaacgctttttccgctatctcgccatcaccagccagagcgacccgaaagtcaaaaccctgccctccaccccgggccagcacgacatggcgcgggagctggcgaaggagctgaaaacgctggggttagatgatattgtgatagatgagttcgccaccgttaccgccgtgaaaaaaggtaatgttcccggcgcgccgcggattggttttattacccatatcgacaccgtcgacgtcggtttatccccggatattcatccacaaatattaacctttacgggggatgatctctgtctgaataaagagaaagatatttggctgcgcgtaaaagagcacccggaaattctggcttatcctgatgaggagattattttcagcgacggaaccagcgtattaggcgcagataataaagcggccgtcaccgtggtcatgacggtgctggaaaacctcaccgctgagcacaaccatggcgatattgtggtggcgtttgtgcccgatgaagagattggcctgtgcggcgcgaaagcgctggatttaaagcgcttcgacgtcgattttgcctggaccatcgactgctgcgagctgggcgaaattgtttacgagaactttaacgcggcggcggctgaaattcgctttaccggcgtcacggcgcacccgatgtccgccaaaggggtgctggtcaatccgctgctgatggcaacggatttcatcagccatttcgatcgccagcaaaccccggaatgcaccgaggggcgcgaaggttatatctggtttaacggcatccaggccgggcagaacgaagcgatactgaaagccaatattcgtgattttgacaaagatggtttcgccgcccgcaagcagcacattgccgatgtggcggcgcaaatagccgcgcagcatcccacggcaaacgtggagtatcgcattgaggatacctacagcaatatcagcaatgcgattggcgaagaccgccgcgcgatcgacctgatgttcgaggcgatggaatcgctcggcatcaccccaaaaccgatccccatgcgcggtggcacggatggggcggccctgtcagccaaaggcctgctcaccccgaacttcttcaccggcgcccataacttccactcgaagtttgagtttttaccgctgtcgtcgttcgaggcctcctgtcgcacggccctgcaactctgtctgctggccgcgcgttaa

SEQ ID NO: 1373 - DNA, 846 bp, Enterobacter cloacae
gatatgtcgcgtcgttcatttccacttaatgccgtagagacgttcatcgtgaccgcgcgtcacctgaatcttacccatgccgcgaaggagctttgtctgacgcagggggcggtaagccgtaaaatcgcctcgctggaaagctggttcggcttcccgctgttcgagcgccatgcccgcggcctgcgtctctcctcacagggaagcgccctgctgccggagctgcaatctgcctttgagcacctgctgaacgttgctgaacaggcgcgaacgcaccagaccgtaatccgtctgaaagcgcctacctgcgcgatgcgctggctggtgccgcgtctgctacaggtggagcgcgaacagccggaactccagattgcgctgaccaccaccaccgatcacaacgtcaatttcaaaaccgaatcctgtgacgcggcgattgtgtttgggacgcacatgagcgccggcgatctgctgttcgaagaggccttaaccccggtgatgagcccgctacgggccggctctgcgctggaagcactcactttccttcaccccacgcgggacaaaacggactggacgctgtggctggcgaaacagccgggtccgccgccagctatgctcaaaaatcaacacttcgaaaccatggatctcgccattaccgccgccattcaggggctgggcatcgccatcgcggatgaaacgctggtggaggaggacgtgcgcgccggacggctgatgcgcccgtttgacacaagcataaaaacgggggcgagctaccggctggtattacgcgacgcacccggccctgaaaacgggctggatgcgtttcgcgcctgtctgctcagtcgaggctga

SEQ ID NO: 1374 - DNA, 1524 bp, Enterobacter cloacae
tggaaaaagaaggttggtatggaaaatccctctgcccctgtggttgaaacgcgccagggcgcactgattggttttactgaaggcgatacccatgtgtggtgtggcattccctatgcagcaccccctgttggcccgtggcgctggcgctccccgcgtccccctgcacgctgggatggcgtgcgtccggcgacggcgttctccgcctccagctggcagagcagcgaaagctgtcaggagctgggcggcggcgaccccggccagttctctgaagactgcctgtatcttaacgtctggtcgccagtggctcgcgccgctccgcttccggtgatggtctggctgcacggcggaggatttaccctcggcgctggcgggctgcctccgtataacggcagggcgctggcgaagcgtggcacggtggtggtgacgatcaattaccgtctcggccacctcggcttttttgctcatccggcgctggagggggaggaagagcgcgtggtgcataacttcgcactgctcgatcagatccaggccctggaatgggtgcgcgataacattgccgcgtttggcggcgatcctgagaacatcaccgtatttggcgagtcggccggtgcgcgcagcgtgctgtcgctgatggcttccccgcttgcgggaggactgttccataaagccattgtgcaaagcgggtacacgctgcccgacaccccgcgcgagcaggccatgcataaaggcgaagcgattgccgcccatttcggcctgcacaatgctaccgcggaacagcttcgcgcgatcccgcctgaggcgttctggccgctgacctcgccgttgaatatcgcccctgcgcccatcgtgggggattgcgttttgcctgaggccatgctcgacgttttcttcgcggcccgccagcatcctgtaccggtgatgattgggtcgaacagcgacgaagccagcgtgatgtcggtattcggggtcgatctggccgggcagatccagaagctccgccgtgagcggcgctttggcctggggctgataaagctgctttatcctggcgtgaagggcgatgaggaacttggcaggcaggtatgccgcgacatggccttcaccaccatgggatacgtggtaatgcaggcccagcagcgggcgggcggcctgtgctggcgatactggtttgattatgtggccgaagcggagcacgcgacgtacatcaacggcgcctggcacggcaacgaagtgccctacgtcttcgatacccttggacaggtggaaccttcgcggcagtatgtgaatgaacgcgatctggccttcgccgctcaggtggcggactactgggtgagcttcgcccgggatgcgggggcacgcgatagcctggcagggcccacgcgctggcccgcctgccggaaagggcgggacgtgctgttacgtattggtgtgaataaacatgcaggttttcggcttgaaaaccgcttcatgcgtgcccgtatgagcctcttcaaacgggtgatgaaacaccacgtcagcctcgactga

SEQ ID NO: 1375 - DNA, 1200 bp, Enterobacter cloacae
ttatgcattcaccacgagaagggacagaggatgactttgaaaacgccggtgcagacacgatccaaattgcccgatgtaggaaccaccatttttaccgttatcggccagctttcagcccggcataacgccatcaacctttctcagggggcgccgaatttttcctgcgacccaaaacttatctccggcgtgacccgcgccatggaggcagggtataaccagtacgcctccatgaccggtctgcaaccgctcagagagcgcatcgcggacaaaattgccacgctctatggcacacactatgacccggcgagtgaggtgctggtgaccgccagcgccagcgaagggctttactcagccatcagcgggctggttcatcctggagacgaggtgatctatttcgagccctcctttgacagctatgcgccgattgtccgtctgcaaggagcgacgccgattgccattaaactgacggtaccggattttgccgtgaactgggatgaagtacgggcggctataaccccacgcacgcggatgatcatcgtcaatacgccgcacaacccgagcggacaggtgttttcagccgccgatctgcaccagctggcagcgctgacgcgccacaccgacatcatcattttgtctgacgaagtgtatgagcacgtcgtttttgatggcgaaccgcaccacggaatggcgacgcacccgcagctggcggagcgcagcgtgattatttcttctttcggaaaaacctatcacgtcaccggctggcgcgtgggttattgtgtggcacccgcggaactgatggatgagatatgtaaagtccatcaatttttaatgttctcggccgatacgccgatgcagtacgcgtttgccgaacacatgaccgatccgcaaacctggctgtcgctggcggcgttttatcagcgcaagcgcgatctgctgcaaagtttgctcgccgactcaccgttcaggctgctaccaagtgccggttcgttcttcctgctggcggattacagcggctttagcgacgagcgcgacagcgagatggtgaaaaggctgattgtcgagtacggggttgccaccattccgctgtcggcgttttatgccgatggcacggacaataagttaatccgtctctcttttgcgaaagatgaggcgacgttacgggcaggtgcccaggccctttgtcgggttacaccacgttaa

SEQ ID NO: 1376 - DNA, 1746 bp, Enterobacter cloacae
ccgtttttgtttaggctgtgcgttctttcttgccgtcatttcgctgcgcgcgaaactcattcacacgaccataaggacgttttctcaggcatgaatcgcagacgttttctcaaaggttccctggcaatggctgccctgagcggcacttctggccttgcttctctgttttcccaggcggcgtatgctgctgactccgacattgccgacggtcagagccgtcgctttgacttctctgttctgcaatccatggcgcacgatctggcgaaaaccgcgtggggcggtgcgccgcgtccgctgccggaaacgctggccaccatgacgccgcaggcgtacaacgccatccgttacgatgagaagcagtcgctgtggaataacattgaaggccgtcagctggacgcccagttcttccatatggggatgggattccgccgccgcgtgcgcatgttctcgctggatcaaaccacctctcaggcgcgtgagatccacttccggcctgagctgttcagctatggcgatacgggcgtggataccaaacagcttgaagggcagagtgacctcggcttcgccggattccgcgtctttaaagcgccggaactggcgcgacgcgatatcgtttcgttcctgggcgcgagctacttccgcgcagtggatgatacctaccagtacggcctttccgcgcgcgggctggcggtggatacctttaccgacaccccggaagagttcccggatttcacctccttctggtttgaaaccgttaagccgggtgataccacctttaccgtctatgcgctgctggacagcccgagcattaccggtgcctataagtttgtgatccactgtgagaagagtcaggtgatcatggacgtcgaaaaccatctctatgcgcgcaaagacatcaagcagctcggcatcgcaccaatgaccagcatgttcagctgcggcaacaacgaacgccgcatgtgcgacaccatacatccgcagatccatgattcagaccgcctggcgatgtggcgcggtaacggggagtggatctgccgaccgctgaacaacccgcaaaagctgcaattcaacgcctacctggataaaaacccgaaaggctttggtttgttacagcttgaccgtgacttctcccattaccaggacgtcatgggctggtataacaagcgaccaagcctgtgggtcgagccgcgcaacaactgggggaaaggatccatcgccctgatggagatcccgacaaccggcgagacgctcgataacgtggtctgcttctggcagccggagaaaccggtgcaggcgggtgatgagctggacttcaaataccgtctctactggagcgcacagccgccggtgcgttccccgctggcaaacgtctacgccacccgtaccggtatgggcggcttcccggagggctgggcgccgggtgaaaattacccgaaagtgtgggcccgtcgctttgccattgacttcgtcgggggcgatctgaaggccgccgcaccgaagggcattgagccggtgatcaccctgtccagcggtgaagcgaagcaggtagagatcctctatgtcgagccattcgacgggtatcgcattctgtttgactggtatccaacctctgactccaccgagccggtggatatgcgcctgttcctgcgctgtcagggcgatgccatcagcgagacctggctgtaccagtacttcccgcccgcgccggacaaacgtaactacgttgacgaccggatcatgcgctag

SEQ ID NO: 1377 - DNA, 645 bp, Enterobacter cloacae
tccttatgggtttgtgccgggtggcggcttcgccttacccggcctgctctggacgcatttgtaggccgggtaagcgttagcgccacccggcaattaagaggcactatgtcttcagaaatcattcccgttaaccaggaaatcgagcttcgcgccgtcgaagagcgctataccaccgatctgcataacctcgtaatcaaaaacaaaacctggctgcaaaccgccttcgactgggcgcagcatgtcggcagcgaagaggacacgcgccgcaacgtgcagagcaatcagatgctgcaccagcgcggttacgccaaaatgttcctgattttcatgaaggacgagctagtgggcgtgctgtccttcaacgcgatcgagcctgcgaataagaccgggtacattggctactggcttgacgaggcgcatcaggggcagggtattctttctcaggcgctccaggcgtttatgcgctattacgttgagcgcggcgagatccgccgctttgtgatcaagtgtcgcgtggataaccagagcagtaaccgggtggcgcagcgcaacggtttcacgctggaaggttgtttgcggaaagcggaaatgctcaacgggcgttacgatgacgtgaacctgtacgccagaatcttcccgctatag

SEQ ID NO: 1378 - DNA, 603 bp, Enterobacter cloacae
ggaaaaataatgactgtcgatgaaaactactttactgagaaatatgggctgacccgcacgcactcagaggtgctgctcagcgcggacattgttaagccgggaaaaacgctcgatctcggttgcggaaatggccgtaacagcctctacctcgctgccaatggccatgacgtgacggcgtgggataaaaacccgatgagcatcgataacattgagcgcattaaggcggcggaagggatcgcgaatctgcaaacggcgattaaggatctgaacaacctgacctttgacggcgaatacgactttattctttccaccgtcgtgttgatgttcctcgaagcgaataccatccctggtcttatcgccaatatgcagcgttgcactaaaccaggcggctataacctgatcgttgccgccatggatacggaggattatccgtgcaccgtcggcttcccgtttgccttcaaacccggtgaactgagtaactactacgaaggctgggagctgatcaagtacaacgaagaggtgggggaactccaccgtaccgatgccaacgggaaccgtatcaagctgcgcttcgctaccatgctcgcacgcaagcccgcttaa

SEQ ID NO: 1379 - DNA, 861 bp, Enterobacter cloacae
tccgtctctcttttgcgaaagatgaggcgacgttacgggcaggtgcccaggccctttgtcgggttacaccacgttaaggaatttgagatgaaattacgcgcgttagttgtcggcatgggactgttgtgttcattctcgtcgtttgccgctaccgagttgcgatacgggctggaagcggaatatccgccgtttgaaagccgcaatgcgtcaggggagctggaagggtttgacgtagagctgggaaatgccatctgtaaagccgccgcgctgaagtgcagctgggttgaaacctcgtttgatgcgctgatccccggtctggtggcgaaaaagttcgacgccataaactcggcgatgaacatcaccgaacagcgtcgcaaaagcattgatttcacccagcccatctatcgcattccctcccagctggtgggcaaagccggttctgcggtagaggctacccccgaagggctgaagggcaaaaccatcggcgttctccagggttcaattcaggaaacttacgccaaagagcactgggaaaagcacggtgtcaccgtggtgtcttataaagatcagaatatggcctggggagatctgctgaatggccgcatcgatgcctcgctggtcatgtcagcggccgggcaggcaggtttcctcagtaagccgcagggtaaagggtttggctttatcggcaaaccggtgtcggacgacaccatcctcggcagtgggatcggctttgggctgcgtaaaggggatgaggccaccaaaaagcagcttgatgccgcaattgataaagtacgtgccgacggcacgatcgctaaactggctgataagtacttcccgggtatcgatgtcagcgtaaaataa

SEQ ID NO: 1380 - DNA, 1008 bp, Enterobacter cloacae
cctttaaaaaaaatgcataacctaaaccaacgcgttcttaacttgcccgccgggtatttcggtatggtcctcgggaccataggtatggggttcgcctggcgttatgccagcaccatctggccggtgacgcgctggccgggcgagatcctggtggcgctggcggtggcgatctggttccttctgagcgtggcgtttcttacccgtgcggtacggtttccacatagcgtgttggccgagatgcggcatccggtaatgagcagttttgtcagcctgtttcctgccacaacgctgctggtggccatcggctttgtgccgtggtatcgcccggtggcgctggggttgtttagcgtgggcgtggtgatccagcttgcgtatgccgcctggcaaagcgccgggctgtggcgcggcaagcatccggaagaagccacgacgccgggactctatctgccgacggtggcgaacaattttatcagcgcgatggcctgcggtgcgctaggcttccacgacgcggggctggtgttccttggtgccggggtcttttcctggctgagcctggagccggtcattttacaacgcctgcgcagcgcgggcgagctgcccgctgcccttcgtacctcgctcgggatccagcttgcgcctgccctggtggcctgtagcgcctggtttagcgtcaacggcggcgaagcggacaccttcgccaaaatgcttttcggctatggcctgttgcaactcctgtttatgctgcgtctgatgccgtggtatctgtcgcagccgttcaacgcgtcgttctggagcttctcgttcggggtgtcggcgctggcgaccaccggtttacatcttgggcagagcagtccgtcagggttctttcatgccctcgctgttcccctgtttattttcaccaacgtcatcatcgcgatgctgctggtccgtacttttatcttgctgatgcagggcaaacttctggtgcgcgctgataaggcactgcttatgcaatctgaggaaaaataa

SEQ ID NO: 1381 - DNA, 1599 bp, Enterobacter cloacae
atgatgaaaagcacattcacaatgataacgctggcgcttgctgcactgacggtcagttccaccgtcgcggcaaaaacgctggtgtattgctccgaaggatcgccggaaaatttcaatcctcagctctatacgtcggggaccagcgtggacgccagcgccgtaccggtttataaccgtctggtcgatttcaaaccgggcactaccgaactggtgccgagcctggcggaaagctgggaggtaagcgaggatggcaaggtctacaccttccacctgcgcaaaggggtgaaattccacagtaataagctgttcacgccgacccgcgatttcaacgcggacgacgtgattttttcgtttatgcgccagaaagatgtgaatcatccctaccataacgtctccaacggcagttattccaatttcgaaagtctggagttcggcagcctgattaccgccattgataaagttgacgatcgcaccgtgcgcttcaccctggcgcatccggaagcgccgtttgtcgctgacctggcgtggtactttgcctccattctgtcggcggagtatgccgatgccatgctgaaagcgggcacgccagaaaaggtcgatatgcagccgattggcaccgggccgtttaagctgtcgcaatatcagaaggattcccgcatcctctttaccgctttccctgactactggcagggaaaatcgaagctggatcgtctggtgttcaccatcacgccggacgcctcggtacgttttgccaaagtcgagaagaatgagtgtcaggtgatgccgttcccgaacccggcggacctgccgcgtatgaaggctaacaaagatatcaacctgatgagcaaggccggtctgaataccggtttcctggcgtttaacacgcaaaagccgccgctgaataacgtaaaagtgcgccaggcgctggcgatggcgattaacaaaccggccatcattgaggcggttttccacggcaccggcacggcggcgaaaaacctgctgccgcctggcgtctggagtgccgacagtgagctgaaagactacgattacgatccagaaaaagcgaaagcgctgttaaaggaggcggggtttgccaacggcgtaagcatcgatctgtgggccatgcccgtgcaacggccgtataacccgaacgcgaagcgtatggcggagatgatccaggcggactgggcgaaagttggcgtgcagaccaaaatcgtgacctacgaatggggcgaatacctgaagcgcgtgaagggcggggagcatcaggctgcgctgatgggctggacaacggcgacgggggatccagataacttcttcggcccgctgtttacctgtacgtccgccaacggcgggtcgaattcggcgaaatggtgttataagccgtttgataacctgattgccgaagcaaaatcgataaccgatcgcgaaaaacgcgtggcgctgtacaagcaggcgcagcagatgatgcacgatcaaatgccggcggtaatgattgctcattcaacgatttttgagccagtccgtaaagaggtcacgggctatgaaattgatcccttcggcaaacacctgttctggcaagtggacctgaaagagtaa

SEQ ID NO: 1382 - DNA, 825 bp, Enterobacter cloacae
ttgaaaaaattaaagattaattatctgctcatcggcattgttacgttgctgctggcagtggccctctggccgtctatcccctggttcggcaaggccgaaaaccgtatcgccgccattcaggagcggggggagttgcgcgtcagtaccctctcctccccgcttatttacgacgatatcaacggtaaaaccatcggtcttgattacgaactggcacagctgtttgcggactatctgggcgtgaagctgaaagttaccgtgcggcagaacatcaaccagctgtttgatgatttggaccatgaccgtgccgatattctcgccgcaggtctggtgtacaacagcgaacgcagcaaaaactatcagccgggcccgacctactactccgtgtcgcagcaggtggtttatcgtgtgggtagcctgcgcccgcgctcactggccgacatcaccgaccagcaattgaccattgcgccaggccatgtggtgattgacgatctgcgggcgttgaaagagaaaaaataccctaacctcagctggacggtcgatcctaaactcggcacgaccgaattgctggagcaggtaaaagataaaaagctggcctataccattgctgattcggtggcgatcagtcttttccagcgcgttcatcctgaaatcgccgtggcgctggatgtgaccgacgaacagccggtgacctggtttacccagctggacgacgatcaaaccgtctctgcggccatgctcgatttctttaattccatcaatgaagacggcaccctggcgtcttctaccacaggggtcgaaggtgccgcgcacagcgttagatggcaa

SEQ ID NO: 1383 - DNA, 777 bp, Enterobacter cloacae
cctaagcgcggatcctgccagccctcgtgggtgaagaccacgcgcgccttccgcatcgttgagaaaaccccgcgcagcgcactgatcaccagctttgagtttgagccagttgatggtcagccagttgccgattaccagccgggccagtatctgggcgtctggctgaagcctgaaggcttcccgcatcaggagattcgccagtactccctgacccgcaagccagacggcaaaggctatcgcattgcggttaaacgtgaggaaggtggtcaggtatccaactggctccataacgaagccagcgtgggcgacgtggtccatctggcggcaccggcgggcgatttctttatggccgttgaaacgaataccccggtgacgctgatctccgcaggcgtgggtcagacgccaatgctggcgatgctggatacgctggcgaaagcaaaccacagcgcgcaggttaactggttccacgcggcggagaacggtgatgttcacgcctttgcggacgaagtgaaagcgctgggagcgggtctgccacactttaccgcgcatacctggtatcgttcacccacggaagccgaccgcgcagcggctcgtttcgacagcgaaggcctgatgaatttagggcagcatgaaggggcgttcagcgcaccggggatgcagttctacgtttgtgggccggtagcgtttatgcagtatgccgcgaagcagctggtcgacctgggcgtgaataaagacaacattcattacgaatgtttcggcccgcataaagtgctgtaa

SEQ ID NO: 1384 - DNA, 786 bp, Enterobacter cloacae
atcgcgatgggtagcggaaataatgcgcacgttgatatcgatatcgcggttgctgccaagcggacgcactttccgctcctgcaacacgcgcagcagtttgacctgcaacggcgcgggcatatcgccaatttcatcaaggaacagcgtgcccccctctgccgcctggaacagcccttcacggctgctcaccgcgccggtaaaggcgccgcgggcatggccgaagagctcagactcaagcagttgttccggcagcgcgccacagttgatggcaataaaggcatttttactgcgtgggctggcgttgtggatcgcctgggccaggatctctttcccggtcccgctctggccgttgatcagcacgctaacgtcggattgcgccaccatccgcgcctgttccagcaggcgcagcatcacagggctacgcgtcacgatggattcacgccagccgtcgtcgccggatggcgccgcgtgctcaagagcgctgtcgatcgctttatagagggcgtctttatccaccggtttggtgaggaagctgaataccccctgctgcgtcgcggccaccgcatcaggaatagatccgtgagcggtgaggataatcaccggcatcccgggctgctgcttctggatctccgtgaacagttgcaggccatccatttcatccatgcgcaaatcgctgatcaccagatcgattttctcgcggctgagcactttcagcccctcctgcccgctttcagcggtgaccacgctgtagccttcgctgaccagacgcatccccagcagctttaa

SEQ ID NO: 1385 - DNA, 1485 bp, Enterobacter cloacae
agggcagactcagttacgctctcctcaaacccggatgatgagagtaatgtgttgaaacgctggcccgctttccctcgctccctgcgacagctcgttatgatggccttcctgctgatcctgctacctttgctggttctggcgtggcaggcatggcaaagcctgaatgcgttaagtgcccaggcggccctgactaaccgcaccacgcttattgatgcccgccgtagcgaggcaatgaccaacgccgcgctggagatggagcgtagctatcgccagtactgcgtgctggacgaccgtacgctggagagggtctatcagaaccagcgtaaacgctacagcgaaatgctggatgcccatgccggggtcttgccggatgacaaactctatcaggcgctgcgtcaggatctgaacgatctggcgcggctccagtgcaaaaacagcggtcctgatgccgccgccgccgcccgacttgaagccttcgcgaacgccaatacggagatggtgcagtccacccgtacggttatcttttcccgtggtcaacaactccagcaggagattgccgagcgcggccagttcttcggctggcaggcgctggtgctgttcctcgtcagcctggggctggtactgctctttacccgcatgatcatcggcccggtaaaggggatccagcggatgattaaccgcctgggggagggcaaatctctcggggatacggttgtttttaaaggcccgcgcgagctgcgctcggtcggtcagcgcatcatctggctttctgaacgcctggcgtggctggaatcgcagcgtcaccagttcctgcgccatatctcacacgaactcaaaacaccgctggccagtatgcgtgaaggcacggagctgctggcagatgaagtagcggggccgttatcccctgagcaaaaagagatcgtggcgattctggatgccagtagccgcaatttacaaaaacttattgaacaactgctggactataaccgcaagctggcggatggtgctgtggtgcttgaaagcgttgagattgaaccgctggtggacatggtgatctccgcccatagcctgccagcaagagctaaaatgatgcatacccaggtggatctcaatgcgccatcctgcctggcagagccgatgctcctaatgagcgtactggataatctttattccaatgcggtgcactatggtactgaatccggtaccatttatatcagaagcaataacaacggttcgcgggtatttattgacgtagcgaatacgggaagcccgattccggatgatgaaaaaacgatgatctttgagcccttcttccaggggagtcatcagcgaaaaggtgcggtaaaaggaagtggtctggggctgagtattgcccgcgactgcatacgacgcatgcagggtgagcttaacatcgtgagtgatgaacgcgccgatgtctgttttcgtatcgaactgcctcttgagccggaaaaatcaatgaaatga

SEQ ID NO: 1386 - DNA, 348 bp, Enterobacter cloacae
ggacccaccatgaaaaagattgatgcgattattaaacctttcaaactggatgatgtacgtgaagcgctggcagaagtaggcatcaccgggatgaccgtaactgaagtgaaaggttttggtcgtcagaagggccacaccgagctataccgtggcgcagagtacatggtggactttctgccgaaagtgaaaatcgagatcgtggtaagcgatgaaatcgtcgatacctgtgtggataccatcatccgcacggcgcagaccggtaaaattggcgacgggaaaatcttcgtctttgacgtggcgcgcgtgatccgtatccgtaccggcgaagaagacgacgcggcgatttaa

SEQ ID NO: 1387 - DNA, 1365 bp, Enterobacter cloacae
gacgccgaaacaagaggatgtgaagccatgacaagccgtaaacctgcccatctgttactggtggatgacgatcccgggctgttaaagctgctggggatgcgtctggtcagcgaaggctacagcgtggtcaccgctgaaagcgggcaggaggggctgaaagtgctcagccgcgagaaaatcgatctggtgatcagcgatttgcgcatggatgaaatggatggcctgcaactgttcacggagatccagaagcagcagcccgggatgccggtgattatcctcaccgctcacggatctattcctgatgcggtggccgcgacgcagcagggggtattcagcttcctcaccaaaccggtggataaagacgccctctataaagcgatcgacagcgctcttgagcacgcggcgccatccggcgacgacggctggcgtgaatccatcgtgacgcgtagccctgtgatgctgcgcctgctggaacaggcgcggatggtggcgcaatccgacgttagcgtgctgatcaacggccagagcgggaccgggaaagagatcctggcccaggcgatccacaacgccagcccacgcagtaaaaatgcctttattgccatcaactgtggcgcgctgccggaacaactgcttgagtctgagctcttcggccatgcccgcggcgcctttaccggcgcggtgagcagccgtgaagggctgttccaggcggcagaggggggcacgctgttccttgatgaaattggcgatatgcccgcgccgttgcaggtcaaactgctgcgcgtgttgcaggagcggaaagtgcgtccgcttggcagcaaccgcgatatcgatatcaacgtgcgcattatttccgctacccatcgcgatttacccaaggtgatggcgcgcaacgagttccgcgaagatctctactatcgactgaatgtcgtcaacctgaaaatcccggcgctggccgagcgtgcggaagatatcccgctgctggcaaatcaccttttgcgccaggccgctgaccgccacaaaccattcgtgcgcgcgttctccaccgatgcgatgaaacgcctgatgacagcaagctggccgggcaacgtacgccagctggtgaacgtgattgagcagtgcgtggcgctgacgtcatcgccggtgatcagcgatgcgctggtggagcaggcgctcgagggggaaaacacggccttaccgacgtttgcggaagcgcgaaaccagttcgagctgaactatctgcgcaagctgctgcaaatcaccaaaggcaacgtaacccatgcggcgcgcatggccgggcgtaaccgtaccgagttttataaattgctctcacgccacgagctggaagcgaacgattttaaagagtaa

SEQ ID NO: 1388 - DNA, 3918 bp, Enterobacter cloacae
gcgccccggcgcttcgaagacgagagacttatgatggaaattctgcgtggttcgcctgcactgtctgccttccgtattaccaaactgctggcacgttttcaggcggccgaccttccggtaagcaatatttacgctgagtatgtccattttgctgacctgaatgcccccctgaatgcagaggagcgcgtacagctggaacgtctgcttaaatatggcccaagcctgagcagccatacgccgaccggcaaattaatcctcgccacgccacgccctggcaccatctccccctggtcttccaaagcaacagacatcgctcacaactgcggcctgaaccagattaaccgtctggagcgcggtgtggcgtactacgtggaagcctctaccctgagcgacgcgcagtggcaggcggttgcggctgaactgcacgaccgcatgatggagagcgtgtttgactctctggatgatgcgcagaaactgttctcccaccatcagcctgcgccggtacagagcgtggatctgctggggcagggccgtcaggcgctgattgacgcaaacctgcgtcttggtctggcactcgcagaggatgaaatcgactaccttcaggatgcattcgttaagctgaatcgcaacccgaacgacatcgaactgtatatgttcgcgcaggccaactccgagcactgccgccacaagattttcaacgccgactggattatcgacggcgaacagcagccgaagtcgctgttcaaaatgatcaaaaacaccatggagcaaacccctgaccacgtgctgtctgcctataaagacaacgccgcggtgatggaaggttccgaggtgggccgcttcttcgccgatcgcgaagcagggcgctatgacttccatcaggagcccgcgcatatcctgatgaaagtggaaacccacaaccacccgacggcgatctccccatggccgggtgcggcgaccggctccggcggtgaaatccgtgacgaaggggcgaccggtcgcggcgcgaaaccaaaagcgggtctggtcggtttctccgtctccaacctgcgtatcccgggctttgaacagccgtgggaagaagatttcggcaagccagagcgcatcgtgaccgcgctggatatcatgaccgaaggcccgctgggcggcgcggcgtttaacaacgaatttggtcgtccggcgctgaacggttacttccgtacctatgaagagaaagtggacagccacaacggcgaagagctgcgcggctaccacaaaccgatcatgctggcgggcgggatcggcaacatccgtgccgatcacgtgcagaaaggcgagatcgtcgtcggcgcgaagctgatcgtgctcggcggcccggcgatgaacatcggtctgggcggcggtgcggcctcttcgatggcctccggccagtctgatgcggatctcgatttcgcctccgtgcagcgtgacaaccctgagatggagcgtcgctgccaggaagtgatcgaccgctgctggcagctgggcgatgctaacccgattctctttatccacgacgtgggagcgggcggcctgtccaacgctatgcctgagctggtgagcgacggcggtcgcggcggacgcttcaacctgcgcgatatcctgagcgatgagccgggtatgagcccgctggaaatctggtgtaacgaatcccaggagcgctacgtgctggcggttgccgccgatcagctgccgctgtttgacgagctgtgccgccgcgagcgcgcgccgtatgcggtcatcggtgaagcgaccgaagagcagcacctttccttaagcgacacccactttgacaaccagccgatcgatctgccgctggacgtgctgctcggcaaaacgccgaagatgacccgcgacgtgcagactcgcaaagcggcgggcaaagcgctggatcgccagggcatcaccgtggcagaagcggttaaccgcgtgctgcacctgcctgctgtggcagagaaaaccttcctggtgaccatcggcgaccgcaccgtgaccggtatggtatcccgcgatcagatggttggcccgtggcagatcccggtcgctaactgcgccgtgaccaccgcgagcctcgacagctactacggcgaagcgatggcgctgggcgaacgcaccccagtggcgctgctggacttcgccgcctctgcacgactggcggttggtgaagcgctgaccaacatcgcggcgacgcagattggcgacatcaaacgtatcaaactttccgcgaactggatggccgccgccggtcaccctggtgaagacgccggcctgtatgaagccgtgaaagcggtgggtgaggaactgtgcccagccctcggcctgaccattccggtgggtaaagactccatgtcgatgaaaacccgctggcaggagggtaacgagcagcgcgagatgacctctccgctgtcgctggtgataaccgcgtttgcgcgcgtggaagacgtacgtcataccgttacgccgcagctttccactgaagataacgccctgctgttgattgacctcggcaaaggccataacgccctgggcgccaccgcgctggcgcaggtttaccgccagctcggcgataagccagccgacgtgcgcgacgttgcccagctgaaaggcttttacgacgcaattcaggcgctggtggcgcagcgtaagctgctggcctatcacgaccgttccgatggtggcctgctggtgacgctggcagagatggccttcaccggtcactgcggcgttgaagcaaacattgctacgcttggcgaagaccgcctggcggcgctgtttaacgaagagcttggcgcggtcattcaggtacgcgccgcagatcgcgacgcggtagaagcgattctggcgcagcacggtctggcagactgcgtacactatctcggtaaagcggtgcagggcgaccgtttcgtgattgaagccgacggccacgcggtgttcagcgaaagccgcaccacgctgcgtatgtggtgggcggaaaccacctggcagatgcagcgcctgcgtgacaacccggaatgcgccgatcaggaacacaacgcgaaggcgaacgacaacgatcctggcctgaacgtgaagctcagcttcgacataaacgaagacattgccgcgccgtacattgcgaccggtgcgcgtccgaaagtggccgtgctgcgcgagcagggcgttaactcccacgttgagatggcggcggccttccaccgggcgggctttgacgccatcgacgtccacatgagcgacctgctggccgggcgtaccgggctggatgatttccaggcgctggttgcctgcggagggttctcctacggtgacgtgctgggcgcgggcgaaggctgggcgaagtctattctgttcaacagccgcgtgcgtgacgagttcgaaaccttcttccatcgtccgcagacgctggcgctgggtgtgtgtaacggctgtcagatgatgtctaacctgcgcgagttgatcccgggcagcgaagcctggccgcgctttgtgcgtaaccagtctgaccgcttcgaagcgcgcttcagcctggtagaagtaacccaaagcccgtctctgctgttgcagggaatggtgggttcgcagatgccaatcgcggtttcgcacggcgaaggtcaggttgaaatgcgtgatgcggcgcacctggctcagcttgaaagcaaaggactggtagcgctgcgctttgttgataacttcggcaaggtcaccgaaacctatccggctaacccgaacggttcggcaaatggcattaccgcggtcaccagcgaaagcggtcgggtgaccatcatgatgccgcacccggagcgtgtcttccgcaccgtgagcaactcctggcacccggaaaactggggcgaggacagcccgtggatgcgcattttccgcaacgcgcgtaaacaactgggttaa

SEQ ID NO: 1389 - DNA, 771 bp, Enterobacter cloacae
gccggaaaaatcaatgaaatgaataacaacctggtgagtatgtcacacgtcttttaccgcgcactgcgcgcggtgttttccagcaaaaatgtgcgcctcagcctgccctgcttactgctggccggctgtgtaacccatgcaccaaaaagtgcgattagccacaaacaggaagataaatggccgcaaaaacagctggccgatttcctttcaacacgttgcgatgatatctggagcctgtcggggcgtgatgttgaatccaatccgctgttctggctgcgcggaatagactgcgcccagcgactggcgcccgccgaggcccgtgcccaggcggcgatgctgatggacgatacctggcaggacgcgtttaaacgcgggatcgtgatggcggatgccagaatcacgcctgtcgaacgccgcgccaacgtgacgcggctggatacttacgtgatcaatattcccccccaggtgcgcccggtttatcagctctggcgggacggacaaaccctgcaattacagctgtccgaagagcgtttccgctacagcaaattgcagcagtcaagcgacagcgagcttgatgcgcttcgccagcagcaggagtcgctgcgcgagcagctggaaaccaccacccgcaagctcgaaaatctgaccgatatcgaaagacagctctcgacgcgtaagccggcaggcagctatctgcccgatgggtcgaaaggcaactctgccacgacgccagacagtgagacgccgaaacaagaggatgtgaagccatga

SEQ ID NO: 1390 - DNA, 1293 bp, Enterobacter cloacae
cataagatcagtaacaaccagaagcgctcgaaggagaggttaatggaaagcaaagtagttgttccggcggaaggtaaaaagatcaccctgcaaaacggcaagattaacgttcctcataacccgattatcccgttcattgaaggtgacggtatcggtgtagacgttaccccggcaatgctgaaagtggttgatgccgctgttgagaaagcctacaaaggcgagcgtaaaatttcctggatggaaatttacaccggtgaaaaatccactcaagtttatggccaggacgtctggctgccagccgaaacgctggacctgatccgcgactatcgcgttgctatcaaaggccctctgaccacgccagttggcggcggcattcgctccctgaacgtggcgctgcgtcaggaactggatctgtatgtgtgtctgcgtccggtgcgttactaccagggcactccaagcccggttaagcacccggaactgaccgacatggttatcttccgtgaaaactctgaagacatctacgcgggtatcgaatggaaagctgactctgctgacgcagaaaaagtgattaaattcctgcgcgaagagatgggcgtgaagaaaattcgcttccctgagcattgcggcatcggcatcaagccgtgctccgaagaagggaccaagcgtctggtgcgtgccgccatcgaatacgctatcaccaacgatcgtgactctgtgaccctggtgcacaaaggcaatatcatgaagttcaccgaaggcgcgttcaaagactggggctaccagctggcgaccgaagagttcggcggtgaactgatcgacggcggcccatggcagaaaattaagaacccgaacaccggtaaagagatcatcattaaagatgtgattgccgatgcgttcctgcaacagatcctgctgcgtcctgctgagtatgacgtgatcgcctgtatgaacctgaatggtgactacatctccgatgcgctggcagcacaggtgggtggtatcggtatcgccccgggcgcgaacatcggtgacgagtgcgccctgttcgaagccactcacggtactgcaccgaaatacgcaggccaggacaaagtcaacccaggctctatcattctgtccgcagagatgatgctgcgtcatatggaatggttcgaagccgcagacctgatcgttaagggtatggaaggcgcgattaacgcgaaaaccgtcacctatgactttgaacgtctgatggaaggcgctaaactgctgaaatgctcagagtttggcgacgcgattatcgcgaacatgtaa

SEQ ID NO: 1391 - DNA, 300 bp, Enterobacter cloacae
caacgggagcctgagggttcccgttttttatgcacacaagacggaaacaacgctatgacccatgatatcccgctcaagtattatgacatcgtcgacgagtatgcgactgaaacggcgaaaccggtagaagaggcagagcgtacgccgctggcacactatttccagctgctgctcactcgcttatacaacaatgaggaaatcagtgaagaggcgcagcgggagatggctgtccaggcggagatagacgaagcgcgcattgacgatattgcaaacttcctgaatcagtggggcaatgaataa

SEQ ID NO: 1392 - DNA, 1035 bp, Enterobacter cloacae
agacatattgacggcaatatcccggcaattggctttatttctcatgtcgatacctcacctgattttagcggtaaacacgttaatccgcagattgttgaaaactaccgcggcggtgatatagcactgggcattggcgacgaagtgctgtcgccagtgatgttcccggtactgcatcagctgctggggcagacgttaatcaccaccgacggcaaaaccttgctgggggccgatgacaaagcgggcatcgccgagatcatgacggcgctggcggtgctgaagggcaaaaatatcccgcatggcgatatccgcgtggccttcacgccggatgaagaggttggaaaaggcgcgaaacactttgacgttgaggcgtttaacgcgcaatgggcctacaccgttgacggtggcggcgtgggtgaacttgagtatgaaaacttcaacgcggcatcggtaacgatcaaaatcgtcgggaataacgtgcacccgggctctgcgaaaggagtgatggtgaatgcactgtcgctagctgcgcgtattcatgcggaagtgcccgccgaagagagcccggagatgacggaagggtatgagggtttttatcatctgaccagcatcaaggggaccgtggacagcgcgcagatgcactatattgtccgcgatttcgaccgcaaagcctttgaagcgcgcaagcgtaagatgatggagatcgcgaaaaaagtcggcaaggggctacatccggattgctatattgagctcatcatcgaagacagctattacaatatgcgcgagaaggtgatggaacatccgcacattcttgatatcgcccagcaggcgatgcgcgattgtgacatcgagccggtgatgaaaccgatccgtggtggaaccgatggttcacagctgtcgtttatgggcctgccgtgcccgaacctgtttaccggtggatataactaccacggcaagcatgagttcgtgacgctggaagggatggagaaagcggtgcaggtgattgtgcggatagcggagttaaccgcgaagcggtaa

SEQ ID NO: 1393 - DNA, 282 bp, Enterobacter cloacae
tttaatgacaaaaaccatacagagaggaaagctatgggaattttatcctggattatctttgggctgattgcggggatcctggcgaagtggattatgccgggcaaagatggcggcggtttcatcgtcacgatcattctggggattgtgggtgcagtcgtcggcggctggatcagtaccctgttcggctttggcagagttgatggcttcaacttcggcagctttgtcgtcgcggtgattggcgcgctggttgttctgtttatctacagaaaaatcaaaagctaa

SEQ ID NO: 1394 - DNA, 669 bp, Enterobacter cloacae
gctataatgcggcaattgataacgcctgaaaataccatgacgaaaacttcttttagaaaacaccgggttgagcgattcagctcacgacaagccaccagaagaacgccagaaccccagccaacgcgggtcatactgttcaataaaccctacgatgtattgccgcagtttaccgacgaggccgggcgcagcacgctgaaggactttatccccgtacagggagtctacgcagcgggacgtctggatcgcgacagcgaggggctgctggtccttaccaatgacggcgtgctccaggccaggcttactcagccgggcaaacgtaccggaaaaatttactatgtgcaggttgaaggcgagccggacgacgcgtcgctggcaaagctgcgcaacggcgtaacgctgaacgacggtcccaccctgccggctggtattgaacgtgtgaatgaacccgagtggctgtggccgcgcaacccgccgattcgtgagcgtaaatccattcctaccagctggcttaaaatcaccctttatgaaggccgcaaccgacaggtcaggcgcatgactgcgcatgtgggcttccctaccctgcgactcattcgctacgccatgggcagctatacgctggactcgctggcaaacggggaatggcgggatgttacccctaaggagaactga

SEQ ID NO: 1395 - DNA, 1287 bp, Enterobacter cloacae
acgcgccaaacctgcgctcgccactggttgcggaaagcatccgctgctggcagtctacggcgcgcctgccgctggatgtcattgcagaatttaactggccgtttacagagggtgtcaatggtgggggggcgtgatagaatacgccgccttgaagttcaatgtcgtgagtattccatgtcagataacagccagaaaaaagtaatcgtcggcatgtccggcggtgtcgattcctccgtttccgcctacctgttgcagcaacagggctataaggtggagggcctgttcatgaagaactgggaggaagacgatggcgaggaatactgcactgccgctgcggatctcgctgatgcgcaggccgtgtgcgataagctcggcatcgaactgcacaccgttaactttgccgcagaatactgggacaatgtttttgaactcttcctcgaagagtacaaagcgggccgcacgccaaacccggatatcctgtgcaacaaagagatcaaattcaaagccttcctggaattcgctgcggaagacctgggcgcagactacattgcgaccggccactacgtgcgtcgcgcggatgtgaatggcaaaagccagctgctgcgcggtctggacggcaacaaagatcagagctacttcctctatacgctgagccacgaacagattgcccaaagtctgttcccggtcggcgagctggaaaagccggaagtgcgtaagattgctgaagatctggatctgatcaccgcgaagaaaaaagactccaccggtatttgttttatcggcgagcgtaaattccgcgagttcctggggcgctacctgcctgcacagccgggcaaaatcgtcaccgttgacggtgatgagattggtcagcaccagggactgatgtaccacactctcggccagcgtaaaggtctgggtatcggcggcaccaaagagggcagcgaagatccgtggtatgtggtcgacaaagacgtcgaaaacaatattctggttgtggctcagggtcacgaccacccgcgcctgatgtccgttggactgatcgcgcaacagctgcactgggtcgatcgcgagccgctggaaggcacgctgcgctgcacagtgaaaacgcgctatcgccagacggacatcccttgcaccgtaaccgcactggatgacgatcgcattgacgtgcgtttcgacgagccggtttccgccgttacccctggccagtctgctgttttctacagcggcgaaatttgcctcggcggtgggatcattgaacagcgcctgccgctgcctgctgtttaa

SEQ ID NO: 1396 - DNA, 657 bp, Enterobacter cloacae
accgtttgcacacataaaggagaccgtgtggcgaagaactattacgacatcaccctggcgctggcgggaatttgccagtcagcccgtctggtgcaacagctggcgcatcagggtcattgcgacgctgacgccctgcacgtttcacttaacagcgttatcgacctcaacccaggctccacgctgggcgtctttggcggcagtgaaaccaatcttcgtctcggtcttgaaactctgctcggcgtgctcaacgccagcaaccgtcaggggttgaatgcggaactgacccgctacaccttaagcctgatggtgctggaacgtaagctgaacgcggcaaaaggcgcaatgaataccctgggcgatcgcatcgccgggctacagcgccagctcgaccactttgacctccagtctgagaccctgctgagcgcgatggccggtatctatgttgacgtgattagcccgctcggcccgcgtattcaggtcaccggttcgcctgccgtattgcaaagcccacaggtacaggcgaaggtacgcgcttcgctgctggcaggcatccgtgccgccgtgctgtggcaacaggtcggcggtggccgcctacagttaatgttttctcgtcatcgcctgacgactcaggcaaaacaaattcttgctcattgttaa

SEQ ID NO: 1397 - DNA, 1143 bp, Enterobacter cloacae
gagcctgcggaatacataaatatggattatcaattaacgcttaactggcccgactttattgaacgttactggcaaaaacgcccggtcgttcttaaacgcgggatcagcaattttatcgaccctatttctcctgacgaactcgctggtctggcgatggaaaacgaggtagacagccgtctggtaagccaccaggacgggaaatggcaggtcagccacggtccctttgaaagctacgatcacctgggcgaaaacaactggtctttactggtgcaggcggtcaacaactggcacgaacctaccgcagccttaatgcgtcccttccgcgccctgccagactggcgaatggacgatctgatgatctccttctccgttcccggtggcggcgtgggtccgcatctggatcagtacgacgtgtttatcattcagggtaccggtcgccgtcgctggcgcgtgggcgaaaaagtgccaatgaaacagcactgcccgcacccggatctgctccaggttgatccgtttgaagggatcattgatgaagagctggagccaggtgacattctttatatcccaccgggcttcccgcatgaaggttattccctggaaaactcgctgaactattcggttggtttccgcgcgccaagcgggcgcgagatgatcagcggatttgctgactatgttttacagcgtgagctgggcagttaccgttacagcgatccggacgttccggcgcgtgagcatccggcggatattctgccagaggagctggataagctgcgcgggatgatgctggatctgatcaacgaaccggagcacttcagacagtggtttggcgagtttatcagccagtcgcgtcacgaactggacgtcgcaccgccagagccgccttatcaggcagatgaaatttatgatgcgctccagcagggcgataagctggttcgtctgggcggattacgtgtactgcgcattggcgaagaggtattcgtcaacggcgagcgcctggactctccgcatcgcccggcgctggaatcaattgccagccaaatggtgctgactgcggatacctttggcgacgcgctggacgatccctccttcctcgccatgctggccgcgctggttaacagcgggtactggttttttgaggactga

SEQ ID NO: 1398 - DNA, 1425 bp, Enterobacter cloacae
cgactcaggcaaaacaaattcttgctcattgttaacctcccggagttgcgaattatggaattatcctcactgaccgccgtatcccctgtcgatggacgctacggcgataaagtcagcgcgctgcgcgggatcttcagcgaatatggcctgctgaagttccgtgttcaggttgaagtacgctggctgcaaaagctggccgcccagacagcaatcaaggaagttcctgcttttgacgcaaaggcaaacgattaccttgataaaatcgttgctgagttcagcgaagaagatgccgcgcgcattaaaaccatcgaacgcaccaccaaccacgacgtgaaagcagttgaatacttcctgaaagagaaagtggcatgcgtccctgccctgcacgcggtatctgaatttattcacttcgcctgtacgtctgaggatattaacaacctgtctcacgcgctgatgctctttaccgcgcggaaagaggtggtactcccttactggcgtaaaatcattgatgcggtgaaagcgctgtccgtggaataccgcgacattccgctgctgtcccgtactcacggccagccagcaaccccatccaccatgggtaaagagatggcgaacgtggcgtaccgcatggaacgccagtatcgtcagctggagcaggttgagatcctcggcaaaatcaacggcgctgtgggtaactacaacgcccacatcgccgcgtacccggaagtggactggcaccagttcagcgaagagtttgtgacctctctggggatccagtggaacccgtacaccacccagattgagccgcacgactacatcgccgagctgtttgactgcattgcgcgcttcaacaccatcctgatcgacttcgatcgtgacgtatggggttacatcgccctgaaccacttcaagcagaaaaccatcgccggggaaatcggttcgtccaccatgccgcacaaagtgaacccaatcgacttcgaaaactccgaaggtaacctgggtctggcgaatgccgtgttgcagcatatggcgagcaagctgccggtatcccgctggcagcgcgacctgactgactccacggtgctgcgtaacctgggcgtaggtattggctacgcgctgatcgcctaccagtccaccctgaaaggtgtgagcaaactggaagttaaccgcgaccgtctgctggacgagctggatcacaactgggaagtgctggcggagccgattcagaccgtgatgcgtcgttacggcattgaaaaaccgtacgagaaactcaaagagctgacccgcggtaaacgcgttgatgctgaaggtatgaaacagtttatcgacggtctggcgctgccagaagaagaaaaagcgcgcctgaaagagatgaccccggcaaactatattggccgcgccattactatggttgacgagctaaagtaa

SEQ ID NO: 1399 - DNA, 297 bp, Enterobacter cloacae
  unsure (71)
  unsure (81)
aggaggagattattggccgggttggggggggatgaaattttggttgcccgcctgagtcacagcgatgatgncgacaccagnacagagatcaacgcaatcaaaacccgcctcaatggtcttattgcgggcgaatacgggttaggcaatgccaccattctttatcccggtgcaagccttggcgtcgttattgttgatcctcacagcacggatgaagatagcgccctgcgcaccgcggacctcgcgatgtatcaggataaaaaaggaaaaagcaaaacaggctttgtcgcgttagattaa

SEQ ID NO: 1400 - DNA, 1548 bp, Enterobacter cloacae
cctgtgataagatccctgcacctcaggacgtggcgggacagcaggaaaatgaagaaggccattgccgttgctatcatctcaaccctaatggtcgtcctgtcgctgtatgcggttaacgccattatcgctgagcagcaaaagaaccggcagagggagatctcccacacgctcttaagctattccgaagagttaacacaaaatatcgccagtacgcttaaaaataccaccgtgcagggatgcgatagcgccagtctgaacgtctaccgaaaattaaagatgcgtagtctctatttcgccgatgtggggtttatagaaaaggggaaaatcacctgcaccgcgttttggggcaagctggcaaatcccatcgcccttccccctgagctgcataaaacccacaacggattcagtctggcgcagttttcgcagaaagatttctttatcggtaatgcgacaatttataaccaccttattattttcacctcccgttcagcctacgataaatttgcccccgttaccgccaactattcgcttcgttcttccactaaagatttcggccgcacctttttcaccgttacgccgccatcagaaaacttcagccgcttacagtctctgttatttacgctggctgtgacagagtgcagtacacgctgggatttgtgcgttaccgtcacacaccatgatgccggactggcttcgctctcccacgtagtgatggtgcttctgtgcttgtttttatactttatctgggtatccctgacgctgttttctcttcgactttatgaagaccgacgttctctggaacgaacgctggtcaaagcggtaaaagcgaataccatcagcgttcattttcagcccgttattcgggtggctgataagaaaatcgttggggttgaagtgttatcaagatggcaggataacaatcacaaagaggtttctcctgagctgtttatcccgttaattaaaaaaattggcctgtataacgtttattatcagaacatgataaagaaatccctggcggaaattgccgcgctggccgctgaacatcagttaatgatttcactgaacgttggccggacggaaattgaagacggcaaattcctgtcggtattacgtcatgcatgctcagagaacgcgattcctttatcgttaatcaaagttgagttatccgagaatggcgtttccacctcggccatccttgaagaattttgtgaggagcttaaatcggcaggcgtcaaaatttcaatagacgattttggcgtgcaaaactctaatcttgccaggctcacaaatctcaaatatgacgaaatcaaggtagataagtcgttagtggacggcatcagcgagcactataaacaggatatcctggtgatcttcagcgacgcgctcgctaaactgaacaaaaccctggtttttgaaggggttgaaagcgaaacacaatttcagttcatcgcgcagagataccccgatgccctcgtacaaggctggtacttttcaaagtcgctaacccggcacgacctcgccaggctgctggcagactcagcgcgatga

SEQ ID NO: 1401 - DNA, 483 bp, Enterobacter cloacae
ggagaactgatgtttaaacctcatgttacggtcgcctgcgtggtccacgcgcaggggaaattcctggtggtggaagagaccattaacggcaaagcgctgtggaaccagccagccgggcatcttgaagccaatgaaaccttattgcaggcagcgaaacgcgagctctgggaagagacgggtatccgcgccgaaccgcagcactttatccgtatgcatcagtggatagcgcctgaccagacacctttcctgcgctttttattcgccgttgagcttaacgaaacgtgcgccactgaaccgcacgacgacgatatcgatcgctgcctgtgggtgaccgcagaggagatcctgaacgcgccaaacctgcgctcgccactggttgcggaaagcatccgctgctggcagtctacggcgcgcctgccgctggatgtcattgcagaatttaactggccgtttacagagggtgtcaatggtgggggggcgtga

SEQ ID NO: 1402 - DNA, 720 bp, Enterobacter cloacae
ataatcagcgttaaactattcataccatttataaagggagaaatgatgatgcgcgtactggttgttgaggataacgcattgctacgtcatcacctgaaagttcaacttcaggagatggttcatcaggtggacgatgctgaagacgcgaaagaggccgattattatctcaatgaacacctgccggacatcgccattgtcgatttagggctaccggatgaagacggattgtcccttatccgccgctggcgtagccatgacgtttccctgccggtgctggtgctaactgcccgtgaaggctggcaggacaaggttgaagtcctgagcgctggcgcggatgactacgtgactaaacccttccatattgaagaagtcgccgcgcgtatgcaggcgcttctgcgccgcaacagcgggctggcgtcgcaggtgatctctctgccgccattccaggtggatctctcccgccgcgaattttctattaatgatgaagtgatcaagctgaccgcattcgaatacaccatcatggaaacgctgatccgtaacaacggtaaagtggtgagcaaagattctctgatgcttcagctctatccggatgccgaactgcgcgaaagccacaccattgacgtgctgatgggccgcctgcgtaaaaaaattcaggcgcagtacccgcatgacgtgatcaccaccgtgcgtggtcagggttacctgtttgaattacgctaa

SEQ ID NO: 1403 - DNA, 1464 bp, Enterobacter cloacae
atgaaagggattttgcgtcacattttacccctttcgctgcgggttcgctttttgctggcaaccgccgccgtcgtgctggtgctgtcgctctcttacgggatggtggcgctggtcgggtatagcgtgagcttcgataaaaccaccttccgcctgcttcgcggcgaaagtaacctgttttataccctggcgaagtgggagaacaaccgaatcaccgtcgagatgccggaaaacctgaatcagcagagcccgacgctggcgctgatctacgatgaaaaagggaaattgctgtgggcccagcgcgatgtcccgtggctgaaaaagcgcatccgtccggaatggctgaaaaccaacggttttcatgaaatagaagccgatctcaactccaccagcagcctgctgcgtgacgatcgcgccttacagatcaagcttaatgagatccgtgccgaagatgacgacacggagatgacccactctgtggccatcaacctttatcccgccaccctgaacatgccgcagttaaccattgtggtgatcgataccatcccggttgagctgaaacgctcatatatggtctggaactggtttgtgtatgttctggctgccaacctgctgctggtgatccctctcctgtgggttgctgcatggtggagcctccgcccgattgaatcccttgccaaagaggtgcgcgagctggaagaacatcaccgcgagaagctgaacccggaaactacgcgcgaactgaccagcctggtgcgcaacctcaaccgcctgctgaaaagcgaacgtgaacgctacgacaagtatcgcacgacgctcaccgaccttacgcacagcctgaaaaccccgctggcggtgatgcagagtaccctgcgttccatgcgcagttcgaaaatgagcgtggatgatgcagagccggtgatactggaacaaatcagccgtatttcacagcagatcggctattacctgcaccgcgcgagcatgcgctccggaagcgctctgttgagccgtgaactgcacccggtagccccgctgctggataacctcacctcggcgctgaacaaggtgtaccagcgtaaaggggtcaacatcagtctggatatctcaccggaaattagctttgttggcgagaagaatgactttatggaagtgatgggaaacctgctcgataacgcctgtaaatattgtctggagtttgtcgaggtttccgcgcgggtaacggataacgaactgcatattatcgttgaggatgatggtcctggcattccccgtaataaacgcgaagtggtgttcgatcgcggccagcgcgccgatacgctgcggccaggccagggcgtcggattatccgtcgccagggaaattgtcgatcagtacgagggcaagattgaaaccggtgaaagtttgctgggcggagcccggatggaagtcatttttggccgccagcatcccgtatcgaacgatagttga

SEQ ID NO: 1404 - DNA, 1431 bp, Enterobacter cloacae
ccccgatgccagatctcgcaattgttaaccttttcatcctggttaaccctgtttacggagcacctcaaaaataaaccttacactggcaaggtgaatacaatgaccgagataattacccgtaaagaaaagatcagttatgggttaggcgatatggcgagccatattgggctggataacgtcattatttttctgacgttttactatacggacgtggtggggctacctgccgcattcgtgggcaccatgtttcttctggcgagaaccgccgatgccataatagacccggcgatgggctatatcgctgacaggacgcgcacgcgctggggcaaattccgtccctggatgctgtggctggcgctgccctttggcgcaagttgtctgctgacctacgccgtgccggcgtccctcgatctgcacggtaaaatgattttcgctaccgtcagttataccctgatgatgctgatgtataccgcaatcaatattccctattgctccatgggcgcggtgattacgcccgacaacgatgcgcgaatttccctccagtcttatcgctttttccttgccactttgggtggcgcgctgtcgacattctttatgatgccgctggcagagtttttaggtggcgacgataaattactgggctaccgctgggcaatggccattatggcgaccgtcgcggtcgtcatgttctggatctgcttcgccaatacgcgtgaacgtattaaggctcccgctacccacaataattatcttgcggaactgcgggatttattacgaaacgaccaatggcggattgtcgccgtcctggtattaaccaacattggttttggcgttattcgccttggcgcaatgatgtatttcgtcacttattatctcggtagcgcaagctattttatgtggatgctcggggcgcatattctcgggaaagccgcaggcagcgcgctggccaaacgtctgacgcagaacgtcagcaaagtgcagatgtttggatactgttccgtactggcgggggtactcagcatcgctctgttctttgcgcctaagtcggtgcttattctggtgcccatgacgtttattgtctccaccctttaccaggccaccaccacgctgatgtgggtaatgatggcggacgtcgccgattacggcgaatggaaacagggcaaacgcatggacggcgtgatcttctccactttcctcgccgtactcaagttggggatggcgatcagcggcgcgattgttggctggacgctgggcttaagcggttatgttgccaatgccccggagcagaccaacacggccatgtactgcatcatcgccctattcaccgtcgtgcctggcgtcttgtcactctgcgcgtttgccacgctgcgctggtataagctcgacgacagcacaatgcaatccatccatctcgccaaacaccctgtttag

SEQ ID NO: 1405 - DNA, 2052 bp, Enterobacter cloacae
aaggacgcgttatccatgagtgagctgattcaacattccaacagcatcgaatggcgttttgaacgccagatcctgcgtattgaaccgtggggagaaaacagcctgcgcgtcagggccacctgctccccggcttttgaggacgccttacaggcactgttgcccgccgccccttgccaggctgagattatcgccgaagcggaaagcctgacgctgcgcaacggcaatattaccgcgacgctgaaccttaaaggtcagctggccttctacaatcagcgcggcgaactgctgctggaagagatgtggcgccagcgttcaacggtgggtatcggtgccagcgagaagagtcaggataaatatgtcagcgccctgaagctggatggccgtgaatttaagccgctaatggggggaaaatatcagctcaccgtccggtttgaatcgcgtccggatgaacgcatctatggcatgggtcagtatcaacagccgtggctggatctgaaaggctgtacgctggaactggcgcagcgcaactcccaggccagcgtgccctttatgcagtccagccttggctatggcctgctgtggaacaatccggcgattggtgaagccagctttgcaaaaaatcagacggaatggcgcgcccgcgtgacgggagaaatggactactggatcaccgccgctgacacggtggcggatatcacccgccagtatgtaaaagccaccggaactccgcccgccgccccggcgtttatcagcgggctgtggcagtgcaaattacgctaccgcacccagcaggaggtgctagaggttgcgcgggagtatcgccgccgtaatctgccgctgtcggtgatggtcatcgactttttccactggccgaatcagggcacctggtgcttcgaccccgtagactggcccgaccctgaagggatggtcgacgagttgcgcgaaatgggtattgcgctgatggtgtcggtgtggccaacggtagaggcgcgcagccctctctatccgctgatgaaagccaaaggctggctggtcagcagtgaacgtggcgtgcaggtcaacctcgactttatgggcaataccaccttctttgatgcgacccatcctgaggcgcggaaattcgtctgggatacggtgaagaaaaattactacgacatgggcattaagctgttctggctggacgaagcggaaccggaataccgcgcctatgattttgacaactatcgctaccacgccggtccggtactggaagtgggcaatcgctacccgcgtgattttgcgcagggcttttacgatgggctccaggcaaacggtgaaaccgacattgttaaccttgtacgctgcgcctgggcaggcagccagcgattcggcgtgctggcgtggtcgggtgatgtccactcctcattccatgcttttcgcaatcaactcgccgcgggactgaatatggggctggcggggatcccatggtggacgaccgatatcggcggcttccagggagggaacgttaacgacccggcgttccacgaattactgatccgttggttccagtgggcggtgtttacaccggttctacgcatgcacggctatcgcgaaccgcagatccagcctccggagcgctaccgtgacggcattcctcagtgtaacagcggttcgcctaatgagctgtggagttacggagaagagaattacgccatcatgcagcgctggcttaccgtgcgcgaaaccctgcgcccgtatattgacgcgttgtaccagcaggctcatctgcacggagacccgctcatgcgtccgctattctggcactatccgcaggacaagcagagctgggcgtgtgaagatcagtatctgtttggcgaagatcttctggtggcaccggttatgcaggccggccagcgtgagcgcgatgtctggttgccgacgggcaatagctgggtcgctctcaacggtgagcgctacgccggtggggagcatatccgggtgcctgcggcgctggaaaccatcccggtgtttatccgcgaagggagtccgcttatccagcaactggtggactga

SEQ ID NO: 1406 - DNA, 411 bp, Enterobacter cloacae
attgggtggataaaagccgggtgctatagtgttcttgccgaacgtcgcacggcaggaggaaaacggatgattcaatgtaagcgcgtatatgaacaggcaacgtcagacgatggttaccgggtgctggtagacagactctggccgcgaggaataaaaaagaccgacctcgcctgtgatgagtggtgtaaatcgctaacgccgtccagcgaactgcgaaaagcttttcacagtgaaacgatagatttcactgcgttcagtgaagcctatcgtaaagagctggcgcagcatcaggatgaaggcaaacgcctggcggccctcgcccgacagcagaccgtgacgctactctacggggcgaaaaacagggagcagaatcacgcgcgggtactggcggactggctacgtaaactgtga

SEQ ID NO: 1407 - DNA, 279 bp, Enterobacter cloacae
agtggagagaaacgcatggggcagttagtaacacttcatgagtgggcatctggtcctaatggattcaaatatccattaagcaactcagcattaaacaaaatagcaaagaccaaacagacttatccgccagccttaaagcaaggtcgacgctgggttatagatgaagatgctcgttttgttggcatggttggcagtgttgatatttcgtcatcattatcagacaaggcccgccagttagtggagaaagcaataaatggcagctcgccccagaaaacataa

SEQ ID NO: 1408 - DNA, 513 bp, Enterobacter cloacae
agcctgcctgccgacgcgtttgcgcgtaaagtaagcaggcttactatttttggcaaggatcccgtcatgttcgaccctacactgctcatacttctggccctggctgcactgggttttgtcagccacaacaccaccgtcgcgatttccattctggtcctgatcatcgttcgcgtcacaccgttgaacaccttcttcccgtggatagaaaaacaggggcttaccatcgggatcattattttgaccatcggcgtgatggccccgattgccagcggaacgctaccggcctcaacgctgctgcactcctttgtaaactggaaatcgctggtggcgattgcggtgggcgtttttgtctcgtggcttggcggtcgcggcgtgacgctgatgagcagccagccttcgctggtggccgggctgctggtgggcaccgtgttaggcgtggcgctgtttcgtggcgtgccggttggcccgctgattgctgccggtctggtttcgctgtttatcgggaagtcgtag

SEQ ID NO: 1409 - DNA, 711 bp, Enterobacter cloacae
cctctccctcatccgctttcagaagaatctataaaattaatcctgttcatgttttactatgaccggagtctaaattttcagcataacatgcagatacagaggtcttctgcatgggagtcaacctgcctcatgtcagatatcattcttgcccgtgtttcagaaaccctctccactgagcaatctctcgacagtcttgtgcgtcagctactggaaatgctggaaattgtgacggatatggaatcaacctacctgaccaaaatcgatattaacgcgcgtttgcagcacattttatatgcccgtaacagcaagcaaatgcaaatcccggaagggttcagcgtgccctgggacgaaacgctctgtaagcgcgccatggatagcgacactttgttcagtaacgaggtgcctgaccgctggccggagtgtgaagcggcaaaagcactgggtattacaacctatatgagcgtgccggttcacctggctgacggttctctgtacggcacgctttgcgctgccagcaccgcacagaaacagttcagcgagcgtggcgagcaggtgatcaggctctttgccgggttaattggtcagtatattcagaaagagtcgcttgtgcttcagcttcgtgaagcaaatgcggcgctcattacccattcttacaccgacgcccttaccggcctgccgaatcgtcgcgccatttttgaaaaccttaccacc

SEQ ID NO: 1410 - DNA, 1143 bp, Enterobacter cloacae
atggcagctcgccccagaaaacataacgtcaaaatacccaacctttactgtaagttagataagcgtacttcaaaaatttattggcaatatcgccaccctgtaacaggttcatttattggattcggaacagatgatgaagcggcaaaagctgctgcaatcgagatgaaccgtataaccgcagaacaagaaactcagcaatcttatgctctgattgatatggcaatgaagagctcagggaaaaaggatcaagatatacgtgtttctgagtggattaaaaaatacatcgaaattcagatggaaaggttgcgtgacggtgagataaaaaaccctactgtaaaatccagacgattatgttctcagattctcgcagatagagtgccaaaccttcgcctgaaggatgttgatacaagactcattgcaaaaattattgatgaatataaggcagagggaaagcacagaatgggccaactgataagaagcgtactaaacgacgtgttcaaagaggcgcagcatgctggcgaggttgatcctggctacaacccagccttagctgtaaaaaatccaatagccaaagtgaaacgaagcagacttagcattgaacaatggaaattgatttttgaaagcgcaggctctttgccgccttgcgctcaaaattctatgcttttggctttagtaaccgggcaaaggataggtgacatagtcgagatgaagtttagtgacatttgggataatcaccttcatgttacccaaaataaaaccggaatgaagttagctatccccttaaatttaaggtgcgatgcaatcgggttgactctggctgatgttattagtaagtgtcgcgatagagtagtgagcccttatctgatccaccatgttaagcatcacgcttacggtaaagcgggatctcacgttccagaaaaaacgatatcaagatattttaaggaggcaagagataaagcaaatattacctggcctaaggattgcactgcccttccgccgtttcatgaacagcgctcgctttcatcaagaacatacaaagctcagggtatagatgtcaaaactcttttaggacataaaaccgaagcaatgagcgtaatgtatggagatgatcgtggtctagaatggaaaaaagttgtgatttaa

SEQ ID NO: 1411 - DNA, 537 bp, Enterobacter cloacae
caagctacgtattggcaaatcacaggtgaaatcgttatgtctgatgacgtgaccgggacgacgacccatcagcggctaatcagcttattaaccgagcaggaggcgcgctttcgcgtggtggcgcatgaggccgttgggaaatgcgaagcggtcagtgaaattcgcgggaccgatctccggcagggtgcaaaagcactggtctgcaaggtaaaaggcaacggcgttaagaaacatattctggcaatcctcgccgccgatcggcaggccgatctgagcctgctggccagccatttcggtgggctaaaggcctctctcgccagtccggcagaagtggatgcgcttaccggctgcgttttcggcgccattccccccttcagctttcatccggatctgacgctggtcgccgatccgctgctgtttgagcgcttcgatgagatcgcctttaacgccggcctgctggaaaaatcggtgataatggatacccaggactatctgcgtatcgcccgtcctgaactggtgacgttccgtaaacaataa

SEQ ID NO: 1412 - DNA, 1197 bp, Enterobacter cloacae
gagacaataatgactactgctattcaaccttccgggaaacagggtgcactgctggttgcaggcatcctgatgatcgccacgacgctgcgcgtcacatttaccggtgtcgcccccctgctcgacaccatccgacaggactatggcttaagcacggcgcaaaccggcctgctcacaacgctgcccctgcttgccttcgcctttatctctccccttgccgcaggcgtcgcccggcgcctgggcatggagcgcagcctttttatcgctctgctgctgatttgcatcgggattggcgtacgttcgctgccgtcggccgcgctgctgtttatcggtacggcgatcgtgggctgtgggattgcgctgggcaatgtcctgttacctggcttaatcaaacgtgattttccgggccaggtcgcaaaactcacgggggcgtattcgctgacgatgggggccgccgctgccgcagggtcggcgctgatcgtcccgctgtcgctggggagtggtggctggcacggagcgctgttgatgctgatgttcttcccgctggtggcgctgctgctgtggttaccgcaatggcgccagaggccggccgccaccctgaccggcgcgggcgcgttgcacaaccgggctatctggcgctcggcactcgcctggcaggtgacgctttttatgggcattaactcgctgatttactatgtcattatcggctggttacccgcgattttgcttagccacggctacagcgaaacgcaggctggctccatgcacgggcttctccagctggcaaccgctgttcccggtctcgccattccgctgatcctgcaccgtcttaacgatcagcgtggcatagccgggcttgtcgctctgatgtgcgctgtcagtgcggccgggttctggttcgcgccggggctggccgtcgtctggacgctggtgtttggctttggatccggcgccaccatgatcctcggcctgacgtttatcggactgcgggccagctcggcacatcaggccgccgcgctctccggcatggcacagtcgattggctatcttctggcggcctgtggcccaccgctgatggggaaaattcacgataccgccggagactggcgcattccgctgctggcctgtgcgctggctgcggtagtgatggccctgtgcggcatgctggccgggcgtgaccgggagatcacaccccgctga

SEQ ID NO: 1413 - DNA, 753 bp, Enterobacter cloacae
ggctccttatgttatctgaaaatcctccggcataaggaatctctcatggaactctccccggttaaaacgacgctgcgcattgcgctggttggtgatttcaatcctgatgttattgcgcaccaggcgatcccgctggcgattgacgacgccgctgcggttctggatctcaccgctgattatgactggctcgccacgcctgagctgaccagccccgaagacctcgtcgggtatgatgccatctggctggtaccggcaagcccgtataaaaacaccgaggcggcgtttattgcggcgcgttacgcgcgtgagaatagcatcccctttctcggcacctgcggcgggttccagcatgcgctgattgagtatgcgcgtaatgtactgggctggcacgatgcaggccatgccgaaaccgataccgagggaaggatggtgattgcgccgctgacctgctcgctggtagaaaaaaccgacgcgatagagctgcggaataacacgctgattgccaaagcgtatggcaagccggaaattcaggaggggtatcactgcaattacggtgtctcgtctgagtttgccagccagcttgagcggggcgacatgcgcgtaacgggctgggacgagcagggcgagatccgcgcggcagagctgataacccatcctttctttgtcatcaccctgttccagcatgagcgggctgcgcttcaagggcgacctgtcgtgctggtacaggccatgctgcgggcggcgcagggataa

SEQ ID NO: 1414 - DNA, 267 bp, Enterobacter cloacae
aggatcatgataatgaaatatcttctcctggcgctggttgtaccgctggccgcctgctcaacaaagaccacccctcctgatgcgcctcaaccgccgcacgctattggtatggcaaacccggcgtcagtgtactgtctggagaaagggggagagcaaatccctgttcaaagcccgcagggtgtacgtaccgagtgcaaattaccaggcggggaagtgatcgatgaatgggatctctaccgacgcgatcacccgcaaccaaccagatga

SEQ ID NO: 1415 - DNA, 825 bp, Enterobacter cloacae
aatgacagtttatcgctaatatcggacaactttatgtacggactggggctcgacggctacgatcccgatagccagcacgacgcggcggtggcctttcgcatccgcgtggtggcacaggaacaatttattccgctgcatcagcaccgcaaagggcagctgattatggcgctgggtggagcgatcacctgtgaagtggagagcgcgatgctgatggtgccgccccagtatgcggtgtggatcccaggacaaacgccgcacagcaacaaggcgacgcccggcgcgcagctctgcctgctgtttattgaacccggtgcgctcgaattgccgacgcgtacctgtacgctgaaaatatcgcccctggtgcgggagctggtgctggcgcttgcggacaggtcacgggaagagttgcctcttcccgctacgggaaggctggtagacgtcctgtttgatgaactgcccctgcaaccgcaggagcatctacagctgccggtatctccgcatccaaaaattcgcctgatgagtgagaccatggcaaacgaacctgccgcctggcagacgctggcgcagtgggcaagccactttgccatgagcgaacgcaatctggcgcggctggtggtgaaagagaccggcttaagctttcgccgctggcggcaccagctccagctgattgtcgcattgcagtttttgatcggcgggaagtcggtccagcaggcggcgcaggcgctggggtatgactccaccaccgccttcatcaccatgtttaagaaagggctgggacagacgccggcccgctatatcgccagcctgactacgacttcccgataa

SEQ ID NO: 1416 - DNA, 567 bp, Enterobacter cloacae
acacagaggcccgccgactgcacctttactaaccacgcgtttgacagcctgatcccgtccctgaaatttaaaaaatacgatgcggtgatctccggcatggacattacgccagagcgcagcaagcaggtcgcgttcaccgacccgtactacgcgaactctgcggtggtgattgcgaagaaaggagcttataaatctttcgacgagctgaaaggcaagcgcatcggcatggagaacggcaccacgcaccagaaatacctccaggacaagcatcctgaagtgaaaaccgtggcctacgacagctaccagaatgccattatcgacctgaaaaatggccgtatcgatggcgtatttggcgacaccgcagtcgtgaatgagtggctgaaaaccaacccgcagctgggtacagcgacggagaaagtgaccgatccgcagtatttcggcactggcctcggtattgccgtgcgtccggataacaaggctctgcttgagaaactgaacggcgcgctgaaagcgatcaaagctgacggtacgtaccagaaaatcagcgagcagtggttccctcagtaa

SEQ ID NO: 1417 - DNA, 333 bp, Enterobacter cloacae
cggcaggttatcgtgcactataggtgctattcgccgtcaggcttgttttttgaggagagagaaatgtttgcagtaatttttggtcgtccaggatgcccttactgtgtgcgcgcgaaagaactggcagagaaactgactgaagagcgtgatgatttcaacttccgttatgtggatatccacgcggaaggcatcactaaagccgatctggaaaaaaccgtgggtaaaccggttgaaaccgtgccgcagatcttcctcgatcagaaacacatcggcggctgcaccgattttgaggcctacgccaaagaacacctgggcctgtttgcggctcagtaa

SEQ ID NO: 1418 - DNA, 882 bp, Enterobacter cloacae
ttgagaattccagtgaactatatagatcaatttatcaattttgtttctaccttgtacactcctagaagagcctgcacaacattatttatgatatgtggtggagtcctatccttatgtaaaatattaccgcttctacatttatggctaacgactgcaataaaaccgatagcacaaaactatgaaacttatattttattaatttcacttgtaataggtgtttcattaggaattgttgttttcagcatagttgatttgattgtattaacaatctatgaacacctcatttctaaaaagaaaaaatcccaaagtgaattaaaagcgattaaggaaaagaatatacgtgacgaagtaatattttcaaattttaaaactgcttacttccatctcagtattgataagattaatattattagaagcttaatcacattcccttcccttagctttcatagcgaacatgaagatgtaaaattccttgaaaaatcagggtggattgaagcgttaacttacatcagtgatgaggagaaggtatatcaacttaatcaaacaatcaggttatatgctgatgatagatggaacgaggaagtaaatttcaacacggatcattttcatagctttgacgcagaaacagctatatccattattaatgccatgtccgatgtaaaaatcaaggcagaattagatgagttcaacttttcattttataagagcgacattgaaaaatgttttgaagtaagtgagtttaccgagacgctttactctttaagattcaaagaaagatatgaaaaaaagttttccgagctacacctcaaacctttcagaagtgagcgattattttctataaaggttcgtgaaaacattccagatttagacattcctttttag

SEQ ID NO: 1419 - DNA, 1803 bp, Enterobacter cloacae
tgtttagggtatttatcaggaagcagggagatgcaaagtgattccctgactctgaaaacagtagcccaaatagtcctttcattcaacaacttactggtaaacaagaagttagcctccgtgaatataaacgtcgcagacttgttaaatgggaattacatcctgttattatttgtggtactggcgctgggcctttgtctgggtaaattacgcctgggttcagttcaacttggtaattccattggcgttttagtcgtctccctgttattaggtcaacaacatttcagtattaacacggacgcgcttaacttaggtttcatgctgtttattttttgcgtaggcgtggaagccggtccgaactttttttccattttcttccgagatggcaaaaattacctgatgctggcgctggtgatggtcggcagcgccctgctgattgcgttagggctgggcaagctgtttggctgggacatcggcttaacggccggtatgctggcaggctcgatgacctccacaccggtgcttgtcggcgcgggcgatacgcttcgtcattctggcatggccggcacgccgctttcctccgcgctggacaacctgagtctgggctatgccctgacctatctgattggtctggtgagcctgattgttggcgcgcgctatctgccaaaacttcagcatcaggatctccagaccagcgcccagaccatcgcccgcgagcgcggcctggacacggactccaaacgtaaagtttacctgccggtgatccgcgcctaccgcgtcgggccggagctggttgcctggaccgacgggaaaaacctgcgcgagctggggatctaccgtcagaccggctgctacatcgaacgtatccgtcgtaacggcattctggcaaacccggacggtgacgcggtgctccagatgggcgatgacatcgcccttgttggctacccggacgcccacgcgcgtctcgatccgagcttccgtaacgggaaagaggtgtttgaccgcgacctgctggacatgcgtatcgtcaccgaagagattgtggtgaaaaaccacaacgccgtgggccgccgtctggcacagctgaagctgaccgaccacggttgtttcctcaaccgcgtgatccgcagccagattgaaatgcctatcgacgataacgtggtgctcaataaaggcgatgtgttgcaggtcagcggcgatgcccgacgtgttaaaaccgttgccgaccgtatcggctttatctcgatccacagccaggtgacggacctgttagccttctgcgccttcttcattgtcggcctgatgatcgggatgatcaccttccagttcagcaactttagcttcggcattggtaacgcagccggtctgctgttcgcagggatcatgctgggcttcctgcgagcgaaccatcccaccttcggctatatccctcagggtgcgctgaacatggtgaaagagttcggtctgatggtctttatggcgggtgtcggcttaagcgccgggagcggcattggcaacggcctgggcgcggtcggctggcaaatgttggtttccggacttatcgtcagcctggtaccggtggtgatctgtttcctgttcggcgcttacgtgctgcgcatgaaccgcgccctgctcttcggggcaatgatgggcgcgcgcacctgcgcaccggcgatggagatcatcagcgacaccgcgcgcagcaacatcccggcgctgggctatgcaggcacctacgccatcgcaaacgtgctgctgacgctggcaggtacgctgatcatcattatctggccaggactcggataa

SEQ ID NO: 1420 - DNA, 480 bp, Enterobacter cloacae
ccgaaggtgggatggttcgctcgcaggaagcccagcatgatccctgcgaacagcagaccggctgcgttaccaatgccgaagctaaagttgctgaactggaaggtgatcatcccgatcatcaggccgacaatgaagaaggcgcagaaggctaacaggtccgtcacctggctgtggatcgagataaagccgatacggtcggcaacggttttaacacgtcgggcatcgccgctgacctgcaacacatcgcctttattgagcaccacgttatcgtcgataggcatttcaatctggctgcggatcacgcggttgaggaaacaaccgtggtcggtcagcttcagctgtgccagacggcggcccacggcgttgtggtttttcaccacaatctcttcggtgacgatacgcatgtccagcaggtcgcggtcaaacacctctttcccgttacggaagctcggatcgagacgcgcgtgggcgtccgggtag

SEQ ID NO: 1421 - DNA, 528 bp, Enterobacter cloacae
cagtcggttagtttaatcgtaatagctaccgacagccacctattatcgcacgacttctgtgcgtgctttggcaaggattgccgcattgctttatctgactgggcgtccaccggacgatttttgtatttgatagagataagtcaggaggatagtttgaactttaaacgaaactgggctggcgtaatcagctgttttttgctgtttacggtcgtttgcatgtcactcgcttttaacgtgaaaggcgccttcagagcgtccggtcatcccgagctgggcctgttgttcttcatcctgccgggggtagtagccggttttctctcacgtaaaggcgaggtggtgatgccgcttattggggcaatgcttgcggccccgctctgcctgcttctgatgcgcgtgctgtttctctcgtcgagaagcgtctggcaggaagtggcgtggctactgagtggcgttttctggtgtgcgctgggcgcgctctgtttcttatttacgcgcagcctgctgcaacagcggaagcaccgtaaataa

SEQ ID NO: 1422 - DNA, 1086 bp, Enterobacter cloacae
cgcgtgacagcaacaaccgccgcgacacctggagcgaccatattcgtcgcaccattatcaaggagaaccgcccgttcattctcgactacctgcacaaacagggctgggcaacgcggtagtccattcctcctgcgcctcgtgtatgataggcaggcttttaccatgtctttagagaggtgcagggtgaaaattgccatattgtcccgggatggaacgctctattcatgtaaacgcctgcgagaagcggcggcgaaacgcggacatcaggttgagatcctcgatccgatgtcctgctatatgaacatcgaccctgcggcgtcgtcgattcattacaaaggccgcaaactcccgcattttgatgcggtaattccccgtattggctcccagatcacctattacggcacggccgcgctgcgtcagtttgaaatgctgggaagttatccgctcaacgagtccgtggcgatctcccgcgcccgcgataagctgcgctcgctgcaactgctggcgcgccaggggatcgatctgcccgtcaccgggattgcccactccccggacgacaccagcgatttaatcgatatggtgggcggtgcgccgctggtcattaagctggtggaaggtacgcagggtattggagtggtactggcggagacgcgtcaggcggcggaaagcgtgatcgatgcgtttcgcggtctgaatgcccatattctggtgcaggagtatattaaagaggctaaagggtgcgacatccgctgctttgtggtgggcaatgaagtggtggccgctatagagcggcaggcgaaagagggcgattttcgctctaaccttcaccgcggcggtatcgcacgggtggcccttatcagcgagcgcgagcgtgagattgcggtgaaagcggcgcagacgctgggcctggacgtggcgggggtcgatctgctgcgtgccgaccgcgggccgttggtgatggaagttaacgcctcgccggggctggaaggggtggaaaaaacaacaggcgtcgatattgcaggtaaaatgatcgcatggattgaatgccatgcaacgccgggattttgcctgaaaacgggcggttaa

SEQ ID NO: 1423 - DNA, 513 bp, Enterobacter cloacae
tctggacaacgtttttatttaagaggctgcactgcgatggatttacaggtcgtacctacactggatacgttacgtcaatggctcgatgatgccggtattactttcttcgaatgcgactcctgccaggcgctgcatctgcctcacatgcaaaatttcgacggcattttcgatgccaaaatcgatctgattaacgacgtgatccttttctccgcgctggctgaagtaaagccgtccgcgctgctggcgctggcatccgatctgtcagcgatcaacgccagttctttgacggtgaaagcgtttctcgacatacaggatgataatctgccaaagctggtggtttgccagtctttattctccggcgcggggctctccttcaagcagttcgcctggtttatgcgcctgagcgaagagcaaatttccatggtcatgatggaagccaacgcacatcacctgctgtatagcgcggaagatgacgccgagaataatgatgcatctcccaattttctccactaa

SEQ ID NO: 1424 - DNA, 876 bp, Enterobacter cloacae
acatcagcagaaacagatgggagaccacggatgaacaacttaccggtagtacgctccccgtggcgaattgcgatcctgattatcggctttaccttcctgtatgcgccgatgctgatgctggtgatctactcgttcaacagctctaagctggtcaccgtctgggcgggctggtcgacgcgctggtacagcgagctgttccacgatgatgcgatgatgagcgcggtggggctgagcctgaccattgcggcgctggcggcgacgatggcctgcgtgctgggcacgattgccgcgctggtgatggtgcgctttggccgtttccgcggggcaaatggttttgcatttatgatcaccgccccgctggtcatgccggacgtgatcaccggactgtcgctgctgctgctgtttgtcgcgctggcgcacgccatcggctggccagcggatcgcgggatgctcaccatctggctggcgcacgtcaccttctgtacggcatatgtggcggtggtcatctcctcgcggctgcgcgagctggatcgctccattgaagaggcggcgatggatctcggcgccacgccgctgaaggtctttttcatcatcacgctgccgatgattatgccggcggtgatctccggctggctgctggcgttcacgctctcgctcgacgatctggttatcgccagctttgtgtcgggaccgggcgcgacgacgctgccgatgctggtcttctccagcgtgcggatgggggtgaatccggagatcaacgccctggcctccatcatccttggcgtggtcggaattgtcggatttatcgcctggtatttgatggcgcgcgcggaaaaacagcgtgtgcgcgatatccagcgtgcaagacgcggctga

SEQ ID NO: 1425 - DNA, 519 bp, Enterobacter cloacae
tgtgccgcgtatgacgcggcactgtttttcagggaagtaaaaacattgggattcttacaaaaaacacgtcattcgcacgcccgtccgaacgtccctgcactggtgcaggtggcggcgctcgccattattatgatccgctgtctggatgtgctgatgataatgaacacgctgggtccgcgcggaatgggggaatttattcaccgcagcgcgcagacgtggaatctgacgctggtgtttctcagcagcctgatgctggtgtttattgagatctactgtgcgttctcgctggtgaaaggccgtaactgggcgcgctgggtgtatctgctgacgcagatcaccgccgcaggctacctgtgggccgcctcgctgggctatggctatccggagctgttcagcatacccggtgagtcgcgacgtgagattttccattcactggtgatgcaaaaactgccggatatgctggttctgttcctgctatttgcaccagcttcgagccggcggttcttccgcctgcaataa

SEQ ID NO: 1426 - DNA, 1542 bp, Enterobacter cloacae
aaaaagatgccgccgagccggagatcgttcgcaccgtctggggcaaaggctacaaattcgcggagcagaatcatgatgcgtcgctttagcctgagccagcgcctgacgctgctgtttacggtgttactgctgctctgcgccaccgtcgcctgtgcggtgcagctctacattagcatgcagtacggcaacgcgatggtgcagcggctctccggcgggctggcgcagcagattgtgcagcgggaagcgattctggattcgcagggcagggtggatcgcagcgccttaaaaccgctgttcgaccggctgatgacctttaatccgagcgtcgagctgtatgttgtctcgcctgatggcgatatcctggccgatgctgccccgccggggcacattcagcggcaaaaaattgacctcgcgccgatacagaatttcctgagcgggacggtgatgccggtgtttggcgacgatccccgaagccagaataagaaagtcttcagcgccaccccgctgcggcaggacggcgagctgaaggggtatctgtacattattttacagggggaagagtccaacgcgctggcggagatggcctggcacaaagcgctctggagtacggcgctgtggtcgatgctgctggtggcgctgtttggtctgctggcgggggtgctgctctggtactgggtgacgcgcccggttaaagagctcacgctggacgtggccgggctggagcaggacagcatcagcgcgattaagcagctggcggcccagccgcttgagcctgccggccaggatgaagtggcgatcctgcgcaatacctttatcgagctggcgcgcaaaatcacctctcagtgggatcggttggccgacagcgaccgccagcgccgggagtttatcgccaacatttcgcacgacttacgcaccccgctgacgtcgctgctgggttatctggaaacgctgtcgctcaaatccgccacgctgtcgccgcaggagcatcagcagtacctcgctaccgcgctgcgtcaggggcaaaaggtacgccatctgtcgcagcagctgttcgagctggcgcgtcttgagcacggcggcatcaagccccagcgcgagcgttttgccatggctgaactgatttccgacgtggcgcagaagtttgagcttaccgcccgcacgcgcgaggtgaacctgcgtattgatgtgccggggcgattgccgctggtgaacgccgacgtgtcgatgatcgagcgcgtggtcactaaccttctggataacgccatccgtcatacgccgagcggcggagaaattcgtctggcggtctggcaggagaatgaacgacttcaggtcgaagtggcagacaatggtacgggcgtagatgcctcgctgcgcgacgatttgttccagcggccttcagcgttaaatcctcaggcgtcgcgagagaaccgtgggggattagggctgttaatcgtgaagagaatgctggagctgcacggcggtgggatcaggctgatggagtccgtgagcggggcgcggttcaggttctttgtaccgctatga

SEQ ID NO: 1427 - DNA, 1218 bp, Enterobacter cloacae
gccgggcaagcgttagcgccgcccggcgatgcgcaccctgacggtgcgtttgcaccagtgttgatctatgccggagagcaccccgtgaatgacgcgatcccccgcccgcaggcgaaagtccgtaaagcgctgaccccgcttcttgaaattcgtaacctcaccaaatccttcgacggccagcatgccgtggacgatgtcagcctgacgatctacaaaggtgaaatttttgctttgcttggcgcatccggctgcggtaaatcgaccctgctgcgcatgctggccgggtttgaacagcccaccgccgggcagatcgtgctggatggggtagacctctccagcgtgccgccgtaccagcggcccatcaacatgatgttccagtcctatgccctgttcccgcacatgaccgtcgagcagaacatcgccttcggcctgaagcaggacaaactgccgaaagccgaaatcaccgcgcgcgtggcggagatgctgagcctggtgcatatgcaggagtttgcgaagcgtaagccgcatcagctttccggcggccagcgtcagcgcgtggcgctggcaagaagtctggcgaagcgtccaaaattattactgctcgacgagccgatgggcgcgctggataaaaagctgcgcgaccggatgcagctggaagtggtggatatcctcgagcgcgttggggtgacctgcgtgatggtgactcacgaccaggaggaggcgatgaccatggccgggcgcattgcgatcatgaatcgcggtaagttcgtgcagatcggcgagccggaagagatttacgaacacccgacaacccgctacagcgcggagttcatcggctcggtgaacgtcttcgaagggctgctgaaggaacgccaggacgacggtctggtgattgaatcgccggggctggtgcacccgctgaaggttgattctgataactccgtggtggacaacgtgccggtttacgttgccctgcgcccggaaaaaatcatgctatgcgatgagccacccgccgatggctataactttgccgtgggcgaagtggtgcacattgcctatctcggcgatctgtcgatttaccatgtccgcctgaaaagcggccagatgctcagcgcccagttacagaacgaacaccggtatcgcaagggacagccaacctggggcgacgaagtgagcctctgctgggatgcggacagttgcgtagtcctgacggtataa

SEQ ID NO: 1428 - DNA, 963 bp, Enterobacter cloacae
ggagcggtcatgagtacacttgaacctccagcccgcgtcaaaaaaccgggcggtttcgcgctctggctggcgcgcatgcagatggcgcatggccgcaagctggtcatcgccatgccctatatctggctgatcctgctgtttctgctgccgttcctgatcgtctttaagatcagcctggcggagatggcgcgggcgatcccaccgtataccgatctgtgggagtgggccgacgggcagctgacgctgaccgtaaacctcggtaatttcctgcaactgaccgacgatccgctctatttcgaagcctatttgcagtcgttacaggttgcggctatttctacgatctgctgcttgttgatgggctacccgctggcgtgggcagtggcgcacagcaagccgtcgacgcgaaatattttactgctattggtcattttaccgtcgtggacgtcgttcctgatccgcgtgtacgcgtggatggggatcctgaagaataacggcatactgaataacttcctgctgtggcttggggtgatcgaccagccgctgacgatcctgcataccaaccttgcggtgtatatcgggattgtctatgcctatctgccgtttatggtgctgccgatctatacggcgctgacgcgtattgattactcgctggtggaagcctcgctggatctcggcgcacgcccgttgaagactttcttcagcgtcattgtccctctcaccaaaggcggaatcatcgccggatcgatgctggtgtttatcccggctgttggggagtttgtgatcccggaactgctcggcggcccggacagcatcatgattggccgcgtgctgtggcaggagttcttcaataaccgcgactggccggtggcctcggcggtggcgatcgtcatgttactgctgctgatcgtgccgatcatgtggttccataaacatcagcagaaacagatgggagaccacggatga

SEQ ID NO: 1429 - DNA, 1137 bp, Enterobacter cloacae
ggttttcatatgcagtgcgcactctacgacgccggacgctgccgctcctgtcagtggatagaacagccggtctctcaacaactcaccgccaaaatggccaacctgcaacagctgctggcagcacacgcggtgggcgagtggtgcgcacccgtcagcggcccggagcagggctttcgcaataaagccaaaatggtggtcagcggcagcgttgaaaagccgctgctggggatgctgcaccgcgacggtacgccggaagatttaaccgactgcccgctgtatcccgcctcgtttgagccggtgtttagcgctctgaaaccgtttatcgcccgggcggggttaacgccctataacgttgcccgcaggcgcggcgagctgaaataccttctgctgaccgaaagccagatcgacggcgggatgatgctgcgctttgtgctgcgttcggaaaccaaactagagcagctgcgcgcggcacttccgggattgcagcaacagcttccgcagctcaaggttatcaccgcaaatattcagccggtgcatatggcgatcatggaaggggagaaagagatcttcttcaccgaacagcatgcgctggaggagcgttttaacggcgtgccgctgtggatccgtccgcaaagcttctttcagactaaccccaccgtcgccagcgcgctgtacaccaccgcgcgcgactgggtgcgtgcgttacaggttcatcacatgtgggatctgttctgcggcgtcggcggctttggcctgcactgtgccacgccagacatgcagctcaccggcattgagatctccgccgaagcgattgcctgcgcgaagcagtccgccgcggagctggggctgacgaatctgcacttccaggcgctggactccacgcagttcgcgaccgggcagggcaacgtgccggagctggtgctggtgaacccgccgcgccggggcatcggccaggcgctctgcgactacctgagccagatggcgccggagtacatcgtctactccagctgtaacgcgcagaccatggcgaaggatatcgccagcctgccgggctaccgcatcgcgcgcgttcagcttttcgatatgttcccccataccgcccattatgaagtgttgacgttgttaaccaaagcgtag

SEQ ID NO: 1430 - DNA, 813 bp, Enterobacter cloacae
tacagtcaggctatgtttcgccaattacatcaggtggaacattgcctatactggctgccatacgttttacgcaacacaaagagagacaaaatgacgccaaccattgacctgcttcgttcccaccgttccattcgccatttcaccgatgagccaattacccaggcgcagcgggacgcgatcatcgacagcgcaagaggcacctccagctccagctttttgcagtgcagctccattatccgcatcaccgatccggcgatgcgtgagcagctggtaacgctgacgggcggacaaaagcacgttgcccaggcggctgagttctgggtgttctgcgccgattttaaccgtcacctgcaaatatgccctgaggccgagctggggctggcggaacagctgctgctgggcgttgtggatacggcactgatggcgcaaaacgcgttcacggcggcggaatctctggggcttggcggcgtctatattggcgggctgcgtaacaacatcgaaagcgtgacggaactgctgaagctgccgaaacacgtgctgccgctgtttggtctgtgcctcggctggccggcggataacccggatctgaagccgcgcattcctgctgcgatgctggtgcatgaaaaccactaccagccggtcgaccaggacgttctgcatcaatacgatgaagagctggcgaactactatctgacgcgtgacagcaacaaccgccgcgacacctggagcgaccatattcgtcgcaccattatcaaggagaaccgcccgttcattctcgactacctgcacaaacagggctgggcaacgcggtag

SEQ ID NO: 1431 - DNA, 1137 bp, Enterobacter cloacae
cgaactttcagaaggaataacaatatgatcgccttgaataaaaaatggttatcgggtctggttgcgggtgctctgatggccgtctctgccggcacgctcgctgcggaacaaaaaacgctgcacgtctataactggtctgactatattgcgccggataccgtcgccaattttgaaaaagagaccggcattaaggttgtctacgacgtattcgattccaacgaagtgctggaaggcaaactgatggcgggcagcaccggtttcgacctggtggtgccgtcggcaagcttcctggagcgtcagctgaccgccggtgtcttccagccgctggacaagagcaaattaccgaactggaaaaacctcgatccggacgtgctgaagctggtggcgaagcacgacccggacaacaaatacgcgatgccttacctgtgggcgaccaccggtattggctataacgtggataaagtcaaagcggcgctgggcccggacgtcaagctggacagctgggacgtagtgctgaagccggaaaacctcgagaagctgaaaagctgcggcgtctctttcctcgatgcgccggaagagattttcgccaccgtgcttaactatctcggcaaagatccaaacagcagcaaggccgacgactacaccggtccggcgaccgacctgctactgaagctgcgtccgaatattcgctacttccactcctctcagtacatcaacgacctggcgaacggggatatctgcgtggccatcggctgggcgggcgacgtctggcaggcggcgaaccgcgcgaaagaggcaaaaaacggcgtgaatgtttcctacttcattccgaaggagggggcgctggcgttcttcgacgtcttcgcgatgccggctgatgcgaaaaacaaagaggaagcgtatcagttcctcaactacctgatgcgtccggacgtgattgctcacatcagcgaccacgtctactacgccaatggtaacaaggcctccgagccgctggtgagcgaagaaatccgcaataatccggcgatctacccgccagccgatgtgtttgccaagctcttcaccctgaaagtgcaggaaccaaaaattgaccgtgtgcgtacccgcgcgtggaccaaggtgaaaagtggtaagtaa

SEQ ID NO: 1432 - DNA, 729 bp, Enterobacter cloacae
caaatgattgaaggcttacccatgaagcagatcctgctggtagaagatgaccacgatatcgcggcactcctgcgtcttaacctggaagatgaaggctacgccattacccacgagcccgacgggggcaacgccttacagcgtcttgaaacacagccgtgggacgcggtgatcctcgatctgatgctgccgaatgttgatggtctggagatttgccgccgtatccgccagatgacccgttacctgcccattatcatcattagcgcccgcagcagtgaaactgaccgtattaccggcctggaaaccggggcggatgattatctggcaaaacctttctcggtgcaggagctgattgcccgcattaaggcgctgttccgccgacagcaggcgatgggccaggcgcagacggacggcattattcaggcgcacggtctgactatcgatccgctggcgcgcaccgtgcgtcttaacggtcaacacgtcgatctcactccgcgtgaatttgaactgctctatttttttgctcgccatcctggagaggtcttttcacgtctggcattgctggagcaggtgtgggggtatcagcacgaaggctacgaacacaccgtcaacacccatattaaccgcctgcgcatcaaaatagaaaaagatgccgccgagccggagatcgttcgcaccgtctggggcaaaggctacaaattcgcggagcagaatcatgatgcgtcgctttag

SEQ ID NO: 1433 - DNA, 2097 bp, Enterobacter cloacae
ctgatgaacaaactttttttactgagcggccttgctctggcgatctcttctgcctgccacgcggagctgcgtacctggcccgatccgaccggaccgtcacagtccgattttggcggcaccggcctgatgcaaatgcccgacgcgcgctttggccgggaaggggaattcagcgtaaactaccgcgataacaaccagtaccgtttttactcctcttcggtcgtgctcttcccgtggctggaagggacaattcgctataccgacgtccgcacccgtaaatacagcagcaacgaggatttcagcggcgatcaaagctacaaggataagtcgttcgactttaaagttcgtctgtgggaagaggactatagcctgccgcaggtggcgctcggcaagcgtgatattgcaggcaccggcctgttcgatggtgaatatctggttgccagtaaaatggccggaccggtcgattttacctttggaatagcctggggatatcccggtaatagcgacaacgtgggtaacccgctttgccatgacaacaataagtattgcacccgcggcgagtcgcatgatgccggagatatcagctttagcgatatgtttcgtggtccggcgtctctgtttggcggcctccagtatcagacgccctggcagcccctgcgcctgaagcttgagtatgacggcaacaattatgccgatgattttgccggctccattaagcagtcgagccatattaacgtgggggcggtctatcgcgttgccgactgggccgatctcaacctcagctacgagcgcggcaatacgctgatgtttggcttcaccctgcggaccaactttaacgacctgcgccccgcgctgcgtgataacccgaaaccggcctggcaaccggcaccggcaggcgagacgctggactatacctctgcggcgaaccagctcaccgcgcttaagtacaacgcaggcttcgatgcgccggagatccttcagcacggcaataccttatacatgaccggcgaacagtatcgctatcgcgatccgcgcgaagcggtggatcgtgccaaccgtattctgatcaataacctgcccgacggggtcgacacgatcgctatcacccagcagcgtgatcatctgccgctcgtcacgacgcaaaccgatgtcgccagcctgcgcaaacagttggcggggcagccgctcggccaggaggaggcgctcaggcagcagcgcgtcgagcctgtggataccacagcattcgggcgtggctaccgtattcgcgccgatcgcttcagctacagcgttaaaccgacgctggcgcagtcgctgggcggtccggaagatttctatatgttccaggtgggggtgatggccagcgccagctactggctgaccgatcgtctgctgctcgacggcggcgtgttcgccaacctctataacaactacgacaagttcaaatcctcgctacttcccgctgactccagcctgccgcgcgtcagaacccatattcgcgattatgtcagcaatgacgtctacatcaacaacttacaagccaactatgtcgatgcgctggggaacggcttctatgcccagatttatggcggctacctcgaaaccatgtacggcggcgtgggagcagaggcgctctggcgcccgctggatagcgactgggcgctgggcgtggatgcgaattacgtcaagcagcgcgactgggacgacatgatgcgcttcaccgactacagcgtgccaaccggatttatcaccgcctactggaacccggcgaagctcaacagtgtgctaatgaagctgagcgtcgggcagtacctggcgaaggataaaggcgccaccctcgacgtcgcgaagcgattcgacagcggcgtgacggtaggcgtctgggcggcgctgaccaacgtctcgaaagaggattatggcgaaggtggctttagcaaaggcttctacatctcgatcccgcttgatctgatgacgatcggcccaaatcgcaaccgggcggtggtctcttggacgcctctcacgcgtgatggcggccagatgttaggccgtaaatatcagctctatgacatgacgtcagaacgcgaaaccccggtagggcagtag

SEQ ID NO: 1434 - DNA, 477 bp, Enterobacter cloacae
aacagggagatatatcagaacatggccaaactaacgtttaacgccatcctggtgatctgtaccggcaatatctgccgctctcccattggggaacggctactgcgccggctgcttcccgccgcccgggtcgattcagcgggaacgtgtggcctggaagggcgcaccgccgattcacaggcgacagagatcgccgccgaacgcggcaccctgcttgagggccacgtggcgcgcaggctcacccccgccatggtgcgcgactacgatctgattctggcgatggagctggaacatatcgagcagttcacggctatcgcaccggaggcgcgcggcaaaatgatgctctttggtcactggacgggcaaaaaagagatcccggaccccaccgtaaaacccgggacgcatttgaatatgtttatgggctgctggagcaggccagtctggaatgggcgaaacggctcagttaatcacacgggatag

SEQ ID NO: 1435 - DNA, 2187 bp, Enterobacter cloacae
ttacgttttatgtcaacaaataaccttcacgcccatgatgcgtctgccgcgaataacgagatcgatcttgtgcgcctgttgggtgagctgctcgaccaccgaaaattcattctcatccttaccgcgctgttcacgctggtggccctgctttatgcgctctttgccacaccggtttatcaggccgatgcgctgatacaggtggaacagaagcagggcaacgcgctactcagtaaccttagcgagttcatccctgactcctcgccggagtcggcaccggagcttcagcttctccagtcgcgcatgatcctcggtaaaacgattgatgacctgaacctgcgcacgcaggtaagtgaaaactattttccctttgtcggacgcggctgggcgcggctcaccggccaacagcctggcatcgtcgatatccgtatgctcaatcttccccctgttgcgggccgggcgcaaaagctgacgctgaccgtcggcgagaagggccactatcagctggaaggcgataatgtgacgttacagggcgttgtgggacaacccctgagcgcggcgaatatcgccattaccattgccgatatccaggcgaagccgggtacgcaatttacgattacacagcagagtgagctggaggccattgacgcgctacagctgcgtttttccgtgagcgagcgcagcaaggacagcgggatgcttggcctgaccatcacgggggaagaccccgacgagatggctcgcgtgcttaactgcatcgccgacaactatttacaacagaacgtggctcgccaggcggcgcaggatgcgaaaagcctgcaatttttgaagcagcagcttccgcaggtgcgcagcgagctggaccaggccgaggagaagctcaaccgctatcgccagcaaaacgactccgttgacctgaacctggaggcaaaagcggtgctggagcagattgtgaatgcggacaatcagctcaatgaactgaccttccgggaagcggaaatttcgcagctctacaaaaaagatcaccccacctaccgggcgctgattgagaaacgccagacgctggagcaggaaaaaaaccgcctgaataaacgggtatcgtccatgccgtcaactcagcaggaggtgttgcgcctgagccgtgatgtggagtcgggacgcgttatctaccagcagctgcttaaccgcgaacaggagctgagcatcgcccggtcgagcgcaattggtaacgtccgcattatcgatccggccgtgacccggccgcagccagtcaagccgaaaaaagcgctggtcgtcgttctgggggttctcctgggtctgttcgtctctgcgggctggatcctggcgcgcagtatgctgcgtatgggcattgaaacgccggagcagctggaggagcacgggattaacgtctatgccaccgtaccgctgtcagaatggctggctaaaaagatgcgtttgcgtaaaaaagactttatgtccccagggctgcgccataagaccaaacatatccccttcctggcggcggataatccggtcgatctctccgtggaggcgattcgcggcctgcgcaccagcctgcatttcgcgatgatggagtcagcgaacaatatactgatgatctctggcgccacgcctgatagcggtaaaacctttgtcagcagtaccctggcggccgtcgtggcgcaggcgggccagaaagtgctctatattgatgcggatatgcgtcgcgggtatgcccatgatctgtttaagctcgacaatacctgcggcttgtcggagatattgtccggtaaggcggagtatacccagggcgttcagaccttcgataaaggcgggttcgataccatcgtgcgcgggcagatccctcctaatccggcggagcttctgatgcatacgcgtttccagcagctgctggactgggcgaatgaacgctacgatctggtgattatcgatacgccaccgatcctggcggtcaccgacgcggcggttgtcggccgtcgcgcaggcaccacgctgctggtcgcccgcttcgggatgaacagcgtgaaggagatgctggtctgtgtacagcgtctggagcagagtggcgtcaataccaaaggagtgattctcaacggcgtcgttaagcgggcaagcaacgcttacggctacggctaccatcactacggttacaactattcgagtaactga

SEQ ID NO: 1436 - DNA, 1818 bp, Enterobacter cloacae
ttaaattttgcgtgccgttttcagcttttaccttccttttgctgcaacaaaaacaatgcgctgaagcgcgctcgtaaaatgcatttttgcagctggtctgcggctcccgggcagggtatacccttcgcaaaacagggaggggtaataatggtgaaatggataagcatactgatgatcttcttaagcagcggggcgatggctatctgcccggtctggtcaccggctaaagccgggcaggagatcgcggccctgaaggcgcagctgacccgctggaatgaagattactggaagcagggcagcagcgaggtaagcgacgacgtttacgacaggcttaacgcccgcttaaaacagtggcagcgctgttttcacgatgagccgctgcatgacgatcctcctgccgccagcgggacggtgaagcatcccttcgcccataccggcgtgcataaggtagaaagcaagcaggcgcttagccgctggatggcgacgcagcaggatctctgggtacagccaaaggtggatggtgttgcggtcaccctggtctacaaaaacggcaagctggcgcaggcgatcagccggggcgacggcttacagggggaagagtggacggcacaggcgcgaatgatccccgctattccgcaaacgctggccgggccgcttgccaacagtgtgttgcagggggaactttttctgctgcgcgaggggcatatccagcagcggatgggggggatgaacgcgcgtgcgaaggtagcgggggcgatgatgcgcgcgaccgatcgcgcagcgctgaagcagacaggcatttttatctgggcctggccgaacggcccaaaagtgatgaaagcacgcctttccgcgctggcggaggctggttttaccctgacggcgcgatataccctgccggttaaaaacgcggctgacgtggaagcgcagcggacggcctggtttaaggcttcgttgcccttcgccacggatggcatcgtggtccgcgcctcggcagagccgccgggcgaggagtggctgccgggggaaggaagttgggtcgtcgcatggaaataccttcctgtggcccaggtgactgaagtcaaagcgattcactttaccgttggccgtaccgggcggatcaccgcgattgcgcagcttgagccgctgatgctcgacgataaacgcgtacagcgcgtcagcttagggtcagttaaccgctggcagaggctggatattgcccccggcgatcaggtgctggtaagcctggcgggacaaggtattccccggctggataacgtggtgtggcgcaatgtggatcgccgtaaaccacagccgccctcatcgcgctataacggcttaacctgtttctatgcctccccggagtgcatggagcaattttttgcccggctgacgtggctaagttccaggcaggcgttagatatcgaaggtatgggcgaatcaggatggcggaccctctatcaggcgcatcggtttgagcacctcttctcctggctacagctcacgcaggcgcagctcaccgcgacgccggggatatcggcatcgcatggcgctgcgctgtggcatcagtttaacctggcgcgggagcgtccttttatccgctggatcaccgcgatgggaataccgctggcccggtcgacgctcaaggcggcaggggatcgcacctggcaggcgctgattcagcgaagcgaagcggagtggcggatgctaccgggtgtcgggcaggagaaagcccgccagatcgtaaactggctgcatcagcctcagattgatgccctggcaaagtggctggccgcagagcacatcggtggattttaa

SEQ ID NO: 1437 - DNA, 825 bp, Enterobacter cloacae
ttccgctaccggccaggtacgccagagcgaacagatgctcggcgcgggcgtattccctgtcgccatgacgatgttgaagcccgccccatgaacagactcagaaaatggttacctggcgtagggctatctctcttcagcctgtccgccttatgcgcaagcgtcgttaccgtgcatcagccgggcaaaacgtggtctgctgaaccggctgatacgctctcccggctggtcacccagccgcagctgaacaacgtctggtggcagggggctgtcatcgcaaccccttccgccacgctgcgcgcgcaacagacgcaacagcaggtgctggcgtcgctttcagtctggcagaatcgcaccgatgacgagcggatcgcgaccattcgcgctgtcgctgcacagatccgctcgctgcggatcgtcgggcggcagtttgtcagcctcgacccagatgccgtgcgtaccgacgcccgcggcgatcgcttccttgagggccgttacgatctgtggctctctcctgcgccccgtaccgtcacgctgatgggggcggtcgtcacgccggggaaacgggcctggcgaccgggcgcaagcatccgggactacttacaggggcagttgcggctggccggcgccgacaggaataacgtaaccgttatcgatcctgacggcagtacggttgttgcgccggtggcgtactggaacgcacgccatattgaagcagagccgggcgctgttctgtgggtggggtttgatccccgggcggtaccggacgattttaccggtctgaatgagcaaatcgttgcgctcctgacgcggcggatacctgactga

SEQ ID NO: 1438 - DNA, 1134 bp, Enterobacter cloacae
atgaaaaacgttaaattttccgtgctggcgttggctatgatggcgttaagcggttgtactatcgtaccgggccagggacttagcacccagggcaaagatattatcgatctgcctgacagcaattacgatctgaataagatggtcaacgtctatcccctcacgccggggctggtggagcagttgctgcctggcaaagtcgactcccgcgcgaatcctgaactggatcgccagcttcagaactaccaatattgcatcggcgtcggcgacgtgctgatggttaccgtctgggaccacccggagctgaccacccccgcaggtcagtaccgcagcgccagcgatacgggcaactgggtgaatgccgatggcacgatcttctacccctatatcggcaaaatccgcgtcgtcggcaaaacgctggcccaggtgcgcgatgagatcgccgcccggctggattcggtgattgagagcccgcaggtggatgtcagcgtcgcggcattccgctcgcaaaaagcctacgtgacgggcgaagtggctaagtcgggccagcagcccatcaccaacattccgctgacgataatggatgcgatcaatgcggctggcggcctgacatctgaggcggactggcgccatgtggtgctgacccacaacggccaggacacgcacatttcgctctacgcgctgatgcagcgcggcgatctcacccagaacaaactcctctatccgggcgatattctcttcattccccgtaatgacgacctgaaagtgtttgtcatgggcgaggtgggtaaacagagcacccagaagatggaccgtagcggcatgacgctggcggaagcgctgggtaatgcacagggcgtgaatcaggatatggccgacgccaccggaatctttgtgattcgtccgttgcagggcaagcagaacggcaaaatcgccaacgtctaccagcttaacgcccgggatgccaccgcgatggtgttgagcaccgaatttcagcttgaaccttacgacatcgtctatgtcaccaccgcgccgctggtgcgctggaaccgcgtgatctctcagcttgtgccgaccattaccggcgtacatgacctgactgaaacagggagatatatcagaacatggccaaactaa

SEQ ID NO: 1439 - DNA, 678 bp, Enterobacter cloacae
ttgatttcaatgttatttaatcaaggatttctggtgagactgtttattctgctcatcatgactctgctgatccagggatgtacgccgagccagcagagcattattgagacctttaacgccagtctggacgggcgccaggatgtgacggtaacggacgggcagattcaggcgttcccatactcaaccatgtacctgcgactggataatggcccgaggatcctggtggttctcggatacatcgaacagggaaacagtaaatggttatcgcaggataatgcgatgatcgtcacgcataacggtcgccttatccacacgctcaagcttccttataacctgcttgaggtaaccaatcttgagcacgatccgctgcgccacacgccgcagctccgcgacggcagccagtggtcgcgtgatgtgcgctggcaggaagaggggcggtatcgctccgcacacctgaactcgcgcttctccctgagcgggacggaaaacctgacccttgccggaaacacgctacgttgtcaggtctggcaggaggcggtgcaggccgacggcctcgatcgtcgctggcataacaccttctggattgattccgctaccggccaggtacgccagagcgaacagatgctcggcgcgggcgtattccctgtcgccatgacgatgttgaagcccgccccatga

SEQ ID NO: 1440 - DNA, 249 bp, Enterobacter cloacae
gggccacgtggcgcgcaggctcacccccgccatggtgcgcgactacgatctgattctggcgatggagctggaacatatcgagcagttcacggctatcgcaccggaggcgcgcggcaaaatgatgctctttggtcactggacgggcaaaaaagagatcccggaccccaccgtaaaacccgggacgcatttgaatatgtttatgggctgctggagcaggccagtctggaatgggcgaaacggctcagttaa

SEQ ID NO: 1441 - DNA, 840 bp, Enterobacter cloacae
acattcccgtttttaaaggagagatggggggattatagctttcaggggcttctcaggataggaataagcgtcctttatccgtataatgcgcagccacattcgtttcaagccggagaatccatcatgcgtccagcaggtcgtaacgccaaccaggtgcgtcccgtcaccctgacccgtaactatacaaaacacgctgaaggctccgtgctggttgagtttggtgacaccaaggtgctttgcaccgcgtccattgaaaaaggcgtgcctcgcttcctgaaaggtcagggccaggggtggatcaccgccgaatactgtatgttgccgcgcgcaacccatacccgtaatgcccgtgaagcggcaaaaggtaagcagggcggccgtactatggagattcagcgcctgatcgcgcgtgcgctccgcgccgcggttgacctgaaaacgttgggtgagttcaccatcacgctggactgcgacgtgatccaggccgatggtggcacgcgtacggcctctattaccggtgcctgtgtggcgctggcagacgccctgaacaagctggttgccgccggtaagctgaaaaccaacccaatgaaagggatggttgctgctgtctccgttggtatcgttaacggcgaagcgctttgcgatctggaatacgttgaagattctgccgcagaaaccgacatgaacgtggtgatgaccgaagatggtcgcatcattgaagtgcagggtacggcagaaggcgagccattcacccacgaagaactgctcaccttgctggcgttggcccgagggggaatcgaatctattgtagcgacgcagaaagcggcgttagaaaattga

SEQ ID NO: 1442 - DNA, 690 bp, Enterobacter cloacae
gtcgccttttttttgcctgtaagactgaaaagacaaaggagcaaatccatgaaatcgtatcagcgccagtttattgagtttgcgcttaacaagcaggtacttaagtttggcgagttcacgctgaaatccgggcgtaaaagcccgtatttcttcaacgccgggctgtttaataccgggcgcgacctggcactgttaggccgcttctatgccgaagcgctggtggattccgggattgatttcgacctgctgtttggccccgcgtacaaaggcattccaatcgcaaccaccacggcggtggcgctggcggagcaccatgaccgcgacgtaccgtactgctttaaccgtaaagaggccaaaacccacggtgaaggcggcaatctggtaggcagcgcgttgcagggccgcgtgatgctggtggatgacgtgatcaccgcaggtaccgcgatccgtgaatcgatggagataatccaggctaacggtgcaacccttgcgggcgtgctgatttcgctcgatcgtcaggagcgtgggcgcggcgacatctctgctattcaggaagtggagcgcgactacaactgcaaagtgacgtcgattatcaccctgaaagatctgattgcgtatctggaagagaagcctgagatggctgatcatctggcggcggtgcgtcaataccgcgaagagtttggcgtataa

SEQ ID NO: 1443 - DNA, 219 bp, Enterobacter cloacae
agaaccccggatatcgttgccggtgtcgccgcactgaaaactcttgtcccaaacgttgttgggtttgccgcagaaacgaataatgtggaagaatatgcccggcaaaaacgtacccgcaaaaacctcgatttaatttgcgcgaacgacgtatcgctgtccacgcaaggatttaacagcgacaggcaacgcattgcaccttttctggcaggatggagataa

SEQ ID NO: 1444 - DNA, 684 bp, Enterobacter cloacae
tgcaataacaaaccgcaaacgtcagtttgcgggtcgctgtgtggttgccagcctgacaagtgcttattttcaggggtattttgtaacatggcagaaaaacaaaccgcgaaaaggaatcgtcgcgaagaaatacttcaatctctggctctgatgcttgaatccagcgacggcagtcaacgcatcaccaccgcaaaactggcggcctctgtgggcgtgtcagaggcggcgctgtatcgtcatttcccgagcaaaacccggatgtttgacagcctgatcgagtttatcgaagacagcctgatcacgcgcatcaacctgattctgaaggatgaaaaagacaccagcacgcgtctgcgtctgattgtgctgctgattctgggctttggtgaacgtaacccgggtctgacccgtattctgaccggccacgcgctgatgtttgaacaggatcgtctgcaaggccgtataaaccagctttttgagcgtatcgaagcccagctgcgtcaggttctgcgcgagaagaaaatgcgggaagacgagggatataatacggatgagaccctgctggcaagccagatcctggcattttgcgaagggatgctctcccggtttgtgcgcagcgagtttaaatatcgaccaacggacgattttgacgcccgctggccgttagtggctgctcagttacagtaa

SEQ ID NO: 1445 - DNA, 918 bp, Enterobacter cloacae
gaagcccctgaaagctataatccccccatctctcctttaaaaacgggaatgtctatgatccgcagtatgaccgcctacgcccggcgtgaaatcaagggtagctggggtagcgctacctgggaaatgcgctcggtaaaccagcgctatctggaaacgtatttccgtatgccggaacagttccgcagcctggagcctgtggtgcgtgagcgtatccgtacgcgtctgacccgcgggaaagtggaatgtaacctacgttttgagcctgatgccagtgcacagggcgaactgatcctgaacgaaaagttggcaaaacagctggttaatgcggcgaactgggtcaaaatgcaaagcgatgaaggcgagatcaacccggttgatattctgcgctggcctggcgtgatggccgccggagagcaggatctggacgcgattaccgctgagatcctggctgcactcgacggcacgctggacgactttatcgttgcccgcgaaaccgaaggccaggcgctgaaagcgatgattgagcaacgccttgagggcgtgagcgccgaagtcgctaaagtgcgcgctcatatgccagaagtgctgcaatggcagcgtgagcgtcttgtcgccaaactggaagaggcggaagtccagctggaaaacaaccgtctggaacaagagctggtgctgatggcgcagcgtgtggacgtggctgaagagctggatcgtctggaagcgcacgttaaagagacctacaacattctgaagaagaaagaagcggtaggccgccgtctcgactttatgatgcaggagttcaatcgcgagtcgaacacgctggcgtctaagtctatcaatgcagaggtaaccaattcagcgattgaactgaaggtcctgattgagcagatgcgcgagcagatccagaatatcgagtaa

SEQ ID NO: 1446 - DNA, 579 bp, Enterobacter cloacae
cacatacaaaagactctcatggctcaaggcacgctttatattgtttctgcccctagtggcgcgggtaaatccagccttattcaggcactgttaaaaacccaaccgttgtacgatacgcaggtttctgtttctcacaccacgcgagcaccgcgtccgggtgaagtgcacggtgaacactatttctttgtgaatcacgacgaattcagagcgatgattggcagagacgcgtttcttgaacacgcagaagtattcggtaactactacggtacttcgcgtgaaaccattgagcaggttctggcgaccggcgtgaacgtgttcctggatatcgactggcagggcgcgcagcaaattcgtaagaaaatgcctgattcgcgcagtatctttattttaccgccatcgaaagatgaactggatcgccgcctgcgtggtcgcggccaggacagcgaagaagttatcgcgaagcgtatggcgcaggctgttgcagaaatgagccattacgcggaatatgattaccttattgtgaatgatgattttgatgccccgctgagcgatcgttttcaccaaaggcggccggaagga

SEQ ID NO: 1447 - DNA, 645 bp, Enterobacter cloacae
tctccttctcttcattccggagggtttatgctgcttcacattctttatcttattggcattaccgcagaagccatgaccggcgcgctcgctgccggacgtcgccgtatggacaccttcggcgtgattatcattgccacagccaccgcgctcggcggcgggtccgtacgcgatatcctgcttggccattatccgctcggctgggtaaaaaaccctgagtacgtcattatcgtggcaacggcagccgtgctaaccacgattgtggccccggtgatgcctcatctgcgccgcgtgttcctggtgctggatgcgcttgggctgattgttttttccatcattggcgcacaaatcgctctcgatatgggtgaaggcccggttatcgccaccattgctgccgtgatcacgggcgtgtttggcggggtgctgcgggatatgttctgcaaacgtatcccgctggttttccagaaggaactgtatgccggcatctcctttgccgcggcagtgctttacgtcgccttgcagcactatgtcaccagccacgatgtggtggttatctccaccctgctgtttggctttaccgcgcgtatgctggcattgcgcctgaagctgggcctgcccgtttttcattacaaacacaatgcgcattaa

SEQ ID NO: 1448 - DNA, 570 bp, Enterobacter cloacae
cagcgacaggcaacgcattgcaccttttctggcaggatggagataaagtcttaccgcttgagcgcaaagaactcctgggccaacacttactggacgagatcgttacccgttatgatgaaaaaaatcgacgttaagattctggacccgcgcgttggcgagcaatttccgctgccaacgtatgccacctccggctctgccggtcttgacctgcgcgcctgtctcgatgacgccgtagaactggcgccgggtgcaacgaccctgatcccgaccgggctggcgattcacattgctgacccgtcactggcagcggtgatcctgccgcgctctggcctgggccataagcatggcgtcgtgctgggtaacctggtcggcctgatcgactctgactatcagggtcagctgatggtatccgtatggaaccgtggccaggacagcttcaccattgagccgggcgagcgtatcgcgcagatggtgtttgtaccggtggtgcaggcagaatttaacctggtggcagacttcgacgctaccgaccgtggcgaaggcggcttcggccattccgggcgcaaataa

SEQ ID NO: 1449 - DNA, 1578 bp, Enterobacter cloacae
ttcgcagcgggggaatgtttcccccgtatgcgaatatcattctctgtgctggcgtcaccttctgatgacttcatggacgcattactgcaactcaaagggatcgataaatcgttcccgggcgtaaaagccctctccggcgcggcgctgaacgtctattccgggcgcgtcatggcgctggtgggcgaaaacggcgccggcaaatccaccatgatgaaagtgctgaccggtatctaccaacgcgatgccggttcgctgctgtggctgggtaaagagaccaccttcaacggcccgaaatcctctcaggaagcgggcatcggcatcatccaccaggagctgaacctgatcccgcagctcaccattgcggagaacatcttcctcggccgtgagttcgtgaaccggtttggcaaaatcgactggaaaaccatgtatgccgaagcggacaaactgctggcgaagctgaatctgcgctttaagagcgaccgactggtgggcgacctttccatcggcgatcagcagatggtggaaatcgcgaaggtgctgagcttcgagtcgaaggtcatcattatggatgaaccgaccgacgccctgaccgataccgaaaccgaatccttgttccgcgtgatccgtgagctgaaatcccagggccgcggcattgtctatatctcacaccgcatgaaagagatcttcgaaatctgcgacgacgtcaccgtctttcgcgacgggcagtttattgccgagcgcgaagtagcaaccctgaccgaagattcgctgatcgaaatgatggtgggacgtaagctcgaagatcagtatccacatctggaaaaagcgccgggtgagatccgcctgaaggtggataacctctgcggaccgggcgtgaatgacgtctcctttaccctgcgcaagggcgagatccttggcgtcgcgggcctgatgggggcggggcgtactgaactgatgaaagtgctctatggcgcactgccgcgcaccagcggctacgttacccttgacggccatgaagtggtcacccgctcgccgcaggacgggctggcgaatggcatcgtctatatctctgaagaccgtaagcgcgacggcttagtgctgggcatgtcggtaaaagagaacatgtctctgactgcgctaggctatttcagccgcagcggcggcagcctgaaacacaaagatgagcagcaggcggtcagcgattttatccgtctctttaacgttaaaaccccatcgatggagcaggcgattggcctgttgtccggcggtaatcagcagaaagtggcgattgcccgcgggttgatgacgcgcccgaaagtactgatcctcgatgagcccacccgcggcgtggacgtgggcgcgaaaaaagagatctatcagctgattaaccagttcaaggccgacggtctgagcatcattctggtctcttccgagatgccagaagtattaggcatgagcgatcgcattatcgtcatgcatgaagggcatctcggcggtgaattcactcgcgagcaggccacccaggaagttctgatggctgccgctgtgggcaagcttaatcgcgtgaatcaggagtaa

SEQ ID NO: 1450 - DNA, 270 bp, Enterobacter cloacae
tcatcaccctcggcagccgtggggtgtgggctagcgtcaatggcgaaggtcgtcgcgtgccgggctttaaggtcaaagccattgataccatcgccgcagggagacaccttcaacggtgcgctggtaacggcgctgctggaaggaaaagcaatggatgacgcgatccgcttcgcgcatgccgccgctgcgatcgcggtgacgcgtaaaggcgctcagccttctgttccatggcgtaaagagattgatgaattcttaagtcagcaggggtaa

SEQ ID NO: 1451 - DNA, 996 bp, Enterobacter cloacae
cgcttggccacaatgaaagatgtcgcccgtatggcgggcgtttctacctcgactgtttcccacgttatcaataacgatcgcttcgtcagcgaggcgattcgggagaaagttgacgctgcaattaaagaactcaactatgcgccgtccgcgctggcgcgcagccttaagcttaaccagacgcgcaccatcggcatgctgatcacggccagtaccaatcctttctattctgaactggtgcgcggcgtggagcgcagctgcttcgagcgcggctacagcctggtgctgtgcaataccgaaggcgatgagcagcgcatgaaccgtaacctggaaacgctgatgcaaaaacgcgtcgacgggctgctgctgctctgtaccgaaacgcatcaaccttcgaaagagatcatccagcgctacccttctattcccacggtgatgatggactgggcgccgttcgacggcaccagcgatctgatccaggataactcgctgctgggcggcgatatggcgactcagcatctgatcgataaaggtcatacccgcattgcctgtattaccggcccgctggataaaaccccggcgcgcttgcgtctggaaggctatctttcggccatggaacgggcggggcttgccattcctgatggctatcgcatcaccggcgatttcgaatttaacggtggatttgaagcaatgcagaaactgctggcgcaagagccgcgcccgcaggcggtgtttatcggtaatgatgcgatggcattcggagcttatcaggcgctttatcaggcgggattacgtgtcccggacgacatggcgatcgtcggttacgatgatatcgaactggcgcgctacatgacgccgccgctgaccaccatccatcagccgaaagatgaactgggcgagctggccatcgatgtgttgatccaccgcatggcccagcccacgctgcaacagcaacgtttgcagcttactcctgttctgatggaacgcggttcggtttag

SEQ ID NO: 1452 - DNA, 1872 bp, Enterobacter cloacae
tctatgagcactgataataagcaatcattacccgcagtaacgcttgcggcgatcggggttgtctacggtgatatcggcaccagcccgctttatacgcttcgtgaatgtctgtccggtcagtttggttttggtgtagagcgtgacgccgtatttggtttcctctcgctcatcttctggctgctgatcctggtggtctcccttaagtatctctctttcgttatgcgggctgataacgcgggcgagggcggtattctgaccctgatgtcccttgccgggcgcaatacgtctgcaagaatgacctccgtgctggtcatcattggcctgattggcggcagcttcttctatggagaagtcgtgattacgccggcgatttcggtaatgtcggccataaaggggctggagattgtcgcgccacagcttgatacttgggtggtgccactcgctattatcgtgctgacgttgctgtttgctatacaaaaacacggtaccgggctggtgggtaagctgttcgcgcctattatgctggcctggttcctgatcctggcggcgctgggcttacgcagtattatcgccaacccggatgtcctgcacgcgctgaacccattgtgggcggtgcatttcttcctgaaatataaagtggtgtcgtttgtggcgctgggcgcggtggtactttccattaccggtgttgaagcgctgtatgcggatatgggccacttcgggaaactccctattcgcgtcgcatggtttagcgtggtcttgccttcactggtgctgaattacttcggtcagggcgcgctgctgcttgcacaccctgaagcgattaaaaacccgttcttcctgctggcgccggactgggcgctggttccgatgctgatcctggcgacgctggcgacggtcattgcctctcaggctgtcatttccggcgtattctccctgacgcgtcaggccgtgcggttgggttatctctccccaatgcgcattatccatacctcagagatggagtctggccagatctacattccgttcgtcaactggctgctctacttcgcggtggtgattgtcatcgtcagctttgagcactccagtaatctggcggcggcgtacggtatcgcggtaaccggaacgatggtgttgacttctattctctccaccaccgtggcgtaccgtaactggcactggaataagttcctcgtggggctgatcctggttggcttcctctgtatcgacgtgccgctgttctctgcgaatctcgacaagattgtctccggtggctggctgccgctgacgctgggtctggtgatgtttattgtgatgacgacgtggaagagcgaacgtttccgcctgctgcgtcgtatgcatgagcacggtaactctctggaggccatgatcgcctcgctggagaaatccccaccggtgcgcgtgccgggcacggcggtgtatatgtctcgcgcgctgaacgtaatcccgtttgcgctgatgcataacctcaagcacaacaaagtgctgcacgagcgcgtgatcctgctgacgctgcgtactgaagatgcgccgtacgttcacaacgtgcgtcgcgtacagattgaacagctgtcgccaaccttctggcgcgtggtggcaagctacggctggcgcgaaacgccgaacgtggaagaggtgttccaccgctgcggtctggaaggcctgagttgccgcatgatggagacgtcgttctttatgtcccacgagtcgctgatcatcggcaagcgcccatggtatttgcgcctgcgcggcaagctgtatctcattctgcaacgtaacgccctgcgtgcgcctgaccagtttgagatcccgcctaatcgcgtgattgagctgggcacgcaggtcgagatttaa

SEQ ID NO: 1453 - DNA, 831 bp, Enterobacter cloacae
atcaggagtaagaagatgactacccaggctgtttctggtcgccgctatttcacaaaggcatggctgatggaacaaaaatcgctgattgccctgctggtgctgatcgcgattgtctcgaccatgagcccgaacttttttaccgtcaataacctgttcaacattcttcagcagacctctgtcaacgccattatggcggtggggatgacgctggtgattttgacctcgggtatcgatctgtccgtcggttccctgctggccctcaccggcgcgatcgccgcgtcgattgtcggtattgaggtcaacgcgctggtggccgttgccgctgcgctggcggcaggtgcggcaattggcgccgtaaccggcgtaattgtggcgaaaggtcgcgttcaggcgttcatcgccacgctggtgatgatgctgctgctgcgcggtgtgaccatggtgtacaccaacggcagcccgattaataccggctttaccgataacgccgatctgtttggctggttcggtatcggtcgcccgctgggtgtcccgaccccggtctggatcatggctatcgttttcctggcggcgtggtacatgctgcaccatacccgtctgggtcgttatatctatgcgctgggcggtaacgaagcggcaacgcgcctgtccggtatcagcgttaataaagtcaaaattatcgtttactccctgtgcggcctgctggcgtctctggcgggcatcatcgaagtggcgcgcctctcttccgcacagccaacggcgggtacgggctatgagctggatgccatcgcggcagtggttctgggcggtacgagtccttgcgggcggtaa

SEQ ID NO: 1454 - DNA, 996 bp, Enterobacter cloacae
ataatgaaaaccgcttacatcgcaaaacaacgccagatcagtttcgttaaatcccatttttctcgccagctggaagagaagcttggccttattgaagttcaggcgccgattctgagccgcgtgggtgacgggacgcaggataacttgtctggttgcgaaaaagcggtacaggtaaaagtgaaaacactgccagacgctcagttcgaagtggttcattccctggcgaagtggaagcgtcaaaccctgggacaacacgacttcagcgcgggcgaagggctttacacgcatatgaaagcccttcgccccgatgaagaccgcctctcccccattcactctgtctacgttgaccagtgggactgggagcgcgtaatgggtgacggcgagcgccacgttggcacgctgaagtctaccgttgaggcgatctacgccgggatcaaagcgaccgaagcggccgtaagcaaagagtttggtctggcaccgttcctgccggaaacgatccactttgttcacagtcaggagttgctgagccgtttcccggatctggatgccaaaggccgtgaacgcgcgattgccaaagagcttggcgcggtattcctgatcggcattggcggaaaattgtctgatggtaaacgtcacgacgtccgtgcgccggattacgatgactggagcacagtgggcgaaagcgaatatgctggtctgaacggcgatattctggtctggaacccggttctggaagatgcgtttgaactctcttcaatggggatccgcgtggatgctgaagcactgaagcgtcagctggccgtgaccggtgatgaggatcgtctgcaactggaatggcaccaggcgctgctgcgcggtgaaatgccgcagaccatcggcggtggtattggccagtctcgtctgaccatgctgctgttgcaactgtcccatatcggtcaggtgcagtgtggggtctggccgcagcaggtacgtgagagcgtcggttctcttctttaa

SEQ ID NO: 1455 - DNA, 450 bp, Enterobacter cloacae
cgaaacgtttcgctagtggagcaaaaaatgaagaaaggcacagtactcaactcagaaatctcatcggtgatttcccgtcttgggcataccgatacgctggtggtttgcgatgcaggcttaccggttccgcgcagcacaacccgtatcgatatggcgttaacgcagggcgtgccctcgttcatgcaggtactggaagtggtcaccgcggagatgcaggttgaggcggccattctcgcggcggaaatcaaacagcataatccgcaactccacgaaacgttgctcagccacattgagcaactgcaacagcaccagggaaacaccatagaaattcgttacacaacgcacgagcagtgcaaacaacataccgcacacagtcatgcggtgattcgcagcgggggaatgtttcccccgtatgcgaatatcattctctgtgctggcgtcaccttctga

SEQ ID NO: 1456 - DNA, 546 bp, Enterobacter cloacae
ccatggtgtacaccaacggcagcccgattaataccggctttaccgataacgccgatctgtttggctggttcggtatcggtcgcccgctgggtgtcccgaccccggtctggatcatggctatcgttttcctggcggcgtggtacatgctgcaccatacccgtctgggtcgttatatctatgcgctgggcggtaacgaagcggcaacgcgcctgtccggtatcagcgttaataaagtcaaaattatcgtttactccctgtgcggcctgctggcgtctctggcgggcatcatcgaagtggcgcgcctctcttccgcacagccaacggcgggtacgggctatgagctggatgccatcgcggcagtggttctgggcggtacgagtccttgcgggcggtaaaggtcgcattgttgggacattgatcggcgcactgatcctcggtttcctgaataatggtttgaatttgttaggtgtttcctcctattaccagatgatcgttaaggcagtggtgattttgctggcggtactggtagacaacaaaaaacagtaa

SEQ ID NO: 1457 - DNA, 918 bp, Enterobacter cloacae
ctgacgacactacaggacatcttagatatgaacatgaaaaaactggctaccctggtttctgctgtcgcgctgagcgcaaccgtaagtgctaacgccatggcgaaggacaccatcgcgctggttgtctctaccctgaacaacccgttcttcgtctccctgaaggatggcgcgcagaaagaagcagataaactgggctacaacctggtggtgctggattctcagaacaacccggcgaaagagctggctaacgttcaggacttaaccgttcgtggcaccaaaatcctgctgatcaacccaaccgattccgacgcggtcggtaatgccgtgaagatggcaaaccaggcgaagatcccggtaatcacccttgaccgtcaggcaacgaaaggggatgtggtcagccacattgcgtctgataacgtactgggcggtaaaatcgccggcgactacatcgcgaagaaagccggtgaaggcgcgaaagtgattgagttgcagggtatcgccgggacttccgcggcccgtgaacgtggtgagggtttccagcaggctgtagcggcgcacaaattcaacgtgctggcgagccagccggcagacttcgaccgtacaaagggtctgaacgtcatgcagaacctgctgaccgcgcatcctgatgtgcaggcggtattcgcacagaacgacgaaatggcgctcggtgcgctgcgtgcgctccagactgcgggtaaatcagatgtgatggttgtcggatttgacggcacgccggatggtgaaaaagcagtaaatgatggcaaactggctgcgaccatcgctcagctgcctgagcagattggcgcgactggcgtgcaaactgccgataaagtgctgaagggcgaaaaagttcaggccaaatatcctgttgacctgaaactggtcattaagcagtaa

SEQ ID NO: 1458 - DNA, 897 bp, Enterobacter cloacae
gggacaccaaataaaagaaaagtgtggcatacgccaccgggtaataccggtggcgctctcagatggacacctcaatacatgaaaaccgcaggcaacctcgtcgtccttggcagtatcaatgccgatcacattcttaaccttgaaacgttccccactccgggcgaaaccgtcaccggcaatcagtatcaggtggcgttcggcggtaagggcgcaaaccaggcggttgccgccggacgcagcggggcgaatatcgcgtttatcgcctgtacgggtgatgacgataccggcgagcgcgtacgcaaacagctcgcaagcgacaacatcgacatcgcacccgtcagcgtggttgcaggggaatctaccggcgtggcgctgattttcgtcaatgcggaaggtgagaatgtcatcggtattcatgcaggggctaatgccgcgttaacgactgaacgcgtcgaagcgcagcgtggaattatcgccggagcggaagccctgctgatgcagctggagtcaccggttgaaagcgtgctggccgctgcgaaaattgcgcatgaaaatcatacctctgtcgtacttaacccggcacctgcccgtgtattatcagacgagctgctggcgctggtggatattatcaccccgaacgaaaccgaagcggaaaagctgacgggtatccgtgtcgaaaatgatgacgatgcagcgcgtgccgcgcttgcgctgcatgataaaggcatcggcaccgtgatcatcaccctcggcagccgtggggtgtgggctagcgtcaatggcgaaggtcgtcgcgtgccgggctttaaggtcaaagccattgataccatcgccgcagggagacaccttcaacggtgcgctggtaacggcgctgctggaaggaaaagcaatggatga

SEQ ID NO: 1459 - DNA, 441 bp, Enterobacter cloacae
aaactcacctggtggaggaccgaagataactttaatcaggtcgtcgatcactttctggtcatgcgcagcagtcttgaacctcaggcctgtctgcttgccgccacgctcggcacagcagagcaaaaagcgcagctcaatactttgatggaagagatggtggatctgaaaaagcactttaaccgcgagcgctggatagcggtcgatatggcctggcatgaacatatctataatatgagcggaaatcctttcctgacctcctttgcttctttattccattctgtgtaccacacttactttacctctatcacacaggatgaggtggtgaagctgaatctgcatcaggcgatagtcgatgccattcaggagagcgacgggcagcgagccctgagtgcgtgccaggcgttgctggccgcgccaacccaccagcaggtaaataaatga

SEQ ID NO: 1460 - DNA, 1464 bp, Enterobacter cloacae
acaggcgcgtcaatgctaacgctggacacgcttaacgtcatgctggcggttagcgaggaagggttgatcgaagaggtcgtcattaccctgctcgcttcaccgcagctggcggccttctttgaaaaattcccgaagcttcgaaaagcaatgacggacgatcttccccgctggcgcgataacctgcgccagcggtttaaggagacggaagtcccgccggaactgacagaggaagtggctggttaccagcagtgccagcggctttcaacgccgcagtttattgcccagctacagcaaactctgacgctgcttgataacgttcactccccgtttgccagccaggccagagcgctggtcacggacaaccccagcttcactcccgccctgcatacgctgtttttacagcgctggcgactgagccttgtggtccaggccacggccctcaatcagcagttgctggacgaagagcgcgaacagttgctcagtgaggtccaggagcgaatgaccctgagcggccagttagaacaggtgctggtggagaatgaaaacgccgctggtcgactctgggatatgagtgccggccagttaaagcggggcgattatcagctgatcgtgaagtacggcgactttctggcgcaacagccggagctgatgaagctcgcagaacagctcggccgctcccgggaggcccggtcggtcccaaagaaagatgcgccgatggagaccttccgaacgctggtacgcaaaccctccaccgtaccggagcaggtggacgggctacagcaaagcgatgacatcctgcgcctgctgccaacggaactcagcacgctgggaatgaccgaactggagtatgagttttatcgtcggctggtggaaaaacagctcattacctatcgactgcatggcgaagcctggcgcgagaagatcagccagcgtccggtggtgcaccaggattttgatgagcaaccgcgcggcccattcattgtttgcgtcgatacgtccggatcgatggggggctttaatgaacagtgcgcaaaagcgttctgcctggccctgatgcgcgtggcgctcgccgatcgtcgtcgctgctacatcatgctcttttccagcgaagtggtggggtatgaactgaccagcccgcaggggctggagcaggcgatccgctttttaagccagcgctttcgcggcggcaccgatctggccagctgttttcgcagtatcattgagcgcatgcagggcggtgactggtacgacgcggatgcggtggtgatttccgattttattgcccagcggctgccggacgaggtcgtgaataaagtgaaggagatgcagcgcgtgcaccagcaccgtttccatgccgtggcgatgtctgcacatggaaaacccggcatcatgcgcatcttcgatcatatctggcgctttgataccgggttgcgtagccgcctgctcagacgctggcgacgttaa

SEQ ID NO: 1461 - DNA, 1434 bp, Enterobacter cloacae
atgacagagaaaaaagcacgcagtatggccggattgccgtggattgcagccatggcgttctttatgcaggcacttgatgccactatcctcaataccgcccttcccgccatagcacaaagccttaaccgctccccgctggcgatgcaatccgccatcatcagctacaccctgacggtggcgatgcttattccggtcagcggctggctggccgatcgtttcggcacgcgtaaagtattcatgctggcggtgacgttgttcaccctcggttctctggcttgcgccctctccacctctctgacggaactggttatcttccgcgttctacaggggataggcggcgcgatgatgatgcccgtcgcgcgtctggcgttattgcgcgcctatccgcgcagcgaactgctcccggtgctcaactttgtgactatgccggggctggtcggcccgatacttggcccggttctcggtggcgtactggtgacctgggcaagctggcactggatcttcctgattaatattccgattggtgtggcagggctgatttatgcccgtaaatatatgccgaacttcaccacgccaagacgcagcttcgatatgggcggcttcttcctgtttggcctgagcctggtcctgttctccagcgggatggagctgtttggcgagaaaatcgtatcaacgtggctggcgctggccgtcatcctcagcggtattctgctgttccttctatatatacgtcatgcgcgtcgccatccgacaccgcttatctctttatctctgtttaacacccgaacgttctccgtcgggattgcgggcaacattgcctcacgtctgggcacgggctgcgtaccgttcctgatgccgctgatgctccaggtcggtttcggctatccggccctgattgctggctgcatgatggcgcccacggcgatgggctcgattctggcaaaatcgacggtcacgcaggtgctgcgctggtttggctatcgtaagacgctggttggcgtgacgatctttatcggattgatgattgcgcagttctctctgcaatctgcggcgttaccaatctggatgctgatcctgccgctgtttgtgctgggtatggccatgtcgacgcagtttacgtcgatgaacaccatcacccttgcggacctcaccgacgagaatgccagcagcggcaacagcgtactggcggtcactcaacagctgtcgatcagcctcggggttgccgtgagcgcggcggtactgcgattttatgaagggtttgacggtacaaataccgttgagcagttccactatacctttatcaccatgggcgcgcttaccgtggtatcggcggtggtctttatgttgttaaaaccaaaagacggccggaacctgattaaagagcgtcacaaagagaaggctaaaccgaaccgcgttccatcagaacaggagtaa

SEQ ID NO: 1462 - DNA, 1587 bp, Enterobacter cloacae
cgccgcacttcagcctattaccaggccagaccgaaacgtctatactcgcttcaattagccgccacgacggcgaaaggatgcaaaactattatggctcactcacatttattagcagaaagaatttcccgcctcagcagtgcgctggaaaaaggcctttacgagcgtagccacgccattcgcctctgtttactggcggcgctgagcggggaaagcgtgtttctgctggggccgccgggcattgccaaaagtctgatcgcacgccgcctcaaattcgctttccagaacgcgcgcgcattcgagtatttgatgacgcgcttctccacgccggaagaagttttcggcccactctccattcaggcgctaaaagatgagggacgctatgaacgtctgacggcgggctatctcccggaagcggaaatcgtctttcttgatgagatctggaaagccggcccggccattctgaataccctgctgacggcaattaacgaacgccgattccgcaacggcgccagcgaagagaagatccccatgcgcctgctggtggccgcgtcaaacgaactgcccgaagccgacagcagcctggaagcgctgtatgaccgtatgttgatccgcctgtggctggataaagtccaggataaatcaaacttccgttctatgctggtaagccagcaggatgaaaacgaaaatccggtggcagcgtcattgcaggtcacggacgaggaataccaccaatggcaggaggagatcggcaagataaaactgcccgatcccgtttttgagctgatcttcatgctgcgccagcagcttgatttactgccctccgcgccgtacgtctccgatcgtcgctggaaaaaagccattcgtctgctccaggcaagcgcgctgtttagcggtcgcgatgctgtcgctcccatcgatctgatcctgctgaaagactgcctgtggcatgacgcagaagggatgaatctgatgcagcagcagctggacgttttgatgaccggacacgcgtggggtcagcaatccatgcttaatcaactgggggcgattgctcaacgtcgccttcagctccagcagcagcaaagtgacaaaaccgcgctgaaggtgaaccgtcttggcgggatgtttgcccgtaaaccgcactacgaactgccagccgggctgactgacgcctcgctaacgcttcttcttcagcagccgctgaagcttcatgatatgcaggttgtgcatgtgactatcgaacgcgttgcgctggttcagtggctggataagggcggtgagatccgcggtaaactcaacggtatcggctttgcacagccgttgtcaatggaagtcgacagcagccagcaccttgtgatccgcgacgtcagccttcagggatcgcgcctggctctgccgggcacggcctccgacactgtgccggaggagatcaaacagcagctcgacgcgctggataacgaatggcatcagcagcacacccgcttcagcgagcagcagaaatgcctctttatccatagcgactggttaggtcgcattgaagccagcttgcaggatgtcagcgcgcagattaaacaggcgcgtcaatgctaa

SEQ ID NO: 1463 - DNA, 468 bp, Enterobacter cloacae
gaaaaacctatggaaaattatcagatcgacaatctggaccgcggcattctggaagcgctcatggccaacgcacgcaccgcgtatgccgaactggataaacaatttggcgtcagcccggggaccattcacgttcgcgtagagaaaatgaagcaggccgggatcatcaccggcgcacgcattgatgtcagcccgaagcaattcggttacgacgtctgctgcttcattggcattattatgaaaagcgccaaagattacccctccgcgctggagaaactgaacgcgctggatgaagtcactgaggcgtactacaccaccgggcactacagcatctttataaaggtcatgtgccgatccattgacgccctccagcaggtacttatcaacaagatccaaacaatcgatgaaattcagtccactgaaaccctgatctccctgcaaaacccgatcatgcgtactatccgcccgtga

SEQ ID NO: 1464 - DNA, 540 bp, Enterobacter cloacae
tcgggaaatttcattcccacattttccacaggtagatcccagctcgttcacagcgtacaatggccgcctctttatctgagcgagcgatcaatggcggacattactcttatcagcggcagcaccctgggcggtgcggaatatgtagcggaacatctggctgagaagctggaagacgcgggcttttctacacaaacgctgcacggaccgctgctggaagatctcccgactgacggggtctggctgctgatcacctccacgcacggcgcgggcgatctgccagataacctgcaacctttatatgacgaactgctggaacaacagcccgatctgtcaaacgtccggtttggcgctgtggggatcggcagccgtgaatatgacactttctgtggcgccatagagaaagtagaagctgcggtgaccgcctgcggagcaaaacagctgggtgaaacgctgaagatcaatatcctcgatcatgatattcccgaagatccagccgagatctggctcgcggaatggaaaaatttactcaaaaacgattaa

SEQ ID NO: 1465 - DNA, 978 bp, Enterobacter cloacae
tggcacgtggtatcgcgaagtctgcgctaccttcacaggctttacataggttccactattttgtctcaatccaaatttcagcgggcgtttctgcacccgcgctactggtttacgtggtttggccttggcgtactttggctgctggttcaacttccttatcccgtgatccgtttcctgggttcgaagctcggcagcgcatcgcgtcacttccttaagcgtcgtgagtccattgcccgaaaaaatctcgaactttgctttccgcattacaatgcgcagcagcgcgaaacgctgattgcggaaaactttaaatctatcggtatggcgctgcttgaaaccggtatggcctggttctggccagacgagcgtgtccgtaaatggtttgacgtggaaggtctggataacctgaaacgtgcccagatgcaaaaccgcggcgtgatggttgtgggtctgcattttatgtcgcttgagctgggtggccgcgttatgggcctttgtcagccgatgatggcaacctatcgcccgcataacagcgcgctgatggaatgggtacaaacgcggggccgcatgcgttcaaataaggcgatgatcagccgtaacaatttgcgcggtatggttggcgccctgaaaaaaggtgaagcagtctggtttgccccggatcaggactacggtcctaaaggcagcagctttgcccctttctttgcggttaaagatgtcgctacgacgaacggtacctttgtgatttcacgtctctcaggcgccgcgatgttgacggtgaccatggtcagaaaagcggataagtcaggctatcgtctgcatatctccccagagatggcgaactatcctgaagatgagagtgaagccgcgacctttatcaataaggtgattgagtttgagattatgcgtgcgcctgagcagtatctgtggatgcaccgccgctttaaaacccgtcccctgggcgaagcctcactctatatctga

SEQ ID NO: 1466 - DNA, 735 bp, Enterobacter cloacae
cagatgaaagtcatcatcgtagaagatgaatttctggctcaacaggagttgagctggcttatcaaaacccacagccagatggagattgttggctgttttgaggatggtctggacgtgctgaaatttttacagcataaccgggtcgacgcgatattcctcgatattaatattccgtcgctggacggcgtcctgctggcgcaaaatatcaatcagttcgcccacaagccgtttattgtgtttgtcaccgcgtggaaagagcatgccgtggaggccttcgagcttgaggcgtttgactatattctaaagccgtaccaggagtcgcgtattatcagcatgctgcataagctggaagccgcgtggcagcagcagtccttacccgccagtgccagcccggtagcgcgggaaaacgacacaattaatctggtgaaggacgaacggatcatcgtcacgcctgtcgacgatatttactatgccgaagcgcatgaaaaaatgacatttgtctatacgcggcgtgaatcctacgtcatggcgatgaacatcaccgaattctgcaataaactcccggccgcccacttcttccgctgccaccgctcgttctgcgtcaacctgaacaagatccgcgaaatcgaaccctggtttaacaacacctatatattgcggctgaaggatctggattttcaggtgccggtaagccgcagcagagtgaaagagttccgccagctcatgcacctgtag

SEQ ID NO: 1467 - DNA, 1260 bp, Enterobacter cloacae
gccgttttgtacaaggaaatcatcatgctccatccgcgagccagaaccatgctgttattggctgtcccggcgctgattattggcgtggcgtcgagcctggtgctcatcgtcgtcatgaaagtggcggcggtgctgcaaacgattttatggaccgcgcttccggtaaaactcggcatcagcattgactcgccgggctggatcatggtgatgctgaccctgaccgggattgccgtagggctggtgatccgctatagcccgggccatgccgggccggacccggcactggaacccttgattggcgcgcctgtctccccctcggctctgccggggcttatcatcgcgctgataatcggtcttgcgggcggcgtaagcctcgggcctgaacatcccattatggcggtgaatatcgcgttggcggtctttctgggggcgcgtcttttcccgcgcgttggcgcgctggactggacgatcctggcctccgctggcaccatcggggcgctgtttggcactccggtcgcggctgcgctcattttttcgcaaacgctcagcagtgatcatgaggtgccgctttgggataaactcttcgcgccgctaatggccgccgctgcgggagccctcaccaccagcctgtttttccatccccatttttcactctccattccccactacggccagatgcaactcaccgatattttcagcggtgccgtcgtcgtcgcgatcgccattgcgctggggatggtcgcggtgtggtgtctccctcgcctgcatcgcctgatgcacaggctgaagcatccggtgctgatcctgggcatggggggttttattctgggcgttttaggcgccatcggcgggacggttacgctgtttaagggtctggacgagatgcagcagctggccttcagccaggtcttcagcgtctccgattatctgctgttcgcgctggtaaaactggcggcgctggtggtcgcggcggcctgtggtttccggggaggtcgtatcttcccggcggtatttgttggcgtcgcgctggggctgatgctgcatgagcacgttgacgctgtccctgcggcgattaccgtctcctgctccattctggggctggtactggtggtcacgcgcgatgcgtggctgagcctgtttatggcggccgttgtcgtgccggataccacgcttctgccgctgctctgtatcgtgatgttgcccgcctggctcctgctggcgggcaaaccgatgctgatggcatggcgaaacgacaggtaa

SEQ ID NO: 1468 - DNA, 957 bp, Enterobacter cloacae
atgagcaattaccccgaaggagctgttatgaaagacattaacgaagaaaaaattggcgagaacaatgaagaacttgagattgaaagtgaggagaaagaccggggagaagagatagaagtcgatgaagatcgcctgccgtcacgcgccatggctattcatgagcatattcgccaggacggggaaaaagagatggagcgcgacgcgatggccctgctgtggtcagccattgcagccggtctgtcaatgggcgcctctttgctcgccaaagggatatttcacgttcagctggaaggcgtaccgggcgggtttttgctggaaaatttaggctacacgttcggctttattatcgtcattatggcgagacagcagctttttacggagaataccgtcactgccgtactgcccgtcatgcaaaatccgaccctcggtaatttcggtttactgatgcgcctgtggagcgtcgtgctgctggggaacctcatcggtacgggtatagccgcctgggcgttcgagtatatgccaatatttgatgaaccgacccgcgacgcatttgtgaaaattggcatggatgtgatgaaaaacacgccggttgaaatgttctctaatgctataatttccggctggatcatcgccactatggtgtggatgttcccctcagcgggcagcgcgaaaatcgtggtgattatcctgatgacctggcttatcgcactcgccgataccacgcacattgttgtcggaaccgttgaaatcctttatctggtatttaacggcacactccactggagcgactttttctggccgttcgccctgccaaccctcgcaggcaacatttgtggcgggacctttatctttgcgctgttgagccatgcgcaaatccgtaacgacatgtccaacaagcgtaaggccgagcttaaggctcaggaaaaaaaggataaaactgccgaaaaatcggcgtga

SEQ ID NO: 1469 - DNA, 381 bp, Enterobacter cloacae
cacaatcagaaattcatcgccgccgtagcgaaaaacgtaatcacaggttcgcacgttgtcgtagaacgcgccggagacttttcgcaggatctcgtccccggtattgtgcccccaggtatcgttgatttgtttaaatttgtcgacgtcaatcagcagcgtcgagagctttgttcccgcccgggtggcgtgcaggatttcgcgtttgaagatggttggcaggaaacggcgattcaacaggcgggtcaggacatcaacccccacctcgtgtcgcgacacttcgtcaaacagttcgcgcaaaagcgtgatgatttgcgagagcgtattacgcattcgctgcaagaatttatcccgctgcgctttatcactcagaccctgccctga

SEQ ID NO: 1470 - DNA, 1725 bp, Enterobacter cloacae
atttttcccgttttcccaggcctgaccgtgcacgaaatcttcaatatgctcctcgcggtgttcgaccgcgcggcattaatgctgatctgtctctttttccttatccgcatccgcttgttccgcgaactgttgcataaatctgcccattctccaaaagagctgctggccgtcacgtttatcttttcgatgtttgccctgttcagcacctggtccggggtgccggtagaaggctcgctggtgaacgtgcgcatcatcgccgtcatgtcgggcgggatcctctttggtccctgggtcgggattatcacaggcattatcgctggcacccatcgatacctgattgatattggcggcgtgacggcagttccctgctttatcaccagcattattgccgggctgctctcgggctggattaaccgcaaaatcccgaaaaagcagcactggcgtgcagggattatcgcggggatggtctgcgaaacgctgaccatgatcctggtcatcgtctgggcgccaaccgttgcgctggggctggatatcgtctcgaagatcggtattccgatgatcctcgggagcgtctgtatcggttttatcgtgctgctggtgcaaagcgtggaaggtgaaaaagaggccagcgccgcgcgtcaggccaagctggcgctggatatcgccaacaagacgctgccgcttttccggcacgttaacgccgaatctttacgtcaggtttgcgatatcatccgccgtgatattcacgccgatgcggtcgctatcaccaatattgatcacgtgctggcttacgttggcgttggtgagcacaattatcgcgacagcgacgacaccatcagcccgaccaccagacaggcgattaactacggaaaaatcatcattaaaaacaatgacgaagcccaccggacgccagagatccactcaatgctggtgatcccgctgtgggaaaaaggcgtggtcacggggacgctgaaaatttactactgtcatgcgcaccaaatcacctcctcgctccaggagatggcgattggcctgtcgcagatcatctccactcaactagaggtttcgcgtgcagagcagctgcgcgagatggcaaataaggcagagctgcgcgccctgcaaagcaagatcaatccccattttctgtttaacgcgctgaacgctatctcctcttccatccgtctgaatccggacaccgcgcggcagctgatatttaatctgtcgcgctatcttcgctacaacattgagctaaaagacgacgagcagatcgacatcaaaaaagagctgtatcaaatcaaggattacatcgcgatcgagcaggctcgctttggcgataagctgacggtcatttacgatattgatgaagaggtcaactgcgtgatcccaagcctgctgatccagcctctggtggaaaacgccattgttcacggtattcagccgtgtaaaggcaaaggcgtggtaacaattagcgtaacggaaagcggtaaccgcgtgcgtatcgccgtgcgcgataccgggcacggcatcgatccgaaagttatcgaacgcgtcaaatcaaacgaaatgccaggcaacaagatcggactgctgaatgtgcatcaccgggtcaaactgctgtacggtgacgggctgcatattcaccgccttgagccgggcaccgaaattgccttttatgttccgaatgagcgaacgcccgtgaatgccccaatatccttgttgccgtag

SEQ ID NO: 1471 - DNA, 1311 bp, Enterobacter cloacae
cgttgggcgaacggcgagtccggccacttctatcatatgagcgaacccatcaccgttgcgcaggcggtgcttacggaacaaaacgcctgctatgaaattgacagagtcctgaccaccatgctgcgggagcgccgtccgggctatctgatgctgcccgccgatgtggcgaaaaaagccgctacacctcctgtaagcgctctcactgttaaccccgcaccggccgattcagcctgcttgcaggctttccgtgaggctgccgaaaagcgcttgtctacgagcaaacgcaccgcgctgttagcggacttcctggtactccgccacggtctgcgcgcggcccttcagacgtgggtgaaagaggtgccgatggcacacgccaccatgctgatgggcaagggaatttttgacgaacgacagagcggtttttacggcacctacagcggatcggcgagcgccgcgccggtcaaagaggccatcgagggtgctgatacggtgctgtgcattggcacgcgctttaccgatacgctcactgccggatttacccaccagcttacgccagaccagacgatagaggttcagcctcacgcgtcccgcgtcggcgacgtctggtttacgggtatcccgatgagggaggccattgaaacgctgacagcgctgtgtaaaacctatgttcgtgatacgcgagcgccatcggatcacagcggcttttcgttcccgactattgaaggggcgctgactcaggagagcttctggcgcaccctgcaaacgtttattcgccccggagacattattctggctgaccaggggacgtctgctttcggcgctatcgatctgcgtttaccggcggacgtgaactttatcgtccagccgctgtggggatcgattggctacacgctggcggcggcgtttggcgcgcaaacggcgtgtccgaatcgacgcgtgattgtcctgacgggcgacggcgccgcgcagttgaccattcaggagctgggatccatgctgcgcgacaagcagcgcccgattattctggtgcttaacaacgaaggatacacggtggaaagggccatccacgggccggagcagcgctataacgatattgccctctggaactggacgcagataccgcaggcgctgagcctggcgcctcaggcagagtgctggcgcgtcagcgaagcggaagcgctggcggaggtgctggataaagtggcacaccatgagcggctttcgctgatcgaggtcatgctgccgaaagccgatattccgccgctgctgagcgcgctgaccaaagcgctggaggcgcgcaataacgcctga

SEQ ID NO: 1472 - DNA, 1254 bp, Enterobacter cloacae
cgtgactctgaggaatctatggctgaattcagtcctgaacgccgttttacgcgtatcgatcgtctccccccttatgttttcaatatcactgctgaactgaaaatggctgcgcgtcggcgcggcgaagacattatcgatttcagtatgggtaaccctgacggcccaacgccgccgcacattgttgagaaactctgcacggttgcccagcgtcccgatacccatgggtattccacctcacgcggcattccacgcttacgtcgggcgatctcccgctggtatcaggatcgttatcaggtcgatatcgatcctgaaaatgaagcgattgtgaccattggctccaaagaggggctggcccacctgatgctggcgacgctggatcacggcgataccgtactggtgccgaatccgagctacccgattcacatctatggggcggtgattgccggggcgcaggtgcgttctgtcccgctggtggaaggcgtcgacttctttaacgagctggaacgggcgattcgtgaaagctatccgaagccgaaaatgatgatcctcggtttcccgtcaaacccaacggcacaatgcgttgaactcgaattcttcgagaaagtggtcgcgctggctaagcgttacgacgtgctggtggtacacgatctcgcctacgccgatatcgtttatgatggctggaaagcgccgtcaattatgcaggtaccgggtgcccgtgatgtggcggttgagtttttcaccctgtcgaaaagctacaacatggcgggctggcgaattggttttatggtgggaaacaaaacgctggtgagtgccctggcgcgtattaaaagctaccatgactatggcacctttacgccgttacaggtcgcggccatcgcggcgctggaaggggatcagcagtgcgtgctcgatattgccgctcagtacaaacgccgtcgtgatgtgctggtaaaagggcttcatgaagcaggctggatggtggaaatgcctaaagcctccatgtacgtctgggcgaaaatccccgagccgtatgcggcgatgggttctctggaatttgccaaaaaactgcttcaggatgcgaaggtttgcgtctctccaggcattggctttggtgactacggtgacacgcatgtgcgtttcgcgctgattgaaaacagcgaccgtatccgtcaggcagtgcggggcattaaaagcatgttccgtgcggatggcctgcttgcagcgaagagcgttgcggaacaacccgagtcgtaa

SEQ ID NO: 1473 - DNA, 981 bp, Enterobacter cloacae
cggagcagtagaagaatgacaaagtatgctttggtaggtgatgtaggcggcaccaacgcgcgccttgccctgtgcgatgtgaacagcggtgaaatttctcaggcgaaaacctattcagggctggattacccaagcctggaagcggtggttcgcgtctatctggaagagcataaagtgagcgttgaagacggttgtatcgccatcgcctgtccgattaccggcgactgggtggcgatgaccaaccacacgtgggccttctcaattgccgaaatgcggaaaaacctcggcttctcgcaccttgaaattatcaacgacttcactgcggtttccatggctatcccaatgcttaaaccagagcatctgattcagttcggcggtacggccccggttgaaggcaaaccgattgccgtttacggcgcgggaaccggtctgggggtggcgcacctggtccacgtcgacaaacgctgggtcagcctgccgggcgagggcggtcacgtggattttgcgccgaacagcgaagaagagggcattattcttgaggagctacgcgccgagattggtcacgtgtcggccgagcgggtgctttctggtccgggtctggtgaacctgtatcgggcgattgtcaaatcagacggtcgtctgccggaaaatctgcaaccgaaagatgtgaccgaacgcgcgctggccgacagctgtattgactgccgccgtgctttgtcgctgttctgcgtcatcatggggcgttttggcggcaacctggcgctgaaccttggcacctttggcggggtctatattgcgggcgggatcgtgccgcgcttcctcgatttctttaccgcctccggcttccgtggcggcttcgaagacaaaggccgcttcaggagctatgtccaggacattcctgtttacctgattgtccacgacaacccaggcttactgggatccggcgcgcatctgcgtcaggttcttggtcagatcctctga

SEQ ID NO: 1474 - DNA, 1416 bp, Enterobacter cloacae
atctgcgttcccgcatgcctcctgaaggtgcagaccatggaaacctacctgcaaacggtgaaagaagaatgggtgaagctaattaatgaaaccgatcccgatgtgcatcggcttgcgactgagcttgccagggacaacgcaacgcccctggtcgctgaattctatcgtgttgtgctggcagatccgtcggcagctgaattcctgaccaccgaacaggtggagaggcagcttcaggaggcgcttcgtcgctggcttattgatgtgctctcatgccgtgtggagcaggttgaagagcagatgcgggcgcagcagcgcgctgcggatgttcatgcccgtattggtatttcggttgatttagttgaaatgggcttccgtgttctgaaaaagctgctgttacctgtcattactaccagcgcccattcgcctgaggtgaagctgcatatttatcactacgcgattaacagtatcgatctggccatggaagtgatgtcgcgggcctatgtatttagcgagaacaatgcggcgaaagaggacgaaaattaccgcatcttttccttaatggagaacgcagaagaggagaaggagagacagaccgcggcgctgctgtcatgggaaatggtgcttctgtataagatcacgcttaattccagtatcggcaacagtctgccgctggggcagtctgaatttggactgtggtttagccataaaggtcggcactatttcagcgggatcgctgaggctggtcatatctctcgtctgattcaggaattcgatgacctttttaacgaggtccgtctttcagggcagggtctgagtgataaagcgcagcgggataaattcttgcagcgaatgcgtaatacgctctcgcaaatcatcacgcttttgcgcgaactgtttgacgaagtgtcgcgacacgaggtgggggttgatgtcctgacccgcctgttgaatcgccgtttcctgccaaccatcttcaaacgcgaaatcctgcacgccacccgggcgggaacaaagctctcgacgctgctgattgacgtcgacaaatttaaacaaatcaacgatacctgggggcacaataccggggacgagatcctgcgaaaagtctccggcgcgttctacgacaacgtgcgaacctgtgattacgtttttcgctacggcggcgatgaatttctgattgtgctaacggaaatctcagaggtggacgcgctgcgaatcgccgagcgtatccgcaggcgggtggaaaaaatcaaggttaactccccaaccggcgatattatcccgctctccctctcgataggcgtggcgatgttcaacgggcatcccgattacgagcgattgattcaggcggcggatgaagccttatacggcgtgaaacggcgtggccgaaactgcgtggagctttggaagggggcgtaa

SEQ ID NO: 1475 - DNA, 888 bp, Enterobacter cloacae
cgcgagcgggtcgtcattgtcctcgtagacatcggtaagcgtgctgttacaatcacttgcacgtttcaggcggagcatcaccggctccgtcacagatggcattcaacgatagccatattgaacagggagaaatttatgaagcttcggctgtcggcgcttgcgctgggcgtaacaatgcttgtgggctgcgccagctctggcgagcaaacgggacgctccgatcctctcgaaggatttaaccgttcaatgtacagctttaactataatgtgctggatccgtatctggttcgtccggttgccgtggcatggcgtgactacgttccgcagccggcgcgtaacgggctgagcaactttaccagtaacctggaagagccagcggttatggtcaactacttcctccagggcgacccgtatcaggggatggtgcatttcacccgcttcttcctgaactccctgctgggtatgggcggcttaattgatgtcgcgggcatggcgaacccgaaattacagcgtgaacagccgcaccgtttcggcagcacgctggggcattatggcgtaggttatgggccgtatgtgcacctgccattctacggcagctttaccgtgcgtgatgatggcggcgacatggtggatacgttgtatccggtgctgtcatggctcacctggccgctgtcgattggtaaatggaccgtggaaggaattgaaacacgtgcgcaactgctggactctgacggtctgctgcgtcagtcttccgatccgtacatcatggtccgcgaggcctacttccagaaccatgactttattgccaacggcggtaagctgaagccggaagataatccgaacgcgaaagccatcgagaacgaattaaaagatatcgattcggaataa

SEQ ID NO: 1476 - DNA, 525 bp, Enterobacter cloacae
tatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggctacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 1477 - DNA, 234 bp, Enterobacter cloacae
tgctgccaacttactgatttagtgtatgatggtgtttttgaggtgctccagtggcttctgtttctatcagctgtccctcctgttcagctactgacggggtggtgcgtaacggtaaaagtactgccggacatcagcgctatctctgctctcactgccgtaaaacatggcagttacagttcacatacacagcctctcaacccggtacgcaccagaaaatcattgatatggccatga

SEQ ID NO: 1478 - DNA, 942 bp, Enterobacter cloacae
cctggcagaaacccttcatgcataccgtcttggagcggactggaacaacgcgccaggcttgcggctgaattcatgtatggattgctgtccagacagggcgtgatcgacacggctttcgcatcgctgaccacaaaaccgcatctgacgcaggatcagcaggccctgatacaggacattcttacggatatccgcatttacggccagcctcactttgatgtcacggccttttacaacgggatgctcagttatctgaaccggggccggttcagggcgaccggggagctgactacccaggacaggctgcgggaggtgttcaggatcagcagcattgatgagttccgggccctgctggcaaatgaacccatgctggttctgccggaatgcccggacaataaactgaccctcgaggcgtttttctggcgcgacgaatattttaacagtcagggaccggatgcacttctcagttatctgttcagtccggagcagatccagcgctatctgaacgtcagggcggaatttgaagacaaaggtaaaaccgtggaaaaactgtcagccgggcaacgggggaccttctatgtctgccttaaactggcggcagatgccttcggatcgccgtttgtatttgatcagccggaagatgacctggacaatgaattcatcatgcatagtctggtcccacttttcagaaaaataaaacagtaccggcaggtcatcatcgtgacgcataacgccaacctggtggttaactgtgatgctgaacaggtcatcatcgcggccaataatgatgaagtcatcagttaccgtagcggggcgctggaatacggagatcacggggcgccaaacagtatgtgcaaggctatatgtgatgtgcttgaagggggacgccaggcgttcgaagcgcgtgagcaaaaatacgggatggtgtggcttaacgccatctga

SEQ ID NO: 1479 - DNA, 285 bp, Enterobacter cloacae
ggtgctccagtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaaccgcccgcattatgggcgttggcctcaacacgattttccgccatttaaaaaactcaggccgcagtcggtaa

SEQ ID NO: 1480 - DNA, 525 bp, Enterobacter cloacae
tatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagactgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggacgtcgctgtcgttctcaaaatcggtggagctgcatgacaaagtcatcgggcattatctgaacataaaacactatcaataa

SEQ ID NO: 1481 - DNA, 234 bp, Enterobacter cloacae
tgctgccaacttactgatttagtgtatgatggtgtttttgaggtgctccagtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatga

SEQ ID NO: 1482 - DNA, 285 bp, Enterobacter cloacae
ggtgctccagtggcttctgtttctatcagctgtccctcctgttcagctactgacggggtggtgcgtaacggtaaaagtactgccggacatcagcgctatctctgctctcactgccgtaaaacatggcagttacagttcacatacacagcctctcaacccggtacgcaccagaaaatcattgatatggccatgaatggcgttggatgccgggcaaccgcccgcattatgggcgttggcctcaacacgattttccgccatttaaaaaactcaggccgcagtcggtaa

SEQ ID NO: 1483 - DNA, 729 bp, Enterobacter cloacae
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccaatcggaatgataaaaatgaaccacccggttgcgatggtctttga

SEQ ID NO: 1484 - DNA, 297 bp, Enterobacter cloacae
tgcccgatgactttgtcatgcagctccaccgattttgagaacgacagcgacgtccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcagtctcataagacgccccagcgtcgccatagtgcgttcaccgaatacgtgcgcaacaaccgtcttccggagcctgtcatacgcgtaa

SEQ ID NO: 1485 - DNA, 681 bp, Enterobacter cloacae
gctatcaatcctatgagaatactccttgtcgaggacgatccgatggttggagaggtcgtcaccagctcgctgaaagacaacgcctgggcggtagactgggttaaaagcggcaatgatgcctgtgtcgggtttagcacctggcaatatgatgtgattttgcttgacctagggttgcctggcaaagacggcctgaccgtgctggccgaaatccgccaaaaagcgcttccggtgccggtgctcattctgaccgctcgcgacgcgctcgaagacaggttaaaagggctcgacggcggtgcggacgattatattctcaaaccatttgaaatgagcgagctactggcccggatccgcgcagtcattcgaagaaacactggcaatggaaaccctgtcctgagtaatggcgtactgacgctggatccggtcactcatgaagccagcatttccgaaacccagcaaaagtttttgctctcgaaccgcgaatacgccctgttggaagctctgatgctgcgtccaggaggaatactttcccgcagcgcactggaagaccgaatttatggctggggtgatgaagtcgaaagtaatgccatcgaatttctgatccatgcgttaagaaagaagctcgggcgggacgcgattaaaaatgtcaggggagtcggatggctggtttcaaaaaacggatga

SEQ ID NO: 1486 - DNA, 1413 bp, Enterobacter cloacae
actatgttcggattagatgccttccatttggccagggtacagtttgcatttactgtttccttccacattattttcccagcaataaccattggtctggccagtttcctggccgtgctcgaagggttatggttaaagacacgaaatgacacttacaaggagctctatcacttctggtcaaaaatttttgcagtaaactttggtatgggtgttgtttccggtctggttatggcttatcagtttggtaccaactggagtggcttctcacagtttgcagggagtatcaccggtccattgctgacctacgaagttctgactgcgttcttccttgaagcgggtttccttggtgtcatgctgtttggctggaatcgtgttggccccggtctgcacttctttgctacctgtatggtggcgctggggacactgttttccacgttctggatcctgtcatccaatagctggatgcagactccacagggttatgccatcgagaatggtgttgttatccctgtagactggctgaaaattatctttaacccttccttcccgttccgcctgttacatatgtccactgcggctttccttgcaagcgctttttttgtcggagcatcagcagcatggcatctgctaaaaggcaatgatactcccgctattcgcaaaatgttctctatggcattgtggatggcattaatcgtttccccgatccaggccgttatcggtgatgcgcatggtctgaatactcttgagcaccagccggcaaaaatcgctgcgattgaaggacactgggaaaataaacctggtgaagcaacccctctggttctgtttggcctgccagatatgaatgcagaagagacgaagtacaaaatagaggtcccttatcttggcagtattatccttacacacagccttgataagcaggtgcctgccctgaagagtttccctaaagaagatcgtcctaactccactatcatattctggtctttccgcgtaatggctggcttagggatgctgatgattcttctcggggtggtcagcgtatggctgcgctggcggaaacgtctctatacatctaaaccgttcctctatttttctctcttcatggggccttcgggactgattgcgttactggccggttggttcacaactgaaataggtcgtcaaccatgggtcgtttatggcgtacagcgaacgaaagatgctgtttctgcacatggcgatttacatatgtcaatcagcttactggcgtttcttcttgtttacacctcagtctttggcgtcggttatatatatctcgtacgtctgatcaaaaaagggcctgtacatgctgaggagcatcaggaggtaacggatggaacacctgcccgtcctctgtcagcggtaaatgagggtttggcaacacgtgggagagacaaataa

SEQ ID NO: 1487 - DNA, 738 bp, Enterobacter cloacae; identical to SEQ ID NO: 1033

SEQ ID NO: 1488 - DNA, 297 bp, Enterobacter cloacae
tgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaa

SEQ ID NO: 1489 - DNA, 1386 bp, Enterobacter cloacae
aaatgtcaggggagtcggatggctggtttcaaaaaacggatgaaaacctccgttcagttacggttatcactggcgctgggtatcgctatcctgcttaccgccgttatttccggagggattaccttttatctggcgctggatgaagccagggagcttcaggacgataccttaaaacagatagcttacgtcacgaagtcccccggacataacgcgctgcccgaaataaaggggcaaaagagggccgacgaggacagcgatggcaaaatactggtggaatatctcaccgtctcgggtacgcaaaacgatgacacaggcatcacctttcatttgcccgcgcccgtgagggaaggttttcagaacgccaccatcaccggtgtacaatatcgggttcttgttcaccgtctgacgccggaacagtttgtgattgttggtcagcagaccgaggtcagggatgaaatcgcctttgcaagcgcattacgcacgctgatcccatttatcctgcttttacctgtgctgctgctggtcaccaccgacctgataaaaaaatccttccggccagtgctgaatcttgctgcaggagtataccggcgagatgaacgggatttaacaccattgagggatgataacataccggacgagattcgccctttcgtggaaagtattaacagacttttgcacaaagtgaacaacacaatacaggcacaaaaacgcttcattgccgatgccgcgcacgaattacgcacccccctgacggccctgtccctccaggctgagcggttatcgggttcagacatgtcggcagaggcgcgtgagcgtttagccgctctgaggctggggttgacgcgggaaaaaaatttgcttgagcagctattatctctcgccagagagcaacagcctcttcagacgcaagggacagaagcggtatcactcaatgaagtgtttcggcaggttatagagaccctgctccctctggcactggaaaagggtattgatatcggtgtggtggaaaccccttaccaggcagagtcgcaggtgattacggaaaaaaacaccctgtacacggcgctcaaaaatctggtcgaaaacgcgattcactatatccctgaaaacgggcagattgacctgcggttacagtttattgataacagcgcggtgattgatgtcgaggataacgggccgggaattgcagcggaacaaagagaacgagtatttgacgcattctaccggcctgcaggcaccgaaaaacctggctcagggttgggcttgtctattgtaaaagcatgcgtgcaccggctgggaggaacaatcattcttgcgccatcctcacactttccatccgggttgagggcaaggataatcctgccggttgaaagccactccgggtaa

SEQ ID NO: 1490 - DNA, 348 bp, Enterobacter cloacae
cgctaccgtggatgtccggtccctcctggttccctctgcatccgggctcgcaactcaatgaaagacgaaatagcacgacagatcgccggacttattgagctgaacaaatttaatggctatacgctggtcagcggagaagactggcagaagcctacagtcaccgaaatcctgctggtccggggatttatccccctgactgacaaccagctggctaaccgactggatgtggacgaacgcaccatccgtaagtggaaatcaggagagaccagtatggtgtacaccacctggtgctgcctgtgctggctggctgggctggggatgccgctcgataacattatcagtggctga

SEQ ID NO: 1491 - DNA, 1041 bp, Enterobacter cloacae
gggtttggcaacacgtgggagagacaaataatgggtattgatctgtcaattatctggtttgtcatcatcgtcttcgctacgttgatgtatatagtgatggatggatttgatctgggaatcggtattttgttcccgtttcataagcacgatgtcgatcgcgatacaatgatgaataccgttgcgccggtatgggatggcaacgaaacctggatggtactggggggagcggcattgtacggcgcgtttcctctggcttacgctgttatcattgatgctcttagtattccgcttaccgcaatgttacttgggcttatctttcgtggtgtggccttcgagtttcgttttaaagcaatcccggaacatcgacctatctgggacaaagcatttatagtcggctctgtactggccactttcagtcagggtgttgcagtcggaaccttattaaatggattgagtgtgtccggacgtgcatttagcggttctgcattggtttggctcgccccgttccctctgttctgcggattgggactggtactggcctatgccctgctgggttgcacctggctgattatgaaaacagaagactcgtttcaccgcaggatgtcagagcttgcaactccgttaaccattggtttactggcagttattgcaattatcagtgtctggaccccattgactcatcctgagattgccagtcgctggttcagtatgccaaatgtcatctttttcctgcctgtaccattgctggtccttgtttgttgctggggtatcgttcgcagtgtttatagccgtcgatccagctttggtccctttatgctgacgttaggattaatcttccttggtttcagtggtcttgggatcagtatctggccatatatcataccgccttctgtaaccatctggcaggccgcgtcacctcctcagagtcagggctttatgctaataggtggcttgttgattatccctgtaatcctgatgtacacctgctggagttactatgtattccgggggaaggtaaaaactggcgacggttatcactaa

SEQ ID NO: 1492 - DNA, 501 bp, Enterobacter cloacae
ataatttacatctcaacaatttacatgacttctttgcgccttttccgggcttgtacaactctgcaacgccacttcgaattgtacaatatattttgtgaatttagcagtaagctgtatacatataaccatatgataaatatatactttatcaaatatattataaaatatttaaaaaattgtacatttttaatgtacagatttgaaaattatgtataccttaaatgtaacgttactgattacgaaaatttacaggagcgaaacatgcagcagaacggacacctcgcagacacagcaacagcaattgcgcagtacttcgaaaaagccgcgcttccaacccaacaggaaacattgggtcaggttgttgttgaaatccttagcgacgggcggaatctgaatcgcaaatcgctctgcacaaaactgttaagtcgccttgaaaaggccaatggcccggaagaggagcatcattatcacatgcttcttggcctgctcttcgaacgttaa

SEQ ID NO: 1493 - DNA, 381 bp, Enterobacter cloacae
gaacaaatgagacaaaatattcagcttcaacccgaataccactccgcctttttagatagcgcgttgtcggagtatttccgtcacgcaggcgatcgctttgctgaagagtctgccattttttcgactgcggttcgttgtgttcttgcttccgaaggtcatctgaccaacaaatcgatcattctctggctgatccagacgctggaatccaccgatgatgtcgttaaggcggatgtgatccgcaagacgctggaaattgtcgtcggttacaccatggacgatctttatcgcctcactcttcccatctcttcggatagcgtgtcgtcgtcaattctgacgaacggactgacgataacgtgccctctctcacctaacgccctgtga

SEQ ID NO: 1494 - DNA, 2184 bp, Enterobacter cloacae
acattgcttcatttcttaacaggtctgttattgatgaaaaaaatcgccagcgtctgcccctactgcggtgcaggctgcaaacttaacctcgtcgttaaaaataaccggattatccgtgccgaagccgctgatggcgtaactaatcagggcacgctttgcctgaaagggttctacggctgggactttcttaatgatactcggctgcttaccccccgcctgacgcagcccatgatccgctacagcaaaggcgaggcctttacccctgttacctgggaagaggccattcgctataccgcttacaggcttaaaagcatcaaagaacagtacggccctcggtccattatgaccacgggttcctcgcggggaacgggcaatgagaccaactatgtgatgcaaaaatttgcccgtgcggtgttgaatactaacaacgtcgactgctgcgcccgcgtctgtcacggtccttccgttgccggtttacaggagaccctcggcaacggcgccatgagcaattccattaacgatattgaaaactcaaaatgcctgctggtattcggctataactgcgccgactctcaccccatcgtcgcccgacgcgtgcttaaagcacgtgaaaatggcgctaaaatcattgtctgcgatccgcgtcatattgaaacggcacgcattgccgatcttcatcttcagttaaaaaatggcagtaacatggcgctggtcaatgcctttggctatgtcctgcttgaagaggaattgtacgacaaaaactacgttgctcgctttacagaagggcttgaggcgtaccgactgacggtaaaagattacgcacccgagcaggttgaacatctgacggggatccccgcgcgggatgttcgtcaggcaatgcgcatgttcgcagcggcgccttcagcaacggtgatgtggggaatgggcgtcacgcagtttggtcaggcggtcgatgtggtgaaaggtctctccagcctggcactgctgaccggcaatctgggccgccctgccgtcggcgtggggccggttcgcgggcaaaataacgttcagggcgcctgcgatatgggtgttctgcccaatatgttccccggctaccaggacgtcactgatccggcggtcagactgaaatttgccgatgcgtggaaaatcaatgtcaaccggatggacgatcgcgtcggaacgcgtatcaccgaagtgccgcatctcgcgctggaaggtaagatcaaagcgtattacatcatgggggaagatccgcttcagacagaagccgatctgggtctggtccgccgcggctttgaggcgctcgattttgtggtggttcaggacatctttatgaccaaaacggcagagctggctgacgtgctgctccctgccacctcatggggagaacacgccggtgtgttcacctgtgccgatcgcggctttcagcgtttcggcaaagccattgagcccagcggcaatgtcaggcgtgactgggagatcatcagcctgctggccacggaaatgggctatcccatgcattacgaggataaccagcagatctgggacgaaatgcgcgagctgtgccccctcttctacggcgtgacctacgaaaaaatgggcgagatgggtcatgtgcagtggccctgtccaaccctcgatcatcccggcactccctacctgtacaaggataatcagttcgacacccccactggcaaaggccagctatttgccgccccctggcgcgccccggcggagacaccggatgcggattacccgctggtactgtgcacagtgcgcgaagtgggccactactcctgccgctccatgaccgggaactgcgccgcgctgcaaagcctggccgacgagccgggccgggtgcaaattaacccggccgacgcggatgaacgggggattgccgaaggccagctggtctgggtacgttcacgccggggtaaagtgatcacccgcgccagcatcagcgagcgcatcaatgcgggagcaatctatatgacctaccagtggtggattggcgcctgtaatgagctgacgcaggataatctcgacccgatctccagaacgccggaaacgaagtattgcgccgtgcagcttgaggcaatcgaggaccagcgctgggcggaggattttgcggcttccgcgtaccagaccatgaagacgcggttgatcgctgcggttaacgtttaa

SEQ ID NO: 1495 - DNA, 687 bp, Enterobacter cloacae
ggtaaaaaaatgcgttttatcaccacaacgggcctggttatggcgctgttaccgctgacgttaacatccgccagtgcaggagtaattattggcggcacccgtgttatttttgatggggctaaaaaagaagcgtcaataaatattacgaatcctgataacggtccttatttaattcagtcgtggatagatgttcaggatgaacaatcgggtaaagcgccttttattattactcctccgctgtatcggctggacggcggacaaaaaaacctcgagcgtattgtcatgacaggctctctgcctcaagggcaggagagtttattctggctgaacatcaaagctattccgtcagcctctaagcagatgaactcgctgcaaattgccgtcaaaacgcgcatcaaattaatttatcgaccagaggctcttcgtgcgtctacccccgaggagcaggccaataaattaacctggcgtcgtgcgggaaatacccttctggttaataatccaacgccgtacgttatcaatttcaatgaaattacgttgggtaataagaaacttgacgatgtcacgtatgtgatgccttcgggcacagcccgtttcccgttaccgaatggaaccagtggcaatacgctgacgtttaaagtcattaacgattatggcagccctggtgaattacaccgggccagtttgtga

SEQ ID NO: 1496 - DNA, 2571 bp, Enterobacter cloacae
tccttacgcgttaatcaggtgctcgtcatgacaacggcattgaatacaatgcagcctgcgcgcctggcaatatttattgccctcgcgcttgctggtgtctctcccacactgtatgccagtgagacgtttaatacggaactggtagagctggataatcccggaatggggaaagcggatttatctgcctttgaatccggctcgcaggcgcccgggacataccatgttgatattattcttgacgatcggctgctggaaacgcgggatattcgtttcatggcagtgaaggatgctaacggcagtgaaacgttgcagccgtgcctgagtatcgggcagttaaaagcgtggggcgtgaaaacggcgcttttcccgcagctcgacgccggggaaggagaatgcgccgatctcagggcgattccacaggccagcgcggatttccagtttggcgcccagcgcctggcgatcagcatcccacaggcggccatagacctgccagcgagaggttacgttccgccggatatgtgggatgaaggcattaccgcggccatgctcaactacagcctgagcggggcaaacagccgggcaagaagcggggcaggcacccgcagcgacagccagtatgcaaacctgcggccggggatcaacgtcggtccctggcggttacgcaactacaccacctggtcccgcgatgcgtccggcctggataagtgggacaacgtctacaccttgatgcagcgcgcgattattcccctgcaagcccagcttacgctcggagacagttccgcgcctgccgatgtctttgacagcatgccgtttcgcggcgtccagctggcgtccgacgacgatatgctgccggattccctgaaaggctatgcgccggtggtgcgcggtattgcgcgaactaacgcgcaggtcgtggtgcgtcagaatggctatcaaatctaccaaagctacgtggcgccgggcgcgtttgagatcgcggatatgtatcccaccggcggcgcgggcgatcttgatgtcacgatcgtcgaagccgatggcagtgagcaacatttcaccctgccgtacgcttcgctgccggtcctgcaacgggaggggcgactgaaatatgcccttaccgccgggcaatatcgctcgtataaccgtagcgtggagaaaacccccttcgggcaactgaccggaatttacggcctccctcacggaatcacgctctatggcggcgtccagggggcagataagtaccagtcggcggctctggggatgggcaagaacatgggcgatctcggggcagtatccgcagacgtcaccctgggctggtcaacgccggagcataccgcgaaaacaaacggtcagtcgtggcgggccagatacagcaagaattttatcactaccggaaccaacttttcgattgccgggtatcgctactcgacccgcggctattacgggatgcaggacgtcctcggttcgtacggcgacagcagcgcgcttcaggacaggcgacgtaaccgtgccgagctgacgatgagccagacgctgggggacaacctgggcgcgcttaccctcagtgcggcgcgggaagattactggaatgacggtaagtcgatggcttcgtggagcgtcggctatagcaactactggcacaacatcagctatggcctgacatggacctacagcaaaaatgtccgctcagcgtcagaaaaccgcaaaagccaaaaaaacgctgaccacaaccagcttctgtcgttcaacgtcagcattccgctggataaatttttgccgcagacatgggctaactatggcatgaacgccagcagcaataacgggacgacgcataacgtcggcctgaacggggtggcactcgagaaccgtgccctgagctggaacgtccagcagggatatggcacagagggcgtggggaataccggcaacgtgaacgcggactataaaggcacctatggcgaagtcacggcaggttatggttatgacaaaaacagtgaacgcctgaattacgggctgcaaggcggcattctcgcccatgctgatggcatcacgctttcccagccgctgggggagaccagcgtcttaatcaaagccccaggcgcctacgacgtggatatccgcaatcagcccggtgtacggacagattttcgcggatatacggtcgtgagcaacctttctgtctaccggaaaaacgatctcaccctcgacccggaaacgatgccggacgatgtcgagctggagatcaacacccgcacggtgacgccgacgcggggagcggtggtgagagccgattatctgccgaagtcaggtcgccgggtgctgatgaccttgaccgacaacgaccgcgccgttccgtttggggcggtggtcacccttgtgggtgatgaaagcggcagttttattgtcggcgatcgcggtcaggtctatttaaccgggatgcgcgagcagggaacgttagtcgccacatggggaagtcaatccagccagcaatgccgcgctgatttcacgctgccgaatcactcaatgtacggtgggatcgctgatatgcgcgccacctgccgtcaggaacgctaa

SEQ ID NO: 1497 - DNA, 681 bp, Enterobacter cloacae
cggtgcaccgctggcgatgaacagccgactatttttgcgacagtctgccggggggcaagagacgttgccattaacggcccgatattaccagacgttaacccgcgtggagtcaggttcagcgaatgcctccgccaccctgaatttgacctaccagtagcaggtaagaagatgaaaataagatgcaggacactgctgttacttgccttactcagcgggaaggtatgctccgctgatagcgtcaacatcggtgtgacgggaaatatcgtggcgtcgccatgcatatttaatggcggcaataacaatctcgatgtcaatctgggcaatattcaggcaaccaatatggcgacgccgggctcaacatcggatccggtgcctttcagtctgctgtttacccagtgcccaacgggaacgcagagtgtgaccgtcgctttcaccggcagccccgatcctgaggcgggcgcggactattttatgaacagcggttcggccacacatgtggcgatagccatgcgcgatgcccaaaccggtgcgcttaaaggaacaggctccagcatgacccagaccattgccgcggacagaaccgcgacattagctatgctggcctcggtaaaatccatgacggggggcgccacgccgggaagcatccgcgcggttgtggtgatgacgatgcagtacaactga

SEQ ID NO: 1498 - DNA, 1284 bp, Enterobacter cloacae
tgtgctataacagagttctccccacgtgttttcgtggtcaccccctcaatcttcaggattagcatgctcacaaccattatttaccgcagtcatatctgcgaggacgttccagtgaaagcgctggaagacatggtcgctgctgcaaattgtagaaatcgccagttcgatgtgacggggattttgctgtttaacggcacacacttctttcagttacttgaagggcccgctgataacgttaaggagatctatcagctcatctgccgtgacccacggcatcacaacgtggtcgaattattaagcgatcacgggccttcaagacgttttggcaacgtaggtatggagctctttgaccttcgtcagtacgacaccgacgaagtgctacaaaaggtactcgataaaggcacaacccgctatcagctgacctataacgatcgcgccctacaatttttccgcaccttcgttgaggccactgaaaaagccaactactttgagctgcctccggctgacgcctgggagtttgtcaccgaaaacacgccattatcctcccagccaacggtagtggcaaagggcgcggactgtagtttcgcatttcaacctatcgtcgatccgtttatgcagcaggtggtttcctgggaagccctgatccgcacgccgtccggtgagtccccggaaagctactttgccaacctgtcgcgtgaggcgctgtacgaatcggatctgaagagtaagcaggtggctttgtcgatggccagcgcgctgggcctacagactcaaacgttgtccatcaatctgttgccgatgacgctggttaatgttcctggcgccgtcgattttttactgacggcaattgaggcgaacggttttgtgccggagcaaattgtggtcgagttcaccgagagcgaggcgatctcgcgcttcgaagagttcaccagcgcggtcagacagcttaaaagcgccgggatcagcgtggccatcgatcactttggcgcgggattcgccggtctgcaactgctggcccagttccagccggacagaatcaagatcaaccgtgatttgattgctaacgtgcacaagagcggcccgcgtcaggcaatcattcagtcaatcattaaatgctgcgcctccctggaaattctgttctgtgcggtaggcgtagagctagctgaagagtggatgtggctggaatctgccgggatttctcagttccagggtcaccttttcgccagcccgcgtctggggggcattccggcgattgcctggcccgagaaaaagtacgatttataa

SEQ ID NO: 1499 - DNA, 852 bp, Enterobacter cloacae
cgagtgagtggttctttgagccattcacttgtctcagaacgaggagttagttatacaaatgatttgtacaatctgataaggttggtttggttaggtatggaagtattgtgcgtgagggagttaatggcctattacagtatcggcgaagtggccgaacgatgcggtatcaaccccgttacgttgcgtgcctggcagcgccgttatggattgttgaagccgcagcgaagcgaagggggccatcgtcagtttgacgatgaagatatcctgcgtatcgaagagatcaaacgcctgatgaaaacgggtgtttcggtcggtaaagtaaaagcgcttcttgaaaatacagaagtgatgactcaggggaactgggcatcgtttcaggaagagatgttaaccgttctgcgctatgccagcccggcaaaactgcgcgccaaaatcggcgagttccgccgtgaccatgcgatggatgttctgatagataacatcatcacccctgtgcggcagcgaatgaaccaggaccagaatacggtgcgtcacatggcgagcctgctggacggtgtcctgattgagtttgccgttgcaagcctgggtgagtcgcgaaaaaaagcaggtaaggatgcgctgctgattgggtgggagtgcgacgaccgtacgcatttgtggctggaagcggcccgtcttgcctacaaaggctggcatatcgacgtgctggctgagccgattgattctccacgtcctgaactcatccccgggcaaaaaatcttcgtctggaccggtaaagcgcctacgcctcgtcaacaggagcagctcgaccactggcgtgaacagggtttcgccgtttcgatccatcactga

SEQ ID NO: 1500 - DNA, 378 bp, Enterobacter cloacae
ggtggacctatggaactgcattcagaaaccttcaatccggccgattttgcctggcgtggcttaacgctgacgcccgcggcggcggcgcatattcatgagctggtggcaaaaaatcccgacatcctcggcgtacgcttaggcgttaagcagactggctgcgcgggatttggctacgtgctggataccgtaaccgaacctgaaaaggacgatctggtctttgaaaccgacggtgcaaagttatacgtcgcactacaggcgatgccgtttatcgatggaaccgaagtcgactacgttcgggaaggtttaaaccagttattcaaatttcataacccgaaagcccagaacgaatgcggctgcggcgaaagctttggggtatag

SEQ ID NO: 1501 - DNA, 1317 bp, Enterobacter cloacae
aatccggtgactttacgctggttaaacaactggaggagcagggttatggctggcttaccgaacagcagtaatgcacttcagcagtggcaccggctgtttgaagcgcaggctggagcgcgctctgaacaggctcagcaccatctccagcagatgctgcgtctcggtttaccgacgcgtaaacatgagaactggaaatataccccgctggatggcctgctgaacggcgagtttgtcacccgtctggcgcaggtcagccccggtcagcgcgatgtgctggcgctgagtgtggatgccgtgcgtctggtgtttgtcgacgggcagtttcgtgaggaactcagcgacagcgtacaggagagcgggttcgatatcgtcattaacgatgaacgtcagtcgctgaacgcgcctgttcagcctgaagtcttcctgcacctgacagagagcctgtcacaatctgtcacccatattcgcgttaagcgtaaccagcgcccggcgaaaccgctgctgctgatgcatatcacccagggcgttgcgggtgatgagattaacaccgcccactatcgccaccatcttgagctggcagaaggggcggaggcgacggtgatcgagcattacgtcagccttaacgacacccgtcattttaccggttcgcgtctgacgatgaacgtggcggccaatgcccaactgcaccacatcaagctggcgtttgagaatccgctcagtcaccacttcgcccacaacgatattctgctgggccaggatgccgcggcgtacagccacagttttctgcttggcggcgcggtgctgcgccacaataccagcacccagctgaacggtgaaaacactacgttgcgtattaacagcctggcgatgccggtgaagtcagaagtgtgcgacacgcgcacctggcttgagcataacaaaggctactgcaacagccgtcagctgcacaaaaccatcgtcagcgacaaaggacgtgcggtgtttaacggcctgataaacgtggcgcagcacgccatcaaaactgacgggcagatgaccaacaataacctcttgctgggacgtctggcagaggtggacaccaaaccacagctggaaatctatgcggacgacgtgaaatgcagccacggcgcgacggtcgggcgtattgacgatgagcagatgttctacttgcgctcgcgcgggatagaccagcaggccgcgcaaaagatgattatttacgcctttgcggctgagctgacggaagcgctgcccgatggcggacttaaacagcaggtgctggcccgtatcggtcagcgactgcctggaggcgaagcatga

SEQ ID NO: 1502 - DNA, 1065 bp, Enterobacter cloacae
tcgccacatggggaagtcaatccagccagcaatgccgcgctgatttcacgctgccgaatcactcaatgtacggtgggatcgctgatatgcgcgccacctgccgtcaggaacgctaacatgaaatgtcttaactcgatgctgctgctctgtttgctcgcggcgggaagtatcgctcgtgccggtacctgcaccaccatcatcccgcagctttccaccctgtccgtggggacgatcaacgtgcagcgcgatgcgcctgtcggcacggtggtattttccggcgcggcgtcagccacaggctcctatcttaccgggtgtacgaatccgctgatgctgggattcagcatgcgctacaacagcgccacgttgagcagctacggcaaccatgtttacaacacgaacgtcatcgggatagggatacgcttttcctccaacggctattttgaaaacccgagcaatacgttctcgtacaatgcgcagacctcctatgtggactggtacggcgggaggattgagctggtggtgaccggcccggtctcatcgggggcattaaccccgggggtgattggcgtcgtgacgcttcagggaagcgacggcctctaccgtgacggtctgaccacgcagctcacctccggcaacatcaatgccctggcgtgcacggtgaatacggcccagctgacgtttccgataggggatattcccgcttcggcgttcggcaccgtggtgggcaccacgccagcgggagcacagaacacgcaaaacctgggcttaacctgcgccgccggaaccaatattacggtctcgctcagtggaatacagaatccggacagcgccaataccagcgtgatggccttaaccgggcagggaaatgccggcactgcaaaaggggtgggggtgcagctaatctataacggtgcaccgctggcgatgaacagccgactatttttgcgacagtctgccggggggcaagagacgttgccattaacggcccgatattaccagacgttaacccgcgtggagtcaggttcagcgaatgcctccgccaccctgaatttgacctaccagtag

SEQ ID NO: 1503 - DNA, 534 bp, Enterobacter cloacae
ggtaccggccatgtgccgcgcatcgctggtgatgtacaacacaacggaagaggtcgacagactggtggcgggattaaaacgtattcatcagctgcttggctaacggagaggcgagagatggcagatttgccggacagagataaattgctgcgcaactttgggcgttgcgcgaactgggaagagaaatacctttatatcatcgaactgggtcagcgcctgccgccgctcagcgaagaggcgcataacccggacaacatcattcagggctgccagagccaggtctggatccagatgcagcagacggatgatgtcgtaatcgatttacagggtgacagcgatgccgccattgtgaaggggcttattgccgtcgtatttattctttatcaccagatgtcggcgcaggatattgtcgcctttgacgttcgcccgtggtttgaaaaaatggccttaacccaacacctcaccccgtcccgatcccagggactggaagcgatgatccgcgccatacgcgccaaagccgcaatccttagctaa

SEQ ID NO: 1504 - DNA, 846 bp, Enterobacter cloacae
cccgaaagcccagaacgaatgcggctgcggcgaaagctttggggtataggcggtactatgtctcgtaatactgaagcaacgagtgatgtaaacacctggagcggcggacacctcaactataaagagggtttcttcacgcagctgcaaaccgatgaactggcgaaaggcatcaacgaagaggtcgtgcgagccatttcggcgaaacgtaacgagccggagtggatgctggagtttcgcctgagcgcattccgcgcgtggctggagatggaagaaccccactggctgaaagcgcattacgataagctgaactatcaggattatagctattactctgcgccctcctgcggcagctgtgatgatacatgcgcctcgcaacccggtgcggtacagcaaaccggtgccgagaacagcttcctgagtaaagaggtggaagaggcgttcaatcagctcggcgtgcccgtgcgcgaaggcaaagaggtggcggtagatgccatttttgactccgtctcggtggcaaccacctaccgtgaaaaactggcggagcaggggattattttctgctccttcggggaagccattcacgatcacccggagctggtgaaaaagtacattggcaccgtggtacccagtaacgataacttcttcgcggcactgaatgcggcggtggcgtcagacggtacctttatctacgtgccgaaaggcgtgcgctgcccgatggagctctcgacctatttccgcatcaacgcggaaaaaaccggccagtttgaacggcacatcctggtggccgatgaaagcagctacgttagctacatcgaagggtgctccgctcctgtgcgcgacagctaa

SEQ ID NO: 1505 - DNA, 702 bp, Enterobacter cloacae
cagctgcaacccggggtggtggaggtcatcatccataaagatgcggaagtgaagtactttacggtacagaactgttccccgggcgacgtaaacaccggcggtattctgaacttcgtcaccaagcgtgcgctgtgcgaaggcgaaaacagcaaaatgtcctggacgcagtcagaaaccggctccgccattacctggaaatacccgagctgtattctgcgcggcgacaactccatcggtgagttttactccgtggcgctgaccagcggtcatcagcaggccgataccggcaccaagatgatccacatcggtaaaaacaccaaatcgaccatcatctccaaagggatctctgccggtcacagccagaacagctatcgcgggctggtgaaaatcatgccgacggcaaccaacgcgcgtaacttcacccagtgtgactccatgctgattggcgcggactgcggggcgcataccttcccatatgtcgaatgccgcaataacagcgcccagcttgagcatgaggcaactacgtcacgtattggtgaagatcagcttttctactgcctgcaacgcgggatcagtgaagaagatgcgatttcaatgatcgttaacggcttctgtaaggacgtgttctctgaactgccgctggaatttgccgttgaagcccagaaactcctcgccattagtcttgaacacagcgtcggttaa

SEQ ID NO: 1506 - DNA, 756 bp, Enterobacter cloacae
ggaaagcacatgttaagcattaaagatttacaggttagcgtggaagagaaagagatcctgcgtggcctcaattttgacgtcaaaccgggtgaagttcacgccatcatggggccaaacggctccgggaaaagtacgctttcagcgacgctggcaggacgcgaagattatgaagttaccagcggctccgttgagtttaacggcaaagatctgctggagatgtcgccggaagagcgtgccggcgagggcatctttatggccttccagtatccggtggaaattccgggcgtcagcaaccagttctttctgcaaacagcgctgaacgcggtgcgcaagtatcgcggccttgaggcgctggatcgctttgacttccaggatctgatggaagagaagatcaagctgttgaaaatgccggaagatctgctgacccgctcggtaaacgtgggtttctccggcggtgagaagaaacgtaacgatattctgcaaatggcggttctggagccagcgctgtgcattctcgatgagaccgattcagggctggatatcgatgccctgaagatcgttgccgacggggtgaactccctgcgtgacggcaaccgctcatttatcatcgtgacacattaccagcgaattctggactacatcaaaccggactatgtccacgtgctttaccagggacgcattgtgaaatccggtgactttacgctggttaaacaactggaggagcagggttatggctggcttaccgaacagcagtaa

SEQ ID NO: 1507 - DNA, 1269 bp, Enterobacter cloacae
acagcaggtgctggcccgtatcggtcagcgactgcctggaggcgaagcatgacatttcccgtagagaaagtccgggcagattttccggtactgacccgtgaagtgaacggtctgccgctggcctatctcgacagtgcggccagcgcgcaaaaaccgaatcaggtggtggatgcggaagccgagttttaccgccacggttatgcggcggtacatcgtgggatccacaccctgagcgccgaggcgacccagcgcatggaaaacgtgcgcacgcaggttgcagccttcctcaacgcgcgttcgccggaagagctggtgttcgtgcgcggcaccaccgaagggatcaacctggtggctaacagctggggcaatgcgcaggtgcacgcgggggataacatcatcatcacccagatggagcaccatgccaacatcgtgccctggcagatgctctgcgagcgtgtgggggcgcaactgcgggtgatccccctgaatgaagacggcacgctccagctggaaaagctggacgctctgctggacgacagaacgcggctggtggcggtgacccacgtttcaaacgtgctgggcacggaaaatccggtggcgctgatcgtcgacaaagcccatcaggccggtgcgaaagtgttgattgatggtgcccaggcggtgatgcaccatgcggttgacgttcaggctctggactgcgatttctacgtcttctccgggcacaagctgtatggcccgacgggcatcggcgtgttgtatgtgaaagaggacattctccaggccatgccgccgtgggaagggggcgggtccatgatcgccaccgtcagcctgacggaaggcacaacctacgcccgtgcgccctggcgcttcgaggcgggtacgcccaacacgggcgggatcatcgggctgggcgcggccattagctacgtctctgaaacggggctggcggcgattcaggagtacgaacagctgctgatgcattatgccttgcaggagctggccagcgtcccggaactgaccttatatggccctgctgaccgtctgggggtgatagccttcaacctcggcaagcatcacgcctatgatgtgggcagtttccttgataattacggcgtcgctgtgcgtaccgggcatcactgcgcgatgccgctgatggcgtattatgaggtaccggccatgtgccgcgcatcgctggtgatgtacaacacaacggaagaggtcgacagactggtggcgggattaaaacgtattcatcagctgcttggctaa

SEQ ID NO: 1508 - DNA, 609 bp, Enterobacter cloacae
ataaggaatctcagcatgaagcgcgcgtctctaataactctattactccttggttcgctcagtgctgttaattcagccagggcggttgattatcctttaccgcccgcaggcagccgcctgattgggcaaaaccagacatacaccattcaggaaggggacaataaacttcagtctatcgctcgtcggtttaataccgccgcacagctcatccttgaaaccaataataccattgcaccggtgaatcctgcgccaggaacggtcattacgatcccttcccagatgctactgccggacaccgagcgtgagggcattgtggtgaatctggcggagctgcgtctttacttctatccgcctggcgaaaatatcgtgcaggtctatccgctgggtattggtcagcttgggctggaaacaccggtcagcaccacccgtgtgagtcagaaaatccctaaccatacctggacccccacagcgggcatcagagcgcgctcactggcccagggaattaaactgccgcatgtggtacccgcagggccaaataacccgctggggcgctttgcgcttcgtctggggatcgggaatggggaatattcagcagacgggccaaaatag

SEQ ID NO: 1509 - DNA, 495 bp, Enterobacter cloacae
gaggagggcagtatggcaaacgactggcttgagctgcgtcagcatgcagaaacaggtattgagacaattaaggcgcatttcgaaggacatgcctttgatccccactggcatgatagctatctggtcggaataaccctttccggtacgcagcagttccactgtcgccgtgaacgccaccgtagccagccgggcgatgcttttttacttgagcccggggagatccatgacggtgatgcgccggtagagggcggctttacttatctgaccttttatctggatgaacactggctcacccatacgcttcaaggcctgtatgactctactcccgggagttacactctccactttgcccaaacgctgacgcgagagcctcagttggtgcgcgctatcggtgatacatttgcctcgttgcataacgatgagatgaagatcgtccaacagagcacaatggataacctgctctctcagataactacccactgtcactggcgttag

SEQ ID NO: 1510 - DNA, 990 bp, Enterobacter cloacae
  unsure (91)
  unsure (124)
aaactcacgtcgcaattacaaagctccgctgtggcgcatcgtgcccgcgactatctctatgcgcatatcggcgagaacgtggggctatcanaacttgcccgcgagacgggtacggatcgctttnacctcacccgctgttttaaacgcgaattcacctgggcacgcacgcctggcttatccagctgcgactggcaaaggcccgacagatgctggcgtgtggggaactgcctgttgatgttgcgacggcagtgggttttgccgatcaaagccatcttggtcgctggttccagcgtgcataccgtatttctccggcacactaccgccggttgtgcacaaaccttccagacgtttccagaaaataacggcacattcgtggctctaataaaaaaggagtcacctgtgaatttattacccttcctgctgtttgcatttgtcgcctcgattacaccggggccaaccaacattctggtactggctaacagtcagcactttggcgtaaaaaatacggttcctgcgatcctgggcgggtgtattgccgccagcgctattgttctggtttcaggcgctggggcaggagaagtgttacgccagtatccattgatacgtcaggtaatgagctgggcgggtgtgctgtggctttcctggatgagctggcagctgtttagcgccccggccgcgaatctctcctccagcagtcacgtccgatttaccgcgcgggcggcggcgttactacaggttgtaaacccaaaaacatggatgatggcgctggcagttgtcagcctgtttgctccggcaagcgaccatgcattacgggatattacgctgatggcgctatggtttctggcgatctccgtggtctgtttgttgtgctgggcgtggctggggaaggcggtgaaccggattttccgcaccaccgtggcgatggtgcgatttcagcgcgcgatggcgctgtgtttgtttatttccgcctggatgggaatgctggcttag

SEQ ID NO: 1511 - DNA, 810 bp, Enterobacter cloacae
ggtagcttcaatcaggtcttccgcaggcacaaccggcaggttggacacttcagccagcttctgtaccgccagttgctgatagccatctggcgtgttcaggcgtgtaccgatggcggttgcgcccaggttcacttccagcagcagttcggacgtacgcagcaggtttttcgtctcttcgttcagcagcacgttaaacgcgtggaattcctgtccgagggtcattggcaccgcgtcctgcaactgggtacggcccattttcagaatgtcctggaactcaacggctttacgctggaagccatcgcccaactgattaatcgcgtcgaccagtttaacgacagaggcatacaccgcgatgcggaagccggttgggtaggcgtcgttggtggactgacatttgttaacgtggtcgttcgggttcaggtactggtattcacctttctgatgacccatcagctccaggccgatgtttgccagcacttcgttggtgttcatgttgacagaggtgcccgcgccgccctgatagacgtcgaccgggaactgatccatgcatttgccgttgttcagcacctcatcgcacgcggcgataatcgcatttgcagcgcttttaggaatggtttgcaactctttgtttgccagagccgcggctttttttaccatcaccatgccacgcacaaattcagggatgtcgctgattttgctgttgctgatgtagaagttttcaatcgctctcagagtgtgaacaccatagtaggcatccgctggaacttccctggtacccaacaaatcttcttcgatacgaatgttgtttaa

SEQ ID NO: 1512 - DNA, 537 bp, Enterobacter cloacae
aaacgatcgggggctaaaacacgatatcccaaaggttattatcagaattcatttaagatgtcggaggagtgccagcggaatctggctcgcagaaatgctcagcatttttcttttggtcatctttttagtataaggtttacacgcggacaactactgtccagcttattgaaaacgaggaataacatgcgcataaaagtctgtgcagggattgtaggtgcagcattgctgctggcgggttgtagcaccagcaatgagctgacggcagcgggccagagcgttcgctttgtggaagataagccgggcagcgaatgccagctgttaggcaccgccactggcgagcaaagcaactggatgtcggggcagcacggcgaagagggcggctctatgcgcggtgcggccaatgccctgcgtaatcaggctgcggcaatgggcggcaacgtgatttacggggtgagcagcccgacgcaggggatgctgtccagctttgtgccaaccgccagccagatgaacggccaggtctataagtgcccgaactga

SEQ ID NO: 1513 - DNA, 843 bp, Enterobacter cloacae
gaggtaagcgtttgttttaataacggatcatcaggattgcccttttccattcgggcaacaaacgcgcggggaacgcgcagggcgaaaaggcgtttcgcctcacgacctgcacgcaacgcttcgtgctgttcgaggtctaaaagacgcagcaattcatcaggactggtgattacatcggcaagttgcgataaccaatcttctctggacggggtgtttagggttacaatatgcgccattttgtggcttagctaccagttaacaaatttagagggccttatggcaacgtactatagcaacgattttcgtgctggtcttaaaatcatgatggacggcgaaccgtacgcggttgaagccagcgaattcgttaaaccaggtaaaggccaggcattcgcacgcgtaaagctgcgccgcctgctgaccggtacccgtgttgagaaaaccttcaaatctactgactccgctgaaggcgctgatgttgtcgatatgaacctgacttacctgtacaacgacggtgagttctggcacttcatgaacaacgaaaccttcgagcagctgtctgcggacgcaaaagcgattggtgacaacgccaagtggctgctggatcaggctgagtgcatcgtgaccctgtggaacggtcagcctatcgcggttacgcctccgaacttcgttgagctggaaatcgttgaaaccgatccaggtctgaaaggtgataccgcaggtactggcggcaagcctgccactctgtctaccggcgctgtggtgaaagtgccactgttcgtacagatcggtgaagtgatcaaagtggatacccgctccggcgaatacgtatcccgcgtgaagtaa

SEQ ID NO: 1514 - DNA, 1221 bp, Enterobacter cloacae
gccggtgtcatccatctcaactgcggccagcagggttgggtaggttggcagcacgaacagggcggaaaccgctgcaaaagaggcaatcgccgtcagcggcgtcacgcccagcatcagtgccgcaggcatcagcgctttggtggtcgcagcctgggagtacagcagcgtcgcggcaaagaacagcactactgccagcagccacggatagttgtgcagcaggtcgcctgcaacggtctggatatcgctgatgtgcgctttcacaaaggtatcaccgagccacgccacgcccagcacgcacacgcaggcgctcataccggatttgaaggtgctggcgttcagcacttcgctggtgtcgattttacaggtgatgctgatcagcgtcgcgatggtcagcataaacaccacaatggcttcgttacgcggcagaaccgggttctggatcagacctaccgtgtcgctgatggcggtcgcgtagaacatcacggcgacgataccaatcagaaacagcagcacggagcgttttgcatgcggcttcagctcgaagacctggctaccgcgcaggctcacttcaccttttgccagacgctcctggtaaaccggatcgtctttcagctcggcaccgaggaagttacacagcacggcagtgatcattaccgcaatcaacgtgaccggaatacagattgccagcagcgtcaggtaacttacgcccattggctcaaggatgcccgcgaagaagaccaccgccgcggaaataggcgaggcggtaatcgcaatctgggaggcgaccacggcaatagaaagagggcgagacgggcgaataccctgctctttcgccacttcggtgatgaccggcagcgtggagaaggcagtatggccagtaccggcgagaatggtcataaaccaggtcaccagcggggcaaggaaggtgatgtatttcggatggcgacgcagcatacgctccgccaggctcaccaggtagtccataccgccagcgacctgcatggccgcgatagcagcaataaccgccatgatgatttcgataacgtcaaaagggattgcgccgggtttaatctgaaagatcagggtaagtacaagcactccgagaccgccagcaaaaccgatgccgattcccccgagtcgtgcgcccaaataaatcgccaacaggacgatgacgagttctgctccaaacataaagacctgccttgctcattaacaagttga

SEQ ID NO: 1515 - DNA, 555 bp, Enterobacter cloacae
aatttggctaaccgtcgccatctcttatctacgcgcttcgcgaacacattcagtcagggccagaaggcacctgccatacaggagatgccagtgcgctggataccatttattgctttctttctttatgtttacattgaaatttcgattttcatccaggttgcccatgtgctgggcgtcctgctgacgctgattctggtgatcttcacctccgtcatcggcatgtcgctggtgcgcaatcagggtttcaaaaatttcctgttaatgcagcagaagatggccgcaggcgaaagcccggccgccgagatgatcaaaagcgtgtcgctgattattgctggtttgctgctgatcctgccgggcttctttacagacttcctcggcctgctgttgctgttgccgccggtgcagaagcacctgaccatgaagctgctgccgcatctgcgtttcagccgtatgccaggcggtggtttcagcaccggcccgggggatacctttgaaggggaataccagcgtaaggatgagcagcgcgaccggttagatcataaagacgatcggtga

SEQ ID NO: 1516 - DNA, 390 bp, Enterobacter cloacae
aaagctatccccatctctcagggcactagccggaaaaccgcatgcgggccggcgtcatccataactgataatgactttctcaaaggagagctatcaatgagtattcgtccgttacatgatcgtgtgatcgtcaaacgtaaagaagttgaaaccaagtctgctggcggcatcgttctgaccggttcagcagcagcaaaatcaacgcgtggcgaaatcatcgctgtcggtaagggccgcatcctggaaaacggaactgtgcagccactggacgttaaagttggtgacatcgtcattttcaacgatggctacggcgtgaaatccgagaagatcgacaatgaagaagtgttgatcatgtccgagagcgacattctggcaattgttgaagcgtaa

SEQ ID NO: 1517 - DNA, 219 bp, Enterobacter cloacae
acgcgaattcacctgggcacgcacgcctggcttatccagctgcgactggcaaaggcccgacagatgctggcgtgtggggaactgcctgttgatgttgcgacggcagtgggttttgccgatcaaagccatcttggtcgctggttccagcgtgcataccgtatttctccggcacactaccgccggttgtgcacaaaccttccagacgtttccagaaaataa

SEQ ID NO: 1518 - DNA, 1659 bp, Enterobacter cloacae
  unsure (1141)
ggaaataagaacatggcagctaaagacgtaaaattcggtaacgacgctcgtgtaaaaatgctccgcggcgtaaacgtactggcagacgcagtgaaagtcactctcggcccgaaaggccgtaacgtagtgctggacaaatccttcggcgcgccaaccatcaccaaagatggtgtttctgttgcacgtgaaatcgagctggaagacaagttcgaaaacatgggcgcacagatggtgaaagaagttgcctctaaagcgaacgacgctgccggtgacggtaccaccaccgcgaccgtactggcgcaggcgatcatcaccgaaggcctgaaagccgttgctgcgggcatgaacccaatggatctgaaacgtggtatcgacaaagccgtcgcttccgctgttgaagaactgaaagcgctgtccgtaccgtgctctgactctaaagccattgctcaggttggtactatctccgctaactccgacgaaaccgtaggtaaactgatcgctgaagcgatggataaagtcggtaaagaaggcgtgatcaccgttgaagacggtactggtctggaagacgaactggacgtggttgaaggtatgcagttcgaccgcggttacctgtccccatacttcatcaacaagccagaaactggcgctgttgagctggaaagcccgttcatcctgctggctgacaagaaaatctccaacatccgcgaaatgctgccagtgctggaagctgtcgcgaaagcaggcaagccgctggtaatcattgctgaagacgttgaaggcgaagcgctggcgaccctggtggttaacaccatgcgtggcatcgtgaaagtggcagcggttaaagcacctggtttcggcgatcgtcgtaaggcgatgctccaggatatcgctaccctgaccggcggtaccgtgatctccgaagagatcggtatggagctggaaaaagcgactctggaagacctgggccaggcgaaacgcgttgtgatcaacaaagacaccaccaccatcatcgacggtgtgggtgaagaagccgctattcagggccgtgttggtcagatccgtaagcagatcgaagaagcaacttccgattacgaccgtgaaaaactccaggagcgcgtagcgaaactggcaggtggcgtancggtaatcaaagtcggtgcggctaccgaagttgaaatgaaagagaagaaagcacgcgttgacgacgccctgcacgcgacccgtgctgcggtagaagaaggcgtggttgctggtggtggtgtcgcgctggtgcgtgtagccgctaaactggctggcctgactgctcagaacgaagaccagaacgtgggtatcaaagttgcgctgcgcgcaatggaagctccgctgcgtcagatcgtgtccaacgccggtgaagagccgtctgtggttgcgaacaaggtgaaagcgggtgaaggtaactacggttacaacgcggcaactgaagaatacggcaacatgatcgacttcggtatcctggatccaactaaagtgacccgttctgctctgcaatacgcggcatctgtagctggcctgatgatcacgaccgagtgcatggtgaccgacctgcctaaaggcgacgcgcctgacttaggtgctgctggtggtatgggcggcatgggtggcatgggcggcatgatgtaa

SEQ ID NO: 1519 - DNA, 333 bp, Enterobacter cloacae
gttaaggagcctgatatgtcctggatcgttcttgttattgccggtttgctcgaagtggtatgggcaattggcctgaaatatacccatggttttacccgcctgacgcccagcgtcatcactatcgccgcaatgattgtcagtatcgtcatgttgtcatgggcgatgcgaagcttgccagtcggaacggcttacgctgtctggacgggaattggcgcggtaggggctgccattaccggtattctgctgctgggggagtctgcgagcctggcgcgcatcgccagcctcgcgttaatcgtcgcgggtatcatcgggttaaaactcagtacccactaa

SEQ ID NO: 1520 - DNA, 1248 bp, Enterobacter cloacae
  unsure (217)
atgagtggactcaggcaggagttggggctggcgcagggcattggcttactctcaacgtctttgttaggcacgggggtatttgcggttcccgcgctggcggcgttggttgccggcaataacagtctttgggcatggccggtgctgatcgtgctggtgtttccggtggcgattgtctttgccatactcgggcggcacttcccgagcgcaggcggcgtancgcattttgtcggcatggcgtttgggccgcggatggagcgtgtcaccggctggctatttttgtcggtgatacccgttggccttccggcagccctgcatatcgcaaccggcttcggacaggcgctgtttggctggcacgatgaacaactgctgctggctgaaatcggtacgctggcgattgtctggtgggttggctcgcgaggggccagttccagcgccaatctgcaaacgctggtcgccgtgttaattgtcgcgctgatcgtcgccatctggtttgcgggtgacattacggtggcggatatccctttccccgcgattaacgacatcgaccacgcacagcttttcgctgcactatccgtcatgttctggtgtttcgtcggtctggaggcgttcgctcatctggcatccgagtttaaacagcccgagcgtgactttccccgcgctctgatgattggcctgctgctggcgggcaccgtgtactgggcctgtaccgtactggtgctgcacttcaacgcgttcagtgaagaaaaagccgccgccgcgtcgctgccgggcatcgtggtgcagctgtttggtgttaaagccctgtgggtagcctgcgtgattggctatctcgcctgctttgccagcctcaacatttatattcagaacttcgcccggctggtgtggtctcaggcactttataaaccggatagccccctctcacgcctgtcaaagcgtcagcttccggtgaatgcgctgaataccgtactgggctgctgcgtggtgaattccctggccatttatctcctcgacatcaaccttgacgcgctgattgtctacgccaacggtattttcatcatgatctacctgctgtgcatgctggcgggctgtcggctactgaaaggacgttttaaggcgctggcggctgtcgggtgtgtcctgtgcctgatgctgctggcgatggtgggatggaagagtgtgtacgccatcgtcatgctggcggggctgtgggtgtttttaccgaagcggcaagctccgcaggcccggtga

SEQ ID NO: 1521 - DNA, 1518 bp, Enterobacter cloacae
tcgtcggtcataaaatattcaaaaccacatatatactgtgtgtttagtacaatccatcggcagcttgaaaagaaggttcacatgttaaacaacattcgtatcgaagaagatttgttgggtaccagggaagttccagcggatgcctactatggtgttcacactctgagagcgattgaaaacttctacatcagcaacagcaaaatcagcgacatccctgaatttgtgcgtggcatggtgatggtaaaaaaagccgcggctctggcaaacaaagagttgcaaaccattcctaaaagcgctgcaaatgcgattatcgccgcgtgcgatgaggtgctgaacaacggcaaatgcatggatcagttcccggtcgacgtctatcagggcggcgcgggcacctctgtcaacatgaacaccaacgaagtgctggcaaacatcggcctggagctgatgggtcatcagaaaggtgaataccagtacctgaacccgaacgaccacgttaacaaatgtcagtccaccaacgacgcctacccaaccggcttccgcatcgcggtgtatgcctctgtcgttaaactggtcgacgcgattaatcagttgggcgatggcttccagcgtaaagccgttgagttccaggacattctgaaaatgggccgtacccagttgcaggacgcggtgccaatgaccctcggacaggaattccacgcgtttaacgtgctgctgaacgaagagacgaaaaacctgctgcgtacgtccgaactgctgctggaagtgaacctgggcgcaaccgccatcggtacacgcctgaacacgccagatggctatcagcaactggcggtacagaagctggctgaagtgtccaacctgccggttgtgcctgcggaagacctgattgaagctacctcagactgcggcgcctacgtgatggtgcacagcgccctgaaacgtctggcggtgaaactgtccaaaatctgtaacgacctgcgcctgctctcctccggtccgcgcgctggcctgaatgaaatcaacctgccagagttgcaggcgggttcatccatcatgccagctaaagtgaacccggtggtgccagaagtggtgaaccaggtttgcttcaaggttattggtaacgatacgaccgtcaccatggcctccgaagccggtcagctccagctgaacgtgatggagccagtgattggccaggcgatgtttgaatctatacatattctgaccaacgcctgctacaacctgctggaaaaatgcattaacggcatcaccgcgaataaagaagtgtgtgaaggctacgtctataactccatcggcatcgtcacctacctcaaccccttcatcggccaccacaacggcgatatcgtcgggaagatttgtgccgaaaccggtaagagcgtacgtgaggtggttctcgagcgaggattgttgaccgaagccgaactggacgatatcttctccgcccagaacctgatgcacccggcatataaagcgaaacgatataccgatgaaagcgaacagtaa

SEQ ID NO: 1522 - DNA, 1722 bp, Enterobacter cloacae
cgattatctctcatggctcaacgcttcattacgctgatcctgctgctgtgcagcacgtcagtttttgccgggttgtttgacgcacccggccgttcgaactttattcctgccgaccaggcattcgttttcgactttcagcaaaaccagcacgatctcagtctcacctggcaggtgaaagagggttactacctctatcgcaagcaggtcagcatcacgccgacaaaggcgaacgtcggcgcattgcagatgcccgctggcgtgtggcacgaggacgagttctacggtaagagtgaaatttatcgccagcgcttaagcgtgcccgtcacggtgaaccatgccgataaaggtgccacattaacggtcacctatcagggctgcgcagacgccggattctgttacccacctgaaacaaaggtcgttccgcttagcgaagtgaaaggcgctgcctcccctctcccatcaggggagagggccaggatgaagggtgaaggcgcaggcgaagccacttcagaccttccgttctcagcactttgggcgttattgattggtatcggcatcgcctttacgccctgcgtactgcctatgtacccgcttatctctggcatcgtgctgggcggtaaacaacgcctttccaccgcccgtgcgctgttgctggcctttatctatgtacagggcatggcgttaacctatacggcgctcggcctcgtggtcgccgctgccgggttgcagttccaggccgcccttcagcatccttatgtgcttatcggactgtcagcggtgtttattctgctggcgctgtcgatgtttggcctgttcaccctgcaactgccctcttccctgcaaacccgtctgacgctgatgagcaaccgtcagcagggtggctctgcgggcggcgtgttcgccatgggtgccatcgccgggctgatttgctccccctgcaccactgcgccgctgagcgccattctgttatacattgctcagagcggcaacctgtggctcggcggcggcacgctgtacctctacgcgctcggcatgggcctgccgctgatcctggtgacggtgtttggcaatcgtctgctgccgaaaagcggcccgtggatggagacggtgaaaaccgcgtttggttttgtcattctggcgctgccggtatttctgctggagcgcatcatcggtgatgtgtggggtacacgtctttgggcgatgctcggcgtggccttcttcagctgggcgtttatcgtgagtctgggggcgaagaaaccgtggatgcgcctgctacagatccttctgctggcggccgcgctggtgagcgtccgtccgctacaggactgggcgtttggcaccccggcaggtcaaacgcaggctcatctgaattttatacagattaaaaacgtagatgaccttaaccacgccctggcgcaggcgaaaggcaaaccggtcatgctcgatctctatgccgactggtgcgtggcctgcaaagagtttgaaaaatacaccttcagcgatccgcaggtacaacatgcgctgagcgataccgttctgctccaggcgaacgttaccgccaacagcacgcaggataaggctctgctgaagcaacttaaagtgctcgggttgcctaccatcctgttcttcaatgaacagggggaagaacagccgacgcagcgtgtaaccgggtttatggacgcgacggcattcaacgcgcatttgcgcaatcgccaaccgtaa

SEQ ID NO: 1523 - DNA, 1041 bp, Enterobacter cloacae
ctaagccacaaaatggcgcatattgtaaccctaaacaccccgtccagagaagattggttatcgcaacttgccgatgtaatcaccagtcctgatgaattgctgcgtcttttagacctcgaacagcacgaagcgttgcgtgcaggtcgtgaggcgaaacgccttttcgccctgcgcgttccccgcgcgtttgttgcccgaatggaaaagggcaatcctgatgatccgttattaaaacaaacgcttacctctcaggatgagtttattaccgcccccggctacagcaccgatccgctgcaagagcagaacagtgtcgtaccgggtttgctgcataaataccgcaatcgtgccctgctgctggttaagggcggttgcgcggtaaattgccgctattgcttccgtcgccacttcccgtacgccgaaaaccagggcaataagcgcaactggcaggtggcgctggactacatcacggcgcacccggaactggatgaaatcatcttttccggcggcgacccgctgatggcaaaagatcatgagctggactggctgctgactcagcttgagaccatcccgcacattaagcgtctgcgcattcacagccgtttaccgatcgtcatcccggcgcgtatcaccgacgccctggtcacgcgcctggagcagtcccgtttgcaggtgctgctggtaaaccatatcaaccacgcgaatgaaattgacgcggactttcgtgaggcaatggcgcgtatgcgaaaggcaggcgtgacgctgctcaaccagagcgtattactgcgcggcgtgaacgacagcgcccgcgtgctggccgatctcagcaatgccttatttgatgcgggcgttatgccctattacctgcatgttctggatcgcgtccagggcgcggcgcacttcatggtgacagatgaagaggcccggaagattatgcgcgagctgttaacgctggtttcaggttatatggtgccgaagctggcacgtgagattggcggagagccgagtaagacgccgctggatttgcagctgcgtcagcagtaa

SEQ ID NO: 1524 - DNA, 627 bp, Enterobacter cloacae
cgccattattaccaactatttttcttccggcgctgcactctttacctttattaccgtcccggtaatcacgccgcttgccgtcattctggtgttcaaatttgttggcgcgaactttctgcgactgtggatcgcccacatggaagttcgctgcgctcaggaggaaaaatgatcgcccagtcgcgtaaaaatatcatggacttgtttatcgatggcgcccgccgcggctttaccatcgccaccaccagcctgctgccgaacgtggtcatggcgtttgttatcattcaggcgctcaaggtaaccggcctgctggatattgtcggcagggtatgcgagcccatcatggctctgtggggacttccgggtgcggcggcaacggttcttctggcctcggtgatgagcatggggggcggtgtgggggtctgcgccagtctggtcgctgccggcacgctcaacggtcacgatgccaccatcctgctgcccgccatctatctgatgggtaatccggtgcaaaacacgggccgttgccttggcaccgcaggcgtcaacccgaagtattatccgcacatcatcgctgtctgcgtcattaacgccctgctctcaatgtgggtgatgcaactactcttctga

SEQ ID NO: 1525 - DNA, 1674 bp, Enterobacter cloacae
  unsure (465)
gtcaggcgcgtcgcctttaggcaggtcggtcaccatgcactcggtcgtgatcatcaggccagctacagatgccgcgtattgcagagcagaacgggtcactttagttggatccaggataccgaagtcgatcatgttgccgtattcttcagttgccgcgttgtaaccgtagttaccttcacccgctttcaccttgttcgcaaccacagacggctcttcaccggcgttggacacgatctgacgcagcggagcttccattgcgcgcagcgcaactttgatacccacgttctggtcttcgttctgagcagtcaggccagccagtttagcggctacacgcaccagcgcgacaccaccaccagcaaccacgccttcttctaccgcagcacgggtcgcgtgcagggcgtcgtcaacgcgtgctttcttctctttcatttcaacttcggtagccgcaccgactttgattaccgntacgccacctgccagtttcgctacgcgctcctggagtttttcacggtcgtaatcggaagttgcttcttcgatctgcttacggatctgaccaacacggccctgaatagcggcttcttcacccacaccgtcgatgatggtggtggtgtctttgttgatcacaacgcgtttcgcctggcccaggtcttccagagtcgctttttccagctccataccgatctcttcggagatcacggtaccgccggtcagggtagcgatatcctggagcatcgccttacgacgatcgccgaaaccaggtgctttaaccgctgccactttcacgatgccacgcatggtgttaaccaccagggtcgccagcgcttcgccttcaacgtcttcagcaatgattaccagcggcttgcctgctttcgcgacagcttccagcactggcagcatttcgcggatgttggagattttcttgtcagccagcaggatgaacgggctttccagctcaacagcgccagtttctggcttgttgatgaagtatggggacaggtaaccgcggtcgaactgcataccttcaaccacgtccagttcgtcttccagaccagtaccgtcttcaacggtgatcacgccttctttaccgactttatccatcgcttcagcgatcagtttacctacggtttcgtcggagttagcggagatagtaccaacctgagcaatggctttagagtcagagcacggtacggacagcgctttcagttcttcaacagcggaagcgacggctttgtcgataccacgtttcagatccattgggttcatgcccgcagcaacggctttcaggccttcggtgatgatcgcctgcgccagtacggtcgcggtggtggtaccgtcaccggcagcgtcgttcgctttagaggcaacttctttcaccatctgtgcgcccatgttttcgaacttgtcttccagctcgatttcacgtgcaacagaaacaccatctttggtgatggttggcgcgccgaaggatttgtccagcactacgttacggcctttcgggccgagagtgactttcactgcgtctgccagtacgtttacgccgcggagcatttttacacgagcgtcgttaccgaattttacgtctttagctgccatgttcttatttcctcaaattcgtacagttttcgtgcgttaattacgcttcaacaattgccagaatgtcgctctcggacatga

SEQ ID NO: 1526 - DNA, 336 bp, Enterobacter cloacae
ggaggtcgacttgtgaacacgcctgatgctgttgttgtactgtgcaccgcccctgatgaagcttctgcccaggatctggccgccaaagtgctggccgaaaaactggctgcctgtgtcacgcttcttcccggcgccacctccctttattactgggaaggcaagctggagcaagagtacgaagtccagatgttgctcaaaaccaacctgacaaaccagcaggcgctcctcgactgcctcaagtctcatcatccataccaaaccccggagctgctggtgctgccagtggtccacggcgataacgattatctctcatggctcaacgcttcattacgctga

SEQ ID NO: 1527 - DNA, 681 bp, Enterobacter cloacae
ccgggtttatggacgcgacggcattcaacgcgcatttgcgcaatcgccaaccgtaaaccacactttagacgggacaaaccgttgggaatagcggaggagataaccgtgcaacgcgaagacgtactgggacaagccctgcaattgcttgagattcaagggatcgccagcaccacgcttgagatggtcgccgaccgtatcgattaccctctggatgaacttaggcgcttctggccggataaagaggcgctgctgtacgatgccctgcgctatctcagccagcaggtggatatctggcgcaggcagctgatgctgaatgaagaactgaccaccgagcaaaagctgctggcgcgctataccgcactgacggagtgtgttaccaacaaccgttacccaggttgtctgtttatcgccgcctgcacctactatccggatcctgggcaccccatccatcaactggcagatcagcaaaaacgagccgcgcacgagttcacacatgagctgctgaccacactagaagtggatgatccggcaatggtcgcgaagcagatggagctggtgctggaaggttgcctgagccgcatgctggtgaaccgtagccaggcggatgtggatacggcgcaccgtctggcggaagatattttgcggttcgcgcagtgtcgtatgggtggtgcactgacctaa

SEQ ID NO: 1528 - DNA, 966 bp, Enterobacter cloacae
  unsure (277)
  unsure (278)
  unsure (281)
  unsure (282)
  unsure (284)
  unsure (285)
  unsure (286)
  unsure (287)
  unsure (288)
  unsure (291)
  unsure (292)
  unsure (294)
  unsure (295)
  unsure (296)
  unsure (297)
  unsure (298)
  unsure (299)
  unsure (300)
  unsure (301)
  unsure (302)
  unsure (303)
  unsure (304)
  unsure (305)
  unsure (306)
  unsure (307)
  unsure (308)
  unsure (309)
  unsure (310)
  unsure (313)
  unsure (314)
  unsure (316)
  unsure (317)
  unsure (318)
  unsure (319)
  unsure (320)
  unsure (321)
  unsure (322)
  unsure (323)
  unsure (324)
  unsure (325)
  unsure (326)
  unsure (327)
  unsure (328)
  unsure (329)
  unsure (331)
  unsure (332)
  unsure (333)
  unsure (334)
  unsure (335)
  unsure (337)
  unsure (338)
  unsure (339)
  unsure (340)
  unsure (341)
  unsure (342)
  unsure (343)
  unsure (344)
  unsure (345)
  unsure (346)
  unsure (347)
  unsure (348)
  unsure (349)
  unsure (350)
  unsure (351)
  unsure (352)
  unsure (353)
  unsure (354)
gagagggaggaagaaaaaaagaaaagggggaagagggggaagaaaaaggagggggggaaaaaaagggaaaaagggggaaagaaaaaggagaggaaggaaggaaaaggggaggaaggagagggggggaaaggaggagggaaaagaggaaggagggggggaaaaaagggagaaaagaaaaaggagaaagaggggaaaagggaggagaaggggagagagaaaaagggaagggggaaggaaggggaagaggggaaggggggagaagggggaaaaaaaaaannggnnannnnnggnngnnnnnnnnnnnnnnnnnaanngnnnnnnnnnnnnnnannnnngnnnnnnnnnnnnnnnnnnacccggcaaaacaccctacacaatctcccgcattttccctgctgtcatctacacttaacaaaaaacagtaaggaaactcctatgcgcattctgcctgttattgccgcagtaacagccgcgtttttagtggttgcttgcagttcccctactcctccgcctggcgtcacggtagtcagtaatttcgacgcacagcgcttcctcggcacctggtatgaaatcgcccgaatggaccatcagttcgaacggggcttagaaaaagtcacggttaactacagcgcgatggatgacggcgggatccgggtcattaaccgcggctataacccggatcgccagatgtggcagcagtcagttggtcaggcctatttcaccggcgcgtctaatcgcgcggccatgaaagtctctttcatcggcccattctacggcgggtataacgtcattgcgctggacagagagtaccgccatgcgctggtgtgtgggccggatcgcaactatctgtggatcctctcccgcacgccaacgatcccggcggaaatgaaacagcagatgctggacatagcgacccggcaagggtttgacgtgacgaaattactctgggtaaaacagccgcattag

SEQ ID NO: 1529 - DNA, 639 bp, Enterobacter cloacae
tggcaggaagccaaaccactagccgactgcgaaaattttatgtttaaaattcttttgattgaccgttgtcacttcacccgcacgggatttgaagcctgggtcaatcattcagacctgttttcgggtcatttcgtcgtaaccggggtaaataatcttttcctcgccagagagcatatcctgcaatggaaacctgcgctggtcatcgctgatttatctggcttccggcaggatttacaccattttcagcagctatcctccctgctgattgccagcgaaacattgccttttattatgctgcaatcaggccaggagcaagagatgacagattatctggcgcagttcccgatatggtcttctctttccaaaaataccgatctggaaaaactagcggcggtgataaatgacgcgctaacgtcatgcgcaagcgcggagcttccggagatggcggcaccgttactgacgcgtcaggaagagagagttcttagcctgtggatggatggcgcgagcaaccagaaaattgccagcaatctgcgcattaacggaaaaacggtgtacacgtacaaacgcaatatccgcatgaagctacatatggatacgcgctactccccgtttttatcgctacaggaagtggagaattga

SEQ ID NO: 1530 - DNA, 711 bp, Enterobacter cloacae
cccccgatcgtttttagtgatgcgacgtacaacttttgtacgcgactcaaaaaagggggtttcatgagtgcatcatcctcaggagaggaaaaagtaacctgggtgggctatctggcgttcgtgctcaccatcgtatttttctcaggttttttcgccaaaagtaccgaatggtggcgcgtgctggattttaccgtcctgaacggtagctttggaccggtgaacggtgcgctgacgtttcgcggcgagggcggcacgggagcgaaagatgggtttttgtttgcccttgaactggcgccctcggtcattttatcgctcgggatcattgccgttaccgaggggctgggcgggctgcgcgccgcacaacagcttatgacgcccattctgcgcccgctgctcggcgtgccgggcatttgctctctggcgcttatcgccaacctgcaaaatactgatgctgccgcagggatgaccaaagagttgaccaacgaaggggcgattactgaccatgagcgcgccattttcgccaccttccagaccagcggtagcgccattattaccaactatttttcttccggcgctgcactctttacctttattaccgtcccggtaatcacgccgcttgccgtcattctggtgttcaaatttgttggcgcgaactttctgcgactgtggatcgcccacatggaagttcgctgcgctcaggaggaaaaatga

SEQ ID NO: 1531 - DNA, 1191 bp, Enterobacter cloacae
tgcaactactcttctgaggagataaaaatggatttttcagtgctggaaccgcaccttttccgcaatgcgcagctttacgctcccgaggatcttgggcattgcgatctgctgattgccggaggaaaaatcgtcgcagtcgaaaaagctggccacgccacaatgaggccagactgtcctgaaagcgatctcgccggagcggtggtttgcccggggtttatcgatcagcatgtacacctgattggcggcggcggtgaagccggtccccacacccggacgccagaggtacgattgtctgcgctggtggcggctggcatcacctccgttgtaggcctgctgggcaccgacggcgtgacccgccatcccgagtcgctgctggcgaaaacgcgggcacttgagcatgaagggatcagcgcatggatgctgacaggcgcgtatggcctgccttctccgacgatcactggcagtatcgaaaaggatgtggcgctaattgataaaatcattggcgtgaaatgcgcgatttctgaccatcgctcttccgcaccggcagatgaccagctcgcgaatatggccgcccagtcgcgcgtcggcgggctgctgggcgccaaagcggggatatccgtatttcacctcggcaacagccctaaactgctggagccactgcttaacatcctgaataacgccgacgtgcctcgcacgaagctgctgccaacccacgtcaaccgcgcccaggcactgttccacgccgcactggactatgcccgcgaaggggggtacatcgacatcaccaccagcatcagtgagcccattgatgccgctaccgccatcgcgacggcccgtgacgcgcaggtgccgtttaaccggctcacgctctgctcggatggcaacggcagccagccgaattttgacgcaaacggtaatcttgttggcattggcgtggcgggttttgagtccctgcttgatacgctacagcagctggtcggccggtatcacctgccgctggaggaggcacttctgccatttacgcgtaacgtggcggagtttctcggtctggagcataaagggcggatcgcgcccggatgcgatgccgatttcctggtgctgacggatgacctgaagatccgtgaggtctgggcgaaaggccgccagatggtgcgtgaaggcgtggtgtgcgtgaaaggcacgtttgagtag

SEQ ID NO: 1532 - DNA, 474 bp, Enterobacter cloacae
gcaatggctttagagtcagagcacggtacggacagcgctttcagttcttcaacagcggaagcgacggctttgtcgataccacgtttcagatccattgggttcatgcccgcagcaacggctttcaggccttcggtgatgatcgcctgcgccagtacggtcgcggtggtggtaccgtcaccggcagcgtcgttcgctttagaggcaacttctttcaccatctgtgcgcccatgttttcgaacttgtcttccagctcgatttcacgtgcaacagaaacaccatctttggtgatggttggcgcgccgaaggatttgtccagcactacgttacggcctttcgggccgagagtgactttcactgcgtctgccagtacgtttacgccgcggagcatttttacacgagcgtcgttaccgaattttacgtctttagctgccatgttcttatttcctcaaattcgtacagttttcgtgcgttaa

SEQ ID NO: 1533 - DNA, 1317 bp, Enterobacter cloacae
gcaaggcaggtctttatgtttggagcagaactcgtcatcgtcctgttggcgatttatttgggcgcacgactcgggggaatcggcatcggttttgctggcggtctcggagtgcttgtacttaccctgatctttcagattaaacccggcgcaatcccttttgacgttatcgaaatcatcatggcggttattgctgctatcgcggccatgcaggtcgctggcggtatggactacctggtgagcctggcggagcgtatgctgcgtcgccatccgaaatacatcaccttccttgccccgctggtgacctggtttatgaccattctcgccggtactggccatactgccttctccacgctgccggtcatcaccgaagtggcgaaagagcagggtattcgcccgtctcgccctctttctattgccgtggtcgcctcccagattgcgattaccgcctcgcctatttccgcggcggtggtcttcttcgcgggcatccttgagccaatgggcgtaagttacctgacgctgctggcaatctgtattccggtcacgttgattgcggtaatgatcactgccgtgctgtgtaacttcctcggtgccgagctgaaagacgatccggtttaccaggagcgtctggcaaaaggtgaagtgagcctgcgcggtagccaggtcttcgagctgaagccgcatgcaaaacgctccgtgctgctgtttctgattggtatcgtcgccgtgatgttctacgcgaccgccatcagcgacacggtaggtctgatccagaacccggttctgccgcgtaacgaagccattgtggtgtttatgctgaccatcgcgacgctgatcagcatcacctgtaaaatcgacaccagcgaagtgctgaacgccagcaccttcaaatccggtatgagcgcctgcgtgtgcgtgctgggcgtggcgtggctcggtgatacctttgtgaaagcgcacatcagcgatatccagaccgttgcaggcgacctgctgcacaactatccgtggctgctggcagtagtgctgttctttgccgcgacgctgctgtactcccaggctgcgaccaccaaagcgctgatgcctgcggcactgatgctgggcgtgacgccgctgacggcgattgcctcttttgcagcggtttccgccctgttcgtgctgccaacctacccaaccctgctggccgcagttgagatggatgacaccggctcaacccgtattggtaagtacgtgtttaaccacgcgttcctcatcccgggcgtggtggcgattacgctctgcgtgatcctcggctttatcatcggcggcattgtgctgtaa

SEQ ID NO: 1534 - DNA, 1734 bp, Enterobacter cloacae
aggcatgttgctggccggaaaagtgatgggcgcgaccgcgctgcatctgcttcaggatgccgacctgttgcgaaaatgccgggaagagttcgaacaacacataacagaaaaaccgtacgagtgtccgatcccgcagggcgtgacaccgtcacctttaaaataaaaaaacacaacacaacaacacaacaacagtcccgaggaacgcccatgagtatgtcttccataccttcgcattccccatccggtaagctctatggctgggttgaaaggatcggcaataaagtgccgcaccctttcctgctttttatctatttaattgtcatcctgatggtcgcgacggccgtgctgtccgcctttgaggtgagcgtgcgcagcccggccgacggcagcatggtggcagtgaaaaacctgctcagcgttgaagggttgcactggtttttgccgaacgtgattaaaaacttcagcggttttgcgccgctgggcgccatcctggcgctggtgttaggcgcgggactggccgagcgcgtgggtctcctgcccgcgctgatggtcaaaatggcctcgcacgtcagcgcgcgttatgccagctatatggtgctgtttattgccttcttcagccatatctcgtccgacgcggcactggtgatcatgccgccgatgggggcgctgattttcctcgccgttggtcgtcatcctgttgcgggcctgctgtcggcgattgcgggcgtcggctgtgggtttaccgctaacctgcttatcgtgaccaccgatgtgctgctctccggcatcagcacagaggcagccagcaccatcgatgcgaccatgcacgtcagcgtgatcgacaactggtactttatggccagttcagtgattgtcctgacgattgtcgggggtctgattaccgataaaatcattgagccgcgcctgggtaaatgggaaggccggagcgatgaaaagctggagacgctgagcaaagagcagcagttcggcctgcgcgtagccgggatcgtctcgctggcgttcattgcggtggtggcgctgatggtggtaccggaaaatggcgtgctgcgcgatccaatcaaacacaccgtactgccctcgccgtttattcagggcattgtgccgctgataattctcttcttcttcgtcgtttcgctcgcgtacggcatcgccaccggcaaaatccgccgtcagggagatctgccgcacctgatgatcgagccgatgaaggagatggcgggttttatcgtgatggtgttcccgctggcgcagtttgtcgccatgtttaactggagcaacatgggcaagtttatggccgtgagcctgacggacgcgctggaggcggcggggttgagcggtgttccggcgtttgtcggcctggcgctgctgtcgtccctgctgtgcatgtttattgccagcgggtcggccatctggtcgattctggcgcccatctttgtccccatgtttatgatgctcggcttccatccggcgttcgcccagatcctgttccgtgtcgccgattcctcggtgatcccgctggcgcccgtgtcacccttcgttccgctgtttttaggcttcctgcaacgctacagaccggaggctaagctgggtacctactattcgctggttctgccctatccgcttatcttcttaggggtatggctggtgatgctggtggcgtggtatcttgtcggcctgccgattggaccgggtgtttacccgaggctgaactaa

SEQ ID NO: 1535 - DNA, 525 bp, Enterobacter cloacae
ggagtactgatgctgagattactcgaagataagattgcgacgccgctggggccgctgtgggttatcgcggatgaagcgttcaatctgcgcgcggttgaatgggaagagcacagcgaccggatggttgagctgctcaacatccattatcgcgccgagggatacgagcgtgttactgcccgtaatcctggcgggctgagcgataaactgacggcctacttcgagggcgatctcagcattattaataccctgccaaccgccacggcgggcacccctttccagcgcgaggtgtggcaggcgctgcgtaatattccctgcgggcaggtgatgcactacggtcagctggcagaacagcttggtcgtgccggcgcggcgcgcgcggtcggtgcggcaaatggctctaaccccgtcagcattgtggtgccttgccatcgcgtgattgggcgcaacggcaccctcaccggctatgccgggggcgtacagcgcaaagagtggctgctgcgtcacgaagggtattttctgctgtaa

SEQ ID NO: 1536 - DNA, 768 bp, Enterobacter cloacae
ggcttgagcaaacctatgatcccggaaaagcgaattatacgacgcattcagtctggcggttgtgctatccattgccaggattgcagcatcagccagctctgtatcccgtttactctgaatgagcacgaactcgatcagcttgacaatatcatcgagcgcaaaaagcctattcagaaagggcagacgctgtttaaggcgggagacgaactgaagtcgctctatgctatccgttctggcaccatcaaaagctacaccattaccgaacagggcgacgagcagatcaccggcttccatctggcaggcgatttagtcggctttgacgccatcggcagtggccatcacccgagctttgctcaggcgctggaaacctctatggtctgtgaaattccgtttgagacgctggacgatctgtccggtaagatgccgaacctgcgtcagcagatgatgcgtctgatgagcggtgagatcaaaggcgatcaggatatgatcctgctgctttctaagaagaatgccgaagagcgtctggccgcctttatctataacctctcccgccgtttcgcggaacgtggcttctccccgcgtgaattccgtctgaccatgacgcgcggtgatattggtaactatctgggcctgaccgtggaaaccatcagccgtctgctgggtcgcttccagaagagcggaatgctggcggttaaaggtaagtatatcaccatcgaaaacggtgaagcgctggccattctggcgggtcactcacgtaacgtggcataa

SEQ ID NO: 1537 - DNA, 1470 bp, Enterobacter cloacae
tttcccgtggacgcgaggtgtgtaatgcaggagaactacgcttttatcgctgatgccatcgacacgcgatgtcagacgtttaccgatattgccgacgacatctgggatcaccccgaaacgcgctttgaagagttctggtccgccgaacgcctcgccagcgcgctggaagccgagggctttaccctgacgcgggaagccggaggcattcccaacgcctttattgccagctacggcagcggcaagcccgttatcgcccttctgggcgaatacgatgccctggccgggctaagccagcaggcacactgcgcgacggcgcaatccgccaccccgggggcgaacggccacggctgcgggcataacctcttaggcacggctgcctttgccggggcggtggcggtgaaaagctggctggaacagcacggcggcagcggaacggtgcgtttttacggctgtcccggcgaggaaggcggctccggtaaaacctttatggtgcgtgaaggattatttgacgacgtggacgctggcgtgacatggcacccggaagcctttgccgggatgtttaacgtcagcacgctggccaatattcaggccgcctggcggtttaaggggatcgccgcccatgccgctaactccccacatctgggacgcagcgcgctggatgccgtgacgttgatgaccaccggcacaaacttcctcaacgaacacatcattgaaaaagcgcgcgttcattacgccatcaccgataccggcggaatttcgcctaacgtggtgcaagcccaggccgaggtgctgtacctgatccgcgccccggagatggccgatgcgcagcagatctacgcgcgcatcgagaaaatcgcccagggcgcggcgatgatgaccgaaaccaccgtcgagtgccgctttgataaagcctgctccagctatctgccgaaccgaacgctcgaagcggcgatgtaccgcgcattacagcattacggcacgccggcctggacggaagaggaacgcgaatttgcccgtaaaatccgcgctacgctcacggcaaacgacctgcaaaacagcctgaaaaacattgccgcaacgggggccgaagagggaaaagcgtttgcccgacgccatcaggagacgctgctggtggatgaagttgccccttacgccatcaccgataacgtgctggcaggctccaccgatgtgggagatgtcagctggaagatgcctgtcgcacagtgctttagcccctgttttaccgtgggcaccccgctgcatacctggcaattagtggcgcaggggcgtacctctattgcccataaaggcatgttgctggccggaaaagtgatgggcgcgaccgcgctgcatctgcttcaggatgccgacctgttgcgaaaatgccgggaagagttcgaacaacacataacagaaaaaccgtacgagtgtccgatcccgcagggcgtgacaccgtcacctttaaaataa

SEQ ID NO: 1538 - DNA, 1719 bp, Enterobacter cloacae
attcgctacgacgatagtattgatgtaaccctgcctcttctcttacggatgaccgccatgctgaaaaatctgcacgtgattaccggtattatctttgccctcaccatattctgtctgctgcaagttgtcacgggagggttgttctactctgccgttaacaacgatcgtcacaactttcagaactccgggttactcaatgcccaacaggaaagcctgagcgacagcgttaacacgctggtgaaaacgcgcgttaccgttacccgcgtggcgatccgctacctgaaaaaccagcgcgatccggcctctctcgcggcgatcaacacgctgctgggcaccgccaacggttcgctggccaaagccgaagactattacaaaaactggcaggctattccgcaggtgaagggccagcatgccgcgctcaccgaagagatgcagaaagcctggaagcaaatgcacgaggtgatgcgcttgtccattgagtatctgcgcgccgataactatcaggcctatggcgacctggacgcccagcaggcgcaggatgagatggaggcggtctatacccgctggcgcgctgaaaacaacgttctgctgaaagccgccgccgaagagaaccagagcagctttacccagatgcagtggacgctggcggcgatcttcctgaccgtgatcgccgtgctggtggtgatctggcagggtttacagcacctgctcctgaaaccgctcaacgccatcatgaaccatattcgcaccatcgcgagcggcgatctgacgcaaaatgtcgcgattgccgggcgcaacgagatgggccagctggctgctggtctgcacgagatgcagcagtcgctggtgagcaccgtcagcgccgtgcgcggcagcacagattctatctacacgggcgcaggagaaattgccgccggaagtaacgacctttccgcccgaaccgagcagcaggcagcctcgctggaagagaccgccgccagcatggaagagctgactgccacggtgaaacagaactcggataacgcccgccaggcgacgctgctagcgaagaatgcgtctgaaaccgccgcacgcggcggtcaggtggtggataacgtggtgcgtaccatgaatgacattgccgacagttctcagcaaattgcgcatatcaccggcgttatcgatagcattgccttccagaccaatattctcgcgctcaacgcggcggttgaagccgcccgtgctggagaacaaggtcgcggctttgcggtcgtggcaggtgaagtacggacgctggccagccgcagcgcgcaggcggcaaaagagatcaaagggcttatcgagaactctgtcagccgggtgaataccggctcggaacaggtgagcgaggcgggtgcgaccatgaaagagatcgtcgcggccgtgacgcgcgtaaccgatattatggctgagatttcctcggcgtctgacgagcagagccgcggtatagagcaggtcagcctggcggtctcgcagatggacagcgtcacgcagcaaaacgccgcgctggtacaggagtcggcaacggcggcggcggcgctggaagatcagtctgaacagctgcgtcaggccgtggcggcattccggctgaacgctcaggcatcgccggcggctcgccctaaaaacgtgaaaacgcccgtactgctgcgcccgtcagcggcaggcgcgaatacagctgacgcgaactgggaaaccttctga

SEQ ID NO: 1539 - DNA, 1347 bp, Enterobacter cloacae
agcagttcacatattttaatgatgacaggaaaagatatgaacgcactggcgcagtacatccagacattagccccacaactgagcgcatggcgtcgcgatttccaccatttcgcggaatccggttgggtggagtttcgcactgcggcaaaagtggcggagatcctcgcctcactgggttacgagctggcgatgggtcgcgacgtggtcgacgccgaaagccgtatgggactgcccgatgacgccaccctttcgcgagagtttgcccgcgcccgggcgcagggcgcgccggagaaatggctggcgccgtttgagggcgggttcaccggcattgtcgcgaccctgaataccggccgcccgggcccaaccctggcgtttcgcgtggacatggacgcccttgatttaagcgaagcgctcgacgacagccatcgcccgttccgcgacgggtttgcctcctgcaatccgggaatgatgcacgcctgtggccacgacgggcataccaccattggtctggggctcgcgcaggtgcttaagcagcatgaagcgcagctcaacggcaccatcaaactgatcttccagcctgccgaagagggtacgcgcggcgcgcgcgctatggtcgccgcaggcgcgctggacggcgtagactactttaccgccattcatatcggaaccggcgttccggaagggacagtgatctgcggcagcgataacttcatggcgaccaccaaatttgacgtgcgctttaccggagtcgccgcacacgctggcggtaaaccggaagagggccgtaacgccctgcttgctgctgcccaggccgctatcgcgctgcatggcatcgcgccacacagcgaaggcgcgtcccgggttaacgtcggggtcatgcaggcgggcagcggacgcaacgtggttccggctgatgcgttacttaaggttgaaacccgcggcgaaagcgaggccattaatcagtatgtctttgagcgcgcgcaggcggtaattaccggcgcggcggcgctctatggcgtaacaaccgggataaacctgatgggggcggcgacctccagcgtcccttccccggcctgggtcgattatctgcgcgagcaggcaagccaggtgcccggtgtgactcatgccattaataaggtcaaagcgcctgcgggctctgaagacgccacgctaatgatggcccgcgtgcagcagaacggcggcatggcctcgtatatggttttcggcacccagctgagcgccggacatcacaacgaaaaattcgattttgatgagcaggtgatgaacgttgccatcgaaacgctggcgcgaactgcgcttaatttcccgtggacgcgaggtgtgtaa

SEQ ID NO: 1540 - DNA, 999 bp, Enterobacter cloacae
gttactcttttacttacagactgtggtgacagtagtaaggagacctgtatggcaaagtatcaaaacatgctggtggctatcgatcctaatcaggacgatcagccggcattacgacgtgctgtgtatttacatcaacggattggtggcaaaattaaagcctttttgccgatttatgacttctcatacgagatgaccacccttctgtcgcctgacgagcgcaccgctatgcgtcagggagtgatcagccagcgtaccgcgtggatccgcgagcaggcgaagtattacctggaagcgggcgtaccgattgatattaaagtagtctggcacaaccgccccttcgaagccattattcaggaagtggtggccggtgggcatgacctgctgctgaaaatggcgcaccagcatgacaaactggaatccgtgattttcactccaacagactggcacctgctgcgcaaatgcccttgtccggtatggatggtgaaagatcagccgtggcctgagggcgggaaagccgtcgtggcggtcaatctggccagcgaagaggattatcacaattcgctgaacgagaaactggtgaaggagacgcttcagcttgccgaccaggttaaccatactgaagtccatctggtgggcgcctatccggttacgccaatcaatatcgccatcgagctgcctgaatttgacccgagcgtgtataacgacgcgattcgcggtcagcatctgctggccatgaaagcgctgcgccagaaattcagtatcgatgagaacatgacccacgtagaaaaagggttaccggaagaggttattccggatctggcggagcatttgcaggccgggattgtggtgctgggcaccatcggccggaccggtatttctgccgcgttcctgggaaataccgccgagcaggtgatcgaccatctgcgctgcgaccttctggtcatcaaaccggatcaatatcagacgccggttgagctggacgatgaggaagacgattga

SEQ ID NO: 1541 - DNA, 1296 bp, Enterobacter cloacae
aaacggaaccacttgggtatcgccggtttggcgattgcgctgattgccaccatctttgggccggaccccggcaacgtggcgtggatcctggtggcgatgatcatcggcggcgcgattggtattcgtctggcgaaacgcgttgaaatgaccgagatgccggagctggttgctattctgcacagcttcgtgggtctggcggcggtgctggtgggcttcaacagctacctgtaccacgaaccgggcctggagccgattctggtgaacatccatctgaccgaagtgttcctcggcatcttcatcggtgcggtgaccttcaccgggtcgattgtggcgttcggcaagctgcgcgggaagatctcttccaaaccgctgatgctgcctaaccgccacaagctgaatctggcggcgctggtcgtttcatttgtgctgctggtggtcttcgtgcgtaccgaaagcgtaggcttgcaggtgctggcgttactggtgatgaccatcatcgcgctggcgttcggctggcatctggtggcgtctatcggcggagcagatatgccggtagtcgtttccatgctgaactcctactccggttgggcggcggcggcggcaggctttatgctgagcaacgacctgctgattgtcaccggtgcgctggtcggttcttccggtgcgatcctgtcttacatcatgtgtaaggcgatgaaccgttcgtttatcagcgtcatcgcgggtggcttcggttctgacggctcatcaaccggttctgatgaggaagtgggtgaacaccgtgaaatcagcgcggaagacaccgcagagatgctgaaaaactcgcattccgtcatcatcaccccaggctatggcatggcggtagcgcaggcgcagtatccggtggcggaaatcaccgagaaactccgcgcgcgcggtatcaaggttcgctttggtattcacccggtggcggggcgtctgccaggccacatgaacgtgctgctggcggaagcgaaggtgccttacgacatcgtgctggaaatggacgagatcaacgatgatttcgccgacaccgacaccgtgctggtgattggcgccaacgacaccgttaacccggcggcgcaggacgatccgcgtagtccgattgcgggtatgcctgttctcgaagtgtggaaggcgcagaacgttattgtcttcaaacgctctatgaacaccggctatgctggcgtgcagaacccgctgttctttaaagataacacccacatgctgtttggcgacgccaaggccagcgtggatgcgatcctgaaagcgctgtaa

SEQ ID NO: 1542 - DNA, 897 bp, Enterobacter cloacae
atccggatcatttttatgaggaaggtcagcatgagcagcatagataaaagcggaacgttcacgctcggaacgcgtacggttaaacgatttggctatggcgcgatgcagcttgccgggcctggcgtttttggtccgccaaaagataaaaatgcggcgctggcggtgctgcgtgaagcggtggcgtcgggtgtgaatcacattgataccagcgatttttacggacctcatgtgaccaaccagcttatctgcgaggcgcttcatccgtaccgggacgaccttacgattgtgaccaagatcggagcccgacgcggcgaggatgcctcctggctgccggcgttttccgcgcaggagctgacgcaggcggtgcatgataacctgcgtaacctgaagcgggatgtgctggacgtggttaacctgcggatcatgtttagcgcccacggaccggcggaaggctcgattgccgcgccgctgagcacccttgcggagctgcaacagcaggggctggttcgtcatattgggctgagcaacgtcaccgcttcgcaggttgctgaagcgcagaagatggtttccgtggtgtgcgtacagaacatgtacaacgttgtgaatcgcggtgacgatgtgctggttgattcgctggcgcagcaggggattgcctgggtgccgttcttcccgctgggtggtttcacgccactgcaatcttccggactacaggcggtggcggattcactgggcgcgacgccgatgcaggtggcgctggcatggctgctgcaacgctcgccaaatatcctcttgatcccgggaacctcatcggtggcgcatctgcgtgaaaacctggcggcagtcgatctggtattgccgcctgaggcgctggagacgttaaattctctggtggggtaa

SEQ ID NO: 1543 - DNA, 1230 bp, Enterobacter cloacae
aagcgctgtaatttcgctcatcctgacaaaccgccccctggggcggttttcttatttctgcggccagcttttctcctctgtctatactttaccctttgtgtaatacgaggaggtgtaatgcgatttttgtcccgcttcgacatcatcgagctgatgatgacgccgtctttctggatcggcgtcgccacggtggtctttgtgactctgctggtgtactggctgctgacgcgcctgatcgccttcgttaagaaagggatcaccacctggggcgacaagcaccccagcaccaaccggatgcgctttatcctgacggatatgcttaaccgcaccagccgcgtcctgctttttgtcgtggcgctgttgttcagcctgcgtttcgtcgacttaccggatcatctctttggtaccgtgagccacgcctggttcctggtcttcgctatccaggtggcgctgtggatggatcagggggtggtgtcgtggcttcgtcacgtcatgctggcgccgggaagccataaaaacccggtgacgctggtgatcacggggcttatcctccgtgccattgtctggtcagtgatgctgctgtctattcttgctaacgcgggcgtcaacatcactgctctggttgccagccttggggtagggggtattgctatcgccctcgcggtgcaaacgatcctgagcgacgtgtttgcatcgctctccatcggttttgataagccgttcgaaatcggcgattttgtggtgtttaacgatgtcgccgggacggtagagcacattggtctgaaaaccacccgtatccgcagcctgagcggggagcagattgtctgcgggaacgccatcctgctgcaacagacgctgcataactacaagcggatgcaaacgcggcggattgtttttaccttcggggtcgccagcgacacggcgccggaaaaactgcgttcagtgggtgagatggtcaaacagatcattaccgacgtcggggaaacgaagtttgaccgcgcccatttcctgggcttcgatcgcgatcgcctgaccttcgaggtggttcatattgttaatacggcggattacaacaagtacatggatattcagcaggagatcaatattcgtatcctggaggagctgaaccagcaggagatcaagctggcgctaccgagcatggttctgcacgcgccctggatgaatgccggcgacgaggcatctgcgcaacggttgagcgaagcgcaataa

SEQ ID NO: 1544 - DNA, 927 bp, Enterobacter cloacae
acaacggttatcggtctcgttatgtcatttcagattaaatttcatcaaatcagggcgtttgtcgaggtggcgcgtcagggcagcattcgcggcgccagccggacgcttaatctttcgcagcccgcgctgaccaaatccattaaagagctggaggagggtatggcggcccagctatttgtgcgccggagtaaaggcgtcgcgctgaccgagtgcggggaagggttttatcaccgcgctaatttgattctggaagagctgcgtgcagcgcaggatgacatccgccagcgacagggcgagcttgccggacagatcaatattgggatgggagccagcatttcacgcagcctgatgccagccgtcattacgcgttttcatgcgcagcatcctcaggtcaacgtccggattatggaaggccagctggtgtcgatgattaatgaattacgtcagggtgagctggactttaccatcaatacctattatcaggggccgtacgatcacgaatttacgtttgaaaagctgttcgaaaagccttttgccgtattttgtcgggcaggacatccggcgacaggggcgacctcaattaatgagcttctgcaatataactggacgatgcctacgccccggggaagttattataagcagttacaggatacttttaaccatcgctctcaaataccgcgaattggcgttgtctgtgagaccttttcctcctgtattagcctcgtcgcacaaagcgatttcatcagcattttaccgcaggagctgggctgcgatccgcttctggcgcaccgtctgataatgctgccggttgtcgaaaccctgcctaaagcggcatattatttaattcagcgtcgtgattctcgccagacaccgcttgccgaatcattaatcacgcagtttcgaagagaggccaggaaattaatttaa

SEQ ID NO: 1545 - DNA, 651 bp, Enterobacter cloacae
gccattatttgtacccgtgcccggatgattgagacccgcaacgggcgcaggtatagtacatcactcagatgtagccggaggatttccatgaaccctgacgacaaatcactttttcttgacgccatggaggatgtccagccgctcaaacgctgcgcggatattcactggcagcagagccgcaacacgcgggcgcgtcaggaaatagatactgagcagctcgataactttctgacgctggggtttctggaactgttgccccttgacgagccgctgatgttccagcgtgaaggggtacagcagggggtatttgataagctgcgttccggcaaatattcccgtcaggccagcttaacgctgttacgccagcctgcggagcaatgccgccagctggtctattcctttattcgccaggccggacgtgacgggctacgcaacctgatcatcgtgcatggtaaagggcgtgaacagcagtcgcaccctaacgtagtgcgcagctatcttgcgcgctggttgaccgagttcgacgaagtacaggccttttgcgaagcgcagccgcatcacggcggcagcggagcatgctatgtctcgttgcgtaaatcagaggatgcgaagcgagataactgggaacgccacgccaagcgcagccgctaa

SEQ ID NO: 1546 - DNA, 1410 bp, Enterobacter cloacae
ataatgactttaacttcccgctggcctgccgtattgcaggccgtgatgcaaggccaaccgcgtgcgctggcggacagccactatccgcagtggcatcccgcgccggtgacggggctgatgaacgatccgaacggctttatctggtttgccggacgctatcatctgttttatcagtggaacccgctgggctgcaatcatcgctacaagtgctggggacactggagctcagcagatctggtgcactggcagcacgagccaatggcgctgatgcctgacgaagagtatgaccgcaacggctgttactccggcagcgccgtggataacaacggtgtgctgaccctgtgctataccggcaacgttaagtttgacgatggcggccgcaccgcctggcagtgtctggcggtgcaaaatgacgacggcacgtttgccaaactgggaccggtgttgcctctgccggacgggtataccgggcacgtccgcgatccgaaagtgtggcgccatgacgggctgtggtacatggtgctcggggcgcaggatcggcataagcgcggcaaggtgctgctgtttacgtcagccgatttacacacctgggcgtcctgcggcgaaatcgccggtcacggcgtcaacggactcacggacgcgggctatatgtgggagtgcccggatctgtttgagcttgatggcacacacgtcttgatctactgcccgcaggggctggcgcgcgaaccgcatcgctatctcaacacctatccggccgtctggatgagcggggcatttgattatcaaacccctgcatttacgcacggcgagctgcatgagcttgacgccggattcgaattttacgcgccgcaaaccacggtggcagaagatggccgccgcatcctcatcggctggatgggcgtgccggacggcgaagagatgctccagcctacgcgggcgcacggctggatccaccagatgacctgtcctcgcgagctgcgctaccgcgacggtaagctctggcagaccccggtccgtgagctggaaacgctgcgcgaggatgaacaccactggcagggacgcgccagcgatgccccggtgctggcgggagcgcgtcttgagttcgaactgagcgcctcgtgcgtgaacgtggattttgccggcgcgttgcgactgattgtggatgatgcggggatccgtctggaacgcgccagtctgaaaaccgcagacacgctgacccgctactggcagggcactgttcatcatttacgcgtgctgtgtgaccgttccagcgtcgaaattttcatcaatcacggtgaaggcgtcatgagcagccgctattttcctgaccatccggcccaggtacgcttcgaaggtgcgtccgacatcacattacgctactggtcgctgcgcagctgcatgatagaatag

SEQ ID NO: 1547 - DNA, 1602 bp, Enterobacter cloacae
agattggattcagccgataaccaaagggaaattatatccctgaggtgtgttatgtcgttgaaaaaatcatccctgattatcctgttttccctgcttttcttctttgtggccagcactatcaccagcgttgggctcatcattaaaagtaatacttcgctggataatgtgaacaaagaaattcaggttgtcctgtccattattgatcccattaaccacagccgaaccctgcgcgtcagggttatggagtatgtgaaaatggtggaagcgggggacgctaccgacccgtctgcgaaactggcctcggttaaagaggcgctgaccaaagccgatagtgcattttcggcgtttatggcctcgccgcgtttgcaggaagaagccccgctggtcactgcctaccaggaggcgtggcaaaactaccgtaaccagggactggcaccgctgattgccgctgccgccgctcacgatgtgtcgcggttcaacgctcttattcccgtggtgtctcaactcgatcgccaatatgaaattgtgctcgatcaggttctctccgttcaccagaagtacgccaaaacgctgaacgaggaggcgagccatgattttgtgtcgggtctggttattatcgccagtattgcggtgctgttcgtggtggtgattttcgccgtcagcctgctgatgaaacgcgtggtctttgcgccggtgaacctggcgcgcgagcactgtcgccagattgcggccgggaagctggacgtaccggtaccgatcaagcgtgattccgggaatgaaatcgatcacctgatgtcctcgatggagcagatgcgccaggcgctgctctccaccatttctcaggtgcgcgatgccagccaaaccgtgacgcatgcagcgcaggaaattgcctccggcaatatcgacctggcctcccgtaccgagcaacaggcttcggccctgacccagacggccgccagcatggaagagctgagcgcgacggtggcgaataacaccgacaacgttttccaggccggtaagctggtgcaggatgccgtgaaaaatgcccataccggtgaagcggtaacccgtgaagtcatcgaaacgatgagtactatcgcgtccaattcgaagcgtattgaggacatcaccagcgtcatcaacagcattgctttccagactaacattctggcgctaaacgcggccgttgaagcggcgcgtgctggcgcgcaggggcgaggatttgccgtggtagcaagtgaagtgcgcacactggcccagaaaagcgcggtggcggcgaaggatatcgaaagcctcatcgcccagtctgtttccagcgtgaaaaacggtgcggaactggtgaatcgttcgggagaggtgattgattctattatcagctctgtgaataaagtgcatatgctgatggaacagatttcggttgcctcagaagagcagagccgcgggattggtcaggttgggcaggccgtaacggagatggacggtgtgacccagcagaacgcggcgctggtgcagcaatccgccgccgccgcggcctcgctggaggagcaggcgcagcagctgtcccaaagtatctcgcgctttagtttgcctgctacggcgtga

SEQ ID NO: 1548 - DNA, 873 bp, Enterobacter cloacae
gagcgcgtttccttccagccccgtggtgaagatctcgccgggaccggtggcggcgtctacgacgtgaagtggaacgatacgctgcgcagtaacttctccctttatggccgtaactttggcagcgaagaggagatcgacaacaacgttcagaactacatcctcagcatgaatcacttcgccgggccggtgcagatgatggtcagcggcttacgggcaaaagataacgacgaccgtaaggacagcaacggcgatccgattaaaaccgacgcggccaataacggagtacatgcgctggttggtctgcataacgagagcttctacggcctgcgggaaggttccgccaaaacggcgctcctttacggccacggtctgggcgccgaggtgaaaagcattggttcagacggcgcgctgctgtcagaagccgatacctggcgttttgctagttacggtgtcacgcctctgggcggtggctggcacattgcgcccgccgtgctggctcaaagcagtaaagaccgctacgtgaagggcgacagctatgagtgggtcacgctcaacacgcgtctgatcaaagaggtgacccagaatttcgccctcgcgttcgagggcagctatcagtacatggatttaagcccggaaggctacaaggatcgcaatgcggttaacggtagcttctacaagctgaccttcgccccgacgttaaaggcgggcaagattggcgatttcttcagccgtccggagctgcgcctgttcgccacctggatggactggagcaacaagctggataactacgccagcgatgacgcctttggcagcaccggctttaacgcgggcggggaatggaactttggggtgcagatggaaacctggttttaa

SEQ ID NO: 1549 - DNA, 1437 bp, Enterobacter cloacae
cccttcacgctcccgcatcgcgggggcgtttcaaacaccataaaaagaggtcaggaagaggtatctatggattttaatcatattgcgcgcgagctgattccgctgctcggtggcaaagagaacattgccagcgcggcacattgcgccacgcgccttcgtctggtgctggtcgacgatgcgcttgccgaccagcaggctatcggcaaggttgaaggcgtgaaaggctgttttcgcaacgccgggcagatgcaggtgatcttcggcaccggggtggtgaataaggtttacgccgcgtttattcaggcggcaggaattagcgagtccagtaaatcggaagcggccgatattgcggcccgcaagctgaacccgttccagcgtatcgcgcgtctgctctccaacatcttcgtgccgattatcccggcgatcgtggcctcgggtctgctgatgggcctgctggggatggttaaaacctacggctgggttaatccggataacgcgctctatatcatgctggatatgtgcagctcggcggcgtttattattctgccgatcctgattggcttcaccgccgcgcgggagtttggcggcaacccgtatctgggggcaacgctcggcggcatcctgactcatccggcgctgaccaacgcctggggcgtagcgtccggcttccacaccatgaacttctttggtcttgaaatcgccatgattggctatcagggaaccgtcttcccggtgctgctggcggtgtggtttatgagcattgtggaaaaacagctgcgccgggcaataccggatgcgttagatctgatcctgacgccgttcctgaccgtcattatctccggctttatcgcgctgttgattattggcccggcgggacgcgcgttgggcgacgggatctccttcattcttagcaccctgattgcccacgcgggctggctggccgggctgttgtttggtgggctctattcggtgattgtcattaccggcattcaccacagcttccacgctattgaggccggactgctgggtaatccgtcgattggcgttaacttcctgctgccgatctgggcgatggcgaacgtggcgcagggcggggcgtgtctggcggtgtggttcaaaacccgcgatgctaaaatcaaagccattaccttaccgtcggcgttttccgcgatgctgggcatcaccgaagcggcaatttttggcatcaacctacgttttgtgaagccgtttatcgcggcgctgatcggtggtgcggcgggcggtgcctgggtggtgtcggtgcatgtctacatgaccgccgttggcctgaccgcgattcccggtatggctatcgttcaggccagctcgctgctcaactatattatcggcatggtgattgcatttggcgtggcgttcaccgtctctctgctgctgaaatataagacggactctgaataa

SEQ ID NO: 1550 - DNA, 1023 bp, Enterobacter cloacae
gtcgttgtgagaaaaacaaaacgcgtcaccattaaagatatcgcggagctcgcgggggtatcaaaagccaccgccagcctggtgctgaacggccgcagcaaagagcttcgggtggcggaggagacacgcgagcgcgtgctggcgattgccaaagaacatcattatcagcccagtattcacgcccgttcgctgcgagacaaccgcagccacaccattggtctggtggtgccggaaatcaccaactacgggtttgccgttttttctcatgagctggagaccctctgccgcgaggcgggtgttcagctgctgatctcctgtagcgatgaaaatccgggccaggagacggtggtggtcaataacatggtggcccgccaggtggacgggctgattgtcgcctccagcatgctcaacgacgcggactatcaaaagctgagcgaacagttgcccgttgtgctttttgaccgtcatatgaacgacagtactctgccgctggtcctcaccgattcaattaccccaaccgccacactggtggccgacatcgcgcgcaagcatccggatgagttctacttcctcggcggccagccgcggctttccccgacgcgtgaccgtctggaagggtttaagcaggggctgcgtgatgctggcgtcgagttacgtccggagtggatcattcatggtaattaccatccgagctccggctacgaaatgtttgccgagctttgcgcacgcctgggccgcccgccaaaagccctttttaccgccgcctgcggtctgctggaaggggtgttgcgctatatggggcaacataatctgctgcaaagcgatatgcgtctggccagctttgacgatcactatctctatgattctctgaccattcctgtcgataccgttcgtcaggataaccgccagctcgcctggcactgctttgatctgattggcaaactgattgaaggggaaacgccggagccgatccagcgtaagctggatgccaccctgcaacggcgatacaaggccgtggagtga

SEQ ID NO: 1551 - DNA, 837 bp, Enterobacter cloacae
agcgttgacagggcaataaacttcgaccactctgaaaaacaatatcttagaggggtcgttatgcttcaacggttagcaaagaaaaaggtgctgttactctctgctctgatggtttcggggctggtcagggcagaggagtcgcttccggatgtggtgaagcacttcagtgaacagcaggacatcaagatcattaagaaaattgacgcccccggcggcgcgccagcgtggctggggcaatatcaggacatgggcgtgacgctctttctgacccctgacggaaagcacgtcgtgtctggctatctgtatgatgagaagggaaccaacctcagcgaggcctttttccagaaagagatctacgccccgatgggccgcgagatgtggaaaaagctcaatgcggcgcatcccctgaaggagggcgcggagagtgccccgcgcaaagtcttcgtctttgccgacccgttctgcccgtactgcaagcagttctgggctgaagcgcagccgtgggtgaaggctggcaaggtccagctcaacacgctgctggttgcgtttcttaacccgaacagcgggcgtaacgcctccgcgatcctgaatgcgaaagatccggtgtcggcctggaaagcgtacgagctgtccggcggtaaaaagctgccgaaacctgaaggagcggcgtcccgggaaaccgttgagatcctgcaaaatcaccagacgctcatggacagtcttggcgcgaatgccacaccggctatttattacctgaatgagcaaaacgaactgcaacaggtcgtgggtatgccagacgcaaaacagcttgaggcaatgttcggaccgaagccgtaa

SEQ ID NO: 1552 - DNA, 591 bp, Enterobacter cloacae
cggtgcgaaagcgccggaagccgagtgagcgatatgaaagccggtgaggcgggggaatcattactgatctcggcactcaatgcctgccgcaggcggctaaaagccttcattcgcggaaggactgcggttcgtgatgatgtcgatgatattcttcaggaagtgacctggcagttgatgaaagtggaacaaccggtcgagaacgtcgccgcctggctgtttcgcgccgcacgaaatgagatgatcgaccgggcgcgaaaaaagcacgaggtttcactgccggggtacctgacagcagatgacgaggactttccggagcaggagattgcagaaacgttattcggcgtaccgcaaacgccggaagaggagtatctcaacatgctgctatgggaagagttggggcaagccctgtcggaactgccgccacctcagcgcgaggtgtttgaaaaaacggaatttgagggctacagcatgaaggtgctggcagaggaaacaggcgacagtgtgcaggcgttattatcccgtaaacacaaagccgtgcgatttttgcgtagtcgcctcaaggatatttatgaagcgttgacagggcaataa

SEQ ID NO: 1553 - DNA, 894 bp, Enterobacter cloacae
aggcatggtatgcagtttcgactgatgcgcaattttatcgtggtggcggaagagcttcacatgcatcgagcggcggagcgccttaacatggcgcagcccgcgctgagtcagcagataaaaacgcttgaagatcgtctgggggtaatgctctttagccgggcgaatcgtcgcctgacgctgacgccagccggtgaggcgtttctcagtaaagccagagtcgcgattttaatgaccgatcaggcgattctggatgccagacagacggccagaggggaacagggcgtgctgaatctcggatgtgtttcaagtgcgatattcgacagtaagctgcccgccgcgctgcggcttttacatgagaaatggcccgccatcagcctttccatgatgacgggaaatgtgcaaaccctttataccggcgtgcaaagcaaccagctggatgtggccattattcgtgccccgttaccgctgctgcctgacgatctgcaaagccgtcctttcacaacggaaaaagccgtgctggccttacctcgtcaacacagcctggcgggctccgccgcgctgacgcttgcgtcggtgaaagaggagaagtggatcgccctgcgcgacccggaggggatggggctggagcaatatttctatgatgcctgccacagcgcgggcatacagcctgacgttgtgcaaaatgccaccgatgtccccacggtgataagcctcgtctcggcagggtttggcatcgccatgctgccggcttcagcgaaggcgatatgcgtacaaaacgtagtctttgtggatattcttgaccgactccgggagagcgagctgacgctggtttgccaccggattattcgctctgaggtgctgaaaaaattgatgagtatcctcgatcatacctga

SEQ ID NO: 1554 - DNA, 1548 bp, Enterobacter cloacae
atgatgcaattgatagccctcttcgtccggttaagaatggatgcattcatccgaggggggaaaaatatggaaaaccacatcaacgatctcagaagtgctatcgaactgctaaaacgccatgaaggtcaataccttgaaaccagccatccggtcgatcctgacgcggagctggcgggtgtgtaccggcatattggtgctggcggcacggtaaaacgtccgacgcgcattggcccggcgatgatgtttaacgctattaagggataccccgactcccgtattctggtcggaatgcacgccagccgcgagcgggcggcgctcctgttgggctgcgatccctctgaactggcaaaacatgtcggccaggccgtgaaaaacccgattgctcccgttgtggttccggcggcacaggcgccgtgtcaggaacaggtgttttatgccgacaatccggacttcgatctgcgtaaattgcttccggcaccgaccaacacgccgatagatgccggtccgttcttctgtctggggctggtgctggcaagcgatccggaagatgcctcactgaccgatgtcactattcaccgtctctgcgtgcaggagcgcgatgagctctccatgtttcttgccgcgggccgccatattgaagtgttccgtaagaaagccgaggaggcgggtaaaccgttgccggtcacgatcaatatgggtctcgatcccgctatctatattggcgcctgtttcgaagcccctaccacgcccttcggctacaacgaactgggtgtcgccggtgcgttacgtcagacccccgtcgagctggtgcagggtgtggccgtaaatgaaaaagcgattgcgcgtgcggaaattatcatcgaaggcgaactgctgccgggcgtgcgcgtagaagaagatcagcatacccacaccgggcacgcgatgccggaatttcccggctactgcggggaggctaacccctccttaccggtaatcaaagtgaaggccgtcacgatgcgtcatcaggcgatcctgcaaaccctggtaggaccgggcgaagagcacaccacgctggccggtttgccaacggaggccagcatccgtaatgcggtggaagaagccattcccggttttctgcaaaacgtctatgcgcataccgctggcggcggcaagttccttggcgtattgcaggtgaaaaaacgccagccctctgacgaagggcgtcagggtcaggcggctctcattgcgttagccacctattccgagcttaaaaacattattcttgtcgacgaagatgtggatattttcgacagcgacgacatcttgtgggcgatgacgacccgtatgcagggcgatgtcagcatcacccatctgccggggatccgcggacaccagctcgatccgtctcaggcgccggactacagcccctccattcgtggcaacgggatcacctgcaaaacgattttcgactgtacggtgccctgggcgctgaagtcccgctttgagcgtgcgccctttatggaggtagacccaacgccgtgggcacctgaactgtttaaaaaatag

SEQ ID NO: 1555 - DNA, 1107 bp, Enterobacter cloacae
cggcggtaccggcgtgctgtaaagcatcctctcagacctatccattccatggataggtcacattcacttcccggcggttctcaaaaatcgcagttgaactatgatgaacttactattgaggagcccatcatgtttactgtgaaaaaacttgcgatatcaaccctgttggccggttcggttttattctttcccgctatccacgcggtggccagcgttccgcagcatgtggtgaaacagcaggctggcggctacagcgttcaggttggcgatacgattgtcaccgcctttacggacggcagcgtgccgcaggatctgcacgccttactgcgccggacgacggcggaaaataccgatgcgttactggctaaaaacttccaggccaatccggtggaagcgtcgattaacgcgttctatatcgccatccccggccacaaaattctggtggataccggttccggtcagctgtttggccccggcaaaggcgggcggctgattgagagcctggcgacccagggcatcaaacccgaagatattaccgatattctgatcacccatgcgcactccgatcacgctggcggcctggttaaagacggtcagcgcgtgtttacccgcgcgcaggtgtatgtcggcaaaccggatatcgatttcttctttaacgacgagaaccagaaaaagtctggctatgaccagaactacttcgacgtcgcgcacaagaccttaaagccctatctggatgccggaaaagtgacgaccttctccggcacggaacagcttctgccgggcatcagcggtacggttcacccgggtcacactccaggctccgcgttctacacgctggagagcaaaggtgaaaaaatgacttttgtcggcgacatcattcacgttgccgcggttcagttcccacagcccaacgtgacgattgcttacgatgaggatcaggacggcgccgcccgggtgcgcaacgctgctttcgctgagtttgtgaaaaataaagcgctgattgcggcgccacatctgcctttccccgggatcggctatgtgacgaaaggtgagcgggacggctacgcgtgggttccggtgacctataccaaccgtgacgcaaaataa

SEQ ID NO: 1556 - DNA, 369 bp, Enterobacter cloacae
cgccatttgcaggaaggcgccgtgatcattaacaccacttccgttcaggcgtttaaaccgagcgcgatcctggtggactatgcgcagaccaaagcctgtaacgtagcctttaccaagtctctggcccagcagctgggaccgcgtggaattcgggtgaatgccgtcgcgccaggtccatactggacgcctcttcagtccagcggcggccagccgcagtccaaagttcagaagttcggggaagatacgcccctgggcagaccgggccagccggttgaaatcgcaccgctgtatgtattgtttgcctccgatacctgctcatacgcctccgggcaagtgtggtgctctgacggcggtaccggcgtgctgtaa

SEQ ID NO: 1557 - DNA, 936 bp, Enterobacter cloacae
cctataccaaccgtgacgcaaaataagatgtccccctccgatatggatatggacctgatcctgacgctggatgcgttactcagggaccagaatatcacccatgccgccgcgcggctgggcatcagccagccggcgatgtctgcccgccttgcgcgcctgcgcgtgttgtttggtgagccgctgtttgtcccttccccacacggacgtggggtgttaccgacgccgcgcgccgaggcgttaaggccgcaggtcgcgacggttttgcagggtatatcggcgatgcttgaacccaccacgtttaacgcgcagaacagcaaccgcacctttgtgattgccctgcacgagaacccggcgctgatgctgggggcagagttgcagaatcagattagcagtgcggcgccaggtatccgcctgcgttttgcgctcccggaaacccaactgctgccagcgcagatggaaaatggcgatgtggatatttatgtcggcgttaacgcggtggcgcacgatgcatgggtcagacgcaagctgtttgacgatgaatatgccacagctcagcgaaaaggccatccgcgcggtacgggtccgatggatctggatagctattgtagcctttcccacctggtggtttcatccgagggcgacccgttcgcgggctttgtcgatcagcatctggcggggcttggccaccagcgtaacgtagtgatgtcgacgcaaagctatgcgatggcgcctgcgattgttgccggtaccgatttgctctgcaccttacccagacgcatgttgctacggtttacgcaaacgcttgatatttttccgccgccgctggatctcccgccgatcgtcatcggtatgtactggcacccgaaaaacagccaggatccggctaaccgctggctgcgagaacagcttcttcaggccgccggacgtcaggtatga

SEQ ID NO: 1558 - DNA, 1434 bp, Enterobacter cloacae
agttcctgcgccgcaccccatgggcgcgggcggaagttgaagccctctacctcgactcccttcacgatgacggtaacggggagcaggacgaaccggcgtttaatccctggacggatagccggacacccaggagctaacacgcaaatgatgcgacacgtaaaacggactggcgcgctgcttggctgcgcgcttttactggtaagttgcacttccaaaccacctaaatcactcgtaaccccgctgccgcaggcgaaacctgtacagcagactaacgaacccatgcgcgggatctggctggcgaccgtctcccgtctcgactggcctcccgtgtcatcggtgaatggccgtagcgcggaccagcgcatcgcccagcaacagcgggcgttgacggacaagctcgataagctgaaaaatcttgggatcaacaccgtcttctttcaggtaaaaccggacagtacggcgctgtgggcttctaaaatactgccctggtcagataccctgacggggactatcggggaagatcccggttacgatccgcttcagtttatgctggatgaagcgcacaagcgtgggatgaaggttcatgcctggtttaacccataccgcgtttccaccaacacgaagccgtcgaccatcgccgcgcttaaccgcacctcgtcgcttcatccttcgagcgtgtacgtcctgcatccggagtggatccgcacctcgggggatcgttttgttctcgacccgggcattcccgaggtgcgggactggataacccaggtggtgatggaagtggtaaatcattaccctgtcgacggcgttcagttcgatgactatttttacaccgagacgccgggctcccccctgaatgatgcctggaccttcaggcgctatggcgaaggattttcgtcaaaagcggactggcgtcggcacaatacgcagcagttgattgtgcaggtctccagggcgatcaagcaggctaaacctgaggtcgaatttggcgtcagcccggcgggggtctggcgcaatcgctccttcgacccggcaggctcggacacgcgcggcgccgcagcctatgatgaatcctacgctgacacgcgcaaatgggtacagcagggattactggattacattgcgccgcagatctactggcccttcgcccgcgacgcggcacgttacgatgtgctgacaaaatggtgggctgacgtggtgaaaccgacccacacccgtctgtatatcgggatcgcgttctacaaagtgggcgcgccttccagaaacgaaccggactggacggtgaacggcggcataccggagctgaaaaaacagctcgacctcaatgattcactgccagacgttaagggcaccatcctgttccgtgaagactatcttaaccagccgcagacgcaggaagcagtaaattacctccggggacgctggggtagttga

SEQ ID NO: 1559 - DNA, 318 bp, Enterobacter cloacae
cttcacgggttaccgcttcaccggtatgggcatttttcacggcatcctgcaccagcttaccggcctggaaaacgttgtcggtgttattcgccaccgtcgcgctcagctcttccatgctggcggccgtctgggtcagggccgaagcctgttgctcggtacgggaggccaggtcgatattgccggaggcaatttcctgcgctgcatgcgtcacggtttggctggcatcgcgcacctgagaaatggtggagagcagcgcctggcgcatctgctccatcgaggacatcaggtgatcgatttcattcccggaatcacgcttga

SEQ ID NO: 1560 - DNA, 609 bp, Enterobacter cloacae
caggaactgagaaaaaggagtcgcatcatggcggttcagactaaagttgtacgcttttttatggcaggcgcggttgccatagcactgagcgggtgcgtcaccgttcctgatgcgatcaagggcaccagcccgacgccacagcaggatctggtacgcgtgatgaatgccccggagctgtatgtcgggcaggaagcgcggtttggcggcaaggtggttgaagtgctaaaccagcaggggaaaacccggctggagattgccaccgttccactggacgacggtgcgcggcctgttctgggtgaagcctcgcgcgggcggatctacgctgacgtcagcggcttcctcgatccggtagatttccgcgggcagctggtgaccgtcgtcgggccgattaccggttcggtggcggggaaaatcggcaatacgccatacaaatttatgaccatgcaggtgaacggctacaaacgctggcgtatcgcccagcaggtggtgatgccgccacagccaatcgatccgtggatgtggggaccgcatccgtatcgttacggctacggtggctgggggtggtacaatccaggccctgcacaggttcaaacaatagtaactgagtaa

SEQ ID NO: 1561 - DNA, 1572 bp, Enterobacter cloacae
caggagcgtgtcatggaattcttaatggacccgtcaatctgggtaggcttgcttacgctggtcgtgctggagatcgttctcggtattgataacctggtgtttatcgccatcctcgcagataaactgccgccgaaacagcgtgataaagcccgtctgatcggcctctcgctggcgctgatcatgcgtctgggcttactgtctgttatctcgtggatggtcaccctgacgaagcccctgttcaccgtcatggatttcaccttctccggccgcgatttaattatgctggtagggggactgttcctgctgttcaaagccacaacagagctgcatgaacggctggagaaccggcagcacgatgatggccacggtaagggttatgccagcttctgggtggttgttctccagattgtggtgcttgatgcggtcttctcactggatgcggtgattacggcggtcggcatggtgaaccatctgccggtgatgatggcggcggtggtgattgcgatggcggtaatgctgctggcgtcgaaaccgctgacgcgtttcgtcaaccagcatccgacggtcgttgtgctgtgtctgagcttcctgctgatgattggtctgagcctggtggcagaagggtttggcttccatattccgaaaggctacctgtacgccgcgattggcttctcgattctgatcgagctgtttaaccagattgcgcgccgtaactttattaagcagcagtcgaatcagccgctgcgagcccgtaccgcagatgcgattctgcgactgatgggcgggcgtcgtcaggtgaacgtgcaggctgataacgagaaccgcaacccggttccggtgccggaaggcgcgtttgtggaagaagaacgctacatgatcaatggcgtgctttcgctggcttcccgctccctgcgcggtattatgacgccgcgcggcgaaatcagctgggtggacgccaacctgagcgtcgacgaaattcgtcagcagctgctctcctcgccgcacagcctgttcccggtctgccggggtgagctggatgagatcatcggtgtggtacgcgcgaaagagatgctggtggcgctggaagagggcgttaacgtcgaggccgtagcggccgcgtcgcccgcaatcgtggtgcctgaaacgctggatccgatcaacctgctgggcgtattgcgtcgtgctcgcgggagctttgttatcgtcaccaacgaatttggtgtggtacagggcctggtgacgccgttggacgtgctggaagccattgccggtgaattccctgatgcggatgaaaccccggaaatcgttgccgacggtgacggctggctggtgaaaggcaccaccgacctgcacgcgctctcgcacacgctgggcgtcgaaaacgtggtcaatgatgatgaagacattgccaccgtggcggggctggtgatctccgttaacgggcagatcccgcgtatcggtgatgtgctggagctgccgccgctgcaaattaccatcgtcgaagccaacgactatcgcgttgatatggtgcgtattgttaaagagcactctgcgcacgacgaagaagagtaa

SEQ ID NO: 1562 - DNA, 1206 bp, Enterobacter cloacae
ggcctgagcttcacgttaatcgcccagacgccggttaagccggcgttttttatgggcgcaaacaaaagagagtccgatttgaattaccagatgatcactaccaacgacgagctggcttcgctgtgcgaggtgacgcgtgaatttcctgctatcgccctggatacggaatttgtccgcacccgaacgtactatccgcagctgggtctgattcagatgtatgacggcaaacacgtgtcattgattgaccccctcggcattaccgactgggcgccaatgcgcgagctgttgctggataccgccgtgaccaaatatctgcacgcgggcagtgaagatctggaagtctttctcaacacttttggcatcatgccgcagccgctgattgatacccagatcctcgcggcgttcagcggtcgtccgctctcctggggcttcgccgcgatggtggaagagtacaccggtctgacgctggataagagcgaatcgcgtaccgactggctcgcgcgtcccctaacggcgcgtcagcttgaatacgccgcggcagacgtcttttaccttcttccaattgccggccagcttatgaaagaggctgaggcgtccggttggctgtctgccgcactggacgagtgccgcatgacgcagcagcgtcgtcaggaagtggttgatccgaaagaggcctggcgtgacatcaccaacgcctggcagctgcgcacccgccagctggcctgtctgcaactgctggctgactggcgtctgcgtaaagcacgtgagcgcgatctggcggttaacttcgtggtgcgtgaagaacacctgtgggcggtggcgcgctatatgccgggtagccttggcgaactggacagcattggcctttccgggagtgagatccgtttccacggtaaaacgctgctcgcgctggtagagaaagctcagcagctgccggaggacgcactgccagaaccactgcttaacctgatggatatgccgggctaccgcaaggcattcaaagatatcaaagcgctggtgcagacggtggcgggggaaagcaaactgagtgccgaactgctggcttcacgtcgtcagattaaccagctgctgaactggcactggaagttgaaaccgcaaaatggtttaccggagctggtcgccggatggcggggggaactgatggccgaacgcctgaataccctgctggaagggtatccgcgctaa

SEQ ID NO: 1563 - DNA, 195 bp, Enterobacter cloacae
caggagttaacgatgtttgcaggtttaccttctctcagccatgaccaacagcagaaagccgttgaacgtattcaggagctgatgtcccaggggatgagcagcggacaggcaatttcccaggtcgcggaagaacttcgcgccacccataccggcgagcggatcgtggcgcgctttgaggatgaagatgaagaataa

SEQ ID NO: 1564 - DNA, 1920 bp, Enterobacter cloacae
gagaacaccgtggcagacgatttttccccagagggtcagttagcacaggctattcccggctttaaaccgcgcgaaccccaacgtcagatggcgcatgccgttgcgcacgctatcgacaaggcgcagccgctggtcgtggaggccggtaccggtacggggaaaacgtatgcttacctcgctcctgcgctgcgggcgaaaaagaaggtgatcatctctacgggatcaaaagcgctccaggatcagctctacagccgcgatttacccacggtggcgaaagcgctgaaatacaaagggcgtctggccttgctgaaagggcgttctaactacctgtgtctggagcgtcttgaacagcaggcgctggcgggcggcgacctgccggtacaaaccctgagcgatgtgatcgtcctgcgcgcctgggccaaccagacggaggagggggacatcagcacctgcgcgagcgtgccggaagactccccggcctggccgctggtgaccagcaccaatgacaactgcctcggcagcgactgcccgctgtataaagactgttttgtggtgaaagcgcgtaaaaccgcgatggacgccgacgtggtggtggtgaaccatcacctgtttcttgcggatatggtggtcaaggacagtggtttcggcgagctgatcccggaggcggaggtaatgatcttcgatgaagcccatcagctaccggacatcgccagccagtattttggtcagtcgctctccagccgtcagcttcaggatctggcgaaagatattaccattgcctatcgcaccgaactcaaagatacccagcagttgcagaagtgcgcggaccgcttggcgcaatgcgcacaggatttccgcttacagcttggcgagccgggctatcgcggcaacctgcgcgaactgctcgcagacaaaaatatccagcgcgcgctgctgctgctcgatgatgcccttgaactctgttacgacgtggcgaagctgtccctcggacgttcagcgctgctggacgccgccttcgagcgcgccacgctttaccgtgggcggctgaagcggctgaaagagatcaaccagccgggctacagctactggtacgaatgtacctcgcgccacttcaccctggcgctcacgccgctgaccgttgctgataaatttaaagaggtgatggcgcaaaagcccggcacctgggtctttacctcggccacgctgtcggtcaatgacgatctgcaccactttaccgagcgcctcggcattgagcaggcggaatccctgcttctgccgagcccgttcgactatgagagacaggcgctgctgtgcgtgccgcgcaatctgccgctgcctaaccagccgggcgcggcgcgccatctggcggccatgctgaagccgatgatcgaggccaacaacgggcgctgctttatgctctgcacctcacacgccatgatgcgcgatctggccgagcagttccgcgccaccatgacgctaccggtgctgttgcagggagaaaccagtaaaggccagctgctccagcagtttgtcagcgccggtaatgccctgctggtggcgaccagcagcttctgggaaggggtggacgtgcgcggcgacacgctctcgctggtgattatcgataagctgccgtttacatcgccggacgatccgcttctgaaagcgcgcatggaggactgccgtctgcgcgggggcgatccgttcgacgacgtccagctgccggacgcggtcatcacgcttaaacagggggtagggcgactgatccgcgacgtcaccgatcgcggggtgctggtgatctgcgacaaccgcctggtgatgcgtccctacggcgcgaccttcctcgccagcctgccgcccgcgccgcgcacgcgggatattaaacgcgcggtccgcttcctggcgaacccgacggcggagtaa

SEQ ID NO: 1565 - DNA, 723 bp, Enterobacter cloacae
ctgaccattgcgagagcgcgacgactgatgcgaattctggctattgataccgcgacagaggcctgttccgttgccctgtggaacgacggtacgatttttgctcatttcgaagagtgcccacgggaacacacccaacgtattctgcccctggtaaaaaccattttaaccgagggcaacaccgccctgactgacctcgacgcgctggcctacggccgtggtccgggcagctttacgggcgtacgtatcgggattggcattgcgcaggggctggcgctgggcgctgacctgccgatgatcggcgtctccacgcttgcgaccatggcccagggagcatggcgcatgaccggcgccacccgcgtgctggctgcgattgatgcccgcatgggggaagtctactgggcggagtacacccgtgacgaaaacggcgtctggcacggcgaagagacggaagcggtgcttaaacctgaagccgtcaccgggcgcctgaaacagctctccggtgagtgggcgacggtcggaaccggctgggcggcgtggccggagatggcgaaggacaccggccttacgctggtggacggtaacatgctcctgcccgccgccgaagatatgctgccgattgcctgtcagctgtttgccgcaggaaaaaccgtggcggttgaacacgctgaaccggtttatttacgaaacaccgtcgcgtggaagaaacttcctggccgcgagtga

SEQ ID NO: 1566 - DNA, 1755 bp, Enterobacter cloacae
tataatgttaacaaactgtttattatcggggctgtgatgacgacgaacactcatttcagaggtgatgcattgaaaaaggtttggcttaaccgttatcccgcggatgtccctgcggagatcaatcctgaccgttatcaatccctgattgaactatttgaacactcggtacggcgctacgctgaccagcccgcgtttgtgaatatgggcgaagtgatgaccttccgtaagctggaagaacgcagccgggcgtttgcggcctatttacaggaagggttgggcttgcagaaaggggatcgcgtcgcgctgatgatgccaaaccttctgcaatacccggtggcgctgttcggcatcctcagggcagggatgatcgtggttaacgttaacccgctctataccccgcgcgagctggaacatcagttgaatgacagcggcgcggcggcgattgtgattgtctccaactttgcccacacgctggaaaaagtcgttgaaaaaactcaggttaagcacgtcatcctgacgcgcatgggtgaccagctctctaccgcgaaaggtacgctggtcaactttgtcgttaaatacgttaagcggctggtgccgaaataccacctgccggatgccatctccttccgccgcgccctgcatgcgggctaccggatgcaatacgtaaagccggagatcgtgtccgaggatctggccttcctgcaatacacgggcggcaccaccggcgtggcgaaaggggcgatgctgacccaccgtaacatgctggcgaaccttgagcaggttaacgccacctacgggccgctgctgcacccgggcaaggagctggtgatcaccgcgcttccgctgtatcacatttttgcgctgaccatgaactgcctgctgtttatcgagcttggcggtcaaaacgtattgatcaccaacccgcgcgatatcccggggctggtcaaagagctggcgaaatacccgttcaccgccatgaccggcgtgaacaccctgtttaacgcgctgcttaacaataaagagttccagcagctcgatttctccacgctgcacctctccgcgggcggcgggatgccggttcagcaggctgttgccgagcgctgggtgaaactcaccgggcagtatctgctggagggctatggcctgacggagtgcgccccgctggtcagcgttaacccgcatgacatcgactaccacagcggcagtatcggtctgccggtcccgtcgacggaagcaaaactggtggatgatgaggataacgaagtgcctcacggtgagccaggggagctatgcgtcagagggccgcaggtgatgctgggctactggcaacgtccggatgccacggatgagatcatcaaagacggctggctgcacacgggcgacatcgcggtgatggatgacgaaggcttcctgcgcatcgtcgatcgcaagaaagacatgatcctggtgtcagggttcaacgtctatccgaacgaaatcgaagacgtggtgatgcagcacagcggcgtgctggaagtggcggcggtgggcgttccttcaggcagcagcggtgaagcggtgaagatatttgtggtcaagaaagatccttctctgaccgaggatgcgctgataacgttctgtcgccgtcagctgacgggctataaagtgccgaagctggtggaattccgggatgagctgccgaaatccaacgtcgggaagatattacgacgagaattacgtgacgaagcccgtgccaaagtggacaataaggcctga

SEQ ID NO: 1567 - DNA, 270 bp, Enterobacter cloacae
gttatggcattactggacttttttctctcgcggaaaaaaagcaccgccaacatcgcaaaagaacgtctgcaaatcattgttgcggaacgtcgtcgtagcgacgccgaaccgcactacctgccgcagctgcgcaaagacattctggaagtgatctgcaaatacgtgcagattgacccagaaatggtcaccgttcagctggagcaaaaagacggggatatttcgattctggagctaaacgtgacgcttccggaagcggaagagtcgcgttaa

SEQ ID NO: 1568 - DNA, 966 bp, Enterobacter cloacae
caagtgaccattgctattgtcataggcacacatggttgggctgcggagcagttactcaaaacggcagaaatgctgttgggcgagcaggaaaacgtcggctggatcgatttcgttcccggtgaaaatgccgagacgctgattgaaaaatacactgctcagcttgagaagctggataccagcaaaggcgtgctgtttctcgtggatacatggggcggcagcccgttcaacgctgccagccgcattgtcgtcgataaagagcattatgaagtcgtcgccggggtgaatatcccgatgttggtggaaaccttcatggcgcgtgacgacaacccaggctttgacgagctggtggcgctggcggtggaaaccggtcgcgaaggggtgaaggcgctgaaagcgcagccggtcgaaaaacctgcccctgcccctgctgcaccaaaagccgttgcaccggcgaagccaatgggtccgaacgattacatggttatcggccttgcgcgtattgatgaccgtctgatccacggccaggtggcgacgcgctggaccaaagagaccaacgtacaacgcatcatcgtggtcagtgacgaagtggccgccgacactgtccgtaaaacccttcttacccaggttgcaccgccgggcgtcaccgcgcacgtcgtggatgtcgccaaaatgatccgcgtttacaacaacccgaaatacgcgggcgaacgcgtgatgcttctgttcaccaacccgacagacgttgaacgcattgttgaaggcggcgtgaaaatcacctccgttaacattggcggtatggctttccgtcagggcaaaacgcaggtcaacaacgcgatttcagtggatgcgaaagatatcgaggccttcaacaagctgaatgcacgcggtatcgagctggaagcccgtaaggtttccacggatcagaaactgaaaatgatggatttgatcggcaaagtggggaaataa

SEQ ID NO: 1569 - DNA, 615 bp, Enterobacter cloacae
agtgaatcgtatcctgaaacaactggagaactcacggtgaagaaagacaacctgacgctggatgattttctgtcacgctttcagcttctgcggccccaggttagccgcgccacgctgaatcaacgtcaggcggcggtgctgatcccggtcgtgcgccgtgagcagccgggtctgttgcttacccagcgctcaccgcatatgcgaaaacacgccggtcaggttgcgtttccgggcggcgcggtggacagcaccgatgcatccctgattgccgccgcactgcgtgaagcgcatgaggaagtggcgatccccccggagacagtcgaggtgatcggcgtgctgccgccagtggacagcgtaaccggttttcaggtcacgccggtcgttggcattattccgcccgatcttcagtatcacgccagcgtcgatgaagtttcagcggtgttcgaaatgccgctggaagaggcccttcgtctgggccgctatcacccactggatattcaccgccgcggacacgatcatcgggtctggctgtcgtggtatcagcattattttgtctggggcatgacggcaggcatcattcgtgagctggccctgcaaatcggcctgaagccttga

SEQ ID NO: 1570 - DNA, 504 bp, Enterobacter cloacae
ccctctggggaaaaatcgtctgccacggtgttctctcactgtatttttgcacagggattatgtcagccccttctctccggtgccaccccaaatagtgacgacggcggaacattatggcagtcttgccgcctgacgacgaaagataacgaggatacgtttatgacaattacgcgcattgatgccgaagcccgctggtctgatgtggtgatccacaaccagacgctgtactacaccggcgtccctgccaatctggacgccgacgccttcgagcagaccgccaacaccctggcgcagatcgacgccgtactggaaaaacagggcagcgacaaatcccgcattctggatgcgacgatttttctggcgaataaagacgatttcgcggcgatgaataaagcatgggatgcgtgggtggtggcgggtcacgcgcctgtacgctgcaccgtacaggccacgctgatgaaaccggaatataaggttgagatcaagattatcgcggcagtgtaa

SEQ ID NO: 1571 - DNA, 1380 bp, Enterobacter cloacae
attattcgcgctaattatttcacgctgcccggtagtatgccatacatgaacatgcgcttccccactgttatgaccttgccctggcgtgctgacgccgcggagttctggtttgcccgtctgagccaccttccttttgccatgctgctgcactccggccatgcggatcacccctacagccgctttgatattctggtggccgacccggttaaaacgctgacgaccgatgcgctgtcgccaacggacgatccgctgatgcggcttcagaacgagatcgatgctctgggcttaactgccacaccggatccggatctgcctttccaggggggcgcgctgggcctgtttggttacgatctgggtcgccgtttcgaaaagctgcccgagcatgcgcaggcggatatttccctgccggatatggcggtggggctgtatgactgggcgctgatcgtggatcaccgtaagcagacggtttctctgctgagccaccgggacgtacaggcgcgtctggcctggcttgaggcgcaacggcccgccgccccggaacactttatgctgacctccggctggcgctcgaacatgagcgcggaggaatacgcggaaaaattctcccgtgtgcaggcgtatcttcacagtggcgactgttatcaggtcaaccttgcccagcgtttccaggcggcgtacaagggagacgaatggcaggcgtttacccgcctcaatgccagcaataaggccccgttcagtgcatttttacgctttgaacacggcgccatactcagcctttcgcctgagcgttttatccacctggctgacggtatgattcagacccgcccaataaagggcacactgccgcgccttgccaacgccgacgccgaccgccagcaggcggagacgctggcggcctctcccaaagatcgtgccgaaaacctgatgattgtcgatctgatgcgcaatgatattggtcgcgtcgccgagccgggcagcgtgcgcgtgccggagctgttcgtcgtggagcctttcccggcggtgcatcatctggtcagcaccatcaccgcacgcctgccggcctcgcgaaccgcctgcgatctgctccgcgccgcgtttccgggcggctccatcaccggcgcgccgaaggtccgggcgatggagatcatcgacgaactggaaccacatcgccgcaacgcctggtgcggcagcatcggctatgtgagtctgtgcggcaccatggataccagcatcactattcgcaccctgacggcgtgcgacggtaacctgtactgttccgcaggcggtggcattgtggccgatagccaggtcgaggcggaatatcaggaaacctttgataaagtgaatcgtatcctgaaacaactggagaactcacggtga

SEQ ID NO: 1572 - DNA, 1407 bp, Enterobacter cloacae
catcgttactggaaccccagtaaccctgtcaggagtgtgaaagtgattagtatattcgacatgttcaaagtggggattggtccttcctcttcccacactgtagggccgatgaaggccggtaaacagttcgtcgatgatctggtcgaaaaaggattactggaaagcgttacccgtgtcgccgtagacgtttacggttcactgtcattaacgggtaaaggccaccacaccgatatcgccattattatgggtctggcaggcaatatgccggacactgttgatattgatgccattccggcatttatccgcgacgtggaaacgcgcggacgcttactgctggctaacggtcagcacgaagtggactttccgcaggatgacgggatgcgttttcgtagcgacaacctgccgctgcatgaaaacggcatgaccatccacgcctggagcggcgaaaaagagatctacagtaaaacctactactccatcggcggcggctttatcgttgacgaagaacactttggtaaagagagcgcgggcgacgtcaatgtgccctatccgtttaaatcggccaccgagatgctgggctactgcaaagagaccggtctgtccctgtccggcatggtgatgcagaacgaactggcgctgcacagcaagaaagagatcgaagactattttgctaacgtgtggcaaaccatgcgcgcctgtattgaccgcgggatgaacaccgagggtgttctgcctgggcctctgcgcgtaccgcgtcgtgcctctgcgctgcgccgcatgctggtcaccaccgacaagttctccaatgacccaatgaacgtggtcgactgggtgaacatgtttgccctcgcggttaacgaagagaacgcagcgggtggtcgcgtggtgacggcgccgaccaacggcgcgtgcggtatcgttccggcggtgctggcctattacgatcactttattgagcccgtgacaccggatatctatatccgttatttcctcgcggcaggcgctatcggcgcgctgtacaaaatgaatgcgtccatctctggtgccgaagtaggctgtcagggtgaagtgggcgtggcctgctctatggcggcagcgggtctggcggaactgttgggcgccagccctgagcaggtgtgcgtggcggcggaaatcggtatggagcacaacctcggtctgacctgtgacccggttgccggtcaggtgcaggtgccgtgcattgagcgtaacgccatcgcctccgtcaaagcgatcaacgcctcgcgtatggcgatgcgccgtaccagcgagccacgcgtgtcgctggataaggttattgaaaccatgtacgaaaccggcaaggacatgaacgcgaagtaccgtgagacctcgcgcggcggtctggccattaaggtgcagtgcgactaa

SEQ ID NO: 1573 - DNA, 1728 bp, Enterobacter cloacae
gccttcctttcgcccatctgcaacagatgggcgaattttcccctctcgtctcgtcgcttcacgtattccccactacactgtcactgttgcgtctggcttttctggccggtgcttaacaggcgaccgttcatgcaaactgcacaaacgatcattaaagactatcgccgaaaacgcgttatcgtctgtgtcacggttgcgctcgttacgctcgtcctgacgctgggcattcgctttatttcacagcgcaacataaatcaggatcggatccacgactttacccaccacaccgtgcgtgcgcttgataaggtgcttctctcgttagaggcccagcgtgaaacgctactttcactggttggcataccctgttccgaagcaaatctaatcctgcgaaaacaggcggcgatcctccagaccgtacgctccatcgccctcattaaagacggaatactgtattgctcaagcgtctttggcagccgtaatgtgcccgtcagtgagtttgtgccggagcttccagtcagtgaatccaggctgctgctgtcgactgaccggtggctggtaaaaggcagcccggtactgattcagtggtctcccgttgcgggcgacggcaacgacggggtgatggaggtggtgaatatcgatctcatcactaaaatgattctcgagccgcagcggccgcagatcaccgacgttgtcctgagagtaggagataacttcctccgcgacgggcaacaggtgacgactacgccgaccttcgatgaaaacgcctccctgctggaacagtcgtcacaacattaccctttcagcgtcacggtgagcggccccgggcctggcgaaatggcgttaaaaaatctgcctacccagctgccgctggcgttgatgctcagcttactgatgggctatatcgcctggctcgccacggcgcggcgaatcagtttcacctgggaaatcaacatgggaattgcggcccgggagtttgaactcttctgccagccgctggtgaatgcccgcacccgggaatgcgtcggcgtcgagatcctcctgcgctggaacaacccgcgtcagggatggatttcgcccgatgtctttatccctctggccgaagaacataacctgattgttccgcttacccgctacgtcatcagcgaaacggtgcggcagataggctatttccctgcctcgcgcgatttccatatcggcattaacgtggccgccagccattttcgccgcgctgcgcttatccaggatctcaaccgcatctggtttaacgccagccctgttcaacagttgatcgtggagttaaccgaacgcgatgcgttgctggatgtggattaccgcatcgtgcgggagctgcaccgcaaaggggtgaaacttgcgattgatgattttggtaccggcaacagctcactttcatggctagaaaaactgcatccggatgtgctgaaaattgataaatccttcaccaccgcgatcggcaccgacgccgtgaactcaacggtaacagatattattattgcgcttggccagcggctgaatattgaactggttgcggaaggggtggaaaccgaggagcagtcacgctacctgcgccgtcacagcgtacatattttgcaggggtacttgtatgcgcggccaatgccgctgcgcgagtttccgaaatggctggcggaaagccactctccgccagcccgtcacaacggacacatcgtgcccttactgccgttacgctag

SEQ ID NO: 1574 - DNA, 573 bp, Enterobacter cloacae
ctcaggagtaatatattgtcttcttctgcaagaaatttatttaagattctctcttctttcttgatccagaaaaaccctcatcatgaagaagtatgtgttcatgaagaaacaacagctggtttatgggcccctctccctgattcgcatgtcgtgcttttcttagatttcgatggggtttgccacaggtgtaaaaatgaaacctttgagcgaatgccactgttagagaaattgctggataactgccctgccatggtgattgttatctccagctcatggcgtgagtgcgctaatacaagttatctgaaatctctgttccgggtgccttatagagacaaaatcataggtgcaaccggttcggtatatttaaaacacggacagactggtgtgcgggctgccgagtgtgaggactttgtcttttcacatcgagttaaagcatttatctgccttgatgacgacgaatcattatttccggccggttatccgcatttgcacaaaaccgattattacacgggcctcaccgaatctgaccttgcagctcttaacgcaaggtaccatcagctcatgggacgctga

SEQ ID NO: 1575 - DNA, 792 bp, Enterobacter cloacae
attcgacaagaaagggacattatgctgcatcactgtcaggctaagtcactggatgacatataccttgaggatattccccacatcatacatccggccacggcggtacatgacctcgaagataccgccctgccaaaccggattattcaggaatggaatttaccgcagggatatacacagtttgtcagccggtatcaccagttccaccatcaacgcccctggctcgcttaccgcgatacgcttgacgacatcagatacggtaagatcgttctgcttagaaaagacataaccggcaatgccgggccgggggttatatcaaatggcaacctacgcaatgacctgcccctgtccctctttacccgtctgcgcgatatcatctctcgtcagttgaaacgcccggggtattacgttcgatcaacgacaccagcacagcacgcccaatcaacaaaaaccattaattccaaagcggctggtcgtcttctcgcagctggcgggctttataatggaaatgtggagggatttcgacatacggctgaacaacttggcggcgaagctgttgaaggctatgaccaggtattgaacgaaacaacttcaggtatgctggttgcagcggcttcacttctggttatccgaaatccaaggtctgcggatgaattgacaagttatctcggcaagtacaaaaaagcacacgttttgctcgatgatatgaatgttagcgaattgaactacatgcgccgagacagagctgaatatttacctctccgtggaacaattcaacaatactgtacgccctaa

SEQ ID NO: 1576 - DNA, 495 bp, Enterobacter cloacae
tcttttctcttcaactcgcaatactgtttatacatacagtacaagaattcgagtgtagctatgtctgttatccttgagcacattagcaacaagccttacgaaatggcaccttttttcagtgatttactaagctgtggagtgatgagtccgtgcgccgggcatgaagataatgaattaaatttgcatgaatatgtagtccgcaaccgcccctcaaccttctttgtcagggcggcgggcctcagtatgatcaatgccggtatcaatgatggagcaatactggttgtggatcggtctttaacagcacgacacggctctatcgtcgttgcgctggtggatggagagtttacggtaaagatcttacacacgtatcctgagctgcttttgatgccttctaatccagcctataagccgatacgtgtaaatcctgaatcccttgagatatggggcgtcgtcacctttgcactgaatcagttcagccatgtacatgcacgttga

SEQ ID NO: 1577 - DNA, 297 bp, Enterobacter cloacae
tgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatcgtgcgttcaccgaatacgtgcgcaacaaccgtcttccggagcctgtcatacgcgtaa

SEQ ID NO: 1578 - DNA, 1272 bp, Enterobacter cloacae
atcagttcagccatgtacatgcacgttgatattaacggagcctatgcggcatttgagtgtgcgatggatcccaagctgtcaaaaaagccgctcatcatagccagcaataacgattcgtccgtcattgcaatgaataaactggctaaaagcgttggtattaagcgtgggaccccaatttttaagtgcagggatttgattcagcaacaccggatcgaagtccggagctctaactttactttgtatgaagactactcaaatcgcttccatgaaacgctggaaagcttcgcgcctcaatcgagtcgatatagcatagatgaaaatttcatgttattgaaaaacatgaacaagataatagattatgaagattacggccggttgatcagaagtacacttcttcataatctgtcccttacctgtggtgtgggttgttcaagcaccaaaaccctcgctaaattatgcacctatgcgagcaaacgatgggcagctacaggcggggttgtagttttgactgatcaggccaggatcaggaagctcctgagcctgatcagtaccagagaaatatggggtattggtcgaaagattagtgaacgcctgtcggctttcgggatcatcactgccggtgatttttataatagcgacgttcgctttttacgtaaaagctttggcgttgaaatcgagcgtacctggcgggaactgcatggcgaaccatgtttccggctgcacgagtctcctcctgtcaggcaacagattatcgtttccagaagttttggtcagcgccttaatgagataggcaagctacatgaggcagtttcattttttaccgcccgggcggcagagcagctgcgcaaggatggctcgtggacccgtcaaatcacagtcttcattcagagtagcaattatgcgcaaggtgaaaaccgctacagcaattgtggtatcgagccgcttaccgctacacaggacacccgcgatctggttgatgcagccatgaccatcctgaaccgcatttacagacccgggatagcgtatgcgaaagcaggggtaatgctctccgctatgactgacggcacagagcaactcagcctgtttgatactcgcccggccaggcctggcagtcaggcactgatgaaagttatggaccggttcaataaagaaaagcgcggagctctgtttttactgggggaaggcattcaacaggattttcgtatgaagcaggccatgctatcaccgagatatacgacccgctgggatgaattactcgttgtaaaagcgtag

SEQ ID NO: 1579 - DNA, 570 bp, Enterobacter cloacae
ataaaacgtagattcagtggagaaatcgttgtgtttacaccaccagcagatgatgtgaaacctattcccgttcctgatgagatttacactcagtgcattacggatgccgcccgctacttcggaattgatgctgaactggtttttacgttgtttgacaatgaaggcggtaaggttggtactttcagcaggaatactaacggcacttatgatattggcccaatgcagatcaactcatccaatctacctgaaataaaaaagcatttcccgacggtaacgtggcgggttctggcttacgatgcttgcgcaagtttctgggttggaacatggtggctctatagaaaaattgttgatcgcaagggcaatgtgtttgaagggattgcagattacaacagcaaaaccccaaaggtacgtgcaaagtacatatttaacttcatggtaaagtacaatcgccggatccagcagcgtaacgggatgggtgagctttatcaatggacccagcaacctcctcgatacaatggccatatagctaaaaatgtcccggagcaaaacccgactcctgttgttaaataa

SEQ ID NO: 1580 - DNA, 228 bp, Enterobacter cloacae
aactttgcaacaggcaaggtcccctctgggtggcaggttcaccacaagatccctcttgatgatggtggcacaaacgctatagacaacctggtacttattcagaattcaccataccattcagcactgtcgaaagcacaatccatcattacgaaggatctaccgtataattcaagcaccaaagttctatggccatcgccgaacggtgttatctacccggtaggaaagtaa

SEQ ID NO: 1581 - DNA, 516 bp, Enterobacter cloacae
gaggcgctcatgaaagatttaactcaactactcagcagcttaaagaggttgatggttgcagatcactaccctttagccagcccggtagccccggaagtcttgaaagacttaatctgcaatccgcctccagtggagtgggcagatcacaaaaagagcgcctatatagatatacagaaactcattaaaaccaggcttgattatgcccaagtgtttaatgctatggatggttttgagtacaacggacttacgttttataaccttgttcaggcagagaacgaaaatctattgtggtcaaatatttacatacgcaactttgaagcacgagacaatgaaatctacgttgacccaaatctcactgataaggtgttaatcggagaagatggcatgtcacttttcgcttatagttttgcagacgactgctttcagataagagacaaagcatctactgattatgttattgaatctcatacagagtttgatagatttttgtcttcactgattcaaaccgtcagttga

SEQ ID NO: 1582 - DNA, 1500 bp, Enterobacter cloacae
tggaccaaaaactcgaaggctatgacatgcctacggccgatccggtcaattatctcaatgctggcggcagttttggaggcacttatgcgcagtaatgccgttttcaacttcaaaaagttacttttgtctctttctgtttgtgctgcaattttagccccgactgcaaatgcagacaacgcaatgcgtaacattttcaatggcatgatgacgtctaccagcccggccaccttttccacagcaacccgtacaggcatagttggcgggtcaatgtcttaccgaacaacaaacgttaataccaaccttgtttccatgtcgtttccaaaagcttctgtcggttgtaacggtattgacgtttttcttgggtccttcagcatgatcaacggggaccagcttgtgcaggtggcccgtggtattgcccagggtgcggctatctatgcttttaacgttgctgtttcagctatttgtgctgactgtgctgcaacgattaatgacatccaaaacaaactgcaagcgctaaataaatttgcgaaagattcatgcaatgcaacttactctttcctttctgaaaacgtgggtacgccaagccagttcgctaactcagttagctctggaccagcctcaattctgggatcgattaatggtcttattcctgattttggctcatcgatgacaaagtcacctgaagctgtcacttctcaggttaaagcaaaggatcccgaagagttcgctgaaaaattcagtggtaacctcttctatatgtcgttcatggatattgataagggaacgatgaacatcggaggggtaacggagttatccggttataaactggcagaacaacttatgtctctcgtaggtactgtcattatcaactgggatagcaaaggcgaaaaagcgggaatggaagtccgcccgtctaccatgactgtcacggattacatcatggggccaccagctggcggatcaattaaaatgctcaagtgttctccggcaccagatccatcatccccacgaaaggctcagtgccttgtcatgtcagaagttaatgacggtggttttaagggattgaaggataccatttctgatcttcttttaaacgtacagaaaaaaatcatcaacgacgttcgtgtttcagatgatgaattacgcattatctcctatatcggcatcccgaccattatcgactctttgcaaacattcgaagcaccggaagggtacgcatacattcaggacatcagcactattgctgcgacgagcctcgtaatcaacatgttgcgccaggttgaggccaaaatttcaaccatgagcataccgagtgagtcgctgtcgggtaaaagggatgatctcaaccgattaacagacaatctctcaaaacaggttaaagccgcctatgagctatcgcacagccaggtcggtaccagctcggacgtcatttcaacctgggataaccgtcgcctgcaacggaaggctttcactgaaagtattcgtggcacacgtaactga

SEQ ID NO: 1583 - DNA, 285 bp, Enterobacter cloacae; identical to SEQ ID NO: 1479

SEQ ID NO: 1584 - DNA, 1959 bp, Enterobacter cloacae
acggtaagtgcaatctggtatgattcacctaacatacgaatctggaaggaaaggtatatgggtgacctggtcagcaaaaataacattgaccgtttagagcgatttcattctttgctggcgggtcagtactggacgtccactgacagcatccctgaagagggtattgtggcaggggatacgctgctcattacgtctttgcgttacgttgaagataagctgcacacagtgattctacgcgcccatccccgcgtttacggtcagactgtagctattgtcactgaagacagcagcggcaaccgtagggaacgtggcaaagaaatgcgagagcatcgcttcctggttaaggattttctgtccagttttgtatttgaacccgaccataaggtaatccgggatgctgaactcagacaagctcaggaagaagtgaatagcctacaggcatcgcttacagccctcgtgagcgatgctcaggggctccgtgaccttgcgattgagcaattaggtacagatgaccgtgaaaaccctgtgacgggccttagcgttgcgttagtgcccccacaagagcagcaggcggtaacctcactggcgattggatcagttcaaaatgctctgtcctctggtatttcagatacccgcattgaacaaatcagagaagcggccttaaaagaagggcagatcagcacagccatcagcaaaatcatcacacaacgaacgcaggcaatcgctaatgccagcaaaagaatgctgccctatttcgaggaagttgcagcggcaagtctggccactacagaagaagccatggaatatgtgaagaaaatccacgatggcgttggcagtctggaactgtataccggcaaagacgttgaggtagtgaatatcgtgaagggtgaatccgctccatcacacctcccgctccaggtcgttcaggcaaagctgatggtggatgaagagctggccgtatggtgcgatctcgatagctggttcgacttctctgatatggaaaaatttcatgaaactttacgaaccagccccgggctggtggagcagatttttccgtccgaacgttccatcgtatgtatggccacaacacgacgttatatcgattaccgcgatccgtgggaaaatcatgtccgcaatgacaggaaccgggttgtattccttctggtccgggacggtcaaaatattcatcaggtttactgttcggtagaaagccatcttggggcttcgcagctattcccttccgccagcgaacaggaagcacatttccaggggattgatggcagcaccataaagtttgaggacgtcagttataccgaccgactgaagcagcatgatcttatggcacttcactaccgtcgtttcctgatccttatctgcggcctcgatcaccggctcaaactatttggtgatttctatgataccaataccccttacagttttctgagccttgagttccaggaacggtacttccaatttctgcacgacaaagacggttctggccttttgggtatggctgagacacggccgtctctgcaaagttatcttgaacaggcaaactcatgccttcagtccggatcccgggtaatgtgcaactgggattcgttgatgaacccagtgacagcaccaggagcagttcaggaagacaacagctactctggctataaatggcttgggagaacccataaaaactatgagccggttattgcattccgtcagggagacgatatctgtgtcaacgcaacagtaaacagatactcaacggatcgagatttcaattgtaaggtgaatttgtctttatttaaggagtccagcaggaatgatgctgaactgggtttcctgtgcatggataccattaaagcggaggagctcgaatggtacattcacagacgtaaattcaggtctaatcacctgttttacattcgcttcttcaagatggtgttaccaacggtgcaaaactga

SEQ ID NO: 1585 - DNA, 315 bp, Enterobacter cloacae
tctgctcctctgaatacaggggagcttatgatcacttttgagattcgtatggaaattaaagtcctgcacaagcggggaatgagtatccgggccattgccagggagctgggtatttcgcgcaatactgtccgcagccacctgaaagccaaatctgaaaagccgcagtattcaccacgcccggcaccatcatcactgctcgatgaataccgtgattacatctctaagcggatcagcgatgcgcatccctacaaaatcccggcgaccgttattgccagggaaatcatggagctgggctatcgtggaagggctttttaa

SEQ ID NO: 1586 - DNA, 759 bp, Enterobacter cloacae
ggagcggaaatgaaaaaaattattaaggcatcggtattacttctttcattaagtaccgccttcacgatgaatgccgagccggttaatacaatggtactgccagatgcagcccgggataagctcaaagccattgggctttcaatcgagcacgtcgaaccctcgccagtaaaagatatttttacggtgatttccagggagggggtaagttacgtgagcaaagacggagattacatttttaccggaagcttattccacgtgaaaggtaaagatgtggtaaacaccactgagcaggccattttaatgggcgtccgggaattcgcatccaaaacaaaatccatcgactacaaatcaccaaacgaaaaataccggcttgctatctttaccgatataacctgtggatactgccaaaaactgcatcatgatctgaagtcttatcttgatgccggtatttcgattaagtttcttgcattcccacgtgcaggactgaactcggtagtagccgggaacatggccaaaatctggtgttcagcaaagccaaacgaagctctggatgcagcgatgaatccggtttcaactatcccggaaggacgtcctgatgaggcttgcttaaacattatcaaatcgcatttccaggtggcctcaacaatcccgctgcaaggtactcctaccatggtgacactaagcggcaaaccgcagttatttacggggtggctgagcccggaaaacctggtgacccaaatgggcgctgcgcaaaagtaa

SEQ ID NO: 1587 - DNA, 909 bp, Enterobacter cloacae
tctccaaaaagcattgtttcacgaataattccgatttaccgggccagtataatccatcgcaggttaataactaacaggctgaaaagcataaaggtagctatgtctaaagaattttatttaaaaccgatggccacgattttaatttctgcggttattgctaccgctgcctcggcgttaatcacggcaacttattttaaaccgaaggtgctcagtgaggaagaaattggcaaaattgccgctacttacctggtaaaaaatccccattatttagtggaagcaggtaaggcgctggaaaatcagaacgtgagtgcctcagtggaacgaataattccatatgcgccagctctgctggataccaaggagacgccaaacatcggccctgatgacgccgacgtcgcggtaatcgagttcttcgactatcagtgtatttactgcatgcgggttacacctgttgttgaatcggtaatgaatcagagcaaagatgtaaaattcttctttaaagaattcccgatttttgccggttcaaaacctgtatctgccatgggggccgctacgggtctgcacgtctatcagaatttcggtgctgaagcctatcgtaagtaccacaacaacctgatggctgtggctcataccttcatgacctctcaacgcaaattcgaactcactgactttaatactgtggtggaaaagtcagggtttaacagcacgttttctgacagggaaaaaaaccggtatgaaaacgtgatctccggcaatatgcagctgggcgaagcgctcgggatcaccggcacacccggtttcatcattatgaatatgaaaaagccgaatgcggcgactaccacatttatccccggggctatggacgcagcaactttgcagggcgcaatcgaaaaagctcgcggggcctaa

SEQ ID NO: 1588 - DNA, 234 bp, Enterobacter cloacae; identical to SEQ ID NO: 1481

SEQ ID NO: 1589 - DNA, 3963 bp, Enterobacter cloacae
ctgaggtctgacatggattacaacatatataccctgggtgatattgattttgtctggtcggcttttaccggtattgccctgatcttttctcaatatactggtgtaaaagagttcctgaccacggccgccgttgtagcaggtgtgagcctattctataaaacgtggctatggcttcaggctccgaccaaaaatgaattaccgtttttctcctggtttttggggttgatccttttcatgatggcaatggttcgagtggatgtaactattgaatctgtaaagtcgggagaggtcagaaacgtcgacggaattccaatttttattgctgcgatggcaaccgtcaccactaacttaagccagggtttgctgaaggattataaaacagcgtttgatccgctttctccggtggacctgtctgcaacaactctggacgatgacatcaccctcggtccgatgatccgattcgtgaagtttttgcaatggggcggcgatagccagggctactgttccgcatttcctgaaccggccagcgggctagggccaatgaacgtatgtgctaccgttcagtctcttgcatacaactgcctgaaggctacccaaaactcaagcgcaaatattgccggtaaagaaactatttttaacgatattttctcagctaatctggcagatagcatggaccggattaatcaggcgatgaaaggcgcactgaagaatgcctctgccagtattgttggcgctaacggttcaaaatctggtacgtgtgatgaggtctggtcaactgtgaaacaggttaccagtacagctgaagctcgccagactatttcccttataggacagacaaacggcatccttactccagacgaagcaaatggtgcacctaccggcgcaagctttactgatgttatggcgtcagcaaatggtatgtacggtaaggctattggttcgtatgacgccaccctgaacctgttcattatgaatgagctcagaaatggcgcaagcaaatataagaccccactcggtctggcttccgatatgcagttgtttgaggcttctctgaagcgaaccaacacaatggcttcacagggccagttgtggttacaactgtcgggagcagcaatcgcattccttgaaatgtttgcttatatggttgctccatttgctttgcttatgctgctggcgttaggtggtaatggtgttgccgctgcggcgaaatatttgcaacttatcctcttcgtgaatatgtggccgcttacggcagtaatggtcaacgcgtatgtgaagaaagtcgcgacggccgacttggatacctggagcaccctcaacagccagaataatgccgtcacgtggatgggactcccagggcttgcggaaacatacagttcatacctgtctgttgcttccgccctctatgctctgattccggtactcacattattcctgatgacacagtcgattcacccgatgatgaatgcggttaagggagtgacccccgatgcgccggtggatactggtcatgtaacgcccaaagtatgggatggccctaacagcggtaaatcttcatttggtgacgtgacacgaaccgccttaaccagtaccggtcagggatacagcgatggcggcgcagttgattcaagtaatttccgtcttggaatgtggaatgctggttcaagtatcgctaacagccagggacaaggatcagctgtaacctcatcagttatgagtgcggcaagtaattcattccaggctggttacagtcagatgagcgaaattggaaggtcaggacagtcgagccagcagttctcaaccaacctgcaaacaatgaagcagatctcggataagattggtgcctctgtagcagaaggtattgcaacgaaacatggggtgagtgcgtctcagatggccagcattgcttcaaatgttattctcaacgctgggcttaatggaggtgttggaactggcaatggagccgggctgaaagcggctgtagcagggcaattgagtagcggtgcatctaagaccaatacaggcagtgactcgctttcaaatgacctttcaaaagcaatcacgaatcagcttagccaggattctgcgttaactgaccagttcagtaaagcggcgtctcaggtaagcagcgatcagatatccaatactaatgcgtttaaagaagcatcgtcgaaaatgaaccaggcgacacagacgatggcgcaaaatatttctacatcggtttcgactaacgcaagctccaatagtggaatgagccttgattctaaacaaagcattaacctggacaggttctccgattctattcgcaacaaaaacttcagtgatgatgatgtaaggaattttgctcgtaagaatgggctggatgagaatgcgtttatggagaaattcaactcctataacgataccttcaaggccagtaatcagcttggatcgcagcttcaacgtactgacgcgcttgtggctgcaacccgagatttcagtgagcaaaaaattgcgattgataccgcccggggagagacggccgaaagtaataaacaggatctccgtgaaacctccagcctgcttaaaagtctggtttccgacttcggtggtaatgcacagcagctgctacctatcaccaatcagctcgacagaatttcaggtgacgggtcaggaattaatactatcactcaggcacaggatagaactcctgacagcgtaaatacgtctggcgtgatgagtgcgtcacgcgtaggggaactgggtggaagtgtagattcgcaggctaaactcggtctttcctccaacgctcaggacgcgacacagcatgtccctggaaaaagtgaagctggctttactccgtataaccttgataacgcgggcaaaggcgatattcagggaatacataacaacaacgtgggccgcacttattctgatgaagaaaggaatgtgcttaattctctcgaaaagaatggacctgtactgaataatcagggtgtagagaaagtcgtcaattcgggtcaggatgtcagaaatgcagaaggcacatttaacgatctggaaaaggttggaggtcgggtggttggtgatggaatggatcaacgagccactgctttgaacagtatgtatcagagcgggcaagttcgtggcttatctaataacactgataactactttagtcgtgttgccaacaacccgaacttaagccgggacgataagcgagctgaattggcacagcaagctgtctttacctatggtgccagcaccatggctaccggtgccgaaagagagcagctcaaagcggatacccagaagatccttaatgaactgggtaactataacgttaactggagtatgaatgacgttaagagcatccatagcagtttcaacactcataacagagctgatggttcacttgagtcagtcgtacgggcaaacctgggagaaggtgggtcgggcggtggtctcgttggtaaccgcactcagaccgtcacagatcgcttggttggggaaaagatagaggccaacactgagcggggcgcgatttctggtgcgctactcgggggccagcaatttgtttcggatacgctaaccagcgttggggcgaaaccggtaaatgagatgcttacgggagcgggcatccttcaaacccagacatcgatagcaaatgatgcctctaaccctgcaaatatgcctgattctctccagggtaaagtccttaatcacatgcagatgtctgatggcgtcgcagctgtaagtgaccggtatcagagtattagcagcgacggcgtttcgacttatgcgaatgcagcgcagaactctgaaagggctatccggcagcaattgacggatgacccacgctttgggcctcagaaagcagatgaattcattcagtacatgaagtcagagctgagcaacacaaatgagccttaccagtcacgtgtcgataaagcggatcagtggcttaatgaaaataaaaaataa

SEQ ID NO: 1590 - DNA, 525 bp, Enterobacter cloacae
tatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcacgatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 1591 - DNA, 453 bp, Enterobacter cloacae
aaaagaataactaaactcagcctgcactggcgggcgaacgtggtggagcaagtgagcggaatactgacgcgctggcgacaatttggcagacgttacttctggccgcatctcttattggggatggtcgcggcgagtctcggcttgcctgtgctcagcaacagcgcagacgcggcaacgccagcacgttccacgacgaccaaacacgatctcaccacacgggttaacttcactaatctcgcatggcttgaagccagccgtcgtctcaatttctccgttgattactggcaacagcacgcgaatcccaccgttaaccgccatctgtccttcgcaagggctcccacaagaatgcttgttgccgaaaaaaatctgccggtccaggctcaacatcttggcctggtccaatcccctaatgccgctctgaacccgggaaaccaacccgccattgaaccgtga

SEQ ID NO: 1592 - DNA, 213 bp, Enterobacter cloacae
atccatgcggacggccggtccgttgtgaaaaccctctgcatgtgtggtcacaacatcattggtgcatttaccgcgtttaaatccggtcatgcactgaacaacaaactgttgcaggcagtcctggcaaaacaggaagcctgggaatatgtgaccttcgaagacgaagctgaactgccgctggcgttcaaagcaccgactatggtcctggcgtaa

SEQ ID NO: 1593 - DNA, 1506 bp, Enterobacter cloacae
tgtcttatggagtccgacgtaatgactcaacctgcgaaaaaggcgccgtcgattaagctgctgttcagcgcactcctgctggtgatgctgctctcggcgctggatcaaaccattgtttccaccgcgctgccgactatcgtgggtgagctgggcgggctggataaactctcgtgggtggtaacggcctatatcctcagttcgaccatcgtggtgccgctgtacggcaaattcggcgatctgtttggccgaaaaatcgttctgcaaatcgcgattgtgctgttccttgtggggtccgcgctgtgcggtctggcgcagaacatgacccagctggtgctgatgcgcgccctgcaagggctggggggcgggggtctgatggtgatcagcatggctgccgtggcggacgtgatcccgcctgccgatcggggtcgctatcaggggctgtttggcggcgtgtttggcctggcgacggtgatagggccgctgatcggcgggtttatcgttcagcacgcatcctggcgctggattttctacatcaacctgccgctggggctgtttgcgctgctggtgattggcgcggttttccacggcagcgcgcggcgcagcaagcatgagattgattacctgggggcgatttacctcagcatggcgttgctgtgcatcattctgtttaccaccgagggggggacgatccgccaatggagcgacccgcagctgtggtgcattctggccttcggcctgacggggatcgccgggtttatctacgaagagcggctggcgtgggagccgattatcccgctgtcgctcttccgcgaccgcagcttcctgctctgtagcctgatcggttttattatcggcatgtcgctgtttggctccgtcactttcctgccgctctatttacaggtggtaaaagacgccacgccgacgcaggccggtttgcagctcatccccctgatgggggggctgttgctcacctccatcatcagcgggcgcatcatcagccgtaccgggaaatatcgtctgttcccgatcctcggcacgctgctcggcgtggtggggatgatgttactgacgcgcatttcaatcacctctccaacctggcagctttacctgtttaccggcgtgctgggcatggggctgggactggtgatgcaggtgctggtgctggcggtgcaaaacagcgtgtcagccgatcaatacggcgtcgcgacgtctggggtgacgctgttccgctccattggcggggcgattggcgttgcgctgtttggcgcggtgttcacccatattctgcaatcaggtctgatcgacaggctgcctgaaggggcggaactgccgcgtgaacttaatcccgttgccatacaccatctgcctgatgccctgcgtctggactatctggatgcgttcggctcggcgatccatgcggtgttcatgctggcggcggagattatggtgctggcgtttgtgttgtcgtggtttttgcgcgaagcgccgctgcgtcggcaggcgtga

SEQ ID NO: 1594 - DNA, 462 bp, Enterobacter cloacae
gctgtgagatattcagattgcgctgaaaataaggagagatttatgcacctgagcattacagataaagtcacggctgaagaaaaagaagaattattaacggggctaagagcctataacgcgcagtatttagatctggcgacgtttagtggcgatattggcgtatatatgcgagacgacaatggcgtcatgctgggcgggttaatcggcgtacggaaaggcgactggctgaacatcgactatctgtgggtcagtgacagcgtgcggggtacgggtgtgggaagccagcttatcaaaacggctgaagaggaggcccgtcgcaaaggctgtcgtcacgcgctggtggatacggtcagcttccaggcgcgtccgttctatgaaaaacagggttatcaggtgcagatgtccttgcaggattacccttatcagggaatgcagagacactatctgtccaaaaatctttaa

SEQ ID NO: 1595 - DNA, 963 bp, Enterobacter cloacae
caggggagagagatgtctacaatcaacgatgtatcgcgtctggccggggtgtccaaagccacggtatcacgggtgttgagcgggtcgcgtggcgttaaagaagccagccgccaggctgttctgaaagcggtggacgagctgaactatcgtcccaacgtgatcgcccagtcgctgctcagccagtcgacgggctgcattggggtgatttgcgcgcaggaaaacattaaccagaccaccggttacctgtacgcgctggaaaaacacctcagccagcatcaaaaacatctgctgctgcgtttcgcacacacgaaaacagaagtgatgaacgcccttgaagaactctcctgcggcttatgtgatgacattctggtgattggcgcgcgtttcccgctggacgtggacatggacaacgtgattctggtcgactgtatggaagccgataacgccaacagcattcagttcgatcacgcgttcgcggctgaaacggcctgcaactatctcaccagccaggggcgtcgccagatagcgctcatccacccgcacggcagcggctttgccgatcaggtgctgttgggttacaaacatgcgctggagaaaaacttcctgccctttaatcgcaacctcgtgtttatggacgcaacttcatcgtccgttgcgcttcaggaattactcaacaacgcgtccacgctgaacttcaacgcgctgctggtggcggatgagcaggaagcccagcgggtgatcccgcagttacaggcgtttaataaatcggtaccggaagacatcatggtctttagcctcggcggttcgctgcatctgccgggtatcccggtgatcccggccattgagtattccatggacgccatggcggcgcgtatcgtgagctggctgacagagaaaacgcagatgctggggtcctacgtgctgcgcggggatttaattattccagatgtgcggaagcgttaa

SEQ ID NO: 1596 - DNA, 672 bp, Enterobacter cloacae
ataagatcaagagatacggtgaccatgccagcacaaaaggacaattctgaaccccgccgccccggtcggccacgcggcggcaagcgcgttaccgccagccgtgaacagctgctggacatcgccctgaacctcttttcccgccaggggatcgccaatacgtcgttgaacgccatcgcccgcgaagcaggcgtgacgcccgccatgctgcactactacttcaactccagagaacagttactggatgcgatgattgaggagcgcttcctgccgttacgcgagcggatcggggcgattttcgccgacaaccgggattcgccggtggatgccctgacggaaatggtcagggtgctggccgaactggcggaaaagtatcgctggtttgccccgctgtggatgcaggaggtgattggcgagatgccggtactgcgcacccatttgcaggcacgctttggcgatgagaaatatcacaccacgctggcaaccatcaaaggctggcagcaggaaggaaagctgaatccggcgctggcccccgaactgctgttcactacgctgctgagcctggtgctggtgccgttctcccgcatgcgcaatgacgagaggcttagcgccctctcgccggagatcgtggtgcgccacgtgttagccgtgataggcaccgggatcggcggttaa

SEQ ID NO: 1597 - DNA, 3141 bp, Enterobacter cloacae
agagatgaaaaccaacggaggaaacgcctgatgttttcccgtttcttcgtgcgtcgcccggtctttgcctgggttatcgccattctcatcatgctcgccgggatactggcgatccgcacgctgcccgttgcgcagtacccggacgttgccccgccgtcgatcaaaatatccgccacctacaccggcgcctccgcacaaacgctggagaacagcgtgacgcaggtgatcgagcagcagctcaccgggctggataacctgctctacttcacctccaccagcagctcggacgggtcggtgagcattaacgtcacgtttgaacagggaaccgatccggacaccgctcaggtacaggtgcagaataaagtccagcaggcagaatcgcgcctgccgaccgaggtgcagcagtccgggatcaccgtcgaaaaatcccagagcaacttcctgctgatcatgggcgtatatgacaaaaccgacaccgccagcagctcggatatcgccgactggctggtgagtaatatgcaggatccgctggcgcgcgtggatggcgtcggtagcctacaggtgttcggtgcagaatacgcgatgcgcatctggctcgacccggcgaagctggcgtcgtactcgctgatgccctccgacgtgcagagcgcgattgaagcgcagaacgtgcaggtttccgccggtaaaatcggcgcgctgccctcgtcgaacgcccaacagctgaccgccaccgtccgcgctcagtcgcgtctgcaaacggtcgatgagttcaaaaagatcatcgtcaagagccagtccaacggtgcggtggtgcgcatcagcgacgtcgcgcgcgtggagatgggcagcgaagattacaccgccaccgcgaagctgaacggccacccggcggcgggtatggcggtgatgctctcaccgggcgccaacgcgcttaacaccgccacggcggtaaaagataagatcgccgagttcaaaaagtcgatgccggaaggctacgacgtggcctacccgaaagacagcaccgagttcatcaagatctccgttgaggacgtgattcagaccctgttcgaagccattatcctcgtggtggtggtgatgtacctgttcctgcaaaacatccgtgcgacgctgatcccggcgctggcggtgccggtggtgctgctgggcaccttcggcgtgctggcgctgttcggttactccatcaacaccctgacgctatttgcgatggtgctggcgatagggcttttggtggatgacgccatcgtggtggtggaaaacgtcgagcgtattatgcgcgacgaagggctgcccgcccgggaagcgaccgaaaaatcgatgggcgaaatttccggcgcgctgatcgccattgcgctggtgctctctgcggtattcctgccgatggccttcttcggcggctctaccggggtcatttaccgccagttctcggtcaccattatttcggcgatgttcctctccgtggtggtggcgctgaccctgacgcccgcgctgtgcggctcgatcctgaatcacaccgctccgcacaaaaagggcttcttcggcgcgtttaaccgcttctacagtaagaccgagcacagctatcagaacaaggtgctgcgcgccctgcgccgttccggtggcatgctggtgatctacgccctgctctgcggcgcgatggggttcgccatgctaaaactgccgggcagcttcctgccaaccgaagaccagggtgaaatcatggtgcagtacaccctgcctgccggcgcaaccgcggtgcgtaccgccgaggtaagccgccaggtacgcgagtggttcctcaccaaagagaaagccaacaccaacgtgatcttcaccattgaaggcttcagcttcagcggcagcggccagaacgccgggatggcgttcgtctccctgaaaaactggtcagagcgcaaaggcgatgagaataccgcccaggccattgccctgcgcgccacgcaggagctgagcaccattcgggatgccacaattttcgccatgacgcccccggcggtggatggtttaggccagagcaacggctttacctttgagctgatggccagcggcggcaccgaccgcgacgcgctgctgaaactgcgtaaccagctgattggcgaagccaaccaggacaactcgctgcacgccgtgcgcgccaacgatctgccgcagatgccgcagcttcaggtggatatcgataacaacaaagccgtgtcgctggggctgtccctgagcgacgtcaccgacaccctctccagcgcctggggcgggacctacgtgaacgactttatcgatcgcggccgcgtgaaaaaggtctacatccagggcgacagcgactatcgcgccgtgccgtcggatctcaacaagtggtatgtgcgcggcagcgacagcaccatgacaccgttctccgccttcgccaccacccgctgggagtacggcccggaaagcctggtgcgctacaacggctcggcggcgtatgagattcagggcgaaaacgccagtggcgccagctccggcacggcgatgagcaaaatggagcagttggcaaacagcctgccgtccggcagcacatgggcgtggagcggtttgtcgttgcaggaaaaactggcgagcggccaggcgatgagcctttatgccctctcgatcctggtggtgttcctgtgcctggcagcgctgtatgagagctggtcagtaccgatttcggtcatcatggtgatcccgctaggggtgctgggcgcggcggttgccgcctccctgcgcggcctgaacaacgacgtctatttccaggtggcgctgctgaccaccatcggtctgtcgtcgaagaacgccattctgattgtcgagtttgccgaagccaaagtggccgaaggctactccctgacgcgcgccgccctgcgggccgcccagacgcgtctgcgtccgatcatcatgacctcgctggcgtttatcgcaggcgtgacgccgctggcgattgccaccggcgccggggccaacagccgcgtggcgatcggtaccggtattatcggcgggacgctggccgcgacgctgctggccatcttctttgttcctttattctttgtactggtgaaacgtctgttctccggtaagcacgcaaaccggaggtcataa

SEQ ID NO: 1598 - DNA, 1164 bp, Enterobacter cloacae
atacctatggcaaaagtctctttttctttcgcggccatccttggcctgctgacggcgatcgggccgctgtgttccgatttttatcttccggcgctgccggagatcgccacccagctcaacacctccacaacgctgacgcagctttctcttacctcggcgctgattggcctggggctgggacaactctttttcggcccgctaagcgatcgcatcggacgtaaaacgccgctgctgttctcacttttgctgtttgtactggcttcagtgctttgcgccagcacgcagaatatttacgccctgatcggctggcgatttgtgcagggcgttgccggggcgggcggctccgtacttgcccgctccatcgcccgcgataactatcatggcacgatgctaacgcagttttttgccctactgatgacggtcaacggcatcgcgcccgtggtgtccccggtactcggtggctatatcgcgtcgcatttcgactggcggatgctgttctgggtaatggcaggggcgggtctggcgctgctgatcgccagccagctttttatccgcgagtccctcacagagaaacagggcaggggatcgctgacgcaaaccgccaggacggtacttaaaaatcgtcgctttatgcgctactgcctgatccaggccttcatgctggcggggctgttcgcctatatcggggcatcctcctttgtgatgcaaaacgagtatggcctgagcgccatgcagttcagcctgctgttcggtgtgaacggtatcggcctgatcgtctcagcgctgattttctcccgtctggcacgccgccatctggcggaaagattgatgcgaacaggcctcgttctggcgttgtcctgcgcggggctgacattgctctttgcgtggatgcagctttccgttccggcactggttgcactctttttcaccgtcgcatttaacagcgggatcagcaccattgcgggttcagaagcgatgagcgcagtcgacacgaaggagtccggcacagcgtcagccattctgggcatgctgatgtttttattcggcgggatcgcagcgcctctcgcgggtatcggcggagaaacgatgctgaaaatgagtctcgcggtgttagtaagctatggcattgcactggcgatcggataccgcacgcagaatgcgtaa

SEQ ID NO: 1599 - DNA, 327 bp, Enterobacter cloacae
ggatggttgtcgatgttcaagattatgctgtgctgctctgccgggatgtccaccagcctgctggtcagcaaaatgatcgatgttgcaaaagaacggggcttacccgtgaagatagatgcgtatggcgtatccgaatttgatacgcagtttccgcactatcaggtggtgcttctcggaccgcaagtgaaatacatgttaaagacactctcagacaaggcagcgacgcaaggcattccggtgcagcccatcgacatgatggattacggcatgcagcgtggcgataaagtactggactatgctctgtcgcttatcgaagcggcacactaa

SEQ ID NO: 1600 - DNA, 576 bp, Enterobacter cloacae
ccgacgatgagcacaaagctggaagaacgacaaaaactacggcaggacgaaatcatcaccgccgcgcgccgctgctttcgcgccagtggatttcacgctgccagcatgtcgcagatcgccagcgaagccaggctcagcgtcggacaaatctatcgctatttcagtaacaaagacgcgatcattgaagagatgatccggcgcattatcgactcacgtattgaggagatgcagggcaaaaccctggttgaagggatgccgcaggcgcttgcctggcgccagacgcttaacgaagatgatgacgcgctaatgctcgaaatgtccgcagaggccacgcgcaatccgctggtggcaaacatgctgatcgaagccgaagcccgcatgttcgccaacgcctgtgagcaccttaaaaagcagttcccccacctgagcgatgagcatattcgctgctgcgtggagattaccgctgtgatgatcgaaggcacgatttaccgtcgactcacgcctttaaaagtaccgtcagaacaattagagcccatataccagaatattttaaatatgcttttctctgcgaagtaa

SEQ ID NO: 1601 - DNA, 1155 bp, Enterobacter cloacae
cagggcaggcttcgttcaccctggaaaaagattatgaaaaccataacaacctccatcgcagcattactcctcctgacagggtgcgataatgcgcaaacatctgctccccagcgtcctcttccggaagtggggattgtcacactcatgagccagccggtgtccgtcgtcagcgagctgaccggccgcaccgccgccgcaatgagcgccgaagtgcgcccccaggtaggtggcattatccagaagcgcctgttcaccgaaggcgatacggtcaaggccgggcaggcgctgtatcagatcgatccttccagctaccgcgccgcttataatgaagctgccgccgcactgaaacaggcgcaggcgctggtgcaggccgactgccagaaagcccgacgctatgcgcagctggtgaaggacgacggcgtatcacgtcaggatgcggaagacgcgaagtccacctgcgcgcaggacaaggccagcgtcgagtcaaagaaagccgcgctggaaagcgcccgcattaacctcaactggaccaccgtcaccgcgccgattgccggacgtatcggcatctcctctgtgacccccggcgcgctggtgaccacccagcaggataccgcgctggccaccattcgcgggctggacagtatgtacgtcgatttaacccgttccagcgccgatctgctgcgtttacgcaagcaaaccctcgccagcaacagcgatacgctgaacgtgtcgttgatcctcgaagacggcagcagctacagcgaaaaaggccatctggcgttaaccgaagtggcggtggatgagtctaccggctcagttaccctgcgcgccgtcttcccgaacccgcagcatcagcttctgccgggcatgttcgtccgcgccagagtggatgaaggcatcatgaatgacgcgatcctcgccccgcagcagggcatcactcgcgacgccaaaggcaccgccaccgcgctggtggtgaacgccagcaacaaggtcgaacagcgtcagctggagacgggtgacacttacggcgacaaatggctggtgctgagcggtttgaaggctggcgataagctgattgtggaaggcaccgacaaagtcaccgccgggcaggaagtgaaagctgaagagatgaaaaccaacggaggaaacgcctga

SEQ ID NO: 1602 - DNA, 1386 bp, Enterobacter cloacae
gcacgcaaaccggaggtcataatgtttcgtgtaaccgtattaacgttagcgctgctgagcgcgggctgtgtgtcattagatcccacgtatcagcgcccggacgcccccgtcccgacgacgttgccgggcgcccatggcgaagccaacgccgtggtgagccagtggcagcaggtgatgaatgatgcgcggttgaaaagcgtggtgacgatggcgctcaacagcaaccgcgacgtgcaaaaagcgattgcggatatcgacgccgcccgtgcccagtatggcgaaacgcgctcgtccctgttcccgacggtggacgcggaactgagccacacccgcagccgcacgctggcgagcggtgtcgcgacaagtgacgaagccaacggcgcggtctccagcttcgaactggatctgtttggccgcaaccagagcctgtcgcgtgccgcgcgtgaaacctggcttgccagcgaattcaccgcgcagaacacgcgcctgacgatggtcagcgagctgaccacggcctgggtgacgctggcggcggataacagcaatctggcgctggcgaagtccaccctggagagcgccgcaaactcactcaagattgtgaagcgccagcaggaagtaggcgtggcagcggcaacggacgtcagtgaagcgatggcggtttaccagcaggcgcgcgccagcgtggcgagctaccagacgctggtgatgcaggacaaaaacgctctcaacctgctggcgggcgatacggtgcccgagaacctgctacccggcacgctggagagcctgagcgacaacgccatcacgctgatcccggcgggcgttagctccagcgcgctgctgcgtcgtccggacattcaggaggcggaacacaacctgctgagcgccaacgccaacatcggcgcggcgcgcgccaacttcttcccgaccatctcgctcaccgccagcgcgggcgtcggcagcgattcgctgtcgtccctgttcagccacgggatgaaggtctggtcgtttgccccttccatcaccctgccgctgttcagcggcggcaacaatatggcgcagctgcgctatgcggaagccgagaaaaaagggttaattgcgacctatgagaaaaccatccagagcgcgttcaaggacgtggccgacgcgctggcccggcgcgaaacgttgagtgaacagcttgatgcccagcgtgaatacgtggcggcggagcaaaaaacgctggatgtggcgacgcgcagttacaaggctggcgcgggcgattatctgacggtgctcaccgcgcagcggtcgctgtggtcggcgcaggaatcactgattgccttgcagcaaaccgacctggaaaaccgcatcacgctgtggcaatcgctgggcggcgggattcagtaa

SEQ ID NO: 1603 - DNA, 1284 bp, Enterobacter cloacae
agtactggactatgctctgtcgcttatcgaagcggcacactaaaaggtgttcacatgagttcgttatatcaatctatggtcgcggtcattgagcaatcaattaccccgctggccgcgaagctgggtcagcaaaagtatgtgattgccatccgcgacggctttaccgccgcgctgccgtttatgatcatcggctcgtttatgctggtgtttatcttcccgccgttttcggcggataccaccaacagcttcgcccgcggctggctggatttctccgagacctaccgcgaacagctgatgctgccctttaacctcagcatgggcgtgatgaccttcttcatctcggtggggattggggcgagcctggggcgtcagtttaacctcgatccggtgatgtccggcctgctggcctttatggccttcctgctggtcgcagcaccctatgccgatggcaaaatttcgacccagtatctctccggccaggggatcttcactgcgcttatcaccgcgatctactccacccgcgtgtacgcgtggctgaagcagaacaacgtcaccatccgcctgccgaaagaggtgccgaccggcgtggcgcgttcgtttgagatcctgatcccggtgatggtggtgatcgggacgctgcacccgctgaacctgttcattgaagcgcagaccggcatgattatcccgcaggcgatcatgcacctgctggagccgctggtctcggcgtctgactccctgcccgcgattctgctctccgtgctgctgtgccagatcttctggttcgcgggtatccacggctcgctgattgtcaccggcatcatgaacccgttctggatggcgaacctctctgcaaaccaggcggcactggcggcgggcgcggcgctgccgcacgtttatctgcaaggtttctgggatcactacctgctgattggcggcgtaggctcgaccctgccgctggcgttcctcctgctgcgtagccgcgttacccatctgcgcaccatcggcaaaatgggcgttgtgccaagcttctttaacatcaacgaaccgattctgttcggcgcgccgatcatcatgaacccgatgctgtttatcccgttcgtgttcgttccgctggtcaacgcctgcctggcgtacggcgcaactaaactcggctggctggctcaggtggtttcgttaaccccgtggaccacgcccgcgccgattggcgcctcgtgggcggcgaactgggcgctgagcccggtggtgatgtgcctcatctgcatggtgatgtcggcgctgatgtac

SEQ ID NO: 1604 - DNA, 1062 bp, Enterobacter cloacae
ataatgatgaagcgcaatatcctggcagtggtagtccctgccctgctggtagccggtgcagcaaacgctgctgaaatctataacaaagacggcaacaaattagatctttacgggaaagcagtcggcctgcattacttctccgataatgacagcaacgatggcgacaacacttacgcgcgtctgggcttcaaaggtgaaactcagatcaacgatcagctgactggctacggtcagtgggaatacaacttccagggtaacaactctgaaggtggcgatgcacagaacggcaacaaaacccgtctggcattcgcaggtctgaaatttggtgacgcaggctccttcgactacggtcgtaactacggcctggtctatgacgcaatcggcatcaccgatatgctgcctgagttcggcggcgacaccggcgcgagcgataacttcttcgcaggccgtacgggtggtctggcgacttaccgtaacagcaacttcttcggcctggttgacggtctgaactttggtgttcagtacctgggcaaaaacgagcgtactgatgcagtacgttccaacggcgacggctgggcaacctcactgagctatgatttcgaaggcttcggcattgtgggtgcttatggtgcagctgaccgtaccaacaaccagcagacgctggaatggggtaaaggtgacaaagctgaacagtgggcaaccggtctgaaatatgacgcgaacaacatctacctggcagctatttatggcgaaatgcgtaacgcagcgcgtctgggcagccgtggtttcgctaacaagtctcaggacttctctgtcgtcgctcagtaccagttcgacttcggtctgcgtccatccatcgcttactacaaatctaaagcgaaagacgtagaaggtatcggtgacgaagactacatcaactacatcgacgttggtgcgacatactacttcaacaaaaacatgtctacctatgttgactatcagatcaaccagctgaaagacgacaacaagctgggcatcaacaacgactatatcgtggctctgggtctggtttaccagttctaa

SEQ ID NO: 1605 - DNA, 666 bp, Enterobacter cloacae
  unsure (596)
tatcaccgacaatcgcctgctgtatggttaaaaaaggaaccaaaaaggatgctttttaccctaaaaaaatatatcggaggcatgatgcttccccttcccctgctgttgcttctcatcgcgctggggctggcaatgatatggtttagccgctttcagaaaagcggtaaatcccttgttaccgtgggctggctggcgctgctgttactcagcctgcaaccggtcgctgacggtttattacgtccgattgaaaacacctacccaacgtggcagggaaatcagaaggtgggctatatcgtggtgctgggcggcgggtatacctgggatccgaactgggcgcccagctcgaacctgatcaacaacagcctgccgcgcctgaacgaggggatccgcctgtggctggccaatcctggatcgaagatgatcttcacgggcgctgcggcaaaaaccaacccggtcagtaccgctgaagcaggagcaagagtggctgaatcgcttggcgtacctcgttccgccatcatcacgctggatagcccaaaagataccgaagaagaggcggcggcggtgaaacaggccatcggtgatgtaccattcgccgntggtgacatatatttccacacctgccgcgctcaattattcgaaaacgagctagaaataccgcctaaagaa

SEQ ID NO: 1606 - DNA, 1209 bp, Enterobacter cloacae
tcacaatggaacttcgtcatgtttgagaacattactgccgctcctgccgacccaattctgggcctggccgatctgtttcgcgccgacgaccgccctggaaaaatcaacctgggtattggtgtatataaagatgaaaccggcaaaactccggtactgaccagcgtcaaaaaagctgagcagtatctgctggaaaacgaaaccaccaaaaactacctcggtattgatggtatccctgaatttggtcgctgcacccaggagctgctgttcggcaaaggcagcaccattgtgagcgaaaaacgcgcccgcacggcgcagaccccaggcggtaccggcgcactgcgcgtggcggcagatttcctggcgaaaaacacttctgtgaagcgtgtgtgggtaagcaatccaagctggccgaaccataagagcgtgtttaattctgcgggtctggaagtgcgtgaatacgcctactacgacgcagccagccacgcgctggatttcgacggcctgctggccagcctgagcgaagcccaggcgggcgatgtggtgctgttccacggctgctgccataacccaaccggtatcgatcctacgcttgagcagtgggaacagctggctaagctgtccgttgaaaaaggctggctgccgctgtttgacttcgcttaccagggctttgcccgtggtctggaagaagatgcagaaggtctgcgcgcattcgccgccgtgcatcaagagttgatagtcgcaagctcctattccaagaactttggtctgtataacgagcgtgtcggcgcctgtacgctggtggctgctgacgaagcaaccgtcgatcgcgcattcagccagatgaagtccgtgatccgcgctaactactccaacccaccggcacacggtgcgtctgtggtcgcgacgatcctgagcaacgatgcgctgcgcgccatctgggagcaagagctgaacgatatgcgtcagcgcattcagcgcatgcgtctgctgtttgtgaacacgctggctgagaaaggcgctgaccgtgacttcagcttcatcatcaagcagaacggcatgttctccttcagcggcctgaccaaagagcaggtgctgcgcctgcgtgaagagtttggcgtgtatgccgttgcatctggccgcgtgaacgttgcaggtatgacgcctgacaacatggcgccgctgtgcgaagccattgtcgcggtgctgtaa

SEQ ID NO: 1607 - DNA, 816 bp, Enterobacter cloacae
caaaatagcggttttgcagtgagtggaaccctcccaatgcgggatcgcaattttgatgacatcgcggaaaagttttcgcgcaacatttatggcaccaccaaaggtcagcttcgtcagacgatcctctggcaggatctggacaagctgctggctgaattcggtgaccgaccgttgcgcgtgctggatgccggcggtggggaaggtcagactgcaattctgatggcgcagcggggacatcacgtcacgctttgcgatctttctgccgagatggttgcgcgcgccgggcgagcggcagaagagaaaggtgtgagcgacaacatgcattttatacattgcgccgctcaggacattccgcagcatttggaaacgcaggttgatctgatattgtttcatgctgtgctcgaatggatcgccgaaccccaggcgatgttaaaaacgctgtggtcgatgttgcgcccgggcggtgcgttatcgctgatgttttacaatgccaacggcctgctaatgcgaaacgtgctggtcggcaattttggctacgtacagcagggcatgtataaaaagaaacgacgcacgctttcaccggatttcccccgtgaaccgcagcaggtctatggctggctggaggagatcggttgggaaattaccggcaaaaccggcgtgagggtgtttcatgattatctgcgtgataaacaaaaacaggatgactgtttagacgccttaacagaaatagagacgcggtactgccgccaggagccttatctgagccttggccgctatatacacgtcaccgcgcgcaagccgcagatgcaaggataa

SEQ ID NO: 1608 - DNA, 1326 bp, Enterobacter cloacae
tctatgagtgaattttcccagacagtccccgaactggttgcctgggccaggaaaaacgatttctccatctcgctgccggtagacagactctcattcctgctggcggttgcgacgctaaacggcgaacgcctggatggcgaaatgagtgaaggcgaactggtggatgcgttccgccacgtcagtgatgcgtttgagcaaaccagcgaaaccattagcgtgcgtgccaacaacgcaatcaatgatatggtgcgtcaacgtctgctgaaccgctttaccagcgagcaggcggaaggaaacgccatctatcgtcttacgccactgggcattggcattaccgactattacatccgccagcgcgaattttccacgctgcgtctctccatgcagctctctattgttgcaggtgagctgaagcgtgccgccgacgcggctgatgaaaacggtgacgaattccactggcatcgcaacgtttacgcgccgctgaaatactcggtcgccgagattttcgacagtatcgatctgactcaacgtctgatggacgaacagcagcagcaggtgaaagacgatatcgctcaactgcttaataaagactggcgtgcggctatctccagctgtgaactcttgctgtcagaaacgtccggtacgctgcgtgagttgcaggatacgctggaggcggcgggggataagctacaggccaatctgctgcgcatccaggacgcgacaatggcgcacgacgatctgcattttatcgaccgtctggtgtttgatttgcagagcaagcttgaccgcattatcagctggggccagcagtcaatcgacctgtggatcggttacgaccgccacgtgcataaatttatccgtaccgccatcgatatggataagaatcgcgtctttgctcaacgtctgcgccagtcggtacagacctatttcgatgcgccgtgggcgctgacccacgccaacgccgatcgtctgctggatatgcgcgacgaagagatggcgctgcgcgatgaagaggtcaccggtgaactgccgccggatctggaatacgaagaatttaacgaaattcgcgagcagcttgcggcgatgatcgaagaacagctcgctgtctacaaaaccagacaagcaccgctggatcttggcctcgtggtacgcgactatctggcgcagtatccgcgcgcgcgccacttcgatgttgcccgcattgttgtagaccaggcggtgcgcctgggcatcgcacaagccgatttcaccggactgccgccgaagtggcagccgattaacgattacggagccaaggtacaggcgcatgtcattgacaaatattga

SEQ ID NO: 1609 - DNA, 4464 bp, Enterobacter cloacae
cggggaggaagagtaatgattgaacgcggtaaatttcgctcactgacgctgattaactggaacggcttctttgcccgaaccttcgatctggatgaactggtgacaacgctctccggcggtaacggggcgggtaaatccaccaccatggcggccttcgtgacggcgctgatacctgacctgaccctgctgcacttccgtaacaccactgaagcgggcgccacgagcggctctcgtgataaaggtctgcacggtaagctgaaagcgggcgtttgttattcagtgctggacgtgatcaactcccgccatcagcgcgtggttgtaggcgtgcgtctgcaacaggttgccggccgcgatcgtaaagtagatatcaaaccgtttgcgatccaggggctgcctacctccgtacagccaaccgcgctgctgacggaaaccctgaatgaacgtcaggcgcgcgtcctgacgctccaggagctgaaagacaagctggaagccatcgaaggcgtacagtttaagcagtttaattccattaccgactaccactctctgatgttcgatctcggcgtggtagcccgtcgtctgcgcagcgcgtcagatcgtagtaaatactaccgtctgattgaagcctccctgtacggcggtatctccagcgccattacccgctccctgcgcgactacctgttgccggaaaacagcggcgtgcgtaaggccttccaggatatggaagccgcgctgcgtgaaaaccgcatgacgctggaagcgattcgcgttacgcagtctgaccgggacctgtttaaacacctgatcagcgaagccaccaactacgtggcggcggactatatgcgccacgccaacgagcgccgtattcatctcgatcaggcgctggagtatcgccgcgagctgtttacctcccgcaaacagctggtggccgagcagtataagcatgtcgaaatggcgcgcgaactgggcgagcacaatggtgctgaaggggatctggaagccgattaccaggcggccagcgatcatctgaatctggtgcagaccgcgctgcgtcagcaggaaaaaatcgagcgctacgaagccgatcttgatgagctgcaaattcgtcttgaagagcaaaatgaagtggtggccgaagctgccgaattgcaggaagagaacgaagcccgcgcggaagccgccgagctggaagtggatgagctgaaaagccagctcgctgactaccagcaggcgctggacgtgcagcagacgcgtgcgattcagtacaaccaggcgttgcaggcgttgcagcgtgccaaagagctgtgccatctgccggacctgaccccggaaagcgctgacgaatggctggataccttccaggccaaagagcaggaagccactgagaaactgctttctctcgatcagaaaatgagcgtggcgcaaacggcgcatagccagtttgagcaggcgtaccagctggtggtggcgattaacggtccgctggcgcgtaacgaagcgtgggacgttgcccgtgagctgctgcgcgacggcgtcaatcagcgccatctggccgagcaggtgcagccgctgcgcatgcgcctgaacgagctggaacagcgtctgcgtgaacagcaggaagccgagcgtctgctggcggaattctgcaagcgtcagggtaaaaattacgatttcgacgagcttgaggccctgcatcaggaactggaagcgcgtattgcggccctgtccgataccgtatcgaatgccagcgaacagcgcatgacgttgcgtcaggagctggaacagcttcagtcccgttcgaagacgctcttacagcgtgcgccgatctggctggctgcacaaagcagcctgaaccagctcagcgaacagtgtggccaggagtttgcctccagccaggacgtcaccgaatacatgcaacagctgctggagcgtgagcgtgaagcgattgttgagcgtgacgaagtgggcgcgcgcaagcgtgacgtcgatgaagaaatcgagcgtttaagccagcctggcggctcagaagatccgcgtctgaatgccttagccgagcgtttcggcggcgtgctgttgtctgaaatttacgacgatgttggtctggacgatgcgccgtatttctccgcgctgtacggtccatcccgtaacgcgattgtggtgccggatctgtcgctgatttctgaccagcttgcagggctggaagactgcccggaagatctctacctcatcgaaggagatccgcagtcgtttgatgacagcgtattcagcgttgacgagctggaaaaagcggtggtggtgaaaatcgccgatcgccagtggcgctattcgcgcttcccggaactgccgctgtttggccgcgccgcgcgtgaaagccgcattgaaagcctgcatgccgagcgcgaaacgctttctgaacgttttgcgaccctctcgtttgatgtacaaaaaacgcagcgtctgcatcaggcgttcagccgctttatcggcagccatctgggcgtggcctttgagcccgatccggaagccgaaattcgcaagctcaacacccgccgcggtgagctggagcgtgcgctggctagccatgaaaatgacaaccagcagagccgcgtccagttcgagcaggcgaaagagggcgttgcggcgcttaaccgcattctgccgcgcctgaacctgctggcggacgatacgctcgccgaccgcgtggatgaaattcaggaacgactggacgaggcgcaggaagccgcgcgctttgtgcagcagcacggcaatcagctggcgaagctggagccgatggtttccgttctccagagcgacccggaacagtttgaacagttaaaagaggattacgcctggtcacagcaggtgcagcgcgaagcgcgtcagcaggcgtttgccctgacggaagtggtgcaacgtcgtgcgcacttcggctactccgattcagcagaaatgctgagcgggaacagcgatcttaatgaaaagctgcgccagcgccttgagcaggcggaagcggaacgtacgcgcgcgcgcgaagcgatgcgtactcacgccgcacagctgagccagtacagtcaggtgatggcgtcgttgaaaagctccttcgacaccaagaaagagctgttaaacgacctgcataaagagttgcaggacattggcgtgcgcgccgacagcggtgcagaagagcgggcacgtattcgccgcgatgagctgcatgctcagctcagcaacaaccgtgcgcgtcgtaatcagctggaaaaagcgctgaccttctgtgaagcggagatggacaacctgacgcgtcgcctgcgcaagctggaacgtgactatcacgagatgcgcgagcaggttgtgaccgcgaaggcgggctggtgcgcggtgatgcgcatggtgaaagacaacaacgtggagcgtcgtctgcaccgccgcgagctggcgtatctgtcggccgatgaactgcgttctatgtcggataaggcgctgggcgcgctgcgtctggcggtggcggataacgaacacctgcgcgacgtgctgcgcatgtccgaagatccgaagcgtcctgagcgcaaaatccagttcttcgtggcggtgtatcagcacttgcgcgagcgtatccgtcaggacatcatccgtaccgacgatccggttgaagcgatcgaacagatggagatcgagctgggccgtctgacggaagagctgacctcccgcgagcaaaagctggcaatcagctcccgcagcgtggcgaatattattcgtaaaaccattcagcgcgagcagaaccgtatccgtcagctgaaccagggcctgcaaagcgtgtcgtttggccaggtcaacagcgtgaggctgaacgtgaacgtgcgtgaggcgcactccacgctgctggacgtgttgtctgaacagcatgagcagcaccaggatctgttcaacagtaaccgcctgaccttctccgaagcgctggcgaagctgtatcagcgtctgaatccgcagattgacatgggccagcgtacgccgcaaaccatcggcgaggagctgctggactaccgcaactatctggaaatggaagttgaggttaaccgtggctcagacggctggctgcgcgcggaatccggtgcgctctctaccggtgaagccatcggtaccggtatgtcgattctggtgatggtggtgcagagctgggaagatgaagcgcgccgtctgcgcggcaaagacatctctccatgtcgtctgctgttcctcgatgaagccgcgcgtctcgacgcccgctccatcgccacgctgtttgagctttgcgagcgactcgatatgcagctcatcatcgcggcgccggaaaacatcagtccggaaaaagggacaacctataagctggtgcgtaaggtgttccagaacagtgaacacgtgcacgtcgtgggcctgcgtggtttcgccccgcagccaccggagtcattaccgggcacggctgacgcctcttaa

SEQ ID NO: 1610 - DNA, 582 bp, Enterobacter cloacae
caatttcttttacctgtagacctgattatcatggacaaatttgacgctaatcgccgcaaattgctggcgttaggtggcgttgcgctgggcgcagcagccatccttccgacgccagcatttgccaccctctcgacacctcgtccgcgtattttaacgctcaacaatctgcatactggtgagacgcttaaagcggaatttttcgatggcagaggctatattcaggatgaattagcaagactcaaccattttttccgtgatttccgcgcgaataaaatcaaagccatcgaccctggattattcgatcagctttaccgcttgcagggactgctggggaccaaaaggccggtgcagctcatctctggctatcgctctctggataccaacaatgaactgcgtgcccacagccgtggggtagcgaaaaaaagctatcacaccaaagggcaggcgatggatttccatattgagggcgtttcgttagccaatattcgcaaagcggcgttatctatgcgcgcaggtggtgtaggatactacccacgtagcaactttgtgcatattgataccgggccggttcggcactggtaa

SEQ ID NO: 1611 - DNA, 801 bp, Enterobacter cloacae
accaggcggtgcgcctgggcatcgcacaagccgatttcaccggactgccgccgaagtggcagccgattaacgattacggagccaaggtacaggcgcatgtcattgacaaatattgaacaagtgatgccagttaagctggcacaggcgctggcgaatccgttgtttccggcgctggacagccagctgcgtgccggtcgtcacattggccttgacgagctggataatcacgcctttttgatggactttcaggagtacctggaagagttttacgctcgctataacgttgagctgatccgcgcgccggaagggtttttctacctgcgtccgcgctctaccacgcttattccgcgctcggtgctttccgaactggatatgatggtcggcaaaattctctgctacctctatctcagcccggaacgtctggcgaatgaagggatcttcacccagcaggagctttacgatgagctgctgtcgctggcggatgaaagcaagctgctcaagctggtgaataaccgctcaacggggtccgatctggaccgtcagaaattacaggaaaaagttcgctcatcccttaaccgtctgcgccgtctgggaatggtctggttcatgggtcacgacagcagcaagttccgcatcaccgaatcggtcttccgttttggcgccgacgtgcgtgcgggtgatgatgcgcgtgaagcgcagctgcgcatgatccgtgacggtgaagcgatgccggtggaaaaccatttgcagctcaatgacgagcacgaagagaatcagccggatagcggggaggaagagtaa

SEQ ID NO: 1612 - DNA, 225 bp, Enterobacter cloacae
tcagcgaagccaccaactacgtggcggcggactatatgcgccacgccaacgagcgccgtattcatctcgatcaggcgctggagtatcgccgcgagctgtttacctcccgcaaacagctggtggccgagcagtataagcatgtcgaaatggcgcgcgaactgggcgagcacaatggtgctgaaggggatctggaagccgattaccaggcggccagcgatcatctga

SEQ ID NO: 1613 - DNA, 330 bp, Enterobacter cloacae
tggtggtgcagagctgggaagatgaagcgcgccgtctgcgcggcaaagacatctctccatgtcgtctgctgttcctcgatgaagccgcgcgtctcgacgcccgctccatcgccacgctgtttgagctttgcgagcgactcgatatgcagctcatcatcgcggcgccggaaaacatcagtccggaaaaagggacaacctataagctggtgcgtaaggtgttccagaacagtgaacacgtgcacgtcgtgggcctgcgtggtttcgccccgcagccaccggagtcattaccgggcacggctgacgcctcttaacctggggtgcgacaaatag

SEQ ID NO: 1614 - DNA, 1908 bp, Enterobacter cloacae
ggcaaggcagcagcgtgtatgcctttctatactgaaggaaagctccagaatactgggcatgtcgtgaaaaacagggggcaagggatgttgcttaagaagaatcgtggtcgtcagctgtctgcgctgagtttgtgcctgacagtgatgtttgctccactgtttaccgctcaggccgatgagcctgaaattgtaccgactgacagctccgcgacgatgggcgcgcagccgacgtcgctgtcacaaccgctggatcagtctccggcgacggccatcatggccggcattaaaccactgccggaaggcatcgatactggatcattacgtcagcagcttatgaccgggctgccctcgggctatactcccgcttatattaaccagctcacgctgctttacgctgcgcgcgatatgaaaccgatgtgggaaaatcgcgaggcggtacgtgccttccagcagcagctggctgaagtggcgattgcaggttttcagccgcagttcacgacctgggttgaactcctgaccgatcctgccgtgaccggacaagcgcgtgacgtggtgctgtctgatgccatgatgggctacttacaatttgttgcggggatttcggtgaacggcaaccgctggttatacagcagtaagccgtacaagctggcgacgcctgcgctgtccgtcattaaccagtggcagctgtcgctggataacggcgaactgccgcgctttatcgcaagccttgcgcctgcccatccgcagtatgccacgatgcatcagtcgcttcttgagctggttgcggattcccgcccgtggcctcagctacgcggcaccacaacgctgcgtccggggcagtggagcagcgatgtgcctgcgatccgcgaaattatgaaacgctccggcattctcgacagcggccctaaaattgcactgcccggtgacgagacgcaaaatgcggtcgtcagcccgtcggcgccggtaaaagagaaaaccgccgttgcgttgagcaataagcccgccgcttacgatcgcgagctggtcgccgcagtgaagcagttccaggccgcgcaggggctgggcgctgacggcgtgattggtccatctactcgcgactggctgaacgtctctccggcccagcgggctggagtgctggcgttgaatatccagcgcttgcgcttgctgccgggcacgttatccaccggcattatggtcaacattccggcgtactccctggtctactatcaggacggtagtgaagtactggcgtcccgcgtgattgtcggccgacctgaccgtaaaacgccaatgatgagcagcgcgctgaataacgtggtggttaacccgccgtggaacgtgccgccgacgctggcgcgcaaagatattctgcctaaggtctggaatgacccgggttatctggagcgacataactatacggtgatgcgtggctggaacagcaaagaagcgattgacccctggatggtggactggtcaacgattacgccttcgaacctgccgttccgtttccagcaggcaccgggcgcacataactcgctgggacgttacaaattcaatatgccaagttcggacgcaatctatctgcatgataccccgaaccataatttgttccagaaagacgcacgcgcgctcagctcgggctgtgtccgcgtgaacaaggcctctgagctggcaaatatgctgttgcaggatgcaggctggaacgatacgcggatatcagatgcgctgaagcagggagatacgcgttacgtcaatatccgccacaatattccggtcaatctttactatctgacggcgtttgtaggggcagacggacgtacccagtatcgtacagatatttacaattatgatctgacagcgcgatccggcgcacaaattttgccaaaagcggaacaattaatcaggtaa

SEQ ID NO: 1615 - DNA, 693 bp, Enterobacter cloacae
taccgggccggttcggcactggtaataacgaaacacaggagcagtatgaactatcgtattattccggttaccgcgttctcacagaactgttcattgatctggtgtgaacaaactaaactggccgcgcttgttgatcccggtggcgacgctgagacaatcaagcaggaagtcgctgccagcggtgtaacgctgatgcagattttactcacccatggccatctcgaccatgtgggtgcagcggctgaactggctgaacactacggtgtgccgattatcggcccggaaaaagaagatgagttctggctacagggattacctgctcaaagccgtatgtttggcctggaagactgtcagccactgacaccggaccgctggctgaacgaagacgatcgcgttaacgtagggaatgtaactttacaggtgttgcattgccccggacatacgcccggccatattgtcttctttgatgacgtgtcgcgtctgctgatttccggtgacgtgattttcaaagggggcgtaggacgcagtgatttcccacgcggcgatcacggtcagctgattcagtcgattaagcagaagttattaccgttaggtgatgatgtgacgtttatccctggacacggaccaatgtcaacgctgggggatgagcggttgcataacccgttccttcaggatgaaatgcctgtctggtaa

SEQ ID NO: 1616 - DNA, 1218 bp, Enterobacter cloacae
ggatgcaggttacagcaccgcgacaatggcttcgcacagcggcgccatgttgtcaggcgtcatacctgcaacgttcacgcggccagatgcaacggcatacacgccaaactcttcacgcaggcgcagcacctgctctttggtcaggccgctgaaggagaacatgccgttctgcttgatgatgaagctgaagtcacggtcagcgcctttctcagccagcgtgttcacaaacagcagacgcatgcgctgaatgcgctgacgcatatcgttcagctcttgctcccagatggcgcgcagcgcatcgttgctcaggatcgtcgcgaccacagacgcaccgtgtgccggtgggttggagtagttagcgcggatcacggacttcatctggctgaatgcgcgatcgacggttgcttcgtcagcagccaccagcgtacaggcgccgacacgctcgttatacagaccaaagttcttggaataggagcttgcgactatcaactcttgatgcacggcggcgaatgcgcgcagaccttctgcatcttcttccagaccacgggcaaagccctggtaagcgaagtcaaacagcggcagccagcctttttcaacggacagcttagccagctgttcccactgctcaagcgtaggatcgataccggttgggttatggcagcagccgtggaacagcaccacatcgcccgcctgggcttcgctcaggctggccagcaggccgtcgaaatccagcgcgtggctggctgcgtcgtagtaggcgtattcacgcacttccagacccgcagaattaaacacgctcttatggttcggccagcttggattgcttacccacacacgcttcacagaagtgtttttcgccaggaaatctgccgccacgcgcagtgcgccggtaccgcctggggtctgcgccgtgcgggcgcgtttttcgctcacaatggtgctgcctttgccgaacagcagctcctgggtgcagcgaccaaattcagggataccatcaataccgaggtagtttttggtggtttcgttttccagcagatactgctcagcttttttgacgctggtcagtaccggagttttgccggtttcatctttatatacaccaatacccaggttgatttttccagggcggtcgtcggcgcgaaacagatcggccaggcccagaattgggtcggcaggagcggcagtaatgttctcaaacatgacgaagttccattgtga

SEQ ID NO: 1617 - DNA, 1392 bp, Enterobacter cloacae
gacatgaagccgggctatcacgagatttattcccgctatcgcgacaacatcatgcgcggcgtgctgaagccgggcgacagggtacctgccatccgcctgctggcggaagagctgaaggtggcgcgcaaaaccgtcgagacggcgtatgccattctgacgggcgaagggtatctggtgagccagggcgcgcgcgggacgcgggtgaatccggatcttctgctgcccgcgcaaaacgcccccacagaacaagcgaccggcacgctgccggcgtcgttgattagccaacgcgaacgggccggttttctgcgccccggcattcccgccctcgacagcttcccctataaaaaatggctgctgctggcgggccaggcgacgcgcgccatgcgtcaggatgaaatgctcaacccgcccgttctgggctggtatccgctgcgcgaggcgatagcccgctatctcaatatctcgcgcgggttatcctgcactgcggaacaggtaatgatcaccagcggctacagcggcagcctgcgcctgatcctcgacacgcttgccagccgcagcgataaggtggtatttgaggatccaggctactttatgggccagcagttgctcaagcgcattgtgccccgcctgcacaccgtgccggtcgatcgcgcagggatggatacggactacctgctgcgtaatcatcacgatgcccgcttcgccatcgttactccgtcgcaccagagcccgctggcggtgacgctctccctgccgcgcaagcagcagttgctcgactgggcgtcacaaaacgaggcgtggattatcgaagatgattatgacggcgaatttcactacacccgcaaagtgctgccgtcgctgaaaagcctcgaccagcacgacagggtgatctttatgggcaccttcagcaaaaccatcatgccatcgctgcgcatgggctacgtggtgatgcccgccagcaccgtcggcgtgtttaccgacagcgcggacatcctcaccagcggccagccggtgctgacgcaaaagatcctcaccgcgtttctcaacgaagggcattttttccgtcatctgaaaaagatgcgcgcgctctatcagacccgccgcgactggatgattgccgccctgcgtgaggtctatggcgatctgtttttcaccgagcaaaacgacggcgggatgcatattgtcgcgttcctcgcaaagggaagcgctgaccgggagatcgcccgctgctggcaggaacagcaattgcaggtcaatgcgctttcggggtggtatcacggatcaggaaaacgctacgggctggtgatgggctataacaatgtgcggtcgtatcaggaggcgctggatttgctggaaaggccgaaacggcagacgctggaactgttgagctga

SEQ ID NO: 1618 - DNA, 1586 bp, Enterobacter cloacae
tgctctcctcgctatgccagtggggttatcatcatggaaaacggccagtacaatacagattcaaaaactgcttttgtttaccatacagatccgctaaaacggtatctgcatggtggtttattcatccatctgtactggtttaatgctctgtatggtgaaaacaaaggatacagcatgacgcgctatcaacatctggccaacctcctggcggaacgcattgaacaagggctgtatcgcagcggcgaacgtctgccgtcggtacgcacgctgagccaggagcacggcgtgagcatcagcaccatacagcaggcctaccagatcctcgaaaacctccagctgatcacgcctcagccgcgctccggctatttcgtctcgaaacgcaaagcccagccgcccgtcccggcgatgacccgtccggtacagcgcccggtggacgttacccagtgggatgaggtgatgatgctgctggacgcccgcgccgacaaagagatgatctcctttggcggcggctcgccggacattaaccagccgagcctgaagcccctgtggcgcgagatgagccgcatcgcgcagcataaccccggcgagatgctgagctatgacgtgctcgacgggcgcctggagctgcgcgagcaaatcgcccgcctgatgctggacggcggctccaccgtcgcggcaaacgaaattgtcattaccaacggctgccacggcgcgctgtcgatcgccctgctctcggtgtgcaaaccgggggatatcgtggcggtggaatcgccgtcgtttcacggcaccatgcagatgctgcgcggctttgacatcaaggccattgaaattcccaccgatcctgaaaccgggatcagcatcgaagcgttggagctggcgctggagcagtggccgatcaaggcggtgatcctggtgccaaactgcaataacccgctcgggtttatcatgccggaggcgcggaagaagcaggtcttagccctggcacagcggcacgatatcgtgattgttgaggatgatatctacggcgagctggcggcggagtatccgcgtccgcgcaccattcattctatggatattgatggtcgcgtgctgttatgcagttcgtttaccaagaccgtggcgccgggcctgcgcgtcggctggattgtgccggggcgctattacgatcgggtgatgcacatgaagtacgccgcgggcgggtttaacgtgccgggcacgcagatggcggtggcggcgtttatccgcgacggccattaccatcgccacgtgcggcgtatgcgccagatttatcagcagaatatggagacctacacctgctgggtgcggcagtattttccggcagagatatgcgtcacccgcccgcagggcagcttcctgctgtgggttgagctgccggagacggtcgatatggtgtgcgtcagcaagcagctgtgccggctgaagatccaggccgcggccgggtcgctgttttccgcctccgggaagtaccgcaactgcctgcggatcaacgtagcgctgccgccgacagacaaaaatcgcgaggcattaaaaaagatgtctacacgccggggaggagtaccgcgtct

SEQ ID NO: 1619 - DNA, 1275 bp, Enterobacter cloacae
cccatggaaaagcataccgaactcaaacgcgccaagcttctcgcgctgtcgctgctgctgattgccgtcgcagcgtttatcaccaccctgttcatgccgcaaaccttctgggtgcgcggcgtaaaggccattgccgaggcggcgatggttggcgcgctggcggactggtttgccgttgtcgcgctgttccgccgggtgcccattccctttatctcgcgccatacggcgattatcccgcgcaataaagaccgcatcggcgacaatctcggccagttcgtgcaggaaaagtttctcgatacgcaatcccttgtcgatcttatccgtcgctacgagcccgcacagatgattgggacctggttcagccagcccgataacgcccggcgcgtggggcagcatctggtgcaggtgatgggcggttttctggaacttaccgacgatgggcgcatccagcgcctgctcaaacgcgcggtgcataaggctatcgacaaggtcgatttaaccgagaccagcgccgtcatgctggaaagcatgaccaaaaacaaccgtcaccaggtgctgctggacgccatcataaaccgcctgattaccctgattcagcgggaaagcacgcgggaatttattgctgaccagatcgttcactggcttaagaccgagcatccgcgcaaggccatggtgctgcccaccgagtggctgggcgatcaaagcgcggagatggtgtcgaacgcggtgaacacgctgctggacgatatcagccacgaccgtacgcaccagatccgtcaggcgtttgaccgcgccacgatcaagttcatcgacaatctgaaaaacgatccggagatgacggcgaaagccgagaatatcaaacactacctcaagaatgatgaggcctttaaccgctatctgggggaaatgtgggctgacctgcgccagtggctgaaaaatgacatgcagagcgatgattcccgcgtgaagcagcgtatcgccaacgccgggctgtggtttggcgaaacgctgaccaacgacgccagcctgcgggcgtcgctgaatgagcatctggagcaggccgcgcaccgcgtggcgccggatttcgccgcgttcctgacgcgccatatcagcgacacggtgaaaagctgggatgccaaagacatgtcacgccagatagaactcaatatcggtaaagatcttcagttcattcgcgttaacggtaccctggtgggcggtacgattggcctgatcctgtttctgctctcgcagctacccgccgtgctggggcattaa

SEQ ID NO: 1620 - DNA, 528 bp, Enterobacter cloacae
ggcaccagaatgcgcgtcccggccacgcacgcctgcccgctgttcataaacccggcctggatcacctgcgggatcgcctgctcgagatccacatcatccagcaggatcgtcggcgatttaccgcccaactccagcgttacgcgcttaaagctttccgccgcgttgcgcaggatcgccttgccggtattcgtggaaccggtgaacgagattttcgcgacgtccggatggcggctgagggtttcgcccaccgtctcgccgcgtccggtgacgatgttaaacacgcccggcggcagcgcggcgtcgcgcagcgcttcggtgacaatctgcgtttgcagggcgctcatttcgctcggcttgatgaccgccgtgcagcccgccgccagcgcggccgccagtttgccgcagataaaccccgcatcgctgttccacggcgtaatcagcccggccacgccgagcggcgtcatctgcaccgttgcggcacctgcggaggtgacaaactcaaatgcctccagcgcctcgatggcctga

SEQ ID NO: 1621 - DNA, 906 bp, Enterobacter cloacae
tctatgcatcgttcaggtctgacagagctggaagtggtgatggcggtggtgcggcgcggcagctttcgcggcgcggcgcaggaactggggatgtccgccacggcggtcagcaacgccatcgccgggctggagagccgccttgagacgcggcttttcaaccgcaccacccgcagcgtggcgctcaccgacgccggacagcgctacgtggcgcgtatcggcccggcgctacaggagatccgcctcgccggggaggagatccacagcgacaccggggaacccgccggaacgctgcgcctcgacgtgccgaaccatatcggcaccctgtttctggaccagctgctgatcgacttcatgatccgctacccgaaaatgcgcgtggaaacggtgagcgaagcgaggatgatcgacatcgtcgccgaaggctatgacgcggggatccgcctcgaagagtccgttccgcaggacatgatcgccgtgccgctgaccggtgagatccgccagctcgtcaccgccacgccggactatttcgcccgtcacggcatacccgagacgccggacgatctgctttcacatcaggggatcggcatgcgcatggcccacggcgggatctaccgctgggagctggcgcgtcggggggaaacgtacgcccttgccgtaccaccgcgctttgcgacgtccgatctttttgcctcgatccgcgccgtaaaggcgggattaggggtaggatttttgccggaactgtatattcaggacgagctgaaaagcggggagctggtgagcgtcttaaacgactgggcgcagccgtttgccgggctgcgcctgtactaccccggccatcgccacgtcccgccggggttgcgggcgctggtggcgatgatccgcgagcgcgggattattccaggttag

SEQ ID NO: 1622 - DNA, 1050 bp, Enterobacter cloacae
cccgcgcgagatattgagatagcgggctatcgcctcgcgcagcggataccagcccagaacgggcgggttgagcatttcatcctgacgcatggcgcgcgtcgcctggcccgccagcagcagccattttttataggggaagctgtcgagggcgggaatgccggggcgcagaaaaccggcccgttcgcgttggctaatcaacgacgccggcagcgtgccggtcgcttgttctgtgggggcgttttgcgcgggcagcagaagatccggattcacccgcgtcccgcgcgcgccctggctcaccagatacccttcgcccgtcagaatggcatacgccgtctcgacggttttgcgcgccaccttcagctcttccgccagcaggcggatggcaggtaccctgtcgcccggcttcagcacgccgcgcatgatgttgtcgcgatagcgggaataaatctcgtgatagcccggcttcatgtcctacctaatttcacgctttttgtatctttttactatgtcatgaacggcgtagatttgcttcatcgcatgacacatgccgcacaaaaaagaggaaagacaatgagcactcgcgtaaaccaccacaaagccacacctgcactcaccaacgcgctttccgccctgagcatggaagtggcgaaaacctctattgatccggcgctgaagcacctgatcgacattcgcgtgtcgcagctgaacggctgtacgttctgtctcgatatgcactcaaaagaggcgaaaatcgccggcgagcgcgagctgcgcctgtaccatctggcggcctggcgcgagtccccgctgttcagcgcccgtgaaaaagcggcgctggccttcaccgaagcgctgacccaaatcggcgttcacggcgtgagcgatgcgctgtaccgcagcgtggcggagcacttctcggacgtggagatttcagagctgaacttcgccatcgtggcgatcaacgcctggaaccgcctgggcattacctcccgcatggagccgggctcgctggatgcggcgtacgggctgaacaaggctaacctggaataa

SEQ ID NO: 1623 - DNA, 495 bp, Enterobacter cloacae
tggcgtactacgagagggctccccatgagtgaagaagatctgtttagccgcaggccgatgggcatgcggatggcgatgatcgtgcgtcagtggcgcgcagtcatcgacgacgccattctcgacaccgggttaacccagtcgagctggacggtgatgatgcagcttcatcaactcggggataacgtctcggtcagcgagctggcggaagtgcagggcattgaactgcctcccctaatgcgcacgctgacacagctggaaaagcagggctacctgctgcgcaccgtctcgccgtatgacaagcgtatccggctgctgacgctgacgcctgagggaaaagccattcttgaaaggctctctcaggtgattgagacgttccaggcgcgcgtatcgcaaaacatcgcgccggaacatatcgatattttcagcgccactctcaatcaaatcgcctgcaatttgcggacaatccgcgaagaagataataagaccgaaaaataa

SEQ ID NO: 1624 - DNA, 744 bp, Enterobacter cloacae
cggatgatgataagctggccgctgagatcaccacaccctgggcgacgaatgttaaagacgagcttaccctctgataacagcgcgatgctggaaaaggcgattgccgcggtggcggctgcaatggccgatccgtcgcgcgtgaagatgctttgtgcgctaatggacgggcgtgcgtggacggccactgaactgagtgcggcggcagacgttgcgccgtcgaccgccagcgggcatcttgcccggctggttgaagggcagctaattacctgcctgtcgcaagggcggcatcgttattatcgtcttgccgggcacgacgtggcggcgctggtggaacagatgatggggctttcgtggagccgcattaccccgccggaaaccagcgcgccgaaagccatgcgtgaagcccggacctgctacgaccatctcgcaggcgcggtggcggtgcagatctatgatttcatgcaggcggaaggctggctggaggctgacggttccgcattgaccctgtatggtcgggagcagttcctggcgctcggtattccgttaagcgctcatccgcgtcggaaggcctgctgcgcctgcctggactggagcgagcggcggtttcatcttggcggtgaggcgggcgctgcgctgcttatccacatggaaagcaaaggctggatccagcgggtggcgggttatcgggaggtggtggtgacggcttcggggaaaagtgccgtcaggaagcattttagccgctaa

SEQ ID NO: 1625 - DNA, 189 bp, Enterobacter cloacae
ccccactggcatagcgaggagagcatcatggaattctacgagaatcgttcaaaacgtccgtttatcgcgtttgtctgggtagcgaaaacgctgcgtaactggtatcgcatcaaccgtacccgccgtattctgagccagatgagcgacgagcagctcaaggacgtcgggttatcgcgatatgatgtgtga

SEQ ID NO: 1626 - DNA, 1449 bp, Enterobacter cloacae
cagactgggctcacacagcctgaggaggtttatatgcacaccattgaacagatctttattaacggcgagtttgttaccccgcacggtaccgaacggtttgatttgtacaatccggcgacggcgcaggtcatcggccaggttcgcctggcggatgaggttgacgctgaacgcgctatcgcggcggcgaaagcggcgtttccggcgtggtcgcagaccacaaagcaggaacgcatcgccgcgctgaagcgcatgcacgccgccgtggccgctcgtcacgacgctctgctggaagcggtcattgaagagtacggcgcgcccgcctcgcgctcggcgtggatggcaagctatccggcagaggtgattgctcaggccatcgaggcgctggaggcatttgagtttgtcacctccgcaggtgccgcaacggtgcagatgacgccgctcggcgtggccgggctgattacgccgtggaacagcgatgcggggtttatctgcggcaaactggcggccgcgctggcggcgggctgcacggcggtcatcaagccgagcgaaatgagcgccctgcaaacgcagattgtcaccgaagcgctgcgcgacgccgcgctgccgccgggcgtgtttaacatcgtcaccggacgcggcgagacggtgggcgaaaccctcagccgccatccggacgtcgcgaaaatctcgttcaccggttccacgaataccggcaaggcgatcctgcgcaacgcggcggaaagctttaagcgcgtaacgctggagttgggcggtaaatcgccgacgatcctgctggatgatgtggatctcgagcaggcgatcccgcaggtgatccaggccgggtttatgaacagcgggcaggcgtgcgtggccgggacgcgcattctggtgccttactcgcgcaaggcggagatcgaaaccgcgctggcgcaggccgtggcggcggtgaaatccggcgacccgcgcaacagcacgacagacgtcggcccgatggtcagcgaaaagcagtggctgcgggtgcagggctatatccgcaaaggaatcgaagaaggggcgcgcctgctggcgggcggcgaagggcgaccggaaggcacgcgggacggctggtttgtgcgtccgacgctgtttgccggcgtgaacaatcggatgaccattgcccgcgacgagattttcggcccggtgctgtgcgtaatcccttatcaggacgaggcggaggcgattgccattgccaacgataccgagtacggcctgagcgcgatggtgctgggcggcgatgtggaccgcgcgcgacgcgtggcacagcagattgtttccggtcgcgtgctggtgaacaccctggctcatgaaccgaaagcgccgtttggcgggtttaagcactccggcgtggggcgcgagatgggcgagtgggggatccgcgcgtttatggagccgaggtcggttctgggctaa

SEQ ID NO: 1627 - DNA, 399 bp, Enterobacter cloacae
agcttcgctctttaccgaagcattgtgcttttccatcctgcattctctcctcaacatcacagcggagagaccatcatgatcgcagtccttttcgaagccaaagccgcgcctgcccatcaggcgcgctacctccaacttgccgcagagcttaagcctttgctggccgacatcgacggctttatcgatatcgaacggttccagagcctgacgaccgacggcaaaatcctctccctttcctggtggcgggatgaagaggccgtccgccgctggaagcagaacgtctttcatcaggcggcgcaggccgaaggacgggcgttgattttctctttctaccgtattcgcgtggcgcagctggtgcgggaatacagttccgaaaccggagggcacgcggatgtatga

SEQ ID NO: 1628 - DNA, 1077 bp, Enterobacter cloacae
gaccgaaaaataatgactcctgaacaaaagtttgcccgctgggtaagggtgagtattgcctctttcctgctgatgtttgtttactttatcgtcgcggatatctggatcccgctgacgccggactccaccgtgatgcgcgtggtgaccccggtgtctgcccgcgtctccgggtatgtggcggcggtacatgtccataacaatagccaggttaagaaaggcgatctgctgtttgagctcgacgccacgccgtttcgcaataaggtcgaggcggcgcagatcgcgctggaacaggcgcgtctgtctaacgatcagctggatgcgcagattgccgcagcgcaggccagcctgaaaaccgccgtgctgaccgcgcgtaacgacaaagtgacattcgaccgctaccagaaactgagcaccttgcagaacgtatcgcaggcggatctggataaggtccgtaccacctggcagagcagcgagcagtccgtcagctcgatccaggcgaatattcataacctgcgcattcagcgcggcgagcgggatgagcaccgtaacgtgacgctgcaaaaataccgtaacgcgctggatgaagcggagctgaatcttggctggacgaaggtctacgccgaggcggacggcacggtcagtaacctgcaattaagccccggtttttacgcctcatccggttcggctgcgctggcgctggtgaacacccggatcgatatcgtggcggatttccgcgagaagagcctgcgtcatacccatcaggggaccgacgctgccgtggtgtttgacgccttcccggggcacgttttccgtgcccacgttaccagcagcgacgcggggatcctcgccggacaggaagccgtaaacggtcaactttctgaaccggaaacctccaaccgctgggtgcgtgatgcccagcgtatgcgcattcacgtagcgctggacgaagccttaccgaagccgctgccgaccggcgcgcgcgccaccgtgcagctctacaacagcgaagggccgtttgcgcgattcttctccgggatgcaaatccatctggtgagcctgcttcactatgtctattag

SEQ ID NO: 1629 - DNA, 948 bp, Enterobacter cloacae
aaaaggccacaaaataatgaggaaagcagaatgacgatgattaaggggataacagggtcggcggtgcttctggcggcgctgagcctgccgttacaggccgcagagccggttaaggtgggttccaaaattgataccgagggcgcgttgctcggcaatatcattttgcaggtactcgaaagccacggcgtgaaaacggtcaataaagtacagcttggcaccacgcctgtcgtgcgcggtgccatcacttccggcgagctggatatctacccggaatacaccggcaacggggcattcttcttcaaggatgaaaacgatccggcctggaaaaatgccaaagccgggtacgaaaaagtcaaaaagctggacgcagaaaaaaataagctggtctggctaacgccggcaccggccaacaacacctggaccatcgcggtgcgcaaagatatcgccgagaaaggcaagctcacctcgcttgacgatctcagccgctacctgaaagagaagggcgagtttaagctcgcggcctcggcagagtttatcgagcgcgctgatgccctgccagcgtttgaaaaagcctatgatttcaagctcgatcaggcacagctgctctctctggcaggcggcgacacggcagtgaccattaaggcggcggcgcagcaaacctccggcgtcaacgcggcgatggcctacggcacagacggcccggtcgcggcgcttggcctgcaaaccctgaccgacccgaaaggcgttcagcctatttacgccccaaccccggtcgtgcgcgaggcggtgctgaaagcctacccggatattgcggaatggctcaaaccggtatttgaaaaactggatgcgaaaacgctgcaacagctgaatgccagcattgccgttgaggggctggatgccaaaaaagtggctgccgacttcctgaaacaacaagggcttgtgaagtaa

SEQ ID NO: 1630 - DNA, 1170 bp, Enterobacter cloacae
cgggataaggctgtgccaataaaatgccataaccgcgtcctgctgctgttggcctgtgtggccatcgcggcggtcgcgttaccttttgtgaatgtcgcgccaaaccgtctggtgtcgggcgaaccgcgcgcgctctggcagatctgggcatttacgccgctgctgctgggcgcggcgctggcgagtactgttgctttagccttctggccggggcgaaccgccctgtggctgacgtttttgctcagcgaagcgctgtttatcgtactgttctggagcgcaggacaggcggcaacgcagatggccgcggttgaaagcccgctggcgcgcacgtcggttggtagcgggctgtggctgtggctggcactttgtctgctggtctgtagcgatgccattcgccgtctgacgccgcaacccgtctggcgctggctgctgaacgcgcaattctgggttatccctctgctgatcctcttcagcggcgatctgaatcagctctcgctgttaaaagagtacgtcaaccgccaggaggtatttgacaacgcgctggcgcaacatctgacgatcctgttcgggacgctgatcccggcgctgctgctgggcgtgccgctgggcatgtggtgctaccgacataccagccgccagggcgccgtctttaccgtgctcaacgttattcagaccatcccctccgtcgccctgtttggcctgctgattgcccccctcgccggtctggtgaaatccttccctgcgttggccgcggcaggcattgccggaaccgggctgacgccagcgctgattgcccttgtgctgtatgcgctgttgccgctggtgcgcggcgtggtggcggggttaagccaggttccgcccgacgtgctggaaagcgcccatgcgatggggatgagcgcgcgccagtgtttctggaaaatacagctgccgcttgcgcttccgctgctggttcgcagcctgcgggtggtaacagtgcaaaccgtggggatggcggtgattgccgcgctgatcggggcgggcggctttggagcactggtcttccaggggctgctcagtagcgcgctggatctggtgttgctgggcgtcgtgcccacaattgcgctggcggtcgtactggatgccctgtttgccctgtggctcgcgctgctcaggagaagagccaatgattga

SEQ ID NO: 1631 - DNA, 1104 bp, Enterobacter cloacae
tcggggcgggcggctttggagcactggtcttccaggggctgctcagtagcgcgctggatctggtgttgctgggcgtcgtgcccacaattgcgctggcggtcgtactggatgccctgtttgccctgtggctcgcgctgctcaggagaagagccaatgattgaatttcatgatgtgagtaaaacctttgcgggccgtccggcggcaagccaccttaatctgcattttgccgagggggcgttctcgatattgatcgggacatcggggtcgggaaaatccacgacgctgaagatgatcaatcggctggtggaacacgacagcgggacgattcgctttgccggagaggagatccgcagcctgccggtgctggagctgcggcggcgtatgggctacgccattcagtccatcggcctgtttccccactggacggtggcgcagaacattgccaccgtgccacagctggaaaaatggtcccgggggaagatcaatgagcgtgtcgacgaactgatggcgctgctgggcctggacgcgtcgcttcgtaaccgctatccgcaccagctttccggcggacagcagcagcgggtcggggtggcgcgcgcgctggccgctaacccgcaggtactgctgatggatgagcccttcggcgcactggatccggtcacccgcggcgcacttcaggccgagatgagccgcatccaccgtattctcgggcgcaccatcgtgctggtgacgcatgatatcgacgaagcactgcggctggccgatcgtctggtactgatggatcacggcgaagtcgtccagcagggtacgccgcttgagctgttaacctcgccggcgaatgattttgtgcgtgaattttttggccgcagcgagctgggcgtcaggctgctctcgctgcgcaccgtcagggactatctgcgtccgcaggatgcgcaaatcggtggtgaaccgctgcatgacgggatgagcctgcgcgatgccctgtcggcgtttgtcgcccggcagtgtgaggtgttacccgttgcggacgggcaggggacgccatgcgggacgatccattttcgcgatctgctggcgggggaggtgacgcgtgaagtgggtccgtga

SEQ ID NO: 1632 - DNA, 771 bp, Enterobacter cloacae
gccagaccgctatacccgaattaccttacgattgccgctggaggagaacgcatgttaagagtgctgattgttgatgatgagccgttagcacgggaaaacctgcgtgtcctgttgcaggagcagagtgatatcgaggttgtgggggaatgtgccaatgccattgaaggcatcggtgcggtgcataaactgcgccctgacgtgttgttcctcgatattcagatgccgcgcatcagcgggctggagatggtcggcatgctcgacccggagcaccgtccctatatcgtctttctgacggcctttgatgagtacgcggtaaaggcgtttgaagagcacgcgtttgattatctgctgaaaccgattgaagagaaacggcttgaaaagaccctgacccgtctgcgccaggagcgtaccgcgcaggacgtgacgctgctgccggagcatcagcagcccctgaagtttatcccctgtaccgggcacagccggatttacctcctgcaaatggacgacgttgcttttgtcagcagccgtctgagcggggtatacgtcaccagcgccgaaggcaacgaaggctttaccgagctgaccttgcgcacgctggagagccgcacgccgctgatccgctgccatcgtcagtatctggtgaatatggcgcacctgaaggagatccgcctggaagataacggccaggccgagctggtgttacgtgccgggcaaaccgttcccgtcagtcgtcgctacctgaaaagtttgaaagaggcgatagggctgtaa

SEQ ID NO: 1633 - DNA, 285 bp, Enterobacter cloacae
atacgcaacactaaccatctggtgtatcgcgataactggaatattcagttaaccaagaccggattcaccaatgcggcaggacactgcctggtgatgcgcaccgtatttaacggtaagccagtggcgctggtggtgatggacgccttcggcaaatatacccacttcgcggatgccagccgcctgcgtacctggattgaaaccgggaaagtgcatccggtgccggcttcagcgctggcgtataaaaagcacaaagcggaacagatggcgacggcgcagaacgattag

SEQ ID NO: 1634 - DNA, 2391 bp, Enterobacter cloacae
ccctgcaaggttttcaggctttgtggcacactgcgcttttcgcacggtctggccgggtgcttcccgcggttattgatgagagagaataacaacatgaaatggctatgttctgtaggtgtcgccgtcagcctggcgctgcaacctgcgctggcagaggatttgtttggtaatcacccgctcacgcccgaagcccgcgacgcctttgtcacggatttactcaaaaaaatgacggtcgatgagaaaatcggccagctgcgcctgatcagcgtcggcccggataacccgaaagaagccattcgcgagatgatcaaagacgggcaggtaggagccatttttaacaccgttacccgccaggatatccgcaagatgcaggatcaggtgatggagctgagccgcctgaaaatcccactgttcttcgcttatgacgtggtgcacggccagcgtaccgtcttcccgatcagcctcggcttagcctcctcctttaacctcgatgcggtgaaaaccgtcgggcgcgtatcggcatatgaagccgcagacgacggcctgaacatgacctgggcgccgatggttgacgtctcccgcgatccgcgctggggccgcgcttcggagggctttggagaagacacgtatttaaccgccacgatgggcaaaaccatggtggaagcgatgcagggcaaaagtccggcagatcgttactcggtgatgaccagcgtcaagcacttcgccgcctacggcgcggtggagggcggtaaagagtacaacaccgtcgacatgagcccgcagcgcctgtttaacgactacatgccgccatacaaggcagggctggacgcgggcagcggggcggtgatggtagcgctgaactctctcaacggcacgcctgccacctccgattcgtggctgctgaaagacgtgttgcgcgaccagtggggcttcaagggcatcaccgtttctgaccacggcgcgattaaagagctgatcaaacacggcacggcgtctgacccggaagatgcggtacgcgtggcgcttaagtccggcatcaacatgagcatgagcgacgagtactacagcaaatacctgccggggctggtgaagagcggcaaggtgacgatggcagagctggacgacgccgctcgccacgtgctgaacgtgaaatatgacatgggactgtttaacgatccttacagccatctggggccgaaggattcagacccggcggacaccaacgccgaaagccgtctgcaccgtaaagaagcccgggaagtagctcgcgaaagcctggtgctgttgaaaaaccgtctcgacacgctgccgctgaaaaaatccggcaccattgccgtggtcggtccgctggccgacagcaagcgcgacgtcatgggcagctggtccgccgcaggcgtggcggatcagtccgttaccgtgctgaccggcattaagagcgccgtgggtgataacgcaaaagtggtttacgccaaaggtgcgaacgtcaccgacgataaagacatcgtgaccttcctcaaccagtatgaggaagcggtgaaggtggatgcgcgcacgccgaaagagatgctcgacgaagcggttaacgccgcgaagcagtccgacgtggtggtcgccgtggtgggtgaagcgcaggggatggcgcacgaagcctccagccgtaccgatattaccattccgcagagccagcgcgatctgatcgcggccctgaaagccaccggcaagccgctggtgctggtgctgatgaacgggcgtccgctggcgctggtgaaagaagatcagcaggctgacgccattctggaaacctggttcgccggaaccgaaggcggtaacgccattgccgacgtgctgtttggcgattacaacccgtccggcaagctgccgatgtccttcccgcgctccgtcgggcagatcccggtttactacagccacctgaacaccggtcgtccgtataacgccgacaagccgaacaagtacacgtcccgttacttcgacgaagctaacggcccgctctatccgtttggctatggcctgagttacaccaccttcaaggtgtctgacgtcaaaatgtcggcgccgaccctgaagcgtgacggcaaagtgaccgccagcgtagaggtgaccaacagcggcaaacgcgaaggcgcgacggtgatccagatgtacgttcaggacgtcacggcctccatgagccgtccggtgaaacagctgcgcggcttcgaaaaggtcaacctgaaaccgggcgaaaccagaacggtcagcttcccgattgacgtaaatgcgctgaagttctggaatcagcagatgaaatacgatgctgagcctggcaaattcaacgtcttcatcggcgtggattccgcccgcgtgaacaaagccgagttcgaactgcaataa

SEQ ID NO: 1635 - DNA, 741 bp, Enterobacter cloacae
cgcgtgaagtgggtccgtgatccgttactctggctgacagggctgtttatcgccttactctacctgatgccgcacagcgcggcgctgtttaatgcgcttattcccgggctgccgcgcccggtataccagcaggagagctttgttaatctcaccctggcgcacttctggctggtggcggtgtcaagcgtgattgccatcgtcctgggcacaggcgccggtattgcggtgacgcggcctgcgggcagggagttccgtccgctggtggagaccatcgccgcaacggggcagaccttcccaccggtggccgtgctggcgattgccgtgccggcgatcggttttgggcaggagcctgccatcattgcgctgattttgtacggcgtgttgcccattctgcaagggacgctggcagggattgcggcggtgcctgcatcggcgctgagcgtagcggaaggaatggggatgagcgcctggcagcggctggtgaaggtcgaactgccgctggccgctccggtgattatcgctggcgtgcgaacgtccgtgataatcaacattggtacggcaaccatcgcctcgacggtcggagccaatacgctgggaacgccgatcattatcgggttaagcgggtttaatacggcttacattattcagggggcgattctggttgcgctggcggcaattgtggtggatcgcctgtttgaacgcctggccggatacctcagccaacaccgccgcgaacaataa

SEQ ID NO: 1636 - DNA, 1704 bp, Enterobacter cloacae
aatgtgcggtttgtgagtatgtacgagtttaatctggtgctgctgttgcttcagcagatgtgcgtgtttcttgtcatcgcctggttgatgagcaaaacgcgtctgttcattccgctgatgcaggtcaccgtccgtctgccgcacaaattcctctgctacgtcgtattttccatattctgcattatggggacctggtttggtctccatattgaggattccatcgccaatacgcgcgccatcggcgcggtaatgggcgggctgctcggaggcccggtcgtgggcggtctggtggggttaaccggcggcctgcaccgctattcgatgggcggtatgacggcgctaagctgcatgatctccaccatcgtcgaagggctgctcggtggtctcgtccacagctatatgattaagcgcggacgcccggataaagtgttcagtccctttaccgcaggggcgattaccttcgtggcggaaatggcgcagatggcgatcatcctgctgatcgcgcgcccgtttgacgatgcgttacatctggtcagcagcattgccgcaccgatgatggtcaccaataccgtaggtgcggcgctgtttatgcgcattctgctcgacaaacgcgccatgttcgaaaaatacacctcggcattttctgccaccgccttaaaagttgcggcgtcgacggaagggatcctgaggcagggattcaacgaggagaacagcatgaaggtggcgcaggtgctgtataaagagctggatatcggggccgtggcgattaccgatcgcgaaaagctgctggcgtttaccggcaccggcgacgaccaccatctgccgggcaaaccgatctcatcggcctataccctgcgcgctattgaaacgggtgaagtggtgtatgccgacggaaatgaagtgccgtaccgctgttccctgcatccgcagtgcaaactcggctctacgttggtcattcccctgcggggcgaaaatcagcgcgttatgggcaccattaagctttacgaagccaaaaaccgcctgttcagctccatcaaccgcacgctgggggaggggatcgcccagctgctttcggcgcaaatcctggcggggcagtatgaacggcaaaaagcgctgctgacgcagtcagaaattaagctcctgcacgctcaggtgaatccgcatttcctgtttaacgcgcttaatacgctgaaggcggtgatccgccgcgacagcgatcaggccgcgcagctggtgcaatttctgtcgacctttttccgcaaaaatttgaagcgtccctcggagatcgtcaccctcgcggacgagattgagcacgtaaacgcctatctgcaaattgaaaaagcgcgcttccagtcacgtttacaggtgtcgttatccgtcccggatgagctggcgtatcagcatcttccggcctttaccctgcaaccgattgtagagaacgccattaagcatgggacctcgcagctgctgggtaccggagaaatcatgatttccgcttcccgttttaaccaccatctggtgctggatatcgaagacaacgcggggctgtatgaagcttccgcgtcaggcggtctgggcatgagcctggtggataaacgcctgcgcgcgcattttggtgacgactgcggtatcaccgttgcctgtgagccagaccgctatacccgaattaccttacgattgccgctggaggagaacgcatgttaa

SEQ ID NO: 1637 - DNA, 525 bp, Enterobacter cloacae
ggctgtaaaactgatacactgcgcgccattgcatcatcgacattcgaaggctctatgctaagtaacgatattcttcgtagcctgcgctacaccctgaaagcgaacaataatgacatggtgcgcattcttgcgctctccgacatggaatccacgtccgccgggttcgacacctggatgactaaagaagatgaagagggttttgttcgctgcccggacatcattctgtcgggctttctgaacggcctgatctacgacaagcgcggcaaagatgaatctgctcctgagctggcgctggagcgtcgggtgaataacaacacggtgctgaaaaaactgcgtattgctttctgcctgaaaactgacgacattctggcgatcatgaccgagcagaaatttcgcgtgtcgatgccggaaatcaccgccatgatgcgcgcgccggatcataagaattaccgcgagtgtggggatcaatttctgcgttatttcctgcgtgggttgacgcagcgggtgcataaccagaaggggtga

SEQ ID NO: 1638 - DNA, 1182 bp, Enterobacter cloacae
gccttctctcagcgcggatgctgccagccccgtggtgaagacgtttacttccacagcctgttctggccagcaatgctggaaggcagcaacttccgcaagccgaccaacctgttcgtacatggctacgtaacggtgaacggcgcgaagatgtctaaatctcgcgggacgtttattaaggccagcacctggctgaaccacttcgacgcggacagcctgcgctactactacaccgcgaagctctcttcccgcatcgacgatatcgacctgaacctggaagatttcgtgcagcgcgtgaacgcggacatcgtcaacaaggtggtgaacctggcgtcacgtaacgcaggttttatcgccaaacgctttgacggcgtgctttctgccgaactggccgatcctgagctgtataaaaccttcaccgacgccgccgctgcggttggcgaagcctgggaaagccgtgaattcggtaaagccattcgcgaaatcatggcgctggcagacgtggccaaccgctatgtggacgagcaggcgccgtgggtggtggcgaaacaggaaggtcgcgacgccgacttgcaggcgatctgcaccatgggtctgaacatgttccgcgtgctgatgacctggctgaagccggttctgccgcagctggcagcccgcgcggaagcattcctgaacaccgaactgacctgggatgccatccagcagccgctgctcggccacaaggtgaacacctttaaagcgctgtacaaccgcatcgagatgaagcaggttgaagccttggtggaagcatccaaagaagaggtgaaagcggctgccgcaccggtgaccggcccgctggcggacgatccgattcaggagaccatcacctttgatgatttcgctaaagtcgacctgcgcgtggcgctgatcgaaaacgcggagttcgtggaaggctctgacaaactgctgcgtctgacgctggatctgggcggcgagaaacgtaacgtcttctccggcattcgttccgcgtaccctgatccgcaggtgctgatcggtcgtcagaccgtgatggtggcaaacctggcgccgcgtaaaatgcgcttcggcatctccgaagggatggtgatggccgcaggcccgggcggaaaagacatcttcctgttaagccctgacgaaggcgcgaagccgggtcagcaggtgaagtaa

SEQ ID NO: 1639 - DNA, 825 bp, Enterobacter cloacae
tttgtacaaaaaagaatcaaatcttcctggttccgcaaagtgggtctacagttaagctggggacgcgcaagcctgggggcgaaaatggcgctttacacaataggtgaagtggcactcctgtgtgatatcaatcccgttacgctacgggcgtggcagcgacggtatggattgcttaagccgcaaagaacggacggcgggcaccgcctgtttaacgatgcggatattgaccggatccgcgagatcaaaagctggatcgacaacggcgtacaggtcggcaaggtaaaatcgcttctgagccagtacgatcctgatacgcagcatctctggcgcgagcagcaggaaaccctgctgaggctgttgcagagtggcaatttgcagcgtctgcgcggctggatcaaagaacagggtcgagactacccggcgcaaaccctgatcactcatctttttattcccctacggcgtcggcttcagtgtcagcaaaccaccttacaggcgctgctcagcatgcttgatggcgtgctgattaactatatttccgtctgtcttgcctcagcgcggaataaaaacagcaaagatgcactggtgatcggctggaacgtacacgataccacccggctgtggctcgaagcctggattgccacccagcagggctggcgcgttgacgtgcttgcccactccctggcccagctcaggccggaactgtttgagggacagacgctgctggtctggtgcggcgaagtcccctccgcttcccagcagcagctccttacggagtggcgcgaacatggttatcccgtttactcactgggtccaaatgcgtcgtaa

SEQ ID NO: 1640 - DNA, 1923 bp, Enterobacter cloacae
ccgcgggaagcacccggccagaccgtgcgaaaagcgcagtgtgccacaaagcctgaaaaccttgcagggttattctctgatttttctcatgaatacccgaccgctcaacggctaatcgcgctatgctttacagcgagaaatttgccccaccacaaggagtggaagatgtcttctgttcgaactgacgataacactacatttattaacgaactgtcgcgcctggttggtcactctcacctgcttaccgacccggctaaaaccgcccgctaccgcaagggcttccgctccggtcagggcgaggcactggcggtggtcttccccggtacgttgctcgaactgtggcgcgtgctcagcgcctgcgttgcggcagacaagattattttaatgcaggctgctaacaccggcctgactgaaggctccacgccgaacggcaacgattacgatcgtgacatcgtgattatcagcaccctgcgcctcgacaaactgcacctgctggacaagggcgaacaggtactcgccttccccggcaccacgctctactcgctggaaaaggcgcttaagccgctgggtcgcgaaccgcactcggtgatcggctcgtcgtgcattggtgcctcggtgatcggcgggatctgcaataactccggcggctcgctggtgcagcgcggcccggcctacacggagatgtcgctgtttgcccgtatcgatgaaaacggcaagctgacgctggttaaccatttggggatcgatctgggcgtaacgccagagcagatcctcagcaaacttgacgatgaccgcgtgaaggacgaagacgttcagcacgatggccgtcacgcgcatgaccacgattacatcacccgcgtgcgcgatatcaatgccgatacaccggcgcgctataacgccgatccggatcgcctgtttgaatcctccggctgcgcgggcaagctggccgtttttgcggtgcgcctcgataccttcccggcagagaaaaagcagcaggtgttttacatcggcaccaatcagccggaggtgctgacggagatccgccgtcatattctggccgagttcactcacctgccggtggcgggcgagtatatgcaccgggacatttacgacatcgccgagcgctacggcaaagataccttcctgatgatcgacaagctcggcaccgacaaaatgccgttcttcttcaccatgaagggccgcaccgatgcgatgctggagaaagtgtcgctcttcaagccgcacttcaccgaccgctttatgcagaagctgggcaacgtcttcccggcgcatttaccggagcggatgaagacctggcgcgacaagtatgagcaccatctgctgctgaaaatggccggggacggaattgacgaagcgcagagctggctcaccgaattcttcaaaaccgccgacggggatttctttgcctgcacgccggaagaaggcagcaaagccttcctgcatcgtttcgccgcggcgggtgccgctatccgttatcaggcggtgcattccgaagaagtggaggatattctggcgctggatatcgcactgcgtcgcaacgataccgagtggtttgaacatctgccgccggagatcgacagcaagctggtgcataagctctattacggccactttatgtgctatgtcttccaccaggattacatcgtgaaaaaaggggttgatgcacacgcgctgaaagaacagatgctggcgctgctgcacgagcgtggcgcgcaatatcctgccgagcacaacgtgggacacctgtataaagcgccggagacgcttaaacagttttatcgcaaaaatgaccctacaaacagtatgaaccccggcattggtaagacaacgcggaagaaatactggaaagagagtgccgaatcagagcagcacaatacgcaagcctctgatgaactcatatag

SEQ ID NO: 1641 - DNA, 636 bp, Enterobacter cloacae
gctctcctcaaacgtactagagtatctgcctgttgccagagaaacgtttctctggctttccaaacaaggagcgggcagaacatgtcggctgtagaaactttccccgaaactgaaatcgaggtgcgcgacgcccttcctgacgatgcgcatgccatctcggcgatatacgcctggcatgtacttcatggccgtgcgtccttcgaggaagttccccccaccgtcgatgagatgcgtcagcggatgaagagcgtgaccgacagcggtttaccgtggctggttgcgctgtatcgcggcattgttgtcggctactgctacgccacgttttatcgtccacgccaggcttatcgctatacccttgaagaatccatttatgtggatgccagcaccaccggccgcgggtttggctcggccttactccaggcactgatcgcccgttgtgaacaaggaccgtggcggcagatgattgccgtggtcggcgacgggcaaaataaccccgggtcgttgcggctgcataaaaagcacggtttcgaaattgtgggtcagctcagaagtgtgggatataaaaaaggcgactggcgggacacggtgatgatgcagcgcccgctcaacgacggggactggacgctgccggaataa

SEQ ID NO: 1642 - DNA, 900 bp, Enterobacter cloacae
aacgatgtcgaatctgccgacggggatatccaccgttgcaatatccgtcgcaccatccgttccctggtgaccggtgaccgcgtggtctggcgtccaggcaaagaagcggcagaaggggtaacggttaaaggtatcgttgaagccgtgcatgaacgcacgtcggttctgacccgtccggatttctacgacggcgtgaagcccattgccgccaacattaaccagatcgtgatcgtttcggcgattttgcctgagctttcactcaacattattgaccgttatctggtggcctgcgaaacgctacaggttgagccgcttatcgtgctgaataaaatcgatctgctggatgacgaggccatggcctttgtcaatgagcagatggatatttaccgcaacattggctatcgcgtgttgatggtgtccagccgcaccaaagacggcctgaagccgctggaagatgcgctaaccaaccgcatcagcatctttgcagggcagtccggcgtgggtaaatccagcctgcttaacaatctgctcggccttcagcaggagatcctgaccaacgatgtgtcggacgtctccgggctgggccagcacaccaccaccgcctcacgtctctatcacttcccgcacggcggcgatgtgattgactccccgggcgtgcgtgaatttggtctctggcacctcgagccggaacaaatctttaacggatttgtcgaattccatgactatttaggcgcttgcaaataccgcgactgtaaacatgacaacgatccgggctgcgccatccgcgaagcggtggagaacggtgaaattgcggaaacccgtttcgaaaattaccaccgcattctcgaaagcatggaccaggtaaaaacgcgtaaaaacttttctgattctgataactga

SEQ ID NO: 1643 - DNA, 417 bp, Enterobacter cloacae
aaccacgctaaggagtgcatgatgacgactaaacgcaaagcctacgtgcgaccaatgccgtccacctggtggaaaaaactgccgttttatcgcttctatatgctgcgtgaaggcacggcatttcccgcggtctggttcagcctcgaactgatgtacggggtgtatgccctcaagcacggcccggaagcctgggccagttttgtgggcttcctgcaaaacccaatcatcgtagtactgaacctgattgtgctcgccgccgcgctgcttcataccaaaacctggtttgaactggcgccaaaagcagcgaacatcattgtaaaaggcgaaaaaatggggccagagccggtcattaaagggctctgggcagtgacagcagttgtctctgtggtcattctgtttgtcgcactgttttggtaa

SEQ ID NO: 1644 - DNA, 1254 bp, Enterobacter cloacae
cagctaatgctaaatttaaccgtttgtcaggcacagtcaaatccaacagactacgcctgtctgatgggcccggacacccccttgactcgctattacggaagattactgatgatgaaaaaatccctttgctgcgccctgctgctgggcctctcttgctctgctctcgccgcgccagtgtcagaaaaacagctggcggaggtggtcgcgaatacggttaccccgctgatgaaagcccagtctgttccaggcatggcggtggccgttatttatcagggaaaatcgcactattacacgtttggcaaggccgatatcgcggcgaataaacccgttacgcctcagaccctgttcgagctgggctctataagtaaaaccttcaccggcgttttaggtggggatgccattgctcgcggtgaaatttcgctggacgatccggtgaccagatactggccacagctgacgggcaagcagtggcagggtattcgtatgctggatctcgccacctacaccgctggcggcctgccgctacaggtaccggatgaggtcacggataacgcctccctgctgcgcttttatcaaaactggcagccgcagtggaagcctggcacaacgcgtctttacgccaacgccagcatcggtctttttggtgcgctggcggtcaaaccttctggcatgccctatgagcaggccatgacgacgcgggtcctgaagccgctcaagctggaccatacctggattaacgttccgaaagcggaagaggcgcattacgcctggggctatcgtgacggtaaagcggtgcgcgtttcgccgggaatgctggatgcacaagcctatggcgtgaaaaccaacgtgcaggatatggcgaactgggtcatggcaaacatggcgccggagaaggttgccgatgcctcacttaagcagggcatcgcgctggcgcagtcgcgctactggcgtatcgggtcaatgtatcagggtctgggctgggagatgctcaactggcccgtggaggccaacacggtggtcgaaggcagcgacagtaaggtagcgctggcgccgttacccgcggcagaagtgaatccaccggctcccccggtcaaagcgtcctgggtccataaaacgggttctactggcgggtttggcagctacgtggcctttattcctgaaaagcagatcggtattgtgatgctcgcgaataaaagctatccgaacccggcacgcgttgaggcggcataccatatcctcgaggcgctacagtaa

SEQ ID NO: 1645 - DNA, 1044 bp, Enterobacter cloacae
aatcgtccccttttttcaggttccggcagcgtaatgccggatcaggaacgacaaaacaatggcctggaggctaccttgttaaactcatttaaactttcgcttcaatacattctgccgaaactgtggctcactcgcctggcgggctggggcgcgagcaaacgagcgggctggctgaccaaactggtcatcgacctgttcgtgaaatactacaaggtcgacatgaaagaagcgcagaagccggatacggcaagctatcgtaccttcaacgaattttttgtgcgtccgctgcgcgacgaagtgcgtccgctgaataccgacccgaacgtgctggtgatgccagcggacggcgtgatcagccagctgggtaaaattgaaaacgacaaaattttgcaggcgaaaggccataactacagcctggaagcgctgctggccggtaactacataatggccgatctgttccgtaacgggactttcgcgaccacctatctctccccgcgcgattaccaccgcgtgcatatgccgtgtaacggtattctgcgcgagatgatctacgtgccgggggatctgttctccgtcaatcacctgacggcgcaaaacgttcctaacctgtttgcccgtaacgagcgcgtcatctgcctgtttgatactgaatttggcccaatggcgcagattctggtgggtgctaccattgtaggcagcatcgaaaccgtctgggcgggcaccattactccgccacgcgaaggcgtgatcaagcgctggacctggcctgccggcgaagaagaaggttctgtggccctgctgaaaggtcaggaaatgggccgcttcaagctgggctcaacggtcatcaacctgttcgctccgggcaaagttaacctggtcgacgagctggaaagcctgtccgtgaccaaactcggccagcctctggcagtatcgacggaggtctttgcaacaccagacgttgcgccagccccgttgccggaagatgagatcaaagccgagcacgacgccagcccgctggttgacgacaaaaaagacgaaggctaa

SEQ ID NO: 1646 - DNA, 1842 bp, Enterobacter cloacae
acgtcctttagctcatcgcgttgcgggaaaacaaaaatctggaggaatgtcgtgcaaacttttcaagccgatcttgccgtaataggcgctggcggggctggattacgggctgcaattgctgcggcacaagccaatccgaacgctaaaatcgcattgatttcaaaagtctatccgatgcgcagccacacggtagccgcagaaggaggatccgctgccgtcgcgcaggatcatgacagctttgaataccatttccacgacacggttgcagggggcgactggctttgcgaacaggatgtcgttgattacttcgtgcatcattgcccaacggagatgacccagctggaacagtggggatgcccgtggagccgccgtccggacgggagcgtcaacgtccgccgcttcggtggcatgaagatcgaacgcacctggtttgccgccgataagaccggcttccacatgctgcacaccctgttccagacctccctccagttcccacaaatccagcgctttgacgaacatttcgttctcgacattctggtcgacgacggtcatgcgcgcggactggtggcgatgaacatgatggaaggtacgcttgtccagatccgcgctaatgcggtggtgatggcaacgggcggcgcgggccgcgtataccgctacaacaccaacggcggcatcgtcaccggtgacggtatgggcatggcgctcagccacggcgtcccgctgcgtgatatggagttcgtccagtatcacccaaccggcctaccgggctccggcatactgatgacggaaggctgccgcggcgaaggcggaattctggtcaacaaaaacggctatcgctatttgcaggattacggcatgggtccggaaaccccgcttggcgagccgaaaaacaaatacatggaactcggcccacgcgacaaagtctctcaggctttctggcacgagtggcgcaaaggcaacaccatctcaacgccgcgcggcgacgtggtgcatctcgacctgcgtcatctcggcgagaagaaactgctggagcgtctgccgtttatctgcgagctggcgaaagcgtatgtgggcgtcgatccggtgaaagaaccgatcccggtgcgtccaaccgcgcactacaccatgggcggcatcgaaaccgatcagcagtgcgaaacccgcatcaaagggctgtttgcggtgggcgagtgttcctccgtcggtctgcacggcgcaaaccgtctgggctcgaactcgctggctgagctggtggtctttggccgcatggcgggcgaacgtgcggtggagcgtgccgcaacggcaggtgaagctaacagcgcggcgctggatgcgcaggttgtagacgtcgaaaaacgcctgaaagacctggtgaaccaggaaggtaacgaaaactggtcgaagatccgcgacgaaatggggctgtcgatggaagaaggctgcgggatctaccgtacgccagagctgatgcagaaaaccgtcgataagctggcggagttgcaggagcgcttcaagcgcgtgcgtatcaccgacacttccagcgtcttcaataccgatctgctttataccattgaactgggccacggcctgaacgtcgcagaatgtatggcccattccgccctggcgcgtaaagagtcccgcggcgcgcaccagcgtctggatgagggctgcactgaacgtgacgacgtcaatttccttaaacacactctcgcctggcgcgatgcggatggcaccacccgtctggactacagcgacgtgaaaatcaccacgctgccaccggcgaaacgcgtgtacggtgcagaagcagaagccgccgataagaaggagaaggcgaatggctga

SEQ ID NO: 1647 - DNA, 417 bp, Enterobacter cloacae
cagcagttgtctctgtggtcattctgtttgtcgcactgttttggtaaggagactactgtgatcaatccaaatcctaaacgttcagacgagccggttttctgggggctgtttggcgcaggcggcatgtggagcgccattattgccccggtcattatcctgctggtcgggatcatgctgccgctggggttgttcccgggcgatgcgctgagctatgagcgcgtactggcctttgcgagcagctttattggccgcgtgttcatcttcctgatgatcgtcctgccgctgtggtgtggtctgcaccgtatccaccatgcgatgcacgatctgaaaatccatgtgccaagcggtaaatgggtcttctacggtctggcgaccattctgacggtcgtcacgttgattgccgtggtcaccatctga

SEQ ID NO: 1648 - DNA, 3483 bp, Enterobacter cloacae
ccaaactcggccagcctctggcagtatcgacggaggtctttgcaacaccagacgttgcgccagccccgttgccggaagatgagatcaaagccgagcacgacgccagcccgctggttgacgacaaaaaagacgaaggctaacaacagaaggatcgctgacgtgcgcccgattatcgtattactgatggcctggtgcctcagcatgggggcgtacgcagcgacggcccccgacgccaaacagataacccaggagctggagcaggcaaaagcggcaaaacccgctcagccggagaccgttgagtcactccagtctgcactgaacgcgcttgaggaacgaaagggttcccttgagcgcgcgcagcagtatcaacaggttatcgacaatttccccaaactctctcagaccctgcgctcgcagctaaacaacctgcgcgatgaaccacgccaggtccccgcggggatgacgtccgaggcgctgaatcaggagatcctgcaagtcagcagccagctgctggaaaaaagccgtctggcgcagcaggagcaggaacgggcgcgtgaaattgccgattccctcagtcagcttccacagcagcaaaccgatgcccgccgtcagttaaatgaggtggaacgccgcatcgggacgcagacgggcagcacaccgcagaatcaggcgcaaaatcttgggttgcaggcggaatccgccagactaaaagccctggttgatgaactggagctggcgcagctttccgctaacaaccgccaggagctgtcgcggatgcgttccgagctggcgcagaagcagagccagcagctggatgcgtatctccaggcgctgagaaatcaactcaacagccagcgtcagcgtgaagctgaacgtgctctggaaagcacagagttactggccgaaaacagcgctaacctgcccgacagcatcgtcgcccagtttaaggttaaccgcgagctttctgctgcgctgaatcagcaggcgcagcgcatggatttggtggcctcgcagcagcgtcaggctaccaatcaaacccttcaggttcgtcaggcactcaacacgctgcgtgaacagtcccagtggcttggctcgtctaacctgttgggcgaagcgttacgcgcgcaggtggcccgtctgccagagatgccaaaaccacagcagcttgatacggagatggcgcagctgcgtgttcagcgtcttcattatgaagatctcctcaacaagcagccgcaaatccgccagatccgtcaggctgacggacagccgctcaccggcgagcaaagtcgtattctggaagcgcagctgcgcacccaacgcgaactgctcaattccctgttgcaggggggcgatacgctgatccttgagctgaccaagctgaaagtctcgaatagccagctggaggatgcgctgaaagaggtcaacgaagccacgcaccgttaccttttctggacgtccgacgtgcggccgatgaccttcgcctggccgattgagatcgtgcaggatctgcgccgcctcatttcgctggacacctttagccagctgggcctcgccagcgtaatgatgataaccagtaaggagactatcttcccgttgctgggggcgctgattctggtgggcttcagtatttattcccgtcgtcactttacccgtttccttgagcgctccagcgcccgagtgggaaaagtaacgcaggatcacttctggctgacgttgcgtacggtgttctggtcaattctggtcgcgtctccgctgccggtgctgtggatgacgctcggatacggactgcgtgaagcctggccctacccgcttgccgtcgcgattggcgatggcgtgaccgccaccgtcccgctgctgtgggtggtgatgatttgcgccacgtttgcgcggccaaatggtctgttcatcgctcactttggctggccgcgtaatcgcgttgcgcgggcgatgcgttactacctgatgagtatcgggctgattgtgccgctgattatggcgttgatcatgttcgataatctcaatgaccgggagttctccggctcgctgggacggctgtgctttatgctgatctgcggggcgttagcggtagtgacgctcagcctgaaacgcgccgggatcccgctctatctcgacaagaccggcagcggcgataacatgttaaaccgtctgctgtggaacctgctgctcagcgcgccgctggcggcgatgctggcggcagcggtcggttatctcgccacgtcgcaggcgctgctcgcccgactggaaacgtcggtggccatctggttcctgctgctggtggtctaccatgttatccgccgcggcatgctgatccagcgtcgtcgtctggcgtttgaccgtgctaaacatcgtcgcgcagaaattctggcccagcgcgcgcggggtgaggaagagccaaaccacgtcaacagcaccgaagggactacagacgctgatgacgtcgaactggatctggatgcgataagtactcagtccctgcggctggtacgctcaattctgatgctggttgccctgctgtcggtgatctacctgtggtcagaaatccactccgcgtttggcttcctggagaacatctctttatgggatgtgacatccacggtgcagggagtcgaaagcctggagcccatcaccttaggggccgtgctgattgcgattctggtgctgatcatcaccacccagctgatacgtaacttccctgccttgctggagctggcgctgttgcagcatctggatttaaccccaggcacaggctatgccatcaccaccatcaccaagtatttaatcatgctgtttggtgggctggtcggcttctcgatgattggtatcgaatggtcaaaactgcaatggctggttgccgccctgaccgtaggcctgggctttggtttacaggagatttttgccaacttcgtttctggtctgatcattctgtttgaaaagccgattcgaattggtgatacggtgaccatccgcgatctcaccggcagcgtcaccaggatcaacacccgtgccaccaccatcagcgactgggaccgtaaagagatcatcgtcccgaacaaggcatttatcaccgagcagtttatcaactggtcgctgtccgactccgtcacgcgtgtggtgctgaccgtacccgctccgtcggatgccaacagcgaagaggtgacgcagatcctgtatacggctgctgaacgctgttcgctggtaatcgacaacccaccgccggaagtcttcctggttgatttgcagcaggggatccagattttcgagctgcgtatctacgccgccgagatgggacaccgtatgccgctgcgccatgagatccaccagctgattctggctggcttccgcgagcacggaattgatatgccgttcccaccgttccagatgcgtctggaaacgctggacggacgtaagacgggaagaacgttgacgtcagcggcgcgtacgcgcccggcgggaagtttgtaa

SEQ ID NO: 1649 - DNA, 810 bp, Enterobacter cloacae
aaatcaccacgctgccaccggcgaaacgcgtgtacggtgcagaagcagaagccgccgataagaaggagaaggcgaatggctgagatgcaaaaactgaaagttgaagtggtgcgctacaatccggaagtggacgccgcgccgcatagcgctttctatgaagtcccttacgacgagcaaacctccctgctggatgcgctcggctatatcaaagataacctggccccagacctgagctaccgctggtcctgccgcatggcaatttgcggctcctgcggcatgatggtcaacaaggtgccaaagctggcgtgtaaaaccttcctgcgtgattacaccaaaggcatcaaggttgaagcgctgggcaatttcccgattgagcgcgatctggtggtcgacatgacccactttatcgaaagcctcgaagcgattaagccgtacatcatcggcaacccgcgcacaccggatcaggggccaaacactcagacgcccgcgcagatggcgaaataccatcagttctccggctgcatcaactgcggcctgtgctacgccgcctgtccacagtttggcctgaaccctgagtttatcggcccggccgccattaccctggcgcaccgctataacgaagacagccgcgaccacggcaaaaaagaacgtatggcccagttgaacagccagaacggggtctggacctgcacgtttgtcggttactgctccgaagtctgtccgaagcatgtcgacccggccgccgccattcagcagggtaaggtggaaagctcgaaagactttcttatcgctaccctgaaaccacgctaa

SEQ ID NO: 1650 - DNA, 903 bp, Enterobacter cloacae
ctgttaatttttctaacggaagagaccatgacgcgaagctatctccccctcaattcgcttcgagcttttgaagccgccgcgagacatctcagctttacgcatgcggccattgagctgaacgtgacccattcagccattagccagcatgtgaaaacgctggagcagcacctgaactgtcagctgttcgttcgcgtgtcgcgcgggctgatgttgactaccgagggtgaaaatttactgccggtgttgaatgattctttcgatcgtatagccggaatgctggatcgcttcgctaaccatcgtgcgcaggagaagctgaaaatcggcgtggtgggtacatttgccaccggggttttattctcgcagctggaggattttcgccgtggctatccgcacatcgatcttcagctttccacccataacaaccgcgttgatccggctgccgaagggcttgactatacgatccgctacggtggcggggcgtggcacggcaccgaggctgaattcctttgtcatgcgccgctcgcgccgctgtgtacgcccgatatcgccgccagtctgcacagtccggccgacatcctcaggtttacgctgctgcgctcttaccgacgcgatgaatggaccgcgtggatgcaggcggccggcgagcatcccccttcgccaacgcaccgcgtgatggtatttgattcgtccgtgaccatgctggaggccgctcaggcaggggtgggcattgccattgcgcctgtcgatatgtttacccatctgttagccagcgagcgcattgtacagccctttgcgacgcagattgagctcggcagttactggctgacccgattgcagtcccgggcagaaacgccagccatgcgcgaattttcccggtggctggtggagaagatgaaaaagtaa

SEQ ID NO: 1651 - DNA, 981 bp, Enterobacter cloacae
ctcatgagcgaaacggccacctggcagccgagcgcatccattccaaacctgctaaagcgcgcagcaattatggcggagatccgccgtttctttgccgaccgcggcgtcctggaggtggaaacgccgtgcatgagtcaggcgacggtcacggatattcatctggtcccgtttgaaacccgttttgttggcccaggccactctcagggcatgaatctgtatctgatgaccagcccggaataccatatgaagcgtctgctggcggccgggtgtggtccggtctatcagctgtgccgtagcttccgtaatgaagagatgggccgacaccataatccggaattcaccatgctggagtggtaccgcccgcactacgacatgtatcgtctgatgaacgaagtcgacgatctgctgcaacaggtgctggattgcgcggaagctgaaacgctctcctatcagcaggccttccagcgccatctggaaatcgatccgctgtcggctgataaaacacagctgcgtgaagtggcggcaaaactggatctgagcaacgtggcggataacgaagaggaccgcgacacgctgttgcaactgctgttcacctttggcgttgaaccgcaaattggtaaagatcgcccgacgtttgtctatcactttccggccagccaggcctcgctggcgcagatcagcaccgaagatcaccgcgtggcggaacggtttgaggtgtacttcaaaggcattgagctggcgaacggtttccacgagctgaccgacgcgcgcgaacagcagcagcgtttcgagcaggataaccgcaagcgcaacgcgcgcggtctgccgcagcagccgattgacaccaacctgctggaagcgcttaaggccggtttgccggactgctccggcgtggcgctgggtgtggatcgtctggtcatgctggcgctgggtgccgagcaactgggcgatgtgattgcctttacggtcgatcgcgcctga

SEQ ID NO: 1652 - DNA, 1563 bp, Enterobacter cloacae
ccacaatatttgtctggtcatctgctaccatccgcgcagtttaattccgtttcggatggttatatgtctcactcactcaaaaaaatgacccttaccgggctcattctgatgatttttacgtcagtctttggctttgccaatagcccgtccgcgttttatctgatgggctacagcgcgacgccgttttatatcgtttccgctctgttcttctttatcccgtttgcgctgatgatggcggagatgggctcggcgtaccggaaagaagagggtggcatctattcgtggatgaacaacagcgtcggtccgcgttatgcgtttatcggtacgttcatgtggttttcatcctacgtcgtctggatggtcagcacggcggccaaggtctgggtgccgttctcaacgtttctcttcggtgcggataaaacgcaggtctggtctctggcggggctgagctccacgcaggtggtcggtattctggcggtgtgctggatggtggtggtcacgctggtggcctcgaaaggcatcaacaaaattgcccgtatcactgccgttggcggtatttccgtgatgtgcctgaacctggtgctgctgctggtcagcatcgccattctgtgcctgaacggcgggcatttcgcacaggaagtcaacttcgtttcatcgcctaatccgggttaccagtccggactggccatgctctccttcgtggtgtttgccatctttgcttacggtggaattgaagccgtgggcggcctggtcgacaaaaccgaaaatccggaaaagaacttcgccaaaggcattatctttgccgccatcgtcatatccattggctactcactggcgattttcctctggggcgtcagcaccaactggcagcaggtactgagcaataacactaccaacctcggcaacattacctacgtgttgatgaaaagcctgggggtgacgctgggcaacgccatggatctcgcgccggaaacgtcggccaccctggggatctggtttgcgcggattaccggtttgtcgatgttcctcgcctatactggcgcgttcttcacgctgatctactcgccgctgaaagcgattattcaggggacgccaaaggcgctgtggcctgcacgtatgactcagctgaacgctgccggtatgcctgccaacgcgatgtggatgcagtgcatgctggtgtgcgtgttcattctgctggtgtccttcggcggtgataccgcgtcggcgttctataacaagctgaccctgatggcaaacgtatcgatgacgcttccgtatctgttcctgaccctggcgttcccgttctttaaggcgaagcaggatctggaacgaccgtttgtgatcttcaaaacccgtgcggcgacgctgctggcgaccactgttgtggtgctggtcgtcgcgttcgccaacatttttaccgtcattcagcccgttgttgaggcaaatgactggaacagcacgctgtggatggttggcggaccgatcttcttctcgctgctggcaatggggatttatgagcattaccgtcgtcgctcgacggcctgtgtagcagaagtggcataa

SEQ ID NO: 1653 - DNA, 642 bp, Enterobacter cloacae
aacatggctaaataccctatctcaaataaggcagataacgaccggattcagatccggtctttctggatatccgaaagaaaagcaccctatgtttatagtttcttgaaaaaaacagaactttgtcataggggtgaccaactggatttaattaggtcggctattagtaccgggttggtattaaataatttatttcctgacttggcaaattttataaatggtttaaacgaaagattaacacttgcagatcttaataggtttctgaatgatggaaatactatagatactgaacctaagcctcctattaatgtattgctagagaatgtcttagatcaaaagtttaaggagtatttaacacctctacaattagataattcaaagcaggattctgtttctgtaaaagaaaccttccttgtacaaaaggaacatgcctgctttggtgtgaagattgaaaatgagggaagcgatacctctataccatctgaaagcccactttcttcaggtgcatccaaaatttcaaaagaaaagtccatttcctctgtggtgccagtgctagaaaaagtatcggatgaaaatcaaaccgcctccataagcataaaatctaaagctaaggcaaacaagcgactagcgactttggcaagatag

SEQ ID NO: 1654 - DNA, 306 bp, Enterobacter cloacae
ttacataaaatatccaggagagtgagagcccacatgtcacataccatccgcgataaacaaaaactgaaagcacgtacaagcaagatccaggggcaggttgctgcgctgaaaaaaatgcttgatgaacctcacgaatgtgccgctgtactgcaacaaatagccgccatacgtggtgccgtgaatggtttattgcgtgaagtgattaaaggacatttgactgaacatattgttcatgaaagtgaagaacagaaacgagaagaagacctggacgttgtgctgaaggttctggattcttacatcaagtga

SEQ ID NO: 1655 - DNA, 1311 bp, Enterobacter cloacae
gaatggaaacgttcatatttgtatcgacagtatctcgcttctgaatgctctgaacgatcttatcagcatatattttgcaaaccagcttccggccgcaggaaaaaaatgatgatcgaaaacgataaagaaaaaagcctgaacgatgctacctcgccagaggtgcagaatgacatccgcagcgaatccacagaaaaatcaaaggaaatgggtcgttcaaggtactcatctattgcgatgatcgattacttcaatgcaatcgaacgtctgtgcgaagagaaaaaaattaacccggaaaatatcgatctgagcttcaaagttcactggctcagaaacgctgttggcggctcgtttgcaaggtcacaggagatgttcgctgagtaccagaagtatgttaaagaggttcctgaagaggcccgttacctggatatacccgatgaggtgaaggttgcactcggcgatattatctcgtacatcacctggcactaccgtagaagctataccgcaatacagagtgatagtgttaaaaaagctgaagcacgtagcatgcagctggaggaggaggtaacgcagcttttacagcggcttgagcaaagcgctaccgatatggatgagctgaaacttgagaatcaggcgctacagggtcgattagagatccgggacagtaccgtcaaggagttagaaacaaggctgaatgttgccgaagcagaactcgaaacctgccatcaccagttagatagcacacggcatgaattaagcctcgcacagcagtcaaatgactcactctcccagcaactggctgaacgtaaaacagagatcgctggtcaccttgaatatcaaaaaaagctgaacgaagagatcaacactcagcgttctgataatgccggtctttccagacaatgcgaccagttaagtcagactgtgtcagatacaaaggcagagagggacaggtttgaacaggaattgattgctgcacagaacctctgtgctgagctgaaaagtgcactgtccgggaaggagggtgacctggtggcggtgaatgccgagcttactgaactccataaactaaacgagtcgctgagcgccgacctgaaaaaagtaactttggtcagccagggctatgaagcggaagtggctgaacaaagcagtgaattaaaaacgctccagtccaaagtaatgaagctggaagctaccctggaggcagagaaaacaatctcagaatccctgaaaggcaccattgatacattgactggtgcaatggcagggggaggtactggaaagtcaaaacagccgcgtagtagaaaaacatcatga

SEQ ID NO: 1656 - DNA, 765 bp, Enterobacter cloacae
  unsure (59)
ttctcacccaaaacgaggaaattaggccggttaaaagttcaccagcaacttcatgtttngggtttagttcctcaggatgttcacctctttgtaactgtaccacttagccagttctatactgctttaggggaaacgaatattgaaaatattcagagaaaaaaagataatctgatgaaaccagtagagcgttatcttgacggtaaacgctattcttttaacgttttgtctgtgactgttttccctgaatctttaccagctgtgacccgggcagatgaaattgaggatattgcttcatttgaatcaagtttggtaattgatcttggtggtactactcttgatgttgcaagtattactgggcaattagaacagatttcgaaagtaaaaggttttgaccgtattggttgttctattgtttacgatgagatcagcaggtatcttgaatctgagaaactgaatacgagtaatgcttacattcatcatcttgttgataatcgtcatgataaatcagctttgaaggttgcagaggacaagcgtgacggtgtttttgatgcggtaaactctgcggtacagaagttgcaaagtaaagtaatcagagcggttacacaagtcgaagagaggcctcataatgttttccttgttgggggaggttcatatctcatcgaaacagctattcgtaaacattttgaaacggctaaagttatcatggtagacaatccgcagttcgcattatctttggcaattgctgatactatttattcagaataa

SEQ ID NO: 1657 - DNA, 1416 bp, Enterobacter cloacae
gtgacgatttatcgtcccactgtggcacaagagatgggaggcgaccattccattaacaaagccgcggtgatgcttacggtatggtggttatcaagttttatcctgattagcacccttaatggctatttcgataatcaggaccgcgattttctgacaggtaaacttcagctcaccgaagagtttcttaaaacagagacgttccggaacaaaacggatattaagtcattatcagaaaaaataaacgatgcgatggtagggcacaatggtttattcatttctataaaaaacatggaaaatgaaaaaattgttgaactctatgccaaaaattctgttgttccagcggtcctgcttaataagtcgggtgatattctcgactatatgatccagacggaagaaaataacaccgtgtaccgcagtatctcgcggcgggttgccgtgacgccggaacagggtaaaagcaaacatgtcatcattacggttgccacggatactgggtatcacaccctgtttatggataagctcagtacctggctgttctggttcaatatcggtctggtctttatttctgtttttctgggctggctgaccacacgtattggtctgaaaccgctacgggaaatgaccagtctggcttcctccatgaccgtacacagcctggatcagcgtcttaatcccgatttggctccgccggaaatttctgagaccatgcaggagttcaataacatgttcgatcgcctggaggggtcattccggaaactgtcagatttctcgtctgacatcgcgcatgagctgcgcacagcggtcagtaatctgatgatgcagacgcagtttgcactggctaaggaaagggatgtttcgcattaccgcgaaatcttattcgcttacctggaagaactgaaaaggttgtcacgaatgaccagtgatatgctttttctggcacgttcagagcatggtctgctgcagctggataaacatgatgtggatctggccgccgaactgaatgaattacgtgagctgttcgagcctctggcagacgaaacaggaaagacaatcaccgttgaaggagagggcgttgttgccggagacagcgatatgctgcgacgtgctttcagtaacctgctttccaatgcaatcaagtattctcccgataacacctgtacagcgatacaccttgagcgtgacagtgactgtgtgaacgtgatgattacgaatacgatgtccggccaggttcccgctaatctggaacgtttgtttgatcggttctatcgagctgattcatcaagggtccacaacacggaaggcgcggggctgggattatcaattacaaggtcgatcattcatgctcatggcggcgagctgtcagcagaacagcaggggcgggaaattgtgttcagtgtgcgcctgttaatggattaa

SEQ ID NO: 1658 - DNA, 825 bp, Enterobacter cloacae
gttattgtcgtctcataccagggttctgagccagtaccggcgagccggacagggcagctcatcagcgcccgggatatggccatgcagaaattcgaagaagggatgcggttaatctcggaagcgtcggaactgtgcggtctctctctcttcaccagcagaattatgcagcccaacgcatttggtcttccgtcgtcactggatcgcaccatcgaggaggggcgtaaggaaattgaccgtaaaacgtggaaaaggctctttgaagaaataggtatggaccggtactggaaccataagcaaaaagaagcctttaacgaatccctacgtacggatccgcccgtcgcttccctggagattgttaagggaacattacagcatgcactggctaacagacgagacacgcttgcagaaggtttcgttgatgttctcaacaagcttgaccgaagttttaaaagcaatgcacggcaatatacaatgccgaaaaagcttgttcttcgggggatttttcctggtgtgaacgtactgaggtacaacggtttctcgcaggacaatcacttttgtttacgcgactttgagaatattgtatgcatctgttctgatactccaacacctgcaaccggcggtgggctgagtatggtcgacaggctgacggccatgagaaatacagatttcacaggcgaggtctgcgatgagaatggctggcggtgtcgcctgtttgagaatggaaacgttcatatttgtatcgacagtatctcgcttctgaatgctctgaacgatcttatcagcatatattttgcaaaccagcttccggccgcaggaaaaaaatga

SEQ ID NO: 1659 - DNA, 447 bp, Enterobacter cloacae
gtcgcggcgaaaaccaataaggacgatacgttcacggtgctggggtcggaaatgacggccatcgatgactttaggatcatccgcgcccgtgctttcgctgtttgcgacgtcgtagccaagctcatcgagcgttttcatgatgatgttaaaggtattacccttatcgtgactcttcagattttttacgttttccagaacaaaaattgcaggttgttttgcccggatgatcctggccacatcaaagaagagcgtaccctgagtgtcgcactcgaaaccgtgtttgcgacccatagagttctttttactgacaccggcgatgctgaatggctggcatggaaatcccgcaagaagaacatcatgatccgggatagaggcatcgataaatttgtatgcctcgtcatcagtaacctcgggccggttgctaagagtgatgtcacggatgtctga

SEQ ID NO: 1660 - DNA, 255 bp, Enterobacter cloacae
gtccgtaacgttgttcagcgacaggtctgcacagatgatttcatgtgtgttgctgtcaactgccagatgcaacttacgccatatacggcggcgttcctggccatgctttttgactttccactcgccttcaccgaagaccttcagcccggtggaatcaattaccaggtgtgcgatttcaccccgggtgggcgttttgaaactgacattaaccgactttgcccgcctgctgacacagctgtaatccgggcagcgtag

SEQ ID NO: 1661 - DNA, 468 bp, Enterobacter cloacae
ttgtttgggtatgaaaacaccggagacccaaccatgaaaaagatccttgtatcatttgttgccattatggctgtcgcttcatccgccatggctgcagagacaatgaacatgcatgaccaggtaaataatgcccaggcacccgcccatcagatgcagtcaacctctgaaaaaagcgctgttcagggagacagtatgacaatgatggatatgagcggacacgatcaggctgcaatgtcccatgaaatgatgcaaaacggcaacgcttctgcccaccaggacatggcggagatgcataaaaaaatgatgaaaggcaaaccaggggccaccaacgaatcagcaacgtcattttcagaaatgaacgagcatgaaaaagccgctgttgtgcacgagaaggcgaataatggtcagtcttccgttattcatcagcagcaggctgaaaagcatcgcagccagatcacccagaattaa

SEQ ID NO: 1662 - DNA, 585 bp, Enterobacter cloacae
cttgttaaaatactgcctgtaaataggcttgtggatacatgtctgtactcaacaaattcaggtgaaatgatgtttttttttacaaagttacttttgcccatcatgattgttgtattcccagtggcgtcctgggggaactcaacaacttttgaggcaaaggtggttaagattgttgacggtgacaccataactgcgttggatgctcaaaacacaaccatcaaaatacggatgtatggtatagacgctcctgaatctaaacaggcttttggccaaaaagcaaaacaggccttaaccacagctatagcaactaaaatcgttaccgtgatagaccatggtacggatatctatggccgtatgttaggtaccatctggttagatggatatgatatcaatgcctctatggtggacagtggatatgcgtgggtttatcggttcgaagataacgccattgtccctggctatatcaaatatgaatccgcagcacaaaaggaggcaaaagggttatgggcagacaccaaccctgtcccaccatggcagtggagacaggcaaacgaaaagcccagaaaggtgaaagggaagaaataa

SEQ ID NO: 1663 - DNA, 1536 bp, Enterobacter cloacae
tctgaatgtcatgtacatgctccaacaggaaatggcgtgacgctcaatacttctcaggtcagttactacatgactcaacgtaaaaaaggggcaacccagcatatctcggccatgaaggccggtatctctgtccgatctggtcgccggatcgagaaagatcagtggtcgaaagccggtgaacgccactggcgaacgcgtaaagatccacttgaagctgtgtgggacagcgagcttgtccctttactgaaagaaaggcctgctctgatgccaaccacgttgctggaaatgctacaggataaatatcctggtcagtaccccaacaacctccgcaggacaatgcagcggcgggtccgtgaatggaagttgcaatatggtgcggagcaggaggtcatgttccgccagcgtcatcaacccgggttgcgtggtctgtctgactttactgagctgaaaggcgtagttgtcaccatcgccggtaagttgttggcgcataagctgtatcacttccgccttgagtggagccactggagctggatgcgggttgtgctgggtggggagagcttctctgccctggctgaagggttgcaggaggcgctcggtcagttaggcggcgtgccgtcagagcacaaaactgacagcctgcgggccgcgtggaaacaccggggtgaagacggtcaacgggaactgacagagcgttatgccgagctctgccggcactacggtatgcagggcgtgcacaataatgccggacggggccatgaaaacggttcggtggagagcgctcacgggcatctgaaacggcggatccgccaggcgctgatactacgcggtagcaacgacttcagtacgcttgaagaataccaggccttcatcactcagcaggtcatgcggcataaccgcaataatcaggatctggttaaagaagagcagcctcatctgaagccgctgccgcttcgtcgcagcgccgactatgacgaactgacggtgagggtcagtagcagcagtaccatcaacgtcaggcacgtcatctacagcgtcccttcccggctggttggccagcttctgcgggtccggttatgggatgaccgtctgagttgttacgttggcagtaacgaagtcatgaactgtccccgggtcagacccgaaaaaggcaagacgcgggcacggcgaatcgacttccggcatgtgatcgacagcctggcaaaaaagcccggggcgttctgccatgcgacactgagaaacgacatcctgccggatgatgaatggcgaaaactatggcgccgtctgtgcaaccacctggagcccgaaatggctggcagactgatggtacacgcactgaaactggctgcggggtatgacgatatctcggtcgtggcacgcgggatggagcagatgctgaataccccaggcgaactggatctgaaccggttgatgcggttcctgggaataaaggaaaaagagctaccgcccgtcagtgtcgttcagcataacctgagcagttatgagcagttgctgcgtggaaaaggaggtctgcagtga

SEQ ID NO: 1664 - DNA, 1101 bp, Enterobacter cloacae
tggaatggtcgcctcccatctcttgtgccacagtgggacgataaatcgtcactcattgaacggagcgctgctatcatgaacgttaaaactattggaatcgatttggcaaaaaacgttttccagatccatggggttgacgagcacggaaaacggttgttcaacaaacaactcagacgggcacaaatggcctccttttttgccaacatcccaccctgtttgatcggcatggaggcctgtgcatctgctcatttctgggccaataaactgatatcgatgggccataatgtcaaactgatggcccctcagttcgtcaaaccctatgttaaaaccaataagcatgatgctgcagacgctgaagctatttgtgaagccgtcactcgacctaacatgcggttcgtgccggtcaaaaccgctgagcagcaagccgtattggcacttcaccggagtcgtcagagcttcatcaaacagcgaaccgcacaagccaatcaaatcagggggttattggccgaatttggcattgtcgtcccccgaggtatccagcagctacagcgacgattacctgagctcgtggaagatgcggataacccgttacccgtcctgtttcgtacacagctgagtctactacagcaccacatggcgtacctgttcgatgtcatcgctacactcgacaagcagattgagcagtgctatcggcaaaatgctctctgccagcgtatcggcaagatccctggtattggccctgttaccgccagcgcgctgattgcgaccattggtaaagccaacaatttcgagaatggccgacaactggctgcctggctcggattggttccacgtcagcactccagtgggggtaaacaagtcctgctcgggataagcaagcgaggtgatacctatttgaggaccttgcttatccatggtgccagggcggtattgcagtcggccaaacataaacaggatgccgtatcgagctgggctaaccagctaatggcgcgccggaataacaacattgcctcggtagcattggctaacaagaatgcgcggactgtgtgggcgctcctggccaaagagcgggagtattgtgcaccaataataagcgcttaa

SEQ ID NO: 1665 - DNA, 990 bp, Enterobacter cloacae
ataaatcgaacttttgctgagttgaaggatcagatcacgcatcttcccgacaacgcagaccgttccgtggcaaagcaaaagttcaaaatcaccaactggcccacctacaataaagccctcatcaaccgtggctccataactttctggctggatgatgaagctattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccattttttctctgatgaacgttccgctacgctgcccggattacagctgtgtcagcaggcgggcaaagtcggttaatgtcagtttcaaaacgcccacccggggtgaaatcgcacacctggtaattgattccaccgggctgaaggtcttcggtgaaggcgagtggaaagtcaaaaagcatggccaggaacgccgccgtatatggcgtaagttgcatctggcagttgacagcaacacacatgaaatcatctgtgcagacctgtcgctgaacaacgttacggactcagaggccttccccgggttaatccggcaaacccaccggaaaatcaggtcagccgccgccgatggcgcttacgatacccggctatgtcacgatgaactgcggcgtaagaaaatcagcgcgcttatccctccccgaaaaggtgcgggttactggcccggtgaatatgcagaccgtaaccgtgcagtggctaatcagcgaatgaccgggagtaatgcgcggtggaaatggacaacagattacaatcgtcgctcgatagcggaaacggcgatgtaccgggtaaaacagctgttcgggggttcactgacgctgcgtgactacgatggtcaggttgcggaggctatggccctggtacgagcgctgaacaaaatgacgaaagcaggtatgcctgaaagcgtgcgtattgcctga

SEQ ID NO: 1666 - DNA, 1482 bp, Enterobacter cloacae
tccaaattaagcgtgttaatctatctcaaagatattattcctgagagagtttggatgaaacgttacactcatgatcttgagacagacctgaatgatgtggataaaacaccatctctgatccacaaaactttgttaacagcttcgactatttatgacctgaaatatctggctcaggtattaaatgatgaaaatggcagtaattggtcccgtgcatcccttaaacgtcaggttacatgcatacctgagcattgtgatctgagtatcgcagatggacgctatctacagactttaataccttcacgacctgctgattatgaggacaggcactttagctttatcgatctgtttgcagggataggtggactgcgaagcggatttgatgccatcggtggtaaatgtcttttcacgagcgaatggaatacttattccagccgtacttaccgggcgaactggtattgcgatgagaacgagcaccgcttcaattcagacatccgtgacatcactcttagcaaccggcccgaggttactgatgacgaggcatacaaatttatcgatgcctctatcccggatcatgatgttcttcttgcgggatttccatgccagccattcagcatcgccggtgtcagtaaaaagaactctatgggtcgcaaacacggtttcgagtgcgacactcagggtacgctcttctttgatgtggccaggatcatccgggcaaaacaacctgcaatttttgttctggaaaacgtaaaaaatctgaagagtcacgataagggtaatacctttaacatcatcatgaaaacgctcgatgagcttggctacgacgtcgcaaacagcgaaagcacgggcgcggatgatcctaaagtcatcgatggccgtcatttccgaccccagcaccgtgaacgtatcgtccttattggttttcgccgcgacctacgtctgaaagacggttttactctgagagacattaaagacttttatccggacaagcgcccttctctctcagatttactggatccgagcgtagatagtaaatacatcctctcccctaaactctgggagtacttatacaactatgcaaagaaacatgcggcaaaaggcaatggttttggttttggactagtagatccttccaatgttaatagtgtcaccagaaccctctcaagccgctatatgaaagacggatctgaaattcttattgatcggggctggtctcatgagctgggagaaactgatttccataacacatacaacatggaccgtcggccacgcatgctaacgccacgtgaatgcagcaggctaatgggcttcgataaacccggggaaagtgttttccgtatccctgtgtccaatacacaggcttacagacagtttgggaactccgtggtcgttgatgtctttgcggccgtcgccaaactgctgaagtctcgaattgaatttgcagcctcccagcgcttgcggcagttttacgacgaagtcagctga

SEQ ID NO: 1667 - DNA, 786 bp, Enterobacter cloacae
gcagttgctgcgtggaaaaggaggtctgcagtgagcaatatccatcacctggaacgcagcctgcgaaaactgcgcctgacacgcgttggcgcggaatggcatgcgctggaaaaacgtgcgctggcagaggggtggaccccgtcacgctatctgctgacgctgtgtaatgaagaactgctgtggcgtgaaagcgaaaagctgcgccgctataaaaaggaagcccggttgccggtcgcgaaaaccctgggtgaatatgacttcgcccaggtgccggagctgaatgcagctcagttccggcagctctgcgaaacgacagactgggttgatgcaggtgaaaacgtcctgctgttcggcgccagcgggctggggaaaagccatctggcggcagcgatcgtggatggcgttgtaggtcagggctaccgggcccggttctacagcgcgggagagctgttgcaggaactgcgtaaagccagagctcagctgaaactgaatgagctgttactgaaactggatcgctatcgggtgatagtggtggatgacctcggttatgtcaaacgcgacaacgcggaaaccggtgtgctgttcgagttaatcgctcatcgctatgaacgagggagtctggtgatcaccagtaaccatccgttcagcacatggggcagcatcttcgtggatgagacgatggcagtagcggcggccgacaggctgatccaccacggatatatgttcgaactgaagggagaaagctacaggaaaaagacggcaaaggcagtaaccagcgcgacttaa

SEQ ID NO: 1668 - DNA, 1131 bp, Enterobacter cloacae
ccaagaatgattctcatgaacgaatttacgacacttcttcagcaaggcaacgcatggtttttcatccccagcgccattctgcttggcgcgcttcatggactggagcccgggcactccaaaacaatgatggcagcattcatcattgctataaaaggcaccgtacgtcaggccgtgatgctgggtgtcgcggcaacattgtcgcacactgcagtcgtatggctgattgcttttggagggatgtatatcagtaataaatttaccgcagaatcagccgaaccctggctacagatggtctcttcagtgatcatccttggtacggctttttggatgttctggcgaacctggagcggtgagaaaaactggctggagggaatgcaggagaatgaacatcatcaccatgacgaaacaaggttgatcgatactggccatggaaaagttgaactgtccatttttgaagaaggacaacttccccactggcggctacgcactcttagtggccaaagatgggcttctgaagatatctcattaaccacacttcgggaaaacagtacgatctctcagacttttgaatttgttgatcatggtgattatctggagtcaacatctcccatccctgagcctcacagtttcaacgtacgtctgtctctgggacatcgtggtcatgtccatgactatgatgtggcgttcgctgaacacgaccatgaccatgaccactctgagcttgatgggctggatgtgaattcgaaagagtatcaggacgctcacgaactggctcatgccaatgacataaaacgccgcttcgacgggaaagaagtaaccaacgggcaaatcctgatatttggactgacaggagggcttatcccttgcccggcagctataactgtattgttgatctgccttcagcttaaagcgcttacgctgggtgccacactggttgtttgtttcagtatcggcctggcattgaccctcgtaacggttggagtgggtgcggcgatcagcgttcgtcaggtcgccaaacgctggagtggcttcaataccatcgccagaagagccccctatatttcaagcgccctgattgctgctgttgggatttacatgggtatacatggctggaatgggctggtgcattaa

SEQ ID NO: 1669 - DNA, 1026 bp, Enterobacter cloacae
aattcgtgcgcagtggaccagcgagtatacctgaagaaaggacttttgatgcttttagcaacagcactgttaataattggtttactgttggtggtctacagtgctgaccgtttggtctttgccgcatccattctctgtcgactcattggcatgccgcccatcattatcggcatgacggtggtcagtgtaggcacatcgcttcctgaaatcatcgtttctgtttcagcctcgttgcatggccaggttgacctcgctatcggcaccgcgattggctctaacatcgtcaatatcttgctgattttaggcttagccgcattactgcatccatttcgcgtacattccgatgttttgcgtcgtgaattgccgctaatgttagtcgtcagtctgctggcgggctatgtgctttatgacggggtgctgagcgtcggtgacggtatattcctgctcgccctggccgtgatctggttgctttacagcgtgaagatcgcacgtctggcggaaaaacagggtaacgatagcctcacgcgtgagcacctcgccgagctgccccgggaagggaccttacccgtcgccctgctgtggctgggcgtcgcgctgattatcatgccaatggccacgcggatggtggtcgataacgcgacggtgctggcgaacgcgtttgcgatgagcgaactgacaattggtctgacggtcatcgccatcggcaccagcctgccagagctggctaccgccatcgccggggcgcgtaaaggggaagatgatatcgccatcggcaatatcattggctcgaatattttcaatatcgcgatcgtgacggggctgccggcattaatctcaccggggccgtttaaccctatggtcttcacgcgcgattacggtgtaatgctgctggtcagcgtaattttcgccctgctctgctggcggcgaaaagagcagatcggcaaaggcgcaggcgcgctgctgacgggtggatttatcgtatggctggcgatgctgtactggctctcgccacttctctctgggtaa

SEQ ID NO: 1670 - DNA, 606 bp, Enterobacter cloacae
tctgctgcgcgctggcgtagtgtaatgaaggataagacaatgagtaatgcgggtgcatcccttgcaacctgttatggcccggtgagcgcccacatgatgtcaaaggcggaaaatatccgcctgctgatcctcgatgtggatggtgtgctctccgacggtctgatttatatgggcaataacggcgaagagctgaaagcctttaacgttcgcgacggttacggtatccgctgtgcgctcacgtccggtattgaagttgcaatcatcaccgggcggaaagctaaactggtagaagatcggtgtgaaacgctgggcattacgcatctctatcagggacagtctgataagatggtagccttccgggatttgctgggaaaactggccattgcgccagagaatgtggcatacgtcggagatgatttgatcgactggccagtcatggcggaggtgggtctgagcatcgccgtggctgacgcgcacccgctgctgatcccgcgtgctgattacgttacccatattcacggtggccgtggcgccgtccgtgaagtctgcgatctgcttctgctggcgcagggcaagcttgatgaggcgaaagggcaatcgatatga

SEQ ID NO: 1671 - DNA, 576 bp, Enterobacter cloacae
ttgaaaaggttagaacctcctatgaaattcaaaacaaacaaactcagccttaaagttgttatcgccagcgcgctgctggcggccagtcttcccgcgcttgctgtgactggcgacaccgaacagccgattcatattgaatccgatacccagtctctggatatgcagggtaacgtcgtcacctttaccggcaacgtcgttgtgacccagggcactatcaaaatcaacgccgacaaagtggtcgttacccgtccgggcggcgagcaggggaaagagattatcgatggttatggcaacccggccaccttctaccagatgcaggacaacggcaagccggtgaaaggccatgcctcgcatatgcactatgaactggcgaaggatctggtcatcctgaccggtaatgtttacctggaacagctggacagcaatatcaaaggcgacaagatcacttatctggtgaaagagcagaaaatgcaggcctccagcgaaaaaggcaaacgcgtcacgaccgtgcttgtgccttcgcagttgcaggacaagaacaacggtcaggctccggcaaagaaaaagagtaactaa

SEQ ID NO: 1672 - DNA, 732 bp, Enterobacter cloacae
ttcgttatggcaactttaactgcaaaaaacctcgcgaaagcgtataagggccgccgcgtcgtcgaagatgtcagtctgaccgtcaactccggcgaaatcgtgggtttgcttggccctaacggggcgggtaaaaccacgaccttctacatggtggtgggcatcgtcccacgtgacgccggcaacatcattatcgatgatgaagatatcagcctgctgccgctgcatgcccgcgcgcgtcgtggcatcggctatctgccgcaggaagcgtctatcttccgccgcttaagcgtgttcgacaacctgatggccgtgctccagatccgtgacgatctgaccagcgagcagcgcactgaccgtgcgaacgagctgatggaagagtttcatattgaacaccttcgcgacagcctcggtcaggcgctgtccggtggtgaacgccgccgcgttgagattgcgcgcgcgctggcagcaaacccgaaatttatcctgctggatgaaccgtttgcgggcgttgaccccatctccgttatcgatatcaaacgtatcattgaacacctgcgcgacagcgggcttggcgtactgatcacggaccacaacgttcgtgaaacgctggcggtgtgtgagcgcgcctacatagtgagccagggccatctgattgcccacggtacgccgcagcaaatcctcgaggatgagcatgttaagcgcgtgtaccttggggaagacttcagactctga

SEQ ID NO: 1673 - DNA, 417 bp, Enterobacter cloacae
ccaccatgctgtccgatcagggtattatggtggcacgtcgtactgtcgcgaagtatcgagagtctttatccattccgccgtctaaccagcgtaaacaactggtttgacacaaccgataaggaagacactatgcagctcaatatcaccggacataacgtcgagattactgaggctttacgcgattttgtaaacactaagtttgcgaaactcgagcagtatttcgagaggatcaaccaggtctatgttgtgttgaaagtggagaaagtgacgcatatctcggatgcgaccctgcacgtcaacggaggggaactccatgccagtgcggaagggcaagacatgtacgcggctatcgacggcttgattgataagcttgcgagacagctcaataaacataaagataaactgaaacaacactaa

SEQ ID NO: 1674 - DNA, 372 bp, Enterobacter cloacae
acatcgttcggtctacattgccgaacagctggccgattacttccgctcacgcggaaagaacgttcagtcccgtcatcgcacgctggaaaaacgcaaaacatgaccgtaaaacagaccgtcgaaatcaccaataagctgggtatgcatgcgcgcccggcgatgaagctgtttgagctgatgcagggttttgatgctgaggtgctgctgcgcaacgacgagggaaccgaggcagaagccaatagcgtgatcgccctgctgatgctggattctgccaaaggccgccagattgaagttgaagccaccggcccgcaggaagaagaagcgctggcggcagtgattgccctgtttaacgccgggtttgacgaagactaa

SEQ ID NO: 1675 - DNA, 891 bp, Enterobacter cloacae
agacgttggccgcggatccgtccagccccgtgggtgaagaccggcggcggtaaacgtattcgtccgatgattgccattctggccgcacgcgcggttggctatcagggaaatgcccatgtcacgatcgcggcgctgatcgaatttatccacaccgccacccttcttcacgacgatgttgtggatgaatcagacatgcgtcgtggcaaagccaccgccaacgccgcgtttggtaatgcggcaagcgttctggtaggcgattttatctatacccgagccttccagatgatgacaagccttggctcgctgaaggtgctggaagtgatgtcagaagccgtgaacgttatcgctgaaggtgaagtcctacagctgatgaacgtcaacgacccggacatcaccgaagaaaactatatgcgggtgatttacagcaagaccgcacgtctgttcgaagccgccgcgcagtgctctggcattctggctggctgtagcgaagcggaggaaaaaggccttcaggactatggccgttacctcggcaccgcgttccagttgattgatgatttgctggactacagcgcggatggcgaaacgctcggtaaaaacgtcggcgatgacctgaacgaaggcaagccaacgctgccgctgctccacgcgatgcgcaatggtacaccagagcaggcgaaaatgatccgggaggctatcgagcagggaaatggacgccatcttctggaaccggtactggaaacaatggcaatctgcggctccctggaatggacgcgtcagcgcgctgaagaagaagcggacaaagccatcgccgctattcaggtcattcccgacagcccatggcgtgatgcgctaatcggcctcgcgcacatcgccgtccagcgcgaccgttaa

SEQ ID NO: 1676 - DNA, 342 bp, Enterobacter cloacae
tgctgtcttttcacacgaaacgacgtggacgataacgaacacaaggacagcattatggatacaaaattcatcgactggcattctgctgacattattgcggcactgcgtaaaaaaggaacttcgctggctgccgaatcacgtcgtcatgggctgagctcgtcgacgctggcaaacgccctgacccgcccatggccgaagggggaactgattatcgcgacggcgctggatacgcatccgtgggtgatatggccgtcacgctaccacgatcccatcacccatgaatttatcgacagaacgcgcatgatgcgccagagcaaaacgaagaaagcgcatcaggactga

SEQ ID NO: 1677 - DNA, 1062 bp, Enterobacter cloacae
cgggtggatttatcgtatggctggcgatgctgtactggctctcgccacttctctctgggtaaacggaaacgcattatgtcgcaaatagaattgcagccgggttttgactttcagaaagcaggcaaagacgttctggagattgaacgtgaaggtctggcgcagttagatcagtacattaatcaggattttagtctggcctgtgagaagatgttctactgcgccggtaaagtcgtggtgatggggatgggcaaatccggccatatcgggcgcaaaatggcggcgacctttgccagtaccggcacgtcgtcattcttcgttcatcccggtgaagccgcgcacggtgacctcggcatggttacgccgcaggacgtggttattgcgctgtccaactccggggaatcgaatgaaatcctggcgttgatcccggtgctgaagcgtctgcacgtaccgctgatttgcatgaccagccgcccggaaagcagcatggcgcgcgcggcggatattcacctgtgcgtgaaggtgcctaaagaagcctgcccgctggggctggcgccgacctccagcacaaccgccgcgctggtgatgggcgatgcccttgccgttgcgctgctggaagcccgcggttttacgccagaagatttcgccctgtctcaccccggcggcgcgctcgggcgcaaactgctgctgcgggttaacgatattatgcacaccggggatgagatcccgcacgtcagcaaagaggcctctttgcgcgacgcgttactggagatcacccgtaaaaacctgggtatgacggttatctgcgacgatctgatgaagattcagggcattttcaccgacggcgacctgcgccgggtattcgatatgggtgtggatgtccgaacgctgggcatcgctgatgtaatgacaccaggagggatccgcgtccgtcccggcacgctggcggtagatgtgctgaacctgatgcagtcccgtcatattacctcagtgatggttgccgatggcgaccaactgctgggtgtggtacatatgcatgatctgctgcgcgctggcgtagtgtaa

SEQ ID NO: 1678 - DNA, 507 bp, Enterobacter cloacae
cgcttaggtgaaattatgataaacaacgattccgctcttcaactgagcaatgtccttaaccaggattgtacccgcagtggcgttcactgccagagcaaaaaacgtgcgctggaaatcatcagtgagctggccgcaaaacagctgggtctgccgccgcagatcgtgtttgaagccattctgactcgtgaaaaaatgggcagtaccggcatcggcaatggcattgcgatcccgcatggcaagctggaagaagatacgctgcgtgccgtgggggtgtttgtgcaactggaaacgcctatcgcttttgacgccattgataaccagcctgtggatctgctcttcgcactgctggttcctgccgatcagacaaagacccacctgcacacgctgtcgctggttgccaaacgtctggcggataaaaccatttgtcgtcgactgcgctcagcccaaagtgatgaagagctttatcaaattatcactgaagcagaaggcaatcaggatgaggcataa

SEQ ID NO: 1679 - DNA, 900 bp, Enterobacter cloacae
tcgggaaagggccttcagaacggctgccctgaggagaaacggaacatggtgctgatgatcgtcagtggtcgttcggggtccgggaagtccgtggccctgcgcgcgctggaagacatgggattttactgtgtagataacctgccggtagtgttgttacccgatctggcgcggacgctggcggacaggcaaatctctgccgccgtcagtattgacgtgcgtaacatgccggaatcgccggaaatcttcgagcaggcaatgaacagcctgccggaatgcttctcgcctcagctcttgttcctggacgctgaccgcaacacgctgatccgccgttacagcgatacacgtcgtttgcatccgctctccagtaaaaatctttcgctggaaagcgccatcgataaagagagcgatctgcttgagccgctgcgttcgcgggccgacctgattgtcgacacctctgaaatgtccgtccacgagctggcggaaatgctgcgtacgcgcttactcggcaagcgcgagcgtgaactgacgatggtgtttgaatccttcggctttaagcatggcatacctatcgatgcggattacgtttttgatgtgcgtttcctgccgaacccgcactgggatccgaaactgcgtccgatgaccggtctggataagccggtggcggcgttcctcgaccgacacacagaagtgcacaattttatctaccagacgcgaagctaccttgagctatggttacctatgctggaaacaaacaatcgtagctacctgacggtggcgattggctgtaccggcggtaaacatcgttcggtctacattgccgaacagctggccgattacttccgctcacgcggaaagaacgttcagtcccgtcatcgcacgctggaaaaacgcaaaacatga

SEQ ID NO: 1680 - DNA, 594 bp, Enterobacter cloacae
ggcgaaagggcaatcgatatgagtaaaaccagacgttgggttatcattctgcttgcgcttgtcgccctgatactgattggcgtaaatctcgctgaccgcgatgatacgcaagcggaagtggttaacacgagcgacccgacctataaaagcgatcacagcgacaccgtggtctatagcccggaaggtgcgctgaactatcgcctcgttgctcagcatgtagaatatttttcagatgacggcacctcgtggtttacccagccggtcctgaccacctttgatacggacaaagtgccgacgtggtcaatcaagtctgaccgggcaaaactgacaaatgaccgtatgctttacctgtatggtcacgttgaagtcaacgccctgaccgctgacgcgcaactgcgaaaaattacgacggataacgcccagatcaacctggtcacccaggatgtcacgtcgcaggatttagtcaccctgtatggcacaacatttaattccagcggtttaagaatgcgcgggaacttacgcagcaaaaacgccgagctgattgaaaaggttagaacctcctatgaaattcaaaacaaacaaactcagccttaa

SEQ ID NO: 1681 - DNA, 1473 bp, Enterobacter cloacae
aggttaagtcacgccgaaccggagaaaaacgctctgaacatgaagcaaggtttgcaattacggctcagccagcaactggccatgacgccgcagctccagcaggcaatccgtctgttgcagctgtccacgttagaactccagcaggagctccagcaggcgctggacagcaatccgctgctggagcagaccgatcttcatgacgaggtagacgcccagcagacgcaggacacagaaacgctcgactccgtagatgcactcgaacagaaagagatgccggacgaactgccgctggatgccagctgggatgaaatctacaccgcgggtaccccttccgggacgcgtgcagactaccaggacgatgaactcccggtctaccagggcgaaactacccaatcgcttcaggactacctgatgtggcaggtggagctgacgcctttctctgataccgatcgcgccattgccacctcgattgtcgatgccgttgacgacacgggctatttgaccgtgacgctggacgagattcttgaaagcatcggcgatgacgagattgaactggaagagatcgaagccgtcctgaaacgcgttcagcgtttcgacccgattggcgtcgccgcgaaagatctgcgtgactgccttctgatccagctttcgcagtttgctaaagagacaccgtggattgacgaagcccggctcatcatcagcgatcatttggatctgctggcgaaccacgacttccgcaccctgatgcgcgtcacgcgcctgaaagaagaggtgctgaaggaagcggtgaatctgatccagtcactcgatccgcgtccggggcagtcgattcagaccagcgaaccggaatatgtcattcccgatgtgctggtgagaaaacacaatggccgctgggtcgttgaactgaacgccgacagcattcctcgcctgcaaatcaaccagcaatacgcctccatgtgcacaagcgcccgtaacgacgctgataatcaatacattcgcagcaaccttcaggaagcacgctggttgattaagagtctggagagccgtaatgacacgctgctgcgcgtcagccgctgtattgtcgaacagcagcaggcattctttgagcagggcgaagagtttatgaaaccgatggtgctggcggacatagcccaggccgtcgagatgcatgaatcaaccatttcccgcgtgaccacgcagaagtatctgcacagcccacgcggtatttttgagcttaagtatttcttctccagccacgtgaacaccgaaggcggcggcgaagcctcgtcgacggccattcgcgcactggtgaagaagttgatcgccgcggagaaccccgcgaagccactcagtgacagtaagttaaccaccatgctgtccgatcagggtattatggtggcacgtcgtactgtcgcgaagtatcgagagtctttatccattccgccgtctaaccagcgtaaacaactggtttga

SEQ ID NO: 1682 - DNA, 833 bp, Enterobacter cloacae
tagacctgagcgcggattctggcagctccctgatgaagacacccgtgatgcaggttgcgctgtcggtaatgaaaaccgcgatcccgctggtgctgttgaccatggcgattggcgaatgggtcgcgccgcagggcgaacagatggcgcgtaactaccgtgctcaggctatgtacggtggttcgctgctctccacgcagcaggggttatgggcgaaagatggtcagaacttcgtctatatcgaacgcgtgaaaggggacgatgaactgggcggcgtgagcatctacgccttcaacaacgatcgtcgtttgcagtcggtgcgttatgccgcctccgctaaatttgatgcgaacaacaagctgtggcggttatcccaggttgatgaatctgacctgacgaacccgaaacagatcaccggttcgcagaccgtaagcggtacctggaaaaccaacctgacgccggacaagcttggcgtggtagcgctcgatcccgatgcgctctccatcagcggtctgcataactacgtgaagtatctgaaatcgagcggacaggatgcggggcgttaccagctcaacatgtggagcaaaatcttccagccactgtccgtggcggtgatgatgctaatggcgctgtcgttcatctttggaccgctacgtagcgtgccgatgggggtccgcgtggtaactggtatcagctttggtttcgtgttctacgtcctcgatcagattttcggtccgctgacactggtgtatggcattccgccaattatcggcgcgctgttgccgagcgccagtttcttcctgatcagcctctggatgctgctaaaacgctcctga

SEQ ID NO: 1683 - DNA, 501 bp, Enterobacter cloacae
aagataaaaaagagtacctcgaggccggaatggacgatgtgctcagcaagccgctggcggtacctgcccctgacggcgatgatcaagaagttctgggatacctgtgatgaagaggagagcaccatgacgtctgttgatagcgccaaagcccaaacgatactggataccgccatgctggagcagtatatcgatctggtaggaccaaaactgatcaccgatggcctggccgtgttcgaaaaaatgatgccgggctatctgaacgtgctcgaatccaacctgacggcgcgtgaccagaagggcatcgtcgaagagggacataaaatcaaaggcgcggcaggatcggtcgggttacgtcatctccagcaactgggccaacagattcagtcgcctgatttacctgcctgggaagataatgtaggtgattgggtcgaagagatgaaacaggagtggcaaaacgatgtggcagtgctgaaagcctgggtagatgccagaaaaaaatga

SEQ ID NO: 1684 - DNA, 759 bp, Enterobacter cloacae
aaagctggtggacagagtgctggttcttaccgaatgagtcgtaaattatcccctggcggttggttaaaacggatcctgctgcgtattgtgctggtcctggccgttttttggggcggaggcattgcgctgttcagcatcctgcccgtcccgttctccgccgtgatggcagagcggcagattagcgcctggctctcgggtgattttggctatgttgcccactcagactgggtcggcatggatgaaatctccccgtggatggggctggcggtcattgcggcagaagatcagaaattcccggagcactggggttttgacgtggcggctattgagaaggcgctggatcataatgaacgtcatgaaaaccgcgtccgcggcgcgtcgacgctttctcagcagacggtaaaaaacctgttcttatgggacggtcgcagctgggtgagaaaagggctggaggccgggctgacgctgggcgtcgagacggtgtggagcaaaaaacgcattttgaccgtctacctgaatatcgcggagtttggtgacggcgtgtttggcgtcgaagcggcatcgcagcgctattttggcaagcccgccagcaggttgactatgtccgaagcggcactccttgccgccgtgctgccgaacccgctgcgttttaaggccagcaccccgtcaggctacgtgcgaagccgccaggcgtggattatgcgccagatgcgtcagttgggtggggaagggtttatggagcgaaataatcttatgtag

SEQ ID NO: 1685 - DNA, 798 bp, Enterobacter cloacae
ggagttaagccactcatgctgttaaatgcgttggcgggtcttggacaccgtggcctaaaaaccatcagtacgttcgggcgtgccggattaatgttgttcaacgcgctggtcggcaaaccggagttccgcaagcatgcgccgttactggtgcggcagctctataacgtcggcgtgctgtcgatgcttatcatcatcgtgtcgggtttgtttattggcatggtgctggggttgcaggggtatctggtactgacaacctacagcgcggaaaccagccttggcatgctggtggcgctctcgctgctgcgtgaactcgggccggtggttgccgcgctgctgttcgccgggcgtgccgggtcagcgttgacggcggaaattggcctgatgcgcgccaccgagcagctctccagtatggagatgatggcagtcgatccgctgcgccgggtgatctcgccgcgcttctgggccggggttatctccttgccgttactgactatcctctttgtggcggtaggtatctggggaggcgcgctggttggcgttaactggaaaggcattgatgccggattcttctggtctgccatgcaggacgccatcgatctgcggatggatctggtgaactgtctgatcaagagcgtggttttcgctgtgacggttacctggattgcgttgtttaatggttacgatgccattccgacgtcggcgggcattagccgtgcaacgacgcgtactgtcgtacattcgtcgctggccgttttaggtctggattttgtgctcaccgcactgatgtttgggaattga

SEQ ID NO: 1686 - DNA, 357 bp, Enterobacter cloacae
tggcctgacggctcagcttcagtccatctctcgtcagaaaattaccctggacgagaagaagtaatgtcacagcagcttagctgggcgcgtgacggcgagacgttgacgctgacgggagagctggatcaggatctgcttaacccgctgtgggacgctcgccataacgcgatgcagggcgtgacgctgattgatctccatggcgtcacgcgggtagataccgccggtatcgccctgctggcgcacctggtggccacgggcaaaaagcaggggagtagcgtcaccctgacgggggtaagcgataacgtgattacccttgcacagctttacaatttgcccgaagacgtattacctcgctaa

SEQ ID NO: 1687 - DNA, 381 bp, Enterobacter cloacae
ttttttcagtacgttacttctgaaagccccgacagtttacgcgtcggggctttttgcttgtttaagaccgcgccactttgctctaagatgttgagcttgttttcactatcagatgatgtagaccccatggaaaataatgaaatccagactgtgctgatgaatgcactctcccttcaggaagcccacgtctctggcgatggcagtcacttccaggttattgctgtgggtgagatgttcgacggaatgagtcgcgtgaagaaacagcaggctgtgtacgcgccgctgatggaatacattgcggataaccgcatccacgccctgtcgattaaagcgttcaccccacaggagtgggcacgcgatcgcaaactaaacggtttttga

SEQ ID NO: 1688 - DNA, 702 bp, Enterobacter cloacae
tcagaatttttaatgtgcttcagcgagttgcttagaaggatcgtcagaatgaagaaagtgggtgtcgtgctgagcggatgtggcgtttacgatggttcagagatacacgaaaccgtattaacgctgctggcattatcgcggcagggggcagacgttatctgcttcgcgccggataaaactcaagcagacgtaatgaatcatcttaccggcgagccaatggcggaaagccgtaacgtgctgattgaagcagcacgtattgtgcgtggagatattcatccgctggcacaggccgatgccgctgaacttgatgcgctcatcgtgccgggcggctttggcgcggcaaaaaacctgagcacgtttgcaacagaaggcgcggcgtgccatgtcgatcccgatttgaaagcgctatcgctggcgatgcatgcagcaggtaagccgcagggctttatctgcattgcgccagccatgctgccgaaaatttttgatttcccgctgcggctcacgatcggaaccgacattgataccgctgaaattatcgaggatatgggcggcgagcacgtgccatgcccggtcgacgacattgtggtggatgaggacaacaaaatcatcaccacgccggcgtatatgctggcgcagaatatcgctgaggctgccgcaggcattgaaaagctggtggacagagtgctggttcttaccgaatga

SEQ ID NO: 1689 - DNA, 567 bp, Enterobacter cloacae
tgtttgggaattgagttcatgcaaacgagaaaaaatgaaatttgggttggcgtgtttctgcttctggcgctgctggccgcgctgttcatctgcctgcgagcggcggacatcacctctgttcgcgccgagccgacgtaccgtatctacgctactttcgataacatcggcggcctgaaagcgcgctcaccggtgcgtattggtggcgtcgttatcggacgtgtcgccgacattacgcttgatgagaaaacctatctgccgcgcgtcgcgatggatatcgaagagcgctataaccacattccggacaccagctcgctttctatccgcacctctggcctgctgggggagcaatatctggcccttaacgttggttttgaagatcctgagctgggaacgactatccttaaagacggtagcgtaatccaggataccaagtcagcgatggtgctggaagatatgattggtcagttcctttacaacagtaaaggggatgataaaaagtctgacgatgcccctgcgcagagtgaagaccacaccaacgtcgaaccgacgccaggcgcgacgaattaa

SEQ ID NO: 1690 - DNA, 654 bp, Enterobacter cloacae
tttcaggagaagttattcatgtttaaacgactgttaatggttgccatgctggtcattgcccctcttaccgcggcgcacgctgcggatcagagtaacccgtacaaactgatgaatgaggccgcgaagaaaaccttcgaccgtcttaaaaacgaacagccaaaaatccgttctaaccctgattatctacgtgatgtggtggatcaggagctgctgccgtatgtgcagatcaagtacgcgggcgcactggtgctgggccgttactacaaagacgcgaccccggcgcagcgcgaggcttactttgcggcgttccgtgaatacctgaaacaggcttacggccaggcgctggcgatgtatcacgggcagacctatcagattgcccctgaacaaccgctgggcgatgccactatcattcctattcgcgtgacgattatcgatccaaacggtcgtccaccggttcgtctggacttccagtggcgtaaaaacagtcagaccggaaactggcaggcgtacgacatgatcgctgaaggcgtcagcatgatcaccactaaacagaacgagtggagcgatctgctgcgcactaaaggcattgatggcctgacggctcagcttcagtccatctctcgtcagaaaattaccctggacgagaagaagtaa

SEQ ID NO: 1691 - DNA, 1977 bp, Enterobacter cloacae
gtattattgagcgataaagtcgtgaagggatcctctatgaagcaaattcgaatgctggcccagtactacgtcgacctgatgatgaagctcgggctggtgcgtttttccatgctgctggcgctggcgctggtcgttctggccattgtcgtgcaaatggccgtgaccatggttctgcatggacaggtcgagagcatcgacgtgatccgctctattttctttggcctgctgatcaccccatgggcggtctatttcctctccgtggtggttgagcagctggaagagtcccgacagcgtttatcgaaactggtggataagctggaagagatgcgcgagcgcgatcttaaactcaacgttcagctcaaggacaacattgcccagctgaatcaggaaatttcagaccgtgagaaggcggaagccgagcgtcagaccacgcttgagcagctgaaaattgagatgaaagagcgcgaagtcacgcagatccagcttgaacagcaatcctctttcctgcgctcgttcctcgatgcgtcgccggatctggtgttctaccgtaatgaagataaagagttctccggctgtaaccgggccatggaactgttgaccgggaaaagcgaaaaacagctgatacacctgaaacctcaggatgtctattccgaagaggcggcagcaaaagtgatggagacggatgaaaaggtcttccgccataacgtttcgctgacctatgagcagtggctggactaccccgacgggcgcaaagcctgctttgagatccgcaaagtaccttattacgaccgggtgggtaaacgtcatggtctgatgggctttggccgtgatatcactgagcgtaagcgctatcaggatgcgctggagcgcgccagccgggataaaacaaccttcatctccaccatcagccatgaactgcgcaccccgctgaatggcattgtggggctgagccgcattctgctggataccgagctgaccagcgagcaggaaaaatacctcaaaacgatccacgtctcggcggtcacgctgggcaatatcttcaatgatattatcgacatggataagatggagcgccgtaaagttcagctcgacaaccagccggttgattttaccggcttcctcgcagacctggagaacctgtcaggtttgcaggcccagcaaaaagggttgagctttgtgatggagccgacgctgccgctgccgcataaagtggtgacggacggcacgcggctgcggcagatcctgtggaacctcatcagcaatgccgtgaagtttacccagaaggggcaggttgcggtgcgcattcgctatgacgaaggcgacatgctgcactttgaagttgaggactcgggtatcggcattcctcaggaagagcaggataagatcttcgccatgtattatcaggttaaagacagccacggcggtaaaccggcgaccggtacgggcattggcctggcggtgtcgaaacgtctggcgaaaagtatgggcggggatatcaccgttgccagccagccgggtaaaggctccacctttacgcttaccgtccatgcgcctgccgtagcggaagaggtggaagatacgtttgagaacgatgatatgccgctgccagccctgcacgtcctgctggtggaagatattgagctgaacgtcattgtcgcccggtcggtactggaaaaactcggtaacagtgtggatgtggcgatgaccggcaaagccgcgctggagatgttcacgccgggcgagtacgacctggtgctgctcgatattcagctaccggacatgaccggactggatatctcccgcgagctgacgcgcaaatatgctcctgacgagctgccgccgctggtggcgttgaccgcaaacgtgctgaaagataaaaaagagtacctcgaggccggaatggacgatgtgctcagcaagccgctggcggtacctgcccctgacggcgatgatcaagaagttctgggatacctgtga

SEQ ID NO: 1692 - DNA, 813 bp, Enterobacter cloacae
atgagccaaacgatggcgaatatagtcgatgtccggggcgtcagtttttctcgcggcaaccggttaatatttgatgatatttcgctgaccgtgccgcgcggtaaaatcaccgccatcatggggccgtcagggatcggtaaaaccacgttgctgcgtcttatcggcgggcaaatcccccctgacagcggcgaaattctcttcgacggcgaaaacgtcccggcgatgtctcgctcgcgcctctacacggttcgcaaacggatgagcatgctctttcagtcgggggcgctattcaccgatatgaacgtttttgacaacgtggcctatccgctgcgtgagcacacccatcttcctcctgcgctgttgcacagcacggtgatgatgaagcttgaagccgtggggctgcggggggctgcgaaactcatgccgtccgaactctcgggtgggatggcgcgccgcgccgcgctggcgcgtgctattgccctggaacccgatttaatcatgttcgatgaaccgttcgtcgggcaggaccccatcaccatgggcgtgctggtgaagttaatttcggagctgaacagcgcccttggcgtcacctgcgtggtggtttcccacgacgtgccggaagtgctgagtatcgctgattacgcctatattgtggctgacaaaaagatcgtcgcccacggcagcgcgcaggcgttgcaggagaatggcgatccgcgcgtgcggcagttcctggacggtatcgcagatgggccggtgcctttccgctatccggcgggcgactatcatgacgatttactgggaatagggagttaa

SEQ ID NO: 1693 - DNA, 1305 bp, Enterobacter cloacae
gggcgaaacgcccgcagcacggttgaatttataagagagcaaacgatggataaatttcgtgtacagggacctacgcgtctccagggcgaagtcacaatttctggcgctaaaaacgccgcgctgcccattcttttcgctgcgctgctcgcagaagagccggtagagatccagaacgtaccgaagctgaaagatatcgacacgaccatgaagttgctcggccagttgggcaccaaagtggagcgtaacggttccgtctggatcgatgccagcaacgtgaacaacttctcagcgccgtatgagctggtgaaaaccatgcgtgcgtccatctgggcgcttggtccgctggtggcgcgcttcggtcagggacaggtttcactgccgggcggatgcgctatcggcgcgcgtcccgttgacctgcatatcttcgggctggaaaaactcggcgcggagatcaagctggaagagggttacgttaaagcatccgtcaatggtcgtctgaaaggcgcgcacattgtcatggacaaagtgagcgtgggcgcaacggtcaccatcatgtcggctgctacgctggcagaaggcactaccatcatcgaaaacgccgcccgtgagccggagatcgtggataccgcgaacttcctggtcgcgctgggagcgaagatcagcgggcagggcacagaccgtatcaccatcgaaggcgttgaacgtctgggtggcggtgtgtatcgcgtactgccagaccgtatcgaaaccggcactttcctggtggccgcggccatttctggcggtaagattgtctgccgtaacgcccagccggataccctggatgcggtgctggcgaagctgcgcgatgcgggtgcggacattgaaatcggtgaagactggatcagcctggatatgcacgggcagcgtcctaaagccgttaacgtgcgtactgcgccacatccggcattcccgacggatatgcaggcacagttcacgctgttgaacctggtggccgaaggcacgggcttcatcacggaaaccatcttcgaaaaccgtttcatgcacgtaccggaactgatccgtatgggtgcgcatgctgagattgaaagcaacacggtaatttgccacggcgttgaaaaactgtccggtgcgcaggtgatggcgaccgatctgcgcgcatctgcgagcctcgtactggcaggttgtattgcggaagggactaccgttgtcgatcgtatctaccacatcgatcgtggttacgagcgtattgaggataaactgcgcgcgctgggtgcaaatatcgagcgtgtgaagggcgagtaa

SEQ ID NO: 1694 - DNA, 1020 bp, Enterobacter cloacae
gaggatcatagtgtcattcatggtgcggctttcgcaccaccgccccggcggtaccgggcagaactggagtacctcatgaaactttcccgtcagacgacttctgatacttctgttgatggccgttcacgcgcatatgcctggggccgtgtccattatttcattatcgaacatgcaccaatggctgagctggtcgctattgacgagctgctggaaaaagctggctggagcaatgacggctgtccgaactatgagaaagatgacgagtttggtaatgctggttacagctgtggttactggatcgatattgacagcgtgggaagcttcaaggctgactacaaacgtcttaagggtgagattagtgcgcatatcgcctcaaaggcggcagaggtggagatccgcgtactggactcgatgtccgacaaagaatgtaaagatgttgcctcggtggcatgtactgttcgccgtgacttacgtacgcagtccgaatcgcttcattcactgcgtactatcgtaacggttgatcattacaatccctatgtgatcaccagccgcccgctgagcatttccgcctggacacttatccacgactgtctgaaaaccggcaccatcaatgacgtctgttcacggttgagttcattaatcctgcactctgaagccgcgattgcccgttgtaagggaagctccgactactcttcggaacacgctcagctatcgttttttgctggtaacgactatgtcaccagacgcacccttgttgatgcagctcacgaagaggctctgcgaatgaaccgccgctttgatgaacgtattgcaatgaacgcggattctgatgccagaaggctccagtgcgaattcaacctgagcaaccatgtcgtacagcgtcggaccgttgaatctgctcatatccaggcaatcaacgaagacgtcacccgttcacaggcggaaccacgctgccctggaaagcttcttctgaaaatgaccagtcatgaggaagtgcgggactcactgagcacctgttag

SEQ ID NO: 1695 - DNA, 201 bp, Enterobacter cloacae
ttacaaatgtcattacaagtatcgcactacaacatgcttagggcaagtcacgaagtaagtcagaaagtagtcgtaagaacggtgatcactgtccgctttgtgccagaagcggactttttaaaaatattgcgtgcccaacaattgggcgcaggtcacatcaagtaccctcagaattatagagaatacctgaaatttttgtag

SEQ ID NO: 1696 - DNA, 300 bp, Enterobacter cloacae
gctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtcaggcaaggcgctatccagggataa

SEQ ID NO: 1697 - DNA, 252 bp, Enterobacter cloacae
catggtttccagcggataaggtcgccggccattaccagccttggggtaaaacggctcgatgacttccaccatgttttgccatggcagaatctgctccatacgggacaagaaaatctcttttctggtctgacggcgcttactgctgaattcactgtcggcgaaggtaagttgatgactcatgatgaaccctgttccatggctccagatgacaaacatgatctcatatcagggacttgttcgcaccttccttag

SEQ ID NO: 1698 - DNA, 855 bp, Enterobacter cloacae
aatgtccccagacaattctctgggggatttttcatgatcaaagagactgttacgatgagtcataaggaactcgaccgacttcacattattcaggagtcacttaatcgccatattactcaggaacaagctgcggcacgcattggcatttctattcggcaggttaaacgtctggtgcaacggtatagaaatgaagggccttctggtctagtttcccgccgacgtggaaagcgtcccaataattccttttctaccgaattcagagcaacagtaatttcactcctcaaaggccgctacgctgattttggacctacgcttgcgtgcgaaaaattgcgcgagatacacggcttgtgtttatccattgaaactctcaggaagtggatggtagaggagggcatatggcgcgaacgtcgtcgtaagtttgcccgaatttatcagcgccggatgcggcgcccatcctacggtgaactcatccagattgatggctcgcctcatgactggtttgaaggtcggggccccaaatgcacactgatagtctttttcgatgatgctaccagcgctctgatggcgctacgattcgctcctgcagaaacaacccgggcttacatggaaaccctccggggttaccttaatgatcatggcgtaccactggctctctattctgacagacacagtatattcagagtaaataacccggagcgggaaaggagagttgactcagttcacacgtgcgataaagacactgggcatcgagccaatccatgccaacagcccgcaggcaaaagggcgggtagagcgtgccaatcagacactgcaggacaggctggtcaaagaaatgcggcttcagggtatcagtga

SEQ ID NO: 1699 - DNA, 642 bp, Enterobacter cloacae
aggggtttcatgttaatcataggcgcgtgtacccgttttatcacttcagtggcctgggcgttaaaccgcagaagacgtcgtaaagggctggcaacagaacgtctgccgtgcttccttccggcggcgcccaatctgacctggtcgatggatttcgtcatggacgcactttccaccggtcgcaggatcaagtgtcttacctgcgtcgatgatttcacaaaggaatgcctgacggtcactgttgcctttgggatttcaggcgttcaggtcacgcgtattctggacagcattgcactgtttcgaggctatccggcgacgataagaactgaccaggggccggagttcacttgccgtgcactggatcaatgggcctttgagcatggtgttgagttgcgcttaatccagccgggcaagccaacgcagaacggatttattgagagctttaacggacgatttcgcgatgaatgtttgaatgagcactggttcagcgatatcgttcatgccaggaaaattattaatgactggcggcaggattataacgaatgccgcccgcactccacgctgaattatcagacaccgtctgaatttgcagcgggctggagaaagggtcattctgagaatgaagattccgacgttactaactga

SEQ ID NO: 1700 - DNA, 1053 bp, Enterobacter cloacae
gtgttgtatctaatcgtgggggcaggtcatggcgattctctgaataatgctaatatgtggggtggggaaatccttaatcgagttcaacaatgtaccagttacactttggcattaacagggaccccatggagaacggataataatcctatagtgctttcaaattacactgatccgcaagggaagatctgttgtgactatgtatatggtctacacgaggctattgtcgatggggtttgtcgtaaacctaaaattgctcttataaatagtaataatttactttattcatcaggggaagttgttcagcattttgattccatagcaggtttcctgagtgaaaccatcacttcgtatcaatcaataatttggcatccagatgcaatgaagtatttactcaaatctggatgtaaaaaactttgtgaaatacgtaaggttaattctgacgcgggtggtttagttgtcgcttcttctgtcgaacatgcatatcaactactgaatatattggaaaacgaattcgcccaaactgcgacaattgtgacgtaccacgatcgagatgctttggttaagatagagaattatcggcaatcaactacagaatggattgttagcgttggtatgattagtgagggcacagatatccctagactacaggtgtgctgccacctaagttctgtcaaaacagaactttacttcagacaagtattgggtagaattttacgggtgaatcaaagtgaaaatcaagaagcctggttatttactatcgctactgatgaactgactttattctcgaatagactggccgaagatttgccagaagactataagatactgcagaaacaatcggatgagtggtcattatctatacatgagactgagtctacatccccagaaatagtgcgcagaaatggtatgtcaaaaatcggagagtttaatttgaaaatgaatttcagtgaaataactatatcgccacctgctgttttagacaaaacaaaacaactaaacatgggttctctatatcaacaggtgatcgacgcatttttattttcagttatttga

SEQ ID NO: 1701 - DNA, 279 bp, Enterobacter cloacae
tctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccaaggtggagcacccatttcgcatcatcaagcgacagttcggcttcgtgaaagccagatacaaggggttgctgaaaaacgataa

SEQ ID NO: 1702 - DNA, 690 bp, Enterobacter cloacae
ataacccggagcgggaaaggagagttgactcagttcacacgtgcgataaagacactgggcatcgagccaatccatgccaacagcccgcaggcaaaagggcgggtagagcgtgccaatcagacactgcaggacaggctggtcaaagaaatgcggcttcagggtatcagtgatattgaaacagcaaacgcatggttgccgacctttattgaagcctataacaaccggtttgctacgccgcctcgtattgctgataacgcccatcttgatgtacaccattctgaagaggaactgggttatatcttcagcctccaggcgaagcgcgttctctccaaaaatctcactttccagtacaaaagcagtgcgtttcagattcgcagtgaaggccggggatatcgacttcggcattcggttgtcacggtatgcgaaagctttaacggtgaaattaaggttctgtatgatgggaaagcgttgggatgggaaaaatatgttgatggcccggagcctataccactggatgatgaaaaaagtgtccatgaacgtgtggataatgcccgttttgatttacgctcaaaattctacgtaaaacctaaagctgaccatccttggctcacgcgccgcacgcaaagtaatcagcaagtgaagccccctaaattacccagaaagaaggctgatcccgataaaatggactga

SEQ ID NO: 1703 - DNA, 948 bp, Enterobacter cloacae
tcgtcctattttaggaagttaataatgactaaaacaaaagggttacctcgtccgctgacgcactacgcttggctttccattgccacggctattgccactatcggactcaaaggtgtggcgtggaaaatgaccggttcggtcggtctgctatctgatgccatcgaatccgtagttaacctcgcaggagccctaatggcgctctggatgctgaccttggctgcgcttccggccgatgagaaccatgcatatgggcacggcaaagccgaatatttctcgagtgctttcgaaggatttctgatcctattggcggcagccagtatcgcctataccgcagttgagcggatgttaactccacagccgcttgaggagattggtctcggattactggtttcaacagtcgcatcaatccttaattttgtgacggctcgcattttgttaagggctggcaggcagcacaactctatcactcttgaggcagatgctcatcacctgctgaccgatgtctggacgtcggtcggtgtcatttttggtgtcggactggtttatctgaccggctggttttgggtcgatccgatcgttgcattgctggtcgcagccaacatcgtttggactggttatcagcttatgagtcgttcagctgcaggtctgatggacgtatcgctacccacggaagaactcaaaaaaatcgagtcactgctggcaggatatcgtgaacaggggcttgatttccatgcactacgtacacgccaggctggcgggcgggcgtttatgacaatgcacatcctagttcctgggcgatggactgttcaatatgggcacgactgggccgagcgtatagagaatgatatccgcaccgcactgccttttatccatatcaccactcatgtggaaccgttggaagatcccgcgtcaatgaacgaccaaacgctcgacatttctgatcactaa

SEQ ID NO: 1704 - DNA, 294 bp, Enterobacter cloacae
actctgatggcgtattttctggattttgacgagcgggcactaaaggaatggcgaaagctgggctcgacggtacgtgaacagttgaaaaagaagctggttgaagtacttgagtcaccccggattgaagcaaacaagctccgtggtatgcctgattgttacaagattaagctccggtcttcaggctatcgccttgtataccaggttatagacgagaaagttgtcgttttcgtgatttctgttgggaaaagagaacgctcggaagtatatagcgaggcggtcaaacgcattctctga

SEQ ID NO: 1705 - DNA, 1026 bp, Enterobacter cloacae
tatgagatcatgtttgtcatctggagccatggaacagggttcatcatgagtcatcaacttaccttcgccgacagtgaattcagcagtaagcgccgtcagaccagaaaagagattttcttgtcccgtatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtcggtttgcccggttatccctggatagcgccttgcctgaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctagtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccaaggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaa

SEQ ID NO: 1706 - DNA, 1374 bp, Enterobacter cloacae
tcgccgcttttctttcgagccagtaggtgctccacgttcgctaacgaatactcagggcatgcagataaactgctggctatatttctttcgaagagcgtggaatgcataccaatccccgataaaaaggagttggtgatgactgtgactaatcaatttgctgcgcacgttggtctggactgggctgataaaaaacacgatgtctgtgttcagtttaaaaacggtgaacgcgtattcgatgtgattgaacatacagcagaagcgcttgatgcctggcttactgagttacaccagaaagtaaaaggtagaatcgcaatagctctcgaactgaagaagggccccgtggtatatgctcttcaaaaatacccctttatcaccgttttccccgtccacgcattgtccctggctcgttatcggcaagccttctcgcccagcggcgctaaagatgatccgcaggatgccgagctggcattagagttaatgctgcgttacccccagaagataaaagctattgaacccgacaatgcggatattcgcttacttcagcaactggttgagcaacgtcgtcagttggttgaagataaacgacgctttgtgaaccggataatcaacacgcttaaacagtattatcctcagccactggagtggttctcacatcggggtagcttactgttgtgtgagctgattatccggtggcccagtctgcaacaactgaaacgagccagacgcgacacgatccgcaactttctgaatgccaaaggtggtcgcgctatggcccttaccgagcaacgtgttgcgagtattgataatgcgatcccattgactacagacccgagtgttatagaggctaatgctttgatggcagcagcactggcgacacaaattaaagtcgtgagtgaaatcatcaaaacctatgacgaacgaatcgaaacgctgtttgacacattgccagatgcggggctgttcaaatcacttccgggcatgggaccgtgcatgggcccacggatgcttgctgcacttggtgataatcgtgaccggtttaacagcgctgaagaaattcaaaactacgcaggtatagcaccggtgaccgaacgaagcggccaaaaatcatgggttcactggcgatggcaatgtgccaagttcgtcaggcagacctttgttgaatgggctgccaagacggttaattcatcatactgggccaaactgtattatcagggccttagagaaaagggcaaatctcatcagtctgcgatccgggcactggcgttcaaatggataaggatcatttaccgctgctggaaggccagaacctgttatgacgaagcgaaatatttgctggctctcgaagcgagacactcgcccttactgaagccataa

SEQ ID NO: 1707 - DNA, 243 bp, Enterobacter cloacae
gacatgggtagcattaacctacgtattgacgatgaacttaaagcgcgttcttacgccgcgcttgaaaaaatgggcgtaactccttctgaagcgcttcgtctcatgctcgagtatatcgctgacaatgaacgcttgccgttcaaacagacactcctgagtgatgaagatgctgaacttgtggagatagtgaaagaacgacttcgtaatcctaagccagtacgtgtgacgctggatgaactctga

SEQ ID NO: 1708 - DNA, 189 bp, Enterobacter cloacae
cacttctgctttgcgttgacaggagaagaaggccatgaaaatgccgaaccaacccattgttttgtgcatattaatagtttgtttaacgctgttgatattcacctggctcacacgaaactcgctttgcgagttgcggatgaaagacggaacaagggaggtatctgctatcctggcctacgaatccggtaa

SEQ ID NO: 1709 - DNA, 1212 bp, Enterobacter cloacae
ctgtgttatggtcatcaaaaactcaaacgtgtagaagtcaaacaaatgaaaataaccatctccggaacaggctatgttggtctctcaaacggtattctgattgcacaaaaccatgaagtggttgcgctggatatcgtgcaggcaaaagtggacatgcttaaccagaagaagtccccgatcgtcgataaagagattgaagaatacctcgcgactaagccgctgaacttccgcgctaccacggacaaagaagacgcataccgcgatgcggatttcgtcatcatcgccacgccaaccgactacgatcctaaaaccaactacttcaatacctcaactgttgaagcggtgatcaaagacgttacggcaattaacccgaacgcagtgatgatcatcaagtcgacgattccagtgggcttcaccaaatcgattaaagaagagttgggtattgataatgtcttcttctcgccggaatttctccgcgagggcagggcgttatacgataacctgcacccatcccgtatcgtgattggcgagcgttccgagcgtgcggagcgttttgctgcgttgcttcaggaaggcgcaatcaaaaaagatattccggtgctgttcaccgattccaccgaggcagaggccattaagcttttcgctaatacctatctggcgatgcgtgtggcttacttcaacgagctggacagctatgccgagagcttaggtctgaacacccgtcagatcatcgagggcgtgtgtcttgacccgcgtatcggtaaccactataacaacccgtcattcggttacggcggctactgtctgccaaaagacaccaagcagttgctggctaactatcaggcggtgccgaacaacctgatttctgccattgtggatgccaaccgtacgcgtaaagacttcatctcggattccattctcgcgcgtcagccgaaagtggtgggcgtgtatcgtctgatcatgaagagcggttccgataacttccgcgcttcttccattcaggggatcatgaagcgtattaaggcgaagggcgtgcaggtcattatttatgaaccggcgatgcaggaagatgagttcttccattcgcgtgtgatccgcgatctggatgcgtttaagaaagaagcggatgtaattatctccaaccgcatggcggaagagctcgcggacgtgaaagataaagtctatacccgcgatttgttcggcagtgactga

SEQ ID NO: 1710 - DNA, 468 bp, Enterobacter cloacae
cgcgcgcaaacctcttcatacagcgagacgttagagcctgcgagcgtaccatcgcgtgaaatatccgtgcacaggacgtgcttcagccctacggggagatacatcccgaccagctcttccagcgttacgccggagttttcctgccagccgctgaccgcgacctgcttgttaccctgttcgtcaatgcgcacatccagcgccagcaccagcgcatccgcaccgaagcggcggaaccagcccttgacactctcaggatctttcacagcggtcgaaccgaccaccacgcgcgccacgcccgcgtccagtaaggcggcaacatcggcttccgtacgcacgccgccgcccacctgcaccgggacgtccacgccagccaccagtgttttaagcagcgggatttggcgcttcgccggatctttcgcgccggtcagatcgaccagatgcaacacctcagcgccctcggcggcgtaa

SEQ ID NO: 1711 - DNA, 351 bp, Enterobacter cloacae
gaatggatactgtcccgaacgccagggcagaaatcgcctgcgcaccgcccactttatagatcgcctgcacgccgcacagcttcgccgcgtacaggatctcatcggcaattggtggaggagagcagagcaccaccttctgacaaccggcaatacgtgccggggtggccagcatcaggacggtcgaaaacagcggagcagagccgccgggaatatagaggccgacggacgccaccggtcgcgtcacctgctggcagcgcacgccgggcagggtttccacatccaccgcctgcaatttctgcgcggtgtggaaggtatcaatatttttcaccgcgacggccatcgcctgtttga

SEQ ID NO: 1712 - DNA, 1143 bp, Enterobacter cloacae
cgataccgggcttttttatcttacccgatccacctactgtttaatggaatagattgtgtgaaaattctagttactggcggtgccggttttatcggttccgcggttatccgacatattattagcaatactcgggatagcgttgttaacgttgataaattgacctatgccggtaatctggaatccttgcgtgaagtaagcgatagcgagcgctatgtttttgagcatgccgatatatgtgataaagaggcaatggcgcgtatttttgctacccatcagcctgatgcggtaatgcatctggctgccgagagccatgttgatcgttctattaccggtcccgctgcgtttattgaaaccaatatttttggcacgtatattctgttagaaacaagtcgtgcttactggtcttcactggacgaggcagcaaaatccgccttccgtttccatcacatttcaactgatgaggtttacggcgatctgcctcatcccgatgaacattcagattccaccccgttaccgctgtttaccgagaaaacagcgtaccagccaagcagcccttactcagcgtcaaaagcgtccagcgaccatttagttcgagcctggatacgcacctatggtttacctgggattgtgacaaattgttcgaataattatggcccataccactttcctgaaaagctgatccctcttgttatccttaatgcgctggataataaaccattgccgatctacggtaagggcgatcaaatccgtgactggttatacgttgaagatcatgctcgtgcactgtatacggttctgaccacgggtaagccgggagaaacctataatattggcggccataacgagaagaaaaatattgaagtcgttcagaccatttgtgatctgctcgatgacatggtaccgaaagaaacatcctatcgcgcacaaattacttatgtagcggatcgtcctggacacgacagacgttatgcaattgatgctcataaaattagcgacgagctcggatggactcctgtggaaacctttgaaagcggcatccgtaaaacggttaaatggtatttgaataaccaggagtgggtatcgaatgtgaaaagcggcgcctataagagctggattgagcagaattatggggagcgtaagtaa

SEQ ID NO: 1713 - DNA, 882 bp, Enterobacter cloacae
atgacgaaacgtaaagggattatattagctggcggatcgggtacacgtctttatcccgtgactatggccgtaagtaagcaattgttgccaatttacgataagccaatgatctattacccgctctctacgcttatgctggcaggtatacgggatattctgattatcagtacgcctcaggacactccgcgttttgaacaactgctcgggaacggtagccagtggggattgcatatccagtacaaagtgcaaccaagtcctgatggactggcacaagcttttattctgggtgaagagtttatcggtgaggataattgtgcgctggtattaggcgataatattttctacggacacgatctccccagactgcttgaaggcgcagcaagccagcaagagggggcgaccgtattcgcctatcatgtcagcgatccggaacgctatggcgtcgttgagtttgataaagacggtactgcaattggtcttgaggagaagcctcagcaacccaagagtaattacgcaataaccggtctttatttttacgacaacgatgtggttgagatggccaaaagtttaacgccgtccgagcgaggtgaactcgaaattaccgacatcaaccgcatctatatgcagcagggacgattgtctgtcgcaatgatgaggcgcggttacgcctggctggataccggaacgcatcagagtatgatcgaagcaagcaattttatcgccacaattgaagagcgacaggggctaaaagtttcatgtcctgaagagattgcgttccgacgaggttttattgatgccgaacaacttcgggtactcgctgaaccattgaaaaagaccgggtatgggcagtatctgctgaatctgaccaagggattagtctga

SEQ ID NO: 1714 - DNA, 876 bp, Enterobacter cloacae
gcggagaatgtaatgaaaaaggtcgcgattgtcgggttaggatggttaggaatgccactggcgatgtcattagccgcgaaaggctggcaggtgacagggagtaagaccacccgagatggggttgaagcggcacgcatgtgcggcattgatggtgtcgagctgcgtctcgaacccgagcttatctgcgataccgacgagctggatgaactgatgaatgtggacgcgctggtcattaccttaccggcgcggcgcagcggcccgagcgagacgttttacttgcaggcggtgcaggagattgtcgacagcgccctggcgcaccatatcccgcgcatcattttcaccagctccacctccgtctatggcgctatcgacggtacggcgaaagaaaacaccgagcgccgtccggtgaccgccagcggccgggtgctgaaagagctggaagactggctgcacaatctgcctggcacgcaggtggatatcttacgtctggccgggctggtggggccggggcgtcatccggggcgcttctttgccggtaaatccgcgccggatggccagcacggggttaatcttgtgcaccttgaggatgttatcggtgcaatagagctgcttttacaggctccgaaaggggggcacatctataatatatgtgcgccttcgcatccgccgcgtagtaccttttatccgctgatggcgcgccagcttggcctggcgccgccggtattcagtgatgcgcagggggagcgcaaaggcaaaattattgatggcaatcgtatttgccatgaactgggatttgaatatcagtatcccgatccgctggtaatgcccacggaatatttttcactcacgaagcggccaggccccgcgctcaacgca

SEQ ID NO: 1715 - DNA, 1449 bp, Enterobacter cloacae
tgcttagcgcggctccttccgacacctctgggtgaagatggaatgtccagacaacagatcggcgttatcggtatggcggtgatggggcgcaatctagcgcttaacatcgaaagtcgtggttataccgtctccattttcaaccgctctcgtgataagaccgaagaagtcatcgctgagaatccaggcaagaaactggttcctttctatacggttaaagagttcgttgagtctctggaaacacctcgtcgtatcctgttaatggtgaaagcgggcgcaggtaccgatgcagctatcgattcactgaaaccgtatctggataaaggcgacatcattattgatggcggcaacaccttcttccacgacaccattcgtcgtaaccgtgaactgtctgctgaaggcttcaacttcattggtaccggcgtatccggcggtgaagagggcgctctgaaaggtccatccatcatgcctggcggtcagaaagaagcgtacgaactggttgcgccaatcctgactaaaatcgcagccgtagctgaagacggcgagccgtgcgtgacctatatcggccctgatggtgctggtcattacgtgaaaatggttcacaacggcattgaatacggcgacatgcagttgattgctgaagcctactctctgctgaagggcggcctgaacctctctaacgaggagctcgcagagaccttcaccgagtggaacaaaggcgagctgaacagctatctgatcgacatcaccaaagatatcttcaccaagaaagatgaagaaggtaaatatctggttgatgtgattctggatgaagccgcgaacaaaggcaccggtaaatggaccagccagagctctctcgatctgggcgagccgctgtccctgattactgaatcggttttcgcgcgttatatctcttctctgaaagagcagcgcgttgcggcatccaaagtgttgtccggcccgcaggctaaaccagctggtgacaaagctgaattcgttgaaaaagtccgtcgtgcattgtacctgggtaaaatcgtctcttacgcgcagggcttctctcagctgcgtgcagcttcagacgagaacaactgggatctgaactatggcgagatagcgaagatcttccgtgccggctgtatcattcgcgcccagttcctgcaaaaaatcactgatgcctatgctgaaaatgcgggtatcgccaaccttctgctggcgccttacttcaagcagattgcagacgactatcagcaggcgctgcgtgatgttgttgcgtacgcggtgcagaatggtatcccggttccaaccttctccgctgcggtggcatactacgacagctatcgtgctgccgttctgccagcgaacctgattcaggcacagcgtgactacttcggtgcgcatacctataagcgtacggataaagaaggtgtgttccacaccgaatggctggattaa

SEQ ID NO: 1716 - DNA, 1143 bp, Enterobacter cloacae
tgccccaggacatcagaatccgcctatgatagcgcgtcgtacttcacttacataacccatctttccgatataactcatcggattcttatagaaaaatcgccagcaacagatacactaaggaaacaagattatttttgccctttttcatctgttagggattgtatgacgcaaaacaacaatagcctggtcacacgcaacaatgacccggagcaaattgatttactggatttagtgctacagctgtggcgtggtaagtgggtaattggagcattcgttgctgcttttatcgttcttgccgttgtttacatcactgttgctaaagagaaatggacgtcatccgccatcatagcccagccagatgcggcacaaatcgccacttattccaatgcgttgaatatcctctatggtggggcagctccatccatgctggatattcagaatcgtgctattggtcgttttaattcctccttctcggcattagctcaggcgctggagaatcaggaagatccggaaaaactgactattgagcctaccgtaaaagggcaaagtttacctttaaccgtaagctatcagggcgaatccgctgatgcagctcaaaagcaattagctcagtatattcagcaggttgatgagcagacggctaaagaactgacgcttgacctcagagataacctcaagcagcagatcacaaccctgaacgactcgcttcagaaccaggagaaagtggcacaggagcagaaagatctgcgtatcaaacagatctctgaagcttacaagaatgcggaagcagctaatattagtactccacagctccagcaaacgcaggatgtcactcaggaaaccatgttcctgctgggtaccgtagcgctcaagtcaatgattgataacgaagcgtcacgtccgctggtcttctcaggcgcttactaccagaccaaacaaaacttacttgatattcagaacctcaacgttaacccagacaccattcacgtctatcgttacgttatgaaacctaatctgcctatccgacgtgacagtcctaaaaaggccattaccctcatccttgccgttctcctcggcgggatcatcggttctgctgtcgtcctcggccgtaacgcgctgagaaactacaagccaagagcctga

SEQ ID NO: 1717 - DNA, 984 bp, Enterobacter cloacae
aaaagcccccggaagatcttcttccgggggcttttttttggaccgcattcagacaggttaaaacaggttaacgaggaacacagaatgttagataactcacgtttacgcatagctattcaaaaatcaggccgtttaagcgacgattcacgcgaactgctggcccgctgcgggattaaaatcaacctgcacacccagcgcctgatcgccctggctgaaaatatgccgatcgacattctgcgcgtacgtgatgacgatatcccgggcctggtgatggatggcgtcgttgatctcggcatcatcggcgaaaacgtactggaagaagagttattaacccgccgagcgcagggcgaagatccgcgctactttaccctgcgtcgtctggactttggcggctgccgcctgtcgctggccacgccggtcgatgaagcctgggacggcccggccgcgctgaacggcaaacgtatcgccacctcttaccctcacctgctgaagcgttacctcgatcaaaaaggcgtgcagtttaaatcctgtctgctgaatggctctgttgaagtggcgccgcgtgcgggcctggccgatgccatctgtgacctcgtctccaccggcgccacgctcgaagcgaacggcctgcgcgaagtggaggtgatctaccgctccaaagcgtgccttatccagcgcgacggcgagatggccgacgccaaacagcacctcatcgacaaactgctgacccgcattcagggcgtgattcaggcgcgtgaatccaaatacatcatgatgcatgcgccaaccgagcgtctggaggaagtgattgccctgctaccgggcgctgagcgtccaaccattctgccgctggcgggcgaccagcagcgcgtggcgatgcacatggtgagcagcgaaaccctgttctgggaaaccatggaaaaactgaaggcgctgggcgcaagctccattctggtgctgccaattgagaagatgatggagtaa

SEQ ID NO: 1718 - DNA, 1089 bp, Enterobacter cloacae
cgccctgaaagcggagaaagtatgagtcagaagtatctctttatcgatcgtgacggcaccatcatctcggagccacccagcgattttcaggtcgatcgtttcgacaagctggcctttgaacccgatgtgatcccggtgctgctgaagcttcagaaagcaggctataagctggtgatgatcaccaaccaggatggtctgggcaccgacagcttcccgcaggcggactttgacggcccgcacaacctgatgatgcaggtgctgacctcgcagggcatcgccttcgacgaggtgctgatctgcccgcatatgcctgccgacaagtgcgactgccgcaagccaaaattgaagcttgttgaacgttatctggctgaagaggcgctggataaagccaacagctatgtgattggcgatcgcgtcacggatatcacgctggcggaaaacatgggcattgcgggtctgcgctataaccgcgacacgctaaactgggcgatgattggcgagcagctcaccagacgcgaccgctattcccacgttgaacgcaacaccaaagagacgcagatcgacgtgaaggtctggctcgaccgcgaaggcggcagcaagatccacactggcgtcggtttctttgaccacatgctggatcaaatcgccacgcacggcggcttccgcatggagatcaccgttaagggcgacctgtatattgacgatcaccacaccgtggaagataccggcctggcgctgggcgaagccctgaagctggcgctcggcgacaagcgcggcatcaaccgcttcggctttgttctgccgatggacgagtgtctggcgcgctgcgcgatggatatctccgggcgtccgcacctggaatataaagccgactttacctaccagcgtgtgggcgatctcagcaccgagatggtggaacacttcttccgctcgctttcttacactatgggcctgacgctgcacctgaaaactaaaggcaaaaacgatcaccaccgcgtcgagagcctgttcaaagcctttggccgtaccctgcgccaggcgatccgcgtggaaggtgacgccctgccctcgtcgaaaggagtgctgtaa

SEQ ID NO: 1719 - DNA, 933 bp, Enterobacter cloacae
agaggtttgcgcgcgttatccgcaggtggcgtttcagtcctctggcggtatcggcgacctggcggatatcgccgctctgcgcggaaccggtgtacgtggcgtgatcgtgggtcgcgcgctgctggaaggcaaatttacggtaaaggaggcgattcaatgctggcaaaacggataattccctgcctggacgtgcgtgatggtcaggttgtaaaaggcgtgcagttccgcaaccacgagatcattggcgacattgttccactggcaaaacgctatgccgaagaaggcgcagacgaactggtattttacgatatcaccgcctccagcgatggccgcgtggtggataaaagctgggtggcgcgcgtggcagaggtgattgatattcccttctgtgtagcgggcgggattaaatctgctgacgatgcggcgaaaattctctctttcggtgcggacaaaatttcgattaactcccctgcgctcgccgacccggcgctgattacgcgtctggcggaccgctttggcgtgcagtgcattgtcgtggggatcgacacctggtttgataccgcgacgggaaaatatcacgttaaccagtacaccggcgatgaaagccgcacgcgcgtcacccaatgggagacgctggactgggtgcaggaagtgcaaaaacgcggtgcgggtgaaatcgttctgaacatgatgaaccaggacggcgttcgtaacggctacgacctcgagcagctgaaaaaagtgcgcgcggtctgccaggttccgctgattgcctccggcggcgcaggcaccatggaacacttccttcaagccttccgcgatgcgaacgtggacggcgcgctggccgcctccgtgttccataaacagattatcaatattggtgagttaaaaacgtacctggccgaccagggcgtggagatcagggtatgttaa

SEQ ID NO: 1720 - DNA, 1140 bp, Enterobacter cloacae
aaccctggccgccgccgaacgtctgactgcccacaaaaatgccgtgacgctgcgcgttgccgccctgaaggagcaagcatgaacatcgaagaattagcccgcgaaaatgtccgtcgcctgacgccctatcagtctgcgcgtcgtcttggcggcaacggcgatgtctggctgaatgccaacgaataccccacgccggtggcctttgagctttcgcagcagacgctgaaccgctacccggagtgtcagccgaaagcggtgatcgagaactatgcgcagtatgcaggcgtgaagcctgagcaggtgctggtcagccgtggggcggatgaagggattgagctgctgatccgcgccttctgcgagccgggtaaagacgcggtgatgtactgccagcccacctatgggatgtacagcgtcagcgccgaaacctttggcgtggcctgccgcaacgtgcaggcgctggacaactggcagctggatttgcagggcatcgccgataacctcgacggcgtgaaggtggtgtttgtctgtagcccgaacaacccgaccgggcagattatcaatccgcaggatattcgtgccctgctggaaatgacgcgcggcaaagcgctggtcgtggctgacgaagcctatattgagttttgtccgcaggccacgcttgctggctggcttgaagagtatccgcatctcgttgtgctgcgtaccctttccaaagccttcgccctcgccggccttcgctgtggatttacgctggcgaataaagcgattatcgacctgctgctgaaagtcatcgccccgtatccgctctcaacgccggttgccgatattgcggcacaggcgctggccccgcagggcatcagcgcgatgcgcgagcgtgtggcgcagatcctggaagagcgtcagtatcttgtcgatgccctgaaaacgattccgtgcgtggagaaggtattcgactcggaaaccaactacatcctggtgcgcttcaccgcctcaagcgcgatatttaaatcgttgtgggatcagggcattatcttacgagaccagaataaacaacctaccctgagcggctgcctgcgtattaccgtcggcacccgtgcagagagccagcgcgtgattgacgccctgaaagcggagaaagtatga

SEQ ID NO: 1721 - DNA, 816 bp, Enterobacter cloacae
cttttacggcgtgcagtttcacccggaacgctccggtgccgccggtgcgcaactgctgaaaaatttcctggagatgtgatgataattcccgctttagatttaattgacggcacggttgttcgtctccaccagggcgattacgggcagcagcgcgactacggcaacgacccgctgccgcggttacaggcttacgccgccgagggcgctgaggtgttgcatctggtcgatctgaccggcgcgaaagatccggcgaagcgccaaatcccgctgcttaaaacactggtggctggcgtggacgtcccggtgcaggtgggcggcggcgtgcgtacggaagccgatgttgccgccttactggacgcgggcgtggcgcgcgtggtggtcggttcgaccgctgtgaaagatcctgagagtgtcaagggctggttccgccgcttcggtgcggatgcgctggtgctggcgctggatgtgcgcattgacgaacagggtaacaagcaggtcgcggtcagcggctggcaggaaaactccggcgtaacgctggaagagctggtcgggatgtatctccccgtagggctgaagcacgtcctgtgcacggatatttcacgcgatggtacgctcgcaggctctaacgtctcgctgtatgaagaggtttgcgcgcgttatccgcaggtggcgtttcagtcctctggcggtatcggcgacctggcggatatcgccgctctgcgcggaaccggtgtacgtggcgtgatcgtgggtcgcgcgctgctggaaggcaaatttacggtaaaggaggcgattcaatgctggcaaaacggataa

SEQ ID NO: 1722 - DNA, 330 bp, Enterobacter cloacae
cggattactgccggtggttgtacagcatgccgtttcaggcgaagtgctgatgctgggatacatgaaccaggaggcactgacaaaaacgctcgacagcggcaaggtaacgtttttctcgcgcaccaaacagcgcctgtggacgaaaggggaaacctcgggtcacttcctgaatgtggtcagcattacgccagattgcgacaacgacaccctgctggtgctggtcaacccgattgggcctacctgccacaaaggcaccagcagctgcttcggcgagacgagccaccagtggctgttcctctatcagctggaacagctgctggcagagcgtaa

SEQ ID NO: 1723 - DNA, 1017 bp, Enterobacter cloacae
atgagggaagctatgaaatttctggtaacgggtgccgcgggctttatcggttctcatgtcagcaagcgcctgcttgatgcagggcatgaagttgttgggattgataatctgaatgattactatgaccctaacctcaagctcgctcgcctcgaactgctcaaatccgagagtttcaccttccacaagctggacttagcggaccgcaagggcatggccgtgctcttcgccaatgaaaaatttgaccgcgtgatccatcttgctgcacaggcgggcgtgcgttactcgctggaaaatccgcatgcctacgcggatgcgaacctggtaggtcacctgaacgtgctggaaggctgtcgccacaacaaggttcagcatcttctgtatgcttcatccagctctgtctacggcctcaaccgtaagatgccgttttctactgacgactccgtggatcatccggtatccctgtatgcggcaaccaaaaaagctaacgagctgatgtcgcatacctattcgcatctgtacaatctgccgaccactggcctgcgcttctttaccgtgtatggcccatggggccgaccggacatggcgctgttcaaattcaccaaagccatgattgaaggcaacagcatcgacgtatacaactacggcaagatgaagcgcgacttcacctatatcgatgatattgcggaggcaattattcgcttgcaggacgtcattcctcaggccgatgccgactggacggtcgaaaccggttcgccggcaaccagctctgctccgtatcgcgtatataacatcggtaacagttcacctgtcgaactgatggattacatcaccgcgcttgaagaggcgctgggcaaagaagcggtgaaaaatatgatgccgatccagccgggtgacgtactggagaccagtgcggatactaaagcgctgtacgacgtcattgggtttaaaccacagacctccgtgaaagaaggcgtgaaaaactttgtcgactggtaccgcaacttctataacgtttaa

SEQ ID NO: 1724 - DNA, 1326 bp, Enterobacter cloacae
gaagatgatggagtaacgaccatgagctttaacacaatcatcgactggaatacctgtagcgacgcgcaacagcgcgagctgctgatgcgcccggcaatttccgcttcggagagcatcacccgcaccgtggcggagatcctcgataacgtcaaagcccgcggagacgacgcgctgcgcgagtacagcgcgaagtttgacaagacggaagtcggcgctttacaggttaccgagcaggaaatcattgatgccagcaatcgtctgggtgatgacatcaaacaggcgatggccgtcgcggtgaaaaatattgataccttccacaccgcgcagaaattgcaggcggtggatgtggaaaccctgcccggcgtgcgctgccagcaggtgacgcgaccggtggcgtccgtcggcctctatattcccggcggctctgctccgctgttttcgaccgtcctgatgctggccaccccggcacgtattgccggttgtcagaaggtggtgctctgctctcctccaccaattgccgatgagatcctgtacgcggcgaagctgtgcggcgtgcaggcgatctataaagtgggcggtgcgcaggcgatttctgccctggcgttcgggacagtatccattcctaaggtcgacaaaatctttggtccgggcaatgcgtacgtaaccgaagcaaagcgtcaggtcagccagcgtctggacggcgcggcgattgatatgcctgccggtccgtctgaagtgctggtgattgccgacagcggcgctacaccggatttcgtggcctctgacctgctctcgcaggccgagcacggccctgactcgcaggtgattttactgacgccagatgccgacatggcaaaacgcgtgggcgacgccgttgagcgtcagctggctgacctgccgcgtgcggaaacggcgcgtcaggcgctattggccagccgcctgattgtggctcgcgatcttgaccagtgcatcgccatctccaaccagtacggtcctgagcacctgattattcagacccgtaacgcgcgcgatctggtcgacagcatcaccagcgcaggctcagtgttcctcggagactggtcaccggaatcagccggggattacgcctccggcaccaaccacgtgctgcccacgtatggctatacctcaacctgctccagcctggggctggcggatttccagaagcgcatgactgtgcaggaactctcccgcgaagggtttgcctcgctggcgtcgaccattgaaaccctggccgccgccgaacgtctgactgcccacaaaaatgccgtgacgctgcgcgttgccgccctgaaggagcaagcatga

SEQ ID NO: 1725 - DNA, 621 bp, Enterobacter cloacae
cgccctgccctcgtcgaaaggagtgctgtaatgaacgtggtgattctggacaccggatgcgccaatctgaactccgtacagtcggcgattatgcgccacggctacgagccggtggtgagccgcgacccggacgtggtgctgcgtgcggataaactctttctgccgggcgtaggcaccgcccaggcggcgatggatcagatccacgagcgcgagctggttgatctcatcaaagcctgtactcaaccggtgctgggcatttgcctcgggatgcagctgcttggccgccgcagcgaagagagcaacggtgtcgatctgctgggcattatagaagaagacgtgccgaaaatgaccgaccacggcctgccactgccgcacatgggctggaaccgcgtttatccgaaggcgggcaacaggctgttccagggtattgaagacggcgcgtacttctatttcgtccacagctacgccatgcccgtgaatacctacaccatcgcccagtgcaattacggcgaggcgttcaccgccgccgtgcagaaagataacttttacggcgtgcagtttcacccggaacgctccggtgccgccggtgcgcaactgctgaaaaatttcctggagatgtga

SEQ ID NO: 1726 - DNA, 654 bp, Enterobacter cloacae
gttaaaaacgtacctggccgaccagggcgtggagatcagggtatgttaacagagcaacaacaggcgcagctggactgggaaaaaactgacggattactgccggtggttgtacagcatgccgtttcaggcgaagtgctgatgctgggatacatgaaccaggaggcactgacaaaaacgctcgacagcggcaaggtaacgtttttctcgcgcaccaaacagcgcctgtggacgaaaggggaaacctcgggtcacttcctgaatgtggtcagcattacgccagattgcgacaacgacaccctgctggtgctggtcaacccgattgggcctacctgccacaaaggcaccagcagctgcttcggcgagacgagccaccagtggctgttcctctatcagctggaacagctgctggcagagcgtaaatcagcggatcccgagagctcgtacacggcgaaactgtacgccagcggcaccaaacgtattgcgcagaaagtgggtgaggaaggcgttgaaacggcgctggcggccaccgtgcatgatcgggaggagctgacgaacgaagcgtcggatttaatgtatcacctgctggtactgcttcaggatcaggagctggatttaacgacggtgattgagaatttgcggaaacggcataaataa

SEQ ID NO: 1727 - DNA, 531 bp, Enterobacter cloacae
gtatcagtcatttggtaccttttgaacagcgccagcactttagagcgtttgtactttccaaaggttcaacacgccactgacaagatgtctaaagctgaatctgaatatcaggatgctgtagaatctcgttcagtgttgattaatcagaagaccgctgaatatctggctaatccttcagaacgtcacggattcattgtgaaacaggtttacccgactaaccaacagcaggtgattcaatcaatggctgaacagggctatatggttcatcgtgtatctgttggaatggttacctttattcgaatgccaaagaacgctaaagataatcctcttcaggaaatcacagataaagctaaagcagaagctgaatcaaccattgacaaaatgattgagcgattgaaagtgagagcaggtgaagctgtccaccagcgaaacaagattgtaactgaagcccgtaaagctctggattcaatcaaatcctttgaaagctatttaaacgtgattgtaaccgactctgaagaggtaaccgaataa

SEQ ID NO: 1728 - DNA, 2559 bp, Enterobacter cloacae
aaccggggacaaaattgccgatctgctgttttccctcaaccgcgagcacggcaccacgctgattctggttacccacgacccgcagctggccgcccgctgcgaccgccgcctgcggctggtgaacggtattcttcaggaggaagcatgattgcccgctggttctggcgcgagtggcgctcgccctcgctgctgattgtctggctggcgttgagcctggcggtggcctgcgtgctggcgctcggtagcgtcagcgatcgtatggagaaagggcttagccagcagagtcgggaatttatggccggagaccgggctctgcaaagttctcgccccgtgccgccgggctggatagaggaagcgcgcaaagaggggctgaaagtaggggagcagatcacctttcagaccatgacctttgcgggcgacacgccgcagcttgccagcgtaaaagccgtggatgacatctacccgatgtacggtgacttacaaaccagcccgccggggctaaaaccgacggccggtacggtcctgctggcatcgcgactgatggcgctgctgaacctgaaacccggcgacagtatcgacgtcggcgacgcgacactcaaaattgccggggaagtggtgcaggagcccgactccggatttaatccgttccagcttgcgccgcgcctgctgatgaacaccgcggatgtggcgaaaacccacgccgtccagccgggaagccgtgtcacctggcggtataagtttggcggaacgcccgctcaactggaggcgtacgaaaaatggctcctgccgcagctcaagccggaacaccgctggtacggactggagcaggatgacggggcgctcggcaaatctcttgagcgttctcagcagttcctgctgctgtcggcgctgttaaccctgctgctagccattgcggcggttgccgtggcgatggggcactactgccgcagccgttacgatctggtggcgatcctcaaaaccctcggcgcgggccgcgcgcaactgcgcaagctgattgtcggccagtggctgatggtgctggcgctgtcggctctgaccggcggggcgatagggctgctgtttgaaaagcttctgatggtgctgctcaaaccggtactgcccgccgcattaccgcctgccagcctctggccgtggctgtgggcaatcggcgcgatgacgacgatctccctgctggtggggttacgcccgtaccgactgctgctcgccacccagccgctgcgcgtgctgcgccgcgatgtggtggccagcgtttggccgctgaagttctacctgccggtgattattgcggtggcggtcgggctgctggcctggctgatgggcggcagtacgctgctgtgggcggtgctggcgggcgcggtggtgctggcgctgctgtgcggcgtagtgggctggatactgcttaatgtgctgagaaagctgacagttaaatcacttcccatacggttagcggttaaccgactgctgcaccagccgtggtctaccctcagccagctctcggcattttcgctgtcatttatgctgctggcgcttctgctggtgctgcgcggggatctgctggatcgctggcagcagcagcttccgccagaaagcccgaactatttcctgatcaacatcgcgcccgagcaggtgacgccgctgaagggcttcctgtccgagcatcacattattcccgagtcgttctatccgatcgtgcgcgcccgactgacgcagatcaacggccagtcgacggagggaaataaggatgaatcgctcaaccgcgaactcaacctgacctggcaggcgaaacgtccggaccataacccgatcgttgctggcacctggccgccgaaagcgggggaagtgtcgatggaggaggggctggcgacacgcctgaacgtgaacctcggcgacagcgtgaccttcaccggtgatacccaggatttcaccgccaaagttaccagcctgcgtaaagtggactgggaaagcctgcggccaaacttcttcttcatcttcccgccgggtgcgctggacggacagccccagagctggctcaccagcttccgctgggaaaacggcaacggcatgctgacgcagcttaaccgggaatttccgacggtgagcctgctggatatcggcgcgatccttaaacaggtcgggcaggtgctggagcaggtaagccgcgcgctggaggtgatggtggtgctggtgacgatctgtggcatattgctgctgctggcgcaggtgcaggtcggcatgcgtcagcgtcatcaggagctggttgtctaccgcacgctgggggccagtaaacggctgctgcgcgccacgctgtggagcgaatttgccctgctcgggctggtggcgggcctggtggcggccatcggggcggaaacggcgctggcggtactccagagcaaagtcttcgacttcccgtgggagcccgactggcggctgtggctcacgctgcccgtctgcggcgccgtgctgctgtccctgtgcggcggctggctcggatcccggctgttgaaaggtaaagcgctattccgccagtttgtcagctag

SEQ ID NO: 1729 - DNA, 735 bp, Enterobacter cloacae
cgctgcgtagcggaaaggattatgcttaaggctcttcttatcacagcggttaatggaatcggaatgaataataaaaaaaatcttctggatatcagggatgttggctttcgtgtgggtgataacaccatccttcagcacgtcgatttttgtctctctccgggcgaatttaaactgataaccggtccctccggctgcggcaaaagcaccctcctgaaaatcgtggcttcgctactgagcccaacggagggaaccatcctgtttgcaggaaaagatatcgccacgttttcatcggaaagctatcgccagcaggtgtcatactgcgtgcaaacgccgtccctgtttggcgacacggtgtacgacaatctggttttcccctggcacattcgcaaccaaacgcctgatccgaaaaagtttaccgacgatctgacccggttcgggctttcgccggagacgctgaccaaatcgatcgccgaactgtcgggcggggaaaagcagcgcgtctcgctgatccgtaacctgcaattcttgccgaaggcgctgttgctggacgaaatcaccagcgcgctggatgacgctaacaagcgcaacgtcaatgacattatccatcgctacgcccgggagcagaatattgccgtgctgtgggtgacgcatgattcaaatgaaattacccatgcggatgatgtcatcacgctcaggccgcagggcgggaaaatggaggaggctcaccgtgggtga

SEQ ID NO: 1730 - DNA, 741 bp, Enterobacter cloacae
cgtgtccgcagccgccgcgcggaaggtcatcagcatcaaaaacaggaagggcaaatgccagcggaaaacattgttgaagttcatcgtcttaagaagtctgtcggtcagggggaacacgagctttccatcctcaccggagttgaactcgttgtcaaacgtgccgaaaccatcgccctgattggtgaatccggttccggtaagtccacgctgctggccattctcgccggtctggacgatggcagcagtggggaagtgaacctggtcggccagcccctccacgcgcttgatgaagaggcccgcgccgcgctgcgagcccggcatatcgggtttgtctttcagtcattcatgctgatcccgacgctgaacgcgctggaaaacgttgagctacctggcctgctgcgcggtgaaaatacccgtgaaagccgcgatcacgcgaaggcgttgctggaacagctggggctgggaaaacgtctcgaccaccttccggcacagctttccggcggtgagcagcagcgcgtggcgctggccagggcgtttaacgggcgcccggaagtgctgtttgccgatgagccaacgggcaatctcgaccgtaaaaccggggacaaaattgccgatctgctgttttccctcaaccgcgagcacggcaccacgctgattctggttacccacgacccgcagctggccgcccgctgcgaccgccgcctgcggctggtgaacggtattcttcaggaggaagcatga

SEQ ID NO: 1731 - DNA, 642 bp, Enterobacter cloacae
aaaacgcagaaaaccggcggttatcgccggttcttctgtttgcagatgcagatccgcaataaagagtgtcgccacgaattactcgctgacggtcacgcttgtaatcacaacgtcttctttaggaacgtcctggtgcataccgctgcggccagtagaaacggctttgatcttgtcgaccacgtccatcccttcaaccacttctgcgaatacgcagtagccccagccttgcagactttcgccagagaagttcaggaagtcgttgtccgctacgttgatgaagaactgtgcggttgcagaatgtggcgcctgagtacgggccattgccagcgtaccacgggtgtttttcaggccgttgttcgcttcgtttttgatcgcttctttcgtctctttctggcgcatgccaggctcgaaaccgccgccctggatcataaagccgttgatcacacggtggaaaatagtgttgttgtagaaaccttcgcggcagtagtccaggaagtttttaactgtttcaggcgctttgtcatcaaaggttttgattacgatatcgccatgattagtgtggaaagtaaccatttttgcatcctgttccgttattgtggtgcgtcgacccgtgctcgggtcacatataggggcttgttatag

SEQ ID NO: 1732 - DNA, 864 bp, Enterobacter cloacae
cgcatgattcaaatgaaattacccatgcggatgatgtcatcacgctcaggccgcagggcgggaaaatggaggaggctcaccgtgggtgaacataacataactaacgaatcgctggcgctgtcgatggtcctggtgctggtggcgattgtggtcagctaccgggaaaagctggggctggaaaaagatattctttggagtatcgcccgcgcggtcattcagctcatcatcgtcggctatgtgctgaaatacatcttcaacgtcaatcatgctgtgctgaccctgttgatggtgctgtttatctgctttaacgcggcatggaacgcgcagaaacgcagtaaatacatcgataaagcgttcatttcgtcgttgatcgccatcactaccgggaccgcgttaacgctggctgtgctggtgctttccggctcgatagaatttacgccgatgcaggtgatccccatttccgggatgattgcgggcaatgcgatggtggcggtcgggttgtgctacaacaatctggggcaacggttcagcagtgaacagcagcagcttcaggagaagctaagccttggcgcgacgccgaaggtggcctcggcgaggttgatccgcgacagcattcgctcttcgctaatcccaacggtggattccgccaaaacggtgggtctggtgagcctgccgggcatgatgtcggggctgatttttgccggtatcgatccggtaaaagccattaaataccagattatggtgacgtttatgctgctctctacggcgagcctgtccaccatcattgcctgctacctgacctatcggaagttttacaacgcgcgccaccagctggtggtgacgcagttgaaaaagacggggtaa

SEQ ID NO: 1733 - DNA, 1167 bp, Enterobacter cloacae
cgtgtctatcaaggaaaaagaatgactataagaaaaacagcgctggcgacaacgatcggcgcagcagtggcattggcttctttcgcatcccaggcggaaatcactcttctgaaacaggatccgcaggcgggtaacccgctgagccgcctgaacttcaccgttggcggtagtattcgtcctcagttccagaacatgaccggcgatgacggcaaaaacggctacaagcgcaacggctttgacggcggtacccgcttccgtttcgcggcagactactacctgttcgatgacatcagctggatcacttactacgagctgggtgtgaacattccggcgcagtttaactgggataaccactacgccgacggcgcgcacgatacttcacgccgtatgctctacaccggtctgaagagcgacacctggggtacgctgaccttcggccagcagaacagcgtgtactatgacgtggtgggcgcaaaaaccgatatctgggactacgacatgattggtcaggcgccaggtaacgggattaatggcgactacgacggctcttaccgttcacgccagatgctgaagtacaagaaaaccgtgggcgatgctgacatctacgcctcttacctgtttgaagacagcgaatacctgccgggcaacggcctgcgctacaagcgtaaaggcggcggttcactgggtatcgattatcacctgaccaccgatctgacctggggcgcagcgtggaactacacccgcgcggacatgcgtaacccggacaacggcgacagcaaatcctacgaccagaacatccttggtaccgccctgagctggacgccggataactggaccttctccgcaggcggcggctggtatcaaaacttcctgaccaccaaaaaagtgtccgttaacgactacttcgccggtgatgcatggggtattgaatactttgcgggttacaagttccctgttggtcagtatgcggtgaaatccatccagccgtacttcatgggcgaccgtatcgagtacgtgaatggccgtaactaccagcgcatcgacaacggtgtgggtatcagcttccagctggattacggtttccgcgtggattacgaacacgtgttcacctcctgcaccgacaacctgggcgacatgaacctggtgcgtctgcgttacgacttctaa

SEQ ID NO: 1734 - DNA, 1581 bp, Enterobacter cloacae
ttagtgtggaaagtaaccatttttgcatcctgttccgttattgtggtgcgtcgacccgtgctcgggtcacatataggggcttgttatagcataaccacaggacacgatcaccttgcattgtgtgctgaccgtactccgaattatgggtattataaggaacaaacaatccacacacgtgtttacatggaatcttcgatgttaaaaatctttaatacaatgacgcgccaaaaagaggaatttaaacctatccatgccggggaagtcggcatgtacgtgtgtggtattacggtttacgatctctgtcacatcggccatggccgtacctttgtcgcgttcgacgtggtgtcacgctacctgcgcttcctgggctacaacctgaagtatgtgcgcaatatcaccgacatcgacgacaaaatcattaaacgtgctaatgaaaatggcgaaagctttgtcgcgctggtggatcgcatgatcgccgaaatgcacaaggattttgacgccttaaatattctgcgcccggacagcgagccgcgtgcgacccaccatatccatgaaatcattgatatcacccaaaagctgatcgagcgcggtcacgcctatgtggcggacaacggcgatgtgatgttctcggtgccgacggacccaacctacggtgcgctttcccgccaggatctggaccagctccaggccggtgcgcgcgtggacgtggttgacgtgaagcgtaatccgatggacttcgtgctgtggaagatgtccaaagcgggcgaaccgagctggccatccccgtggggcgaagggcgtccgggctggcacattgaatgttccgcgatgaactgcaaacagctgggcaaccatttcgacatccacggcggcggttcagacctgatgttcccgcaccacgaaaacgaaatcgcgcagtccacctgtgctcacggcggcgagtacgtgaactactggatgcactccgggatggtgatggttgaccgcgagaagatgtcgaaatcgctgggcaacttctttaccgtgcgcgacgtgctgaagtattacgacgcggaaaccgtgcgctacttcctgatgtctggccactatcgcagccagctgaactacagcgaagagaacctgaagcaggcgcgcgctgcgctggagcgtctgtataccgcactgcgcggcaccgacaagtctgttccggccgcaggcggcgaggcgttcgaagcccgcttcgttgaggtcatgaacgacgacttcaacacccctgaagcctattccgtgctgttcgacatggcgcgtgaggtgaatcgcctgaagtcagaagatatggcggcggccaatgcgctggcgtctcatctgcgtaagctctcttccgtgctcggcctgctggagcaggagccggatgtgttcctgcaaagcggcgcgcaggcggacgacggcgaagtggcggaaattgaagcactgattaaagcgcgtctggaagcgcgtcaggcgaaagactgggcggcggcggatgcggcgcgtaaccgtctgaccgagatgggcattattctggaagatggcccgcagggaaccacctggcgtcgtaagtaa

SEQ ID NO: 1735 - DNA, 1554 bp, Enterobacter cloacae
aacgttctacttacaataacagcgcaaaaaaagcgctactcgggggaaatcagcatgagcctgatatcagggtttgttaaatcgctgtctaagttatcgatgattggtcgcgccttaatgctgccaatttcactgcttcccgctgcgggcctgttgctggccttcggcgataagttccacttgccgctgatgatgaacgcaggcggggttatctttgataacctgccaatgctcttcgccatcggctctgccgtcggactggcttcggaatccggcattgccgctctctctgcggcggtctccgtgtttgtcactaacatcaccatcagcaccgtgctgagcattacgccggaaatggcctcccagggcgggaaatacgccatggtcgtcggcattccgacgttacagatgggcgtctttggcggcctgatctgcggtattcttgcggcctggtgttacaaccgcttccacaccatgcagctgccggaattcctcggcttcttctccggcaagcgctttgtggcgattgcgacggcgtttctgtcgttcctgctcggcctgctgctgccgtacgtctggcagcatattcagtccggcatcgacgccctgtccgtggtggtgaacggcgataaccaggcggcctcgacctttatcttcgggctggtggagcgcgcgctgatcccgctcggcctgcaccacatctggtatccctccttctggtattcgttcggggattacactacccaggcgggtcaggtgatccacggcgaccagaccatctggttcaagatgctggaagagggagtgaaatccttcagcagcgacacctaccagaacgccgggaaattcatgcagggcgagttcccgctgatgctgttcgcactgcccgcggcgtgtctggcgatgtaccacgaagcgcacacgaagaataagaaaatcgcggccggtattctcttctccgccgccctcacctgcttcctgacgggcatcaccgagccggtagagttcacctttatcttcgtggcgccgatcctttacgtcttcaacgccatcatggcaggcctggcgtacatgaccatgtacctgctgcatgcgcatatcgccaagtcgttctcggcgggctttatcgactacctgtcgttcgggatcctgccgtcgtttaacggctatcagaccaacttcctgagcgccattatcgtcggcattccgatggcattaatctactacttcaccttccgcttcgtgatccgccgtttcgacgtgaaaacgccgggccgcaccgaagtgaccgccagcgcgaatgacaagtccgattccgaacttgccaccgaaatcatcggcctgctgggcggtgcgcagaacattgattccgtcggctcctgcatcacgcgtctgcgtctggaagtggcgaacagcgaagcggtggaccgggacgggctgaacgggcttggcgcgcgcggcgtggtgttcgtgggcgataacgggatacaggtgattttcggggccagagcacagtttatcgcccagacgatgtctacgatgattggcaaataa

SEQ ID NO: 1736 - DNA, 564 bp, Enterobacter cloacae
ctgctatatttccatgatttgccatggataaatgcaatgcctaccgttatcacccacgctgccgtacctctgtgtctgggcttagggctcggaaccaacgtcatcccaccccgcctgctgtttgccgggatcgtcctcgccatgctgcccgatgccgacgtactggcgtttaaattcggtgttgcctacgggaatattttcggccatcgcggtttcactcattcgctactgtttgccctggtggtgccgatactctgcgtgctggcaggccgacgatggttcagggccagcctgacgcgctgctggctgtttttaaccgtgtcgctgctgtcgcacagcctgctggattcgatcaccaccggcgggaaaggcgtcggctggctgtggccctggtcagatgagcgcttctttgcgccgtggcaggtgatcaaagtcgcgccgtttgcgctgtcgcgctataccacgccatacgggcatgaggtcattatctcggaactgctgtgggtgtggctgccggggatggtgctgatggggatgttatggtggagaaaacgtgcgcgctga

SEQ ID NO: 1737 - DNA, 645 bp, Enterobacter cloacae
tcgccttcccgttttaaccctccccgtcttttcgcccatttcccgaccacgcaaccgttttccttgccggtattacatgctattctctgtgccctcgaaagcagtgtgttccgcaccacaggagttttaagacgcatgtcttcccgcaataatccggcgcgtgtcgccatcgtgatggggtccaaaagcgactgggctaccatgcagttcgccgccgaaatctttgaaatcctgaatgttccgcaccacgtcgaagtggtttccgcgcaccgtacgccggataaactgttcagcttcgccgaaagcgccgaagagaacggttacgaggtgatcattgccggtgcgggcggcgcagcacatctgccgggcatgattgccgccaaaacgctggtgccggtactgggtgttcctgtgcaaagcgccgcgttaagcggggttgatagcctttactctatcgtccagatgccgcgcggtattcctgtcggtacgctggcgattggtaaagcgggtgcggcaaatgccgccctgctggccgcgcagatcctggcgacgcatgataaagagttacatcagcgtctggcggagtggcgtaaagcccagaccgacgaggtgctggataacccggatccgcggggtgcagcatga

SEQ ID NO: 1738 - DNA, 297 bp, Enterobacter cloacae
agaataccgttcaccagccgcaggcggcggtcgcagcgggcggccagctgcgggtcgtgggtaaccagaatcagcgtggtgccgtgctcgcggttgagggaaaacagcagatcggcaattttgtccccggttttacggtcgagattgcccgttggctcatcggcaaacagcacttccgggcgcccgttaaacgccctggccagcgccacgcgctgctgctcaccgccggaaagctgtgccggaaggtggtcgagacgttttcccagccccagctgttccagcaacgccttcgcgtga

SEQ ID NO: 1739 - DNA, 813 bp, Enterobacter cloacae
atcatgactcgtcaaacagctgagaacctgacaggtaaagttatgcaaaaatcggtcttaataacaggatgttccagcggaattggccttgaaagcgcccttgaactgaaacgtcaggggttttgggtgctggcagcctgccgcaaacccgaggatgtcgaacgcatgcgagggctgggatttaccggcattctgctggatctcgattcgccagagagcgtagagcaggccgccgatgaggttatcgccctgaccaacaaccgtctttacggtctgttcaacaatgcgggctacggcgtgtacggcccgctacagactctctcacgggaacagctggagcagcagttctccgcaaactttttcggggcgcatcagcttaccatgcgccttctcccggccatgctgccgcacggcgaagggcggattgtcatgacctcctcggtgatgggcctgatctccacgccgggccgcggggcttacgctgccagtaaatatgcgcttgaagcctggtccgatgcgttgcgcatggagctgcgccacagcggtattaaggtcagcctgattgaacccggcccgatccgcacccgctttacggaaaacgttaaccagacgcaggcggacaaaccggtcgaaaatcccggcatcgcggcgcgttttacgcttgggccagaagccgtcgttgccaaagtgcgccacgcatttgagagcgatacccctaaaatgcgctatccggtcacgctggtgacccatgccgtcggctggttgaaacgcctgctgccggggcggatgatggacaaaattttgcagggttga

SEQ ID NO: 1740 - DNA, 531 bp, Enterobacter cloacae
cgctttgcgccccgcatcccgaacggggcgttttatttctgccagtccggttcccacctctttacaggggcgaaatcctgttcgttagccgatatacttacgttcaacaaatacgcagttttctcgttacggcatgcaaaacaggaggtttttatgctcatcgtggttccggtcattattttcgttgcgctgttattcgtgggcgcaggcgtcaaaattgtcccgcagggttaccagtggaccgtcgaacgcttcggtcgctacaccaatacccttcagccgggtttaagcctgatcgtcccgttcatggacagaattgggcgcaagatcaacatgatggagcaggtgctggatatcccttctcaggaagtcatctccaaggataacgccaacgtcaccatcgatgcggtgtgctttattcaggtgattgatgcgccaaaagcggcctatgaggtgagcaacctggagctggcgatcgtcaacctgaccatgaccaatgttcacaataagtatgcaagcctgaaatactga

SEQ ID NO: 1741 - DNA, 342 bp, Enterobacter cloacae
agatgccgcagcgcgcgcatcctatattactccggtcccgggcggcgttggcccgatgacggtagcaacactgattcagaataccttgcaggcgtgcgaggagtatcacgacgtagaggacgcgtaatcatggcaactttttctttaggtaaacacccgcacgttgagctgtgcgatctgctgaagctggaaggctggagcgaaagcggcgcgcaggcgaaaatcgtcatcgccgacgggcaggtaacagtagacggcgcggtggaaacccgcaagcgctgcaaaattgtcgcgggtcagaccgtgagcttcgcaggtcagagcgtgaccgtgacggcctga

SEQ ID NO: 1742 - DNA, 876 bp, Enterobacter cloacae
accgataaaagagaatgccgcatgtccgtacagaatatcgtcaacataactgaagctaacctgcaacagacgctcgaacagtcaatgactaaaccggtgctgttctacttctggtctgaacgcagccaacactgcctgcaactgacgccggtcctggaaagccttgccgcgcagtacaacggtcagttcattctggcgaagctggattgtgacgccgaaccgatggtggcttcccagtttggcctgcgtgcgatcccaaccgtctacctgttccagaacggtcagccggtagatggcttccagggtccgcagcctgaagaggcgatccgcgccctgctggataaagtcctgccgcgcgaagaagagctgaaagcgcaggaagccatggcgctgatgcaggaaggcaagtacgacgaggcgctgccgctgttaaaagacgcgtggcagctgtcgaaccagaacagccagattggtctgctgctggcagagacccagattgcactgcaccgccctgaagacgcggaagccgtgctgaaaacggtgccgatgcaggatcaggatacccgttatcagggtctggtggcgcagattgacctgcttaaacaggcggccgatacccctgaaattcaacagcttcagcagcaggttgcggacaacccgcaggatgccgcgctggcaagccagctggcgcttcagctgcatcaggtggggcgtaacgaagaggcgctggagctgctgtttagccatcttcagaaggacctgggcgccgcagacggacaggcgcggaagatgttccaggagatcctggccgcgctgggtaccggtgacgcgctggcgtcgaaatatcgtcgtcagctgtacgcgttgctctactag

SEQ ID NO: 1743 - DNA, 249 bp, Enterobacter cloacae
tcgttggggtcggccaaccgggttttattcgggggcgagtggatcaaagagggcgcattggtcgtggacgtgggtattaaccgcctggaaaacggcaaagtggttggcgacgtggtgtatgaagatgccgcagcgcgcgcatcctatattactccggtcccgggcggcgttggcccgatgacggtagcaacactgattcagaataccttgcaggcgtgcgaggagtatcacgacgtagaggacgcgtaa

SEQ ID NO: 1744 - DNA, 1173 bp, Enterobacter cloacae
cgggatacaggtgattttcggggccagagcacagtttatcgcccagacgatgtctacgatgattggcaaataataagatgcctgaaggaggcgtctcctgtacgctgggggtcgcctcttatctggctgataatcggtaaatttcagggagcggttttgaagaaagtcagcattattgatgtcgcaaagcatgcgggcgtgtcggtttctaccgtttcgctggtgctgcgccagaaagggaagatctcagaggcgacgatcgggaaggtcaatgccgccatcacaacgctgggctatgttcataacgtcgccgctgccaatcttcgcgccaacacctccaacttaatcggcctgatcctgcgcgacttcagcgacagcttttccatcaaggtgatggcgagcatcgttcaggagctggagaagcagggttatatggtgtttctcggtcagccgctgaatgacggcgaacatcttgagcgtaccctgctcacgtttaagcagcagggcgtggcgggcgtcatctacctggcgtcggacacccgcaccgcctctctcccggaacacattcgccactgcccgctgccgcttgtggcggtttcgcagtcgttgctggaagagaaatgcaatctggtgatgcgcgataaccgccaggcggcgaacctggccgcgcgttatcttatcgagcgcgggcaccgcaccatcgcctacattggcgggcgcgacgggtgccgtatccgcgagcagcgcctgctcggttttcgcagcgcgatgacgcagaacggtctgatctggcgtgaggaatattctccagcctgcaccgatgacacgcaggcggcggccatggcgactcgccagctgctggagaagaacaacacgattaccgccctgctctgccattcaccggacgcgatgatcggttcgatctcaggtattcaccaggtggggcgcacggtgggtaaagacgtgtttttaacccagcaggtggcgctgattggttttgaagatatgctccacgttaatctcacgtcgccgtcactgacttacgtttcgtctgccagcgaagagaccggccgccaggcggcagggctgatgatccgcaggctgaaagagccggacctgcaaacgcagcgcataaccctctccgggcagcttatcgcgcgggaatcggcgtaa

SEQ ID NO: 1745 - DNA, 558 bp, Enterobacter cloacae
caagcccctatatgtgacccgagcacgggtcgacgcaccacaataacggaacaggatgcaaaaatggttactttccacactaatcatggcgatatcgtaatcaaaacctttgatgacaaagcgcctgaaacagttaaaaacttcctggactactgccgcgaaggtttctacaacaacactattttccaccgtgtgatcaacggctttatgatccagggcggcggtttcgagcctggcatgcgccagaaagagacgaaagaagcgatcaaaaacgaagcgaacaacggcctgaaaaacacccgtggtacgctggcaatggcccgtactcaggcgccacattctgcaaccgcacagttcttcatcaacgtagcggacaacgacttcctgaacttctctggcgaaagtctgcaaggctggggctactgcgtattcgcagaagtggttgaagggatggacgtggtcgacaagatcaaagccgtttctactggccgcagcggtatgcaccaggacgttcctaaagaagacgttgtgattacaagcgtgaccgtcagcgagtaa

SEQ ID NO: 1746 - DNA, 726 bp, Enterobacter cloacae
ttcgtggcgacactctttattgcggatctgcatctgcaaacagaagaaccggcgataaccgccggttttctgcgttttttacgcggtgaagcgaaaaacgccgacgcgctgtacattctgggcgacctgtttgaggcctggattggcgacgacgatccgaacccgctgcaccgtgagatggctgcggccattaaaacgctggtggattccggcgtcccctgctatttcattcacggcaaccgtgatttcctgatcggccagcgctacgcccgcgagagcggcatgacgctgctgccggaagagcaggtgctaaacctctatggccgcaatattctgatcatgcacggcgacacgctctgcactgacgataccggctacctggcgtttcgcgccaaagttcacaccccgtggatccagaaagtgttcctcgccctgccgctgtttattcgcaaccgcatcgccgccagaatgcgcgcgggcagcaaggccgccaacagcagcaaatcgatgaccatcatggacgtcaacccgcaggcggtggtgaaggtgatggagaagcatcgcgttcagtggctgatccatggccatacccatcgtcccgatgttcattcccttatcgccaacggcgagcccgcccatcgcgtggttttaggggcctggcacagcgaaggatcgatggtcaaagtcacgccggaaggtgttgaactgatcgccttcccgttttaa

SEQ ID NO: 1747 - DNA, 1089 bp, Enterobacter cloacae
cccggatccgcggggtgcagcatgaagcaggtttgcgttcttggtaatggtcagcttggccggatgctgcgtcaggccggtgagccgctgggtattgccgtctggcccgtcgggctggatgccgagccggaagccgtgccgttccaccagagcgtgatcaccgccgaaattgaacgctggccggaaaccgccctgacccgcgagctggcgcgccataacgcctttgtaaaccgcgacgtgtttccgatcattgccgaccgcctgacgcaaaagcagctgttcgacaagctcggcctcgcgaccgcgccgtggcagctgctttccgataagcgcgagtgggatgacgtttttgcgatgctgggagacctggcgattgtgaagcgtcgcgtcggcggctacgacggccgcgggcagtggcgcctgcgcgcgaacgacaccgccgagctgccggatgactgctacggcgagtgcatcgttgagcagggcattaactttagcggtgaagtgtcgctggttggcgcgcgcgggcatgacgggcacaccgttttttacccgctaacgcataacctgcatcaggacgggattctgcgcaccagcgtcgccttcccgcaggccaatgctgaccagcaggcgcaggcggaagaaatgctctctgccatcatgcatgagctgggctatgtgggcgtaatggcgatggagtgtttcgtcacgccgtcgggtctgctgatcaacgaacttgcgccgcgcgtgcacaacagcggtcactggacgcaaaacggcgcctccatcagccagttcgagctgcacctgcgcgccatcactgacctgccgctgccgcagccggtggtgaccagcccgtcggtgatgatcaacctgatcggcaccgatctgaactacaactggctgaagctgccgctggtgcacctgcactggtacgacaaagaggtacgtccggggcgtaaggtcggccacctgaacctgaacgatactgacacggaccgcctgagcgctacgctggaagcgattgttcccctgctgccgccagaatacgcgagcggcattgtctgggcgcagtcaaaactgaagtaa

SEQ ID NO: 1748 - DNA, 1155 bp, Enterobacter cloacae
gtatcccccgccggggagttgaccttccccttccccggcgtacaattcccgcccattgctgctcagttttcttctggaatcaccatgaacgatggaacggactatcgcgcgatcctcgcgtccgatacccctttaatcgacgttcgcgcgccgatcgaatttgcccagggtgcgatgcccgccgcactcaacctgcccttaatgaacgacgacgagcgtgccgccgtcggcacctgctataaacgccagggtccggacgccgcgctggcgctcggccatagcctggtcaacggcgagacgcgagaggcgcgcatcaacgcctggcgggaagccagcctggcccatcctgagggctacctttgctgcgcgcgcggtggccagcgctcacacatctcccaggcctggctgaaagaggcgggaatcgattatccgctgatccgcggcggctataaggccctgcgtcagacggcgattcaggtgaccattgagcagtcacaaaaaccgatggtgcttatcggcggctgtaccggaaacggtaaaacgctgctggttaagcagcatgcgcagggcatcgatctggaagggctggcgcaccatcgcggctcatcatttggtcgcacgctcaccccgcagctttcccaggccagttttgaaaatcaccttgccgtcgaactgctaaaaaaagacgccgcgcgctgggtgctggaagatgaaggccggatgattggctctaaccacctgccggaatgcctgcgcgaccgcatggttgacgcccctgtcgttgtcgtcgaagacccctttgaagtccgcctggagcgcctgcgcgaagagtatttcgaccatatgtgggccgatttttctgctgcctacggcgagaaagcgggctggaaagcgtatagcgaatatctgcatcacggcctgtacgccattcgtcgccgtctggggctgcaacgcttcgcggaatttaccgccctgctggatgccgcgcttgtcgagcaacagcgtactggcagcactgacgcgcacttcagctggcttgtgccgctgctgaaggattattacgacccgatgtacggctatcagctggagaaaaaggcggagaagattgtgtatcgcgggacgtacgaagaaattgctgagtggctcgatcgctga

SEQ ID NO: 1749 - DNA, 888 bp, Enterobacter cloacae
ctgaaagacaaacccgatatgccgggctcgcagcgcggcgcgggcctcttcatcaagcgcgtggaggggctggccgaccaggttcacttccccactgctgccatcgtccagaccggcgagaatggccagcagcgtggacttaccggaaccggattcaccaatcagggcgatggtttcggcacgtttgacaacgagttcaactccggtgaggatggaaagctcgtgttccccctgaccgacagacttcttaagacgatgaacttcaacaatgttttccgctggcatttgcccttcctgtttttgatgctgatgaccttccgcgcggcggctgcggacacgttattgattctgggcgacagcctgagcgcgggctatcgtatggccgccagtgcggcctggcccgccctgctcaatgataaatggcagtcccgggcctctgtcgtgaacggcagcatcagcggcgatacgtcgcagcaaggcttatcgcgcctgcctgccctgcttaagcagcatcaaccgcgttgggtgctggtcgaactgggcggtaatgatggtttgcgcggcttccagccacagcaaacggagcaaacgctgcggaccattttgcagaccattaaggccgccgatgcccagccgctgctgatgcaaattcgcctgcccgctaactacggccgtcggtataatgaggcgtttagcgcgatctatcctaagcttgccaaagagtttgatattccgctgctgccatttttcatggaagaggtctatctgaaaccccagtggatgcaggatgatggcattcaccccaatcgcgatgcccagccgtttattgccgactggatggcaacccggctggctcctttagtaaatcatgactcgtcaaacagctga

SEQ ID NO: 1750 - DNA, 630 bp, Enterobacter cloacae
cgccaccaaaccggacggcacgccgcgcaagttgctggacgtgacccgtctgcatcagctgggctggtatcacgaggtctcactggagcaggggctggccagcacctaccagtggttcctggaaaaccagcaccgcttccgggggtaatgatgtttttaagtcaggaagattttgccacggtagtgcgttccactccgctcatctcaattgatttgatcgtggagaacgaacgcggcgagttcttgctggggaaacgaaccaatcgtcctgcacagggcttctggttcgtgcccggcgggcgcgtgcagaaggatgagacgcttaccgatgcgtttgagcgtctcactctggcggaactgggcctgcaactgccgatggcagcgggccagttttacggggtctggcagcacttctatgacgataacttttcaggcaccgggttcaccacgcactacgtcgtgctggggttccgcctgaaggtgagtgaggcagacctgcgtctgcctgattctcagcatgacgattaccgctggttaacgccagaggcgctgctggcaagcgacaacgtccatgacaacagtcgggcgtacttccttgcggaacgtcaggccgaggtgccaggtctatga

SEQ ID NO: 1751 - DNA, 1422 bp, Enterobacter cloacae
atttggccattacatggtcagggccaactgttgcctgaaaaaggggtcatcatggaaaaattaacctgttttaaagcctacgatattcgcggcaagctgggcgaagagctgaacgaagacattgcgtggcgcatcggccgcgcgtacggcgaatacctgaaaccacaaactatcgtgcttggcggcgacgtgcgtctgacaagcgaatccctgaagctggcgctggcgaaagggctacaggacgcgggcgtcgacgtactggacattggcctttccggtaccgaagagatctattttgccaccttccacctgggcgtggacggcggtatcgaagtgaccgccagccataacccgatggactacaacggcatgaagctggtgcgcaagggcgcgcgtcctatcagcggcgacaccggtctgcgtgacgtgcagcgtctggccgaggccaatgacttcccgccggtgaacgaagcgaagcgcggcagctataagcagattaacctgcaaaaagagtacatcgaccacctgctgggctacatcaatgtggcaaacctcaaaccgctgaagctggtgattaactccggcaacggcgcggcaggcccggttgtagacgcacttgaagcccgctttaaggcgctgaacgtgccggtgaccttcgtcaaagtgcacaacacgccagacggcaacttcccgaacggtattcctaacccgctgctgccggagtgccgcgacgacacccgcaacgcggtgattgagcacggcgccgatatgggtatcgcctttgacggcgacttcgaccgctgcttcctgttcgatgagaaagggcagtttatcgaaggctactacatcgttggcctgctggcggaagcgttcctcgagaaaaacccgggggcgaaaatcattcacgatccgcgtctttcctggaacaccgtcgacgtggtgaaggccgcgggcggcgagccggtgatgtccaaaaccggccacgcgtttatcaaagagcgtatgcgtgaggaagacgccatctacggcggcgagatgagcgcccaccactatttccgtgattttgcctactgcgacagcgggatgatcccgtggctgcttgtgaccgagctgctgtgcctgaaagggcagagcctgggcgaactggtgcgcgaccgcatggcggcgttcccggcgagcggtgagatcaacagcaaactggcacagcccgctgaggccattgcccgcgtggaacagcactttgccattcatgcgctggagattgaccgtaccgacggtatcagcatggcgttcccgcagtggcgcttcaacctgcgctcctccaataccgagccggtggtgcgcctgaacgtggagtcccgcgccgataccgcgctgatggaagcccgaacgaaggacattctggcgctgttgaatcagtaa

SEQ ID NO: 1752 - DNA, 1497 bp, Enterobacter cloacae
acaaagcggcgtactaagatgagcttacgagaaaaaaccatcagcggcgcgaaatggtcagccatggccaccatcgtcatcattggcctcggcctggtgcagatgacggtgctggcgcgcattatcgataaccaccagtttggtctgctgaccgtctcgctggtgattatcgccctggccgatacgctgtcggactttggtatcgccaactccattatccagcgcaaagagatcagccatctggagctgaccaccctctactggctgaacgtcgggctgggtatcttcgtttttgtgctggtgttcctgctgagcgatgtgattgccggcgtgctgcataacccggacctggcgccgctgatgcgtaccctgtcgttcgctttcgtggtgatcccgcacgggcagcagttccgcgcgctgatgcagaaagagctggagttcaacaaaatcggcatgattgagaccagcgccgtgctggcgggctttaccttcaccgtggtcagcgcccatttctggccgctggcgatgaccgccatcctcggctacctcgttaactctgccgtgcgcacgctgctgttcggcttctttggccgtaagatttatcgcccggggctgcatttttcgctggcgtctgtttcatccaacctgcgcttcggcgcgtggctgacggcagacagcattatcaactacgtaaatactaacctctccacgctggtgctggcgcgcattctgggcgcgagcgtcgcgggtggctacaacctggcgtataacgtcgcggttgtcccgccgatgaagctcaacccgattattacccgcgtcctgttcccggcgttcgccaaaattcaggacgataccgagaagctgcgcgtgaacttttataagctgctctccgtggtggggatcatcaacttcccggtcctgctggggctgatggtggtcgccagcaatttcgtaccgctggtgtttggcgagaagtggaacagcatcatcccaatcctgcaactgctgtgcgtcgtggggctgctgcgctcggtggggaacccgattggttctctgctgatggcaaaggcgcgcgtggatatcagcttcaagttcaacgtgtttaaaaccttcctgtttattccggcaattattgtgggcgggcacatggcgggagccattggcgtgacgctcggcttcctgctggtgcaaatcgtcaataccgtgctgagctacttcgtgatgatcaaaccggtgctgggctccagctaccgtcagtacatcctcagcctgtggctgccgttctatctctccttgccgacgcttgcggtgagctacggcctgggcgtggtgctcaacgggcatctgccgctggcggcgctgcttgcggtgcaggtcgcggcaggcgcgctggcgttcggcgtgatgattgtgctgtcacgcaatgcgctggtggtcgagatgaagcgccagttttgccgtaacgaaaaaatgaaaacgctgcttcgcgcaggctaa

SEQ ID NO: 1753 - DNA, 1296 bp, Enterobacter cloacae
ttttacgaggccattatgaaattacttattcttggcaaccatacctgcggcaaccgtggcgacagcgccatcctgcgcggtttactggatgcaattaacacccttaagcctgagacagaagtggatgtgatgagccgttatccggtcagctcatcctggttactgaaccgcccggtgatgggcgacccgctctacagccagatgaaacagcacaacaacgctgcgggcgtgatggggcgcgtgaagaaagtcctgcgtcgccgctatcagcatcaggtgctgctttctcgcgtgaccgacaccggcaagctgcgcaacattgccatcgcgcagggctttaccgatttcgtgcgtctgctgtccggctatgacgccattattcaggtgggcggctcgttcttcgtcgacctgtacggcgtgccgcagtttgaacatgcgctttgcacctttatggcgaaaaagccgctgtttatgattggccacagcgtcgggccattccaggatccgcagtttaaccagctggcgaactatgtcttcggccactgcgacgcgctgatcctgcgtgaatcggtcagcctcgacatgatgaagcgcagcgaaatcgacaccaccaaagtggagcacggtgtagacaccgcctggctggtggatcatcaggatgacagcttccaggccagctacgcggtacagcactggctggacgtggcggcaaagcagaaaaccgtcgccattaccctgcgtgaacttgcgccgttcgataaacgcctcggcacgacccaggcggcgtacgagaaagcctttgccgacgtggtgaaccgcgtgctggacagcggttaccaggtgctggcgctttccacctgtaccggtatcgacagctacaacaaagatgaccgtatggtggcgctcaacctgcgcaacctggtgaacgatccgtcccgctatcacgtggtgatggacgagctgaacgatctggagatgggcaagctgctctccgcctgcgacctgaccgtgggcacgcgtctgcactcggccattatctcgatgaacttcggcacgccagccatcgccatcaactacgaacacaagtccgcgggcattatgcagcagctcggtatgcctgaaatggccgtcgatattcgtcatctgctggacggatcgctgggtgcgatggtgggcgacacgctcggccagctgcctgcgatcaacgaacgtctggcggtggcggtaaaagccgaacgcgaaaaaggtattggcatggtgaaatccgtactcgaccgcgtccgggaggggaaatga

SEQ ID NO: 1754 - DNA, 1035 bp, Enterobacter cloacae
agcagcgaaaaaacactccctgctcaagtctcatggctacgaggttgccatcgcgctggagtcctgagaatgacaaaacaacgtatttttgtcgccggtcatcgcggaatggtgggttccgcgattgttcgccagctggaacagcgcggtgacgtggaggtgattgttcgcacccgcgacgagttgaacctgcttgacagcaaagcggtgcaggacttcttcgccagtgaacgtatcgaccaggtgtatctggcggcggcgaaggtgggcggcatcgtcgctaacaacacctacccggcggatttcatctacgagaacatgatgattgagagcaacatcattcacgcggcgcatatgcacaacgtgaacaagctgctgttcctcggctcatcctgtatctacccgaaaatggcgaagcagccgatcgccgagagcgaactgttgcagggcacgcttgaagccaccaacgagccgtatgcgattgccaaaattgccgggatcaagctgtgtgaatcctacaaccgtcagtataaccgcgactatcgctcggtgatgccgaccaacctgtacggaccgcacgacaacttccacccgagcaattcccacgtgatcccggcgctgctgcgtcgtttccacgaggcgactgccgaaaacgccccggacgtggtggtgtggggcagcggtacgccaatgcgcgagttccttcacgtggacgatatggcggcggccagcattcacgtcatggagctggatcgcgaagtgtggcaggaaaacaccgagccgatgctgtcgcacattaacgtcgggaccggcgtggactgcaccattcgcgagctggcgcagaccatcgcgcaggtggtgggctacaaaggacgcgtggtgtttgacgccaccaaaccggacggcacgccgcgcaagttgctggacgtgacccgtctgcatcagctgggctggtatcacgaggtctcactggagcaggggctggccagcacctaccagtggttcctggaaaaccagcaccgcttccgggggtaa

SEQ ID NO: 1755 - DNA, 936 bp, Enterobacter cloacae
ttaggtctatacttcgtcaaccattttaaggtggaagataaaatgaccaatttgaaagcagttataccggtagcgggcctgggcatgcacatgttgcccgccacaaaagctattcctaaagagatgctgccgatcgttgacaagccgatgattcaatacatcgtcgacgagattgttgctgctgggattaaagaaatcgttctggtgacgcactcttcgaagaatgctgttgagaaccacttcgacacctcttatgaactcgaagcgctgcttgagcagcgcgttaagcgtcagcttctggcagaagttcagtctatctgtcctcctggcgtgaccatcatgaacgtgcgtcaggcgcagccgctgggtctgggccactccatcctgtgcgcgcgtccggtggtgggtgataacccgttcatcgttgttctgccggatatcattattgataacgcttctgccgatccgctgcgttataatctggcggcaatggtcgcacgcttcaacgagacgggccgcagccaggtgctggcgaaacgtatgaagggcgatctctctgagtattctgttattcagactaaagagccactggagacggaagggcaggtgagccggatcgttgagtttatcgaaaaacccgatcagccgcagaccctggactctgacctgatggcagtcggccgttatgtgctgaatgcggatatctgggccgaactggaaaaaactaagccgggtgcctgggagcgtatccagctgaccgatgcgattgctgagctggggaaaaagcagtcggttgatgctatgctgatgaccggcgacagctatgactgcggtaagaaaatggggtatatgcaggcttttgtgaatactggtctgcgtaacctgaaggaaggggcgaagttcaggaagtgcattgaaaaccttttacatgaataa

SEQ ID NO: 1756 - DNA, 1134 bp, Enterobacter cloacae
aggaatataaacatgtctaaagtcgctctcatcaccggcgttaccgggcaggatggttcttacctggcagagttactgctggaaaaagggtatgaagttcacggtattaagcgtcgtgcctcttcatttaataccgagcgtgtcgatcacatttaccaggatccgcatgcggcgaacccgaaattccacctgcattacggcgacctgaccgatacctccaacctgacccgtatcctgcaagaagtacagccggatgaagtgtacaacctgggcgcgatgagccacgttgcggtttccttcgagtccccggagtacaccgctgacgtggacgccatgggtacgctgcgtctgctggaagcgattcgcttcctgggtcttgagaagaaaacccgcttctaccaggcatctacctctgagctgtacggtctggtgcaggaaattccacagaaagagaccacgccgttctacccgcgttctccgtacgctgtggcgaaactgtacgcctactggatcaccgtgaactaccgtgaatcctacggcatgtacgcctgtaacggcattctgttcaaccacgaatctccacgtcgcggcgaaaccttcgtgacccgcaaaatcacccgcgcgatcgctaacatcgctcagggcctggagtcttgcctgcacctcggcaacatggattccctgcgtgactggggccatgcgaaagactacgtgaaaatgcagtggatgatgttgcagcaggagcagccagaagacttcgtgattgcgaccggcgtgcagtactccgtacgtcagttcgttgagatggctgcggcacagctgggcatcaagctgcgcttcgaaggcaccggcgtggaagagaagggtatcgttgtttccgtgaccggccatgacgcaccgggcgtgaagccaggcgacgtgattgtccaggttgatccgcgttacttccgtcctgctgaagtggaaaccctgctgggcgacccaaccaaagcgcacgagaagctgggctggaaaccagaaaccaccctgcaagaaatggtatccgagatggtggccaaagatcttgaagcagcgaaaaaacactccctgctcaagtctcatggctacgaggttgccatcgcgctggagtcctga

SEQ ID NO: 1757 - DNA, 1275 bp, Enterobacter cloacae
caacagtcgggcgtacttccttgcggaacgtcaggccgaggtgccaggtctatgaaaatcctcgtctacggaattaactactcgccggagcttaccggtatcgggaaatacaccggcgagatggtcgagtggatggcgagccagggacatgacgtgcgggtgattactgccccgccgtattacccggagtggaaggtaggcgaacgctattccagctggcgctaccgccgcgaagagggcgccgcgaccgtctggcgctgcccgctctacgtgccgaaacagccctcgacgctgaaacgtttaattcatctgggcagctttgccctgagcagtttcttcccgctgatggcgcagcgtcgctggaagccggatcgcatcatcggcgtggtgccgaccctgttctgcacgccaggcatgcgcctgctgggaaaactctccggcgcgcgcaccctgctgcacattcaggattatgaagtggacgccatgctcgggctgggtatggccgggaaaggcaagggcggcaaggtggcgaagctcgccagcgcctttgagcgcagcggcctgcacaacgtggattacgtctcgaccatctcgcgctcgatgatgaacaaggcgcaggagaagggcgtcccggcggaaaaagtgatcttctttccgaactggtccgaagtggcgcgcttccgcgatgtgacagaccaggacgcgcaggcgttgcgcgcgcaactcgggttgcctgctgagcaaaaaatcattctttactcaggcaacatcggcgaaaaacaggggctggagagcgtgattgacgccgcgcttcagctgagcgaacacccgtggatgttcgtgatagtcgggcagggcggtggtaaagcgcggctggaaaaaatggccagcgagcgcggactgaccaacatccgcttcttcccgcttcagtcttatgacgcgctgcccgcgctgctgaaaatggcggactgccatctggtggtgcaaaaacgcggcgcggcggatgcggtgctgccgtccaagctgaccaacattctggcagtgggcggaaatgcggtgattacggcagaagccgcaacagaattaggccagctgtgcaacagctacccgggcattgccgtttgcgtggagcctgaatcggttcctgcgctggtgaccggaattgagcaggcactcgccatgccaaaagagaacacggtggcacgtgaatatgccgaacgcacgctcgagaaagagaacgtgctgagccaatttattgcagatatacggggataa

SEQ ID NO: 1758 - DNA, 1440 bp, Enterobacter cloacae
atcatgagtcaaaccactttgtatccggtcgtaatggcgggtggatccgggagccggttgtggccactgtcccgcgtgctttatccaaaacaatttctgtgcctgaaaggcgacctcaccatgctgcaaacgacggttaaccgtctgcacggcgtggagtgtgaaagcccggtggtgatctgtaacgagcagcaccgctttatcgttgccgagcagctgcgccagctgaacaaactgaccgaaaatatcattctggagcctgccggacgcaacacggcgcctgccattgctcttgcggcgctggcagcaaaacgcagcagcccggactgcgacccgctgatgctggtgctggcggctgaccacgtcatccagcaggaagaggccttccgcgacgcggtacgcgccgcgattccttacgctgagaacggcaagctggtgaccttcggcatcgtgccggatctcccggaaaccggctatggctacattcgccgcggcagcgttacgcctggtgaaggcgacagcgtggcctttgacgtggcgcagtttgtcgaaaaaccgaatctggaaaccgcgcaggcgtatgtcgccagcggtgaatactactggaacagcggtatgttcctgttccgcgccggtcgctacctggaagagctggaaaaatatcgcccggatatcttaagcgcctgcgaaaaagcgatggcggtggtggatccggatctcgattttatccgcgtggacgaagaagccttcctcgcctgtccggaagagtccattgactatgcggtgatggaacgtacggcagatgcggtagtggtaccgatggatgcgggctggagcgacgtcggctcctggtcgtcactgtgggagatcagcgcgcataccccggagggtaacgtccatcacggggatgtgatcagccacaaaacggaaaacagctacgtctacgccgaatctggcctcgtcactacggtaggggtgaaggatctggtggtcgtgcagaccaaagacgcggtgctgattgccgaccgtaatgccgtgcaggacgttaaaaaagtggtggagaagatcaaggccgatggccgtcacgaacaccatattcaccgtgaagtctaccgcccgtggggcaaatatgactccatcgacgccggcgagcgttatcaggtgaaacgcatcaccgtgaagccgggagaagggctgtcggtgcagatgcaccatcaccgcgccgaacactgggtggtggtggcagggaccgccaaagtgaccatcgacggtgaagtgaagctgctcggtgaaaacgagtccatttatattccgctgggcgccacgcactgtctggaaaacccggggaaaattccgctcgacttaattgaggtgcgttccggctcctatctggaagaggacgacatcatccgcttccaggatcgctacgggcgcgtgtag

SEQ ID NO: 1759 - DNA, 1467 bp, Enterobacter cloacae
acaccctctcccctttggggagagggccggggtgaggggcgaggggtaaggtttagaactaaaggaacaacgatgacaaatctaaaaaagcgcgaacgagcgagaacgaatgcatcgttaatctctatggtgcagcgtttttctgatatcaccatcatggtcggcggactgtgggcggtgtgttgggtcagcgggcagtcgttcttatacatgcacttgctgatggcgttgattgcgctggtggtgtttcagatgatcggcggcatgaccgatttttatcgttcatggcgcggcgtcaaaatgaccaccgaactgatgctgctgctccagaactggaccttaagcctggttttcagcgcaggcctggtggcgttcagccatgattttgataaccgtcttgtgacctatctctgctggtatctgttaaccagcattggcatggtggtctgccgctcgctgatccgctttggcgcgggctggctgcgcaaccgcgggtataaccgtcgcttcgttgccgtggcgggcgatctgccggtggggcaggtgttgctcgacagcttccgcaaagagccgtggttaggttttgaagtggtcgggatttatcacgacgcgaagcccggcggcgtgccgtccgactgggctggtaactacgaacagcttattgacgatgcgaaagccggcaaaattcataacgtctacatcgccatgcagatgaaagatgagtcccgcatcaagaaactgatgcgcgagctggcggataccacctgctcggtgatcctcatcccggatgtcttcaccttcaatattctccactcccgtattgaagaggtgaacggggtaccggttgttccgctgtacgacacgccgctgtcggggattaaccgcgtgctgaagcgcgcggaagatatcgtgctttcgtccctgatcctgctgctcatctccccggtgctgtgctgcattgcgctggcggtgaagctcagctcgccggggccgatcatcttccgtcagacccgctacggcatggacggtaagccgatcatggtgtggaaattccgctccatgaaggtgatggagaacgacaaggtggtgacccaggcgacgcagaacgatccgcgcgttacccgcgtgggcaacttcctgcgccgtacctcgctcgatgagctgccgcagttcatcaacgtgttcaccggcgggatgtccatcgtcgggcctcgtcctcacgccgtggcccataacgagcagtaccgcaccctgattgaaggctacatgctgcgccataaggtgaagccaggcatcaccggctgggcgcagatcaacggctggcgcggcgagaccgacacgctggaaaaaatggaaaaacgcatcgagttcgatctggagtacatccgcgagtggagcctctggttcgatatcaagattgtttttctgaccattttcaaaggtttcgtgaacaaagcggcgtactaa

SEQ ID NO: 1760 - DNA, 1392 bp, Enterobacter cloacae
  unsure (197)
aatggccgtcgatattcgtcatctgctggacggatcgctgggtgcgatggtgggcgacacgctcggccagctgcctgcgatcaacgaacgtctggcggtggcggtaaaagccgaacgcgaaaaaggtattggcatggtgaaatccgtactcgaccgcgtccgggaggggaaatgaagtttggtttcttcttactganatttccgctgtcgtctgaaacttttgtgctgaaccaaatcaccgcgtttatcgatatggggtatgacgtggagattatcgccctgcaaaagggcgatacgcaaaacacccatgcggcgtatacccggtatgggctggaggcaaaaacccgctggttgcaggatgaacccgccggacggatgaacaaattgcgccatcgcgccggacagacgctgcgcggcctgcatcgcgcctcgacgtggcgggcgctgaatatgtcgcgctatggggcggaggcccgcaacctgatcttatccgccatttgcgggcaaacggcccagccgtaccgggcagatgtctttatcgcccactttggcccggcgggcgtaacggcggcaaaactgcgtgagctgggggtgattgacggcaaaatcgcaaccattttccacggtatcgacatctccagccgggaagtgttgaaccactacacaccggaatatcagcagctgttccgccgtggcgacatgatgctgccgataagcaacctgtgggccgggcgcctgaaaaccatggggtgcccgagcgagaaaatcaccgtttcacgcatgggcgtggacatggaacgcttcacccagcgaccggtcaaggtgccgggcaagccgctgcaaattatctctgttgcccgcctgactgaaaagaaagggctgcacgtagccatcgaagcctgtcgccagctgaaggcgcgcggcgtggacttccactaccgcatcctgggtatcgggccgtgggagcgtcgcctgcgcacgctgattgaacagtatcagctggaagacgtggtcgagatgccgggcttcaagccgagccacgaagtgaaagccatgcttgatgacgcggatgtgttcctgctgccttccgtaaccggcgccgacggcgatatggaaggcattcccgtggcgctgatggaggcgatggcggtcggcattccggtagtctcgaccctgcacagcgggatcccggagctgatcacctctgagcattccggctggctggtccctgaaaacaatgcgctggcgctggcggatcgtctggccgcgttcagtgatatcgatcagcaaacgctgatccctgtgctgcaaaatgcgcggcaaaaagttgaagcagaattcaatcagcaggtgattaatcgccagttagcgagcctgctgcaaacgctgtaa

SEQ ID NO: 1761 - DNA, 1398 bp, Enterobacter cloacae
ggttgtatgctgaaaaagattacccgacgccgatttgtctcttctttatccgtcctggctgccatgccgctgctgtcgccccgcgctgcgcgggcggcgaccgggaagacggtttctgtcgatcgctacaacaataacgactggatcgccgcctttaagcaggcatttaccgagggcgataccgttgttgttcccgccgggttaacctgtgaaaacatcaataccggcattttcattcctgatggcaaaaccctgctgatccgcggtgcgctgaagggcaacgggcgcgggcggtttgtgctccaggaaggctgcaaggtcattggggaaggagaggggcgcacgcataacattacgctggacgtgcgtggctccgactgtgtcattaaagggctggcgatgagcggcttcggccccgtcacccagatctacatcggcggtaaaaagccgagagtgatgcgtaacctgcttatcgatcgcattgccgtgagtcaggccaactacgccattctgcgccagggtttccataatcaggtggacggtgcgcgcattaccaacagcaaattcagtcatttgcagggtgacgcgattgagtggaacgtggcgattaacgaccgtaatatcctgatctctgaccacgtgatcgataacatcaactgcacaaacggcaagatcaactggggcataggcattgggctggctggcagcacgtacgacaatgactatccggaacagcagaccgttaaaaacttcgtggtggcgaatatcaccggcagcaactgtaggcagctggtgcatgttgaaaacggtaaacactttgtgatccgtaatatcaaggccagcaatattactcccgacttcagtaaaaaggccggaattgataacgcaacggtagctatttatggctgtgataatttcgttatcgataatatcgatatggtgaacagcgccggaatgttaatcgggtatggcgtgatcaagggcgattatctgtcgataccgcaaaacttcaaacttaacgatattcgcctggataaccgacagcttgcctataagctgcgcgggatacagatttcctccggcaatgctacgtcgtttgttgccatcaccaacgttgagatgcagcgggcaacgcttgagctgcataacaaaccccagcaccttttcttacgtaatatcaacgtgatgcaggagtcaacgacggggccggctttgaagatgaacttcgatttgcgcaaagacgtgcgcgggaagtttatggctaaaaatgagacgttgctgtcgcttgcgaacataaaagcggttaatgaaaaggggcagagctcggtggatattgatcgggtcgatcaacatgtggtgaatacggaacggttgaattttgcgctgccgcacaggtga

SEQ ID NO: 1762 - DNA, 1011 bp, Enterobacter cloacae
cgcattgagtggattatgaacgataaggttttgtttattggcgcgtctggttttgtcggcactcgtttaatcgagatttccaagactgattttgatgttactaacttcgacaaacagcagagtcatttttatccggatattactgtctccggtgatgttcgtaatcaggatcaactcgatcaggcgcttgctggttttgaaactgtcgtgctgctcgccgctgagcaccgtgatgacgttagcccaacatcgctatactatgatgtaaacgtacagggtactcgtaacgtattgtctgctatggaaaaaaataacgttaagaacattatttttaccagttctgtggctgtgtatggtcttaacaaagtgaaccctgacgaatcccatccccatgatcctttcaaccattacggcaaaagcaaatggcaagcggaagaagttctgcgcgagtggtttaataaagctccagaggaaagatccctgacaattgtccggcctacggtcatctttggtgagcgtaaccgtggcaatgtgtacaacctgcttaagcaaattgcagggggtaaattcgccatggtaggcgctggaaccaactataagtcaatggcttatgtcggtaacattgttgaatttatcaaatttaagctgaccaatgttaagccgggttatgatgtctacaactatgtagacaaaccagacctgaacatgaatcagctagtctcagaagttgagaagagtctcaataaaaaaatcccttcagttcatctcccttacccgcttggaatgttaggtgggtattgctttgatattcttagcaaagttaccgggaagaaatatgcaataagctctgtgcgcgtgaagaaattctgtgcaactacacagtttgacgcgaccaaggtacacagctctggatttaaagcgccttataccttatctcaaggtctggaccgtacgctgaagtatgagttcgttcatgagaagaaagatgacattacgtttgtatctgaataa

SEQ ID NO: 1763 - DNA, 438 bp, Enterobacter cloacae
agcgtaaaggcttcgccgatgcgcgtctggctaaactggcgggcgtgcgcgaagcggagatccgcaagctgcgcgaccagtatgacctgcatccggtttacaagcgcgtggacacctgtgcggcagagttctcgaccgataccgcgtacatgtactccacctatgaagacgagtgcgaagcgaacccgtccgtcgaccgcgacaagattatggtgctgggcggcggtccaaaccgtatcggccagggcatcgagtttgactactgctgcgtacacgcctctctggcgctgcgcgaagacggttacgagactattatggtcaactgtaacccggaaacggtctctaccgattatgacacctccgaccgcctctacttcgagccggttaccctggaagacgtgctggaaatcgtgcgcatcgagaagccaaaaggcgtga

SEQ ID NO: 1764 - DNA, 696 bp, Enterobacter cloacae
ttcgtcgctagcgtggtgctccttctttcgcgtcagtcgcgtttgtatggcgacaaaggttgccaatccttgcgatttactttgaagcggtcgttagcctctttcagttggggggggaactgtctacactcattgctacaagaaaagcagaagacaggcatattcatggttctgataatttatgcgcacccctatccgcagcattcgcatgcgaataagcggatgcttgagcaggcaaggacgctcgaaaacgtagagatacgttccctctatcaactctatcctgattttaatatcgatgtcgccgccgaacaggaggcgctctctcgtgccgatctgatcgtctggcagcatccgatgcagtggtacagcacccctccgctgctgaaattgtggatcgacaaagttttctcccacggttgggcatacggacacaacggcaacgcgcttcatggcaaaagcctgatgtgggctgttaccaccggcgggggggaaagccattttgagattggcgccttccctggatttgacgtgctggcgcagccgctccaggctactgccctttactgcggtctgaactggcttccgccttttgcgatgcactgtacctttgtctgcgacgatgaaaccttgcaggcgcaggctcgtcactacaaacaacgcttacttgagtggcaggagacgcacaatggatag

SEQ ID NO: 1765 - DNA, 288 bp, Enterobacter cloacae
cctaaaatagttaggtcgataacgaaaattcaactgagagcaggggaatacaccatgcaaaataaattactgatcgcttccgttctggctgccaccgcaatgttcaccgtggcgggctgttcgtccaatcaggccgtaaaaaccaccgatggcaaaacgattgttactgacgggaaaccgcaggtggatgacgataccggtctggtatcgtacaaaaacgccgaaaccggtcaaactgaacagattaaccgcgaccaggttaaatcaatgggtgagctggataactaa

SEQ ID NO: 1766 - DNA, 1977 bp, Enterobacter cloacae
actggcttccgccttttgcgatgcactgtacctttgtctgcgacgatgaaaccttgcaggcgcaggctcgtcactacaaacaacgcttacttgagtggcaggagacgcacaatggatagccatacgctgatacaggcgctgatttacctcggcgcggcggcattaattgtgcccgtggcggttcgtctggggctgggctcggtgctcggctatctgattgccgggtgtgtaattggcccctggggttttcggctggtgacggatgccgagtcgatcctgcattttgcggagatcggcgtggtgcttatgctgttcgtgattggcctggagttggatccgcagcggctgtggaaactgcgcgcctcggtgtttggcggaggtgctctgcaaatgctggcctgcggtctgctgttgggcgggttctgcattctgctcgggatggagtggaaagtcgcggagttgatcggcatgacgctggcgctctcctcgacggctattgccatgcaggctatgaacgagcgtaacctgacggtgtcgcaaatggggcgcagcaccttctccgtactgttgttccaggatattgctgccatcccgctggtggcgatgatcccgctgctggcaaccagcggcgcatcaacgacgctgggggcatttgccttatcagcgctgaaggttgttggtgcgctggcgctggttgttctgcttggtcgctacgtaacgcgtccgctgctgcgctttgttgctcgctctggcctgcgcgaagtattcagcgccgttgcgttattcctggtgtttggttttggattgctgcttgaagaggccgggctgtcgatggcaatgggcgccttcctcgcgggggtcttactggctagctccgaataccgtcacgcgctggaaagcgatatcgagccgtttaaaggattgctgctggggctatttttcatcggcgtcgggatgtctatcgacttcgggacgctggtgacccatccgctgcgcatcatcattctgctggtgggtttcctggtcattaaaatggcgatgctgtggctgatcgcccgcccgttaaacgtgccaaaaccgcagcgccgctggtttgccgtgctgctggggcaggggagtgagtttgctttcgtggtctttggcgcagcgcagatggcaaatgtactcgatccggaatgggcaaaagcgctgacgctggcggttgcgctgtcgatggccgcaacgccgatcctgctggtgttgctgacgcgtctggaaaaaacgggaagcgaacaggaacgagaagccgatgagatcgacgaggagcagccgcgggtgatcatcgccggatttggccgcttcgggcagattaccggccgtttactgctctccagcggagtcaagatggttatcctcgatcacgatcctgaccatgtggatacgctgcgtaaattcgatatgaaagtgttttacggtgatgcgacccgggttgatctgctggaatccgccggcgcggcgaaggccgaggtgctgattaacgccatcgacgatccagagaccagtatgcagatggttgagctggtcaaagagcattttccgcatctgaccattatctctcgtgcgcgcgatgtggatcattacatccagctccgtcaggcgggtgtggcagcccctgaacgtgaaaccttcgaaggggcgctcaaatctggccgcatggcgctggaaagcctgggacttggcgcgtatgaagcgcgtgagcgtgccgatttattccgccgttttaaccatgagatggtggaagagatggtggcgatggcgagcagtacggcaaccgaacgcgctgcggtgtttaaacgcaccagcaccatgctgacggagatcatcaacgaggatcgtaatcacctgtcgctggttcagcgccacggctggcaaggaacggaagagggcaagcataccggtgatcctgaggatgaaccggagagtaaaccctctgcgtga

SEQ ID NO: 1767 - DNA, 513 bp, Enterobacter cloacae
tggcggcaattttttgcatccgggaaattttcaatgatcagtctgattgcagcgctggcggtagaccgcgttatcggcatggaaaacgccatgccgtggaacctgcctgccgatctcgcatggtttaaacgtactacgttaaacaagccggtagtgatgggccgcctgacctgggagtcgattggtcgtccattgccgggtcgtaagaatattgtgatcagtagccagccgggcactgacgatcgcgtgcagtgggttaagtccgttgatgaagccattgccgcctgcggcgatgccgaagagatcatggtgatcggcggcgggcgtgtgtatgagcagttcctgccaaaagcgcagaaactgtatctgacgcacattgatgcggaagtggaaggggatacccatttcccggattacgatccggacgagtgggagtctgtattcagtgagtttcacgatgcggatgagcaaaactcgcacagctactgcttcgaaattctggaacgtcgttaa

SEQ ID NO: 1768 - DNA, 834 bp, Enterobacter cloacae
gggggggggtacgcctgtccttcgtcccgcctggtgaagacgcgtctgctgcgcgagaagggcgcacaaaacggttgtatcatcgcaggggataacctcgatgcgacgctggcgctggaaaaagcgaaagccttcccgggtctgaacggtatggacctggcgaaagaagtgaccacggcggaagcctacagctggacgcagggtagctggacgctggaaggcgacctgccggaagcgaaaccggaaagcgagctgccgttccacgtggtggcctacgattttggcgccaagcgcaacatcctgcgtatgctggttgaccgcggctgccgcctgacgatggtgcctgcacaaacgtctgccgaagacgtgttgaagatgaatccggacggtattttcctgtccaacggtcctggcgacccggcgccgtgcgattacgccatcgccgccatcaagtccttccttgaaaccgatatcccggtattcggcatctgcctcggccatcagctgctggcgctggcgagcggtgcgaacaccgtcaagatgaagttcggccaccacggtggtaaccacccggtgaaagatatcgataacaacacggtgatgatcaccgcgcaaaaccacggcttcgccgtcgatgaagcctcaatgccggctaacctgcgcgtgacccataagtcgctgttcgatggcaccctgcaggggattcatcgtaccgataagccagcgttcagcttccagggccacccggaagcgagcccgggcccacacgatgccgcaccgctgttcgatcacttcatcgaacttattgagcaataccgtaagatcgctaaataa

SEQ ID NO: 1769 - DNA, 3243 bp, Enterobacter cloacae
tcaggagctgagaagaccatgccaaaacgtacagacataaaaagcatcctgatccttggcgctggcccgattgtcatcggccaggcctgtgaatttgactactctggcgcgcaggcgtgtaaagccctgcgtgaagagggttaccgcgtcattctggtgaactctaacccggccaccatcatgaccgacccggaaatggcggatgcgacctacatcgagccaattcactgggaagtggtacgcaaaattatcgagaaagagcgtccggacgcggtgctgccgaccatgggcggccagacggcgctgaactgtgcgctggagctggagcgtcagggcgtgctggaagagttcggcgtgaccatgatcggtgcgaccgccgacgcgattgataaagcagaagaccgtcgccgcttcgacgtggcaatgaaaaaaattggccttgataccgcgcgttccggtatcgcgcacaatatggaagaagcgctggccgttgcggctgaagtgggctatccgtgcatcatccgtccatcgttcaccatgggcggcaccggcggcggcattgcctacaaccgcgaagagtttgaagagatttgtgagcgcggcctggatctctccccaaccaaagagctgctgattgatgaatcgctgattggctggaaagagtacgagatggaagtggtgcgtgataaaaacgacaactgcatcatcgtctgctccatcgaaaacttcgacgcgatggggatccacaccggcgactctatcaccgttgcgccagctcagacgctgaccgacaaagagtaccaaatcatgcgtaacgcctcgatggcggtactgcgtgaaatcggcgtggaaaccggcggctctaacgtgcagttctcggtgaacccgaaaaccggccgtctgattgttatcgaaatgaacccgcgcgtgtcccgttcctccgcgctggcctccaaagccaccggcttcccgattgcgaaggtggcggcaaaactggcggtgggttacacccttgacgagctgatgaacgacatcaccggtggccgcacccctgcgtccttcgaaccgtccatcgactacgttgtgactaaaattcctcgctttaacttcgagaaattcgccggcgccaacgaccgtctgaccacccagatgaaatctgttggtgaagtcatggcgattggccgcacgcagcaggaatccctgcaaaaagcgctgcgtggcctggaagtgggcgcgaccggctttgacccgaaagtcagcctggacgacccggaagcactgaccaaaatccgccgtgagctgaaagacgcgggcgcagagcgtatctggtacatcgccgatgccttccgcgcgggcctgtccgtcgacggtgtatttaacctgactaacattgaccgctggttcctggtgcagattgaagagctggtgcgtctggaagagaaagtggcggagctgggcatcaacggcctggacgctgacttcctgcgtatgctgaagcgtaaaggcttcgccgatgcgcgtctggctaaactggcgggcgtgcgcgaagcggagatccgcaagctgcgcgaccagtatgacctgcatccggtttacaagcgcgtggacacctgtgcggcagagttctcgaccgataccgcgtacatgtactccacctatgaagacgagtgcgaagcgaacccgtccgtcgaccgcgacaagattatggtgctgggcggcggtccaaaccgtatcggccagggcatcgagtttgactactgctgcgtacacgcctctctggcgctgcgcgaagacggttacgagactattatggtcaactgtaacccggaaacggtctctaccgattatgacacctccgaccgcctctacttcgagccggttaccctggaagacgtgctggaaatcgtgcgcatcgagaagccaaaaggcgtgatcgtgcagtacggcggccagactccgctgaagctggcgcgcgcgctggaagcagcaggtgtaccggttatcggcaccagcccggatgcgattgaccgtgcggaagaccgcgagcgtttccagcaggcggttgaccgtctcaagctgaaacagccggcgaacgccaccgtgaccgcgattgaaatggccgttgagaaagcgaaagagatcggctacccgctggtggtgcgtccatcctacgtactgggcggccgcgcgatggaaatcgtctacgacgaagcggacctgcgtcgctacttccagacggcggtgagcgtttccaacgatgcgccagtgctgctcgaccgcttcctcgacgacgcggttgaagtcgacgtggatgccatctgcgacggcgaaatggtgctgattggcggcatcatggagcacatcgagcaggcgggcgtgcactcgggtgactccgcctgttctctgccagcgtataccctgagccaggagattcaggacgtgatgcgccagcaggtgcagaagctggccttcgagcttcaggttcgcggcctgatgaacgttcagttcgcggtaaaagacaacgaagtctatctgattgaagtcaacccgcgtgcggcgcgtaccgtaccgtttgtctctaaagcgaccggtattccgctggcgaaagtggcggcgcgcgtgatggctggccagacgctggctcagcagggcgtcacgaaagaaatcatcccgccgtactactcggtgaaagaggtggtgctgccgttcaacaaattcccgggcgttgacccgctgttagggccagagatgcgctctaccggggaagtaatgggcgtgggccgcaccttcgcagaagcgtttgcgaaagcgcagctgggcagtagctccaccatgagaaaatctggccgtgcgctgctctccgttcgcgaaggcgataaagagcgcgtggttgacctggccgccaagctgctgaaacagggcttcgagctggacgccactcacggtacggcgattgtgttgggtgaagcgggtatcaacccgcgtctggtgaacaaagtgcatgaaggtcgtccgcacattcaggatcgtatcaagaatggcgaatatacctacatcatcaacaccaccgcaggacgccaggcgattgaagactccaagctgattcgccgcagcgcgctgcaatacaaagtgcactacgacaccaccctgaacggcggtttcgcaacagcgatggcgctgaatgcggatgccaccgagaaggtgatttcggtgcaggaaatgcacgcgcagattagcaagtaa

SEQ ID NO: 1770 - DNA, 1299 bp, Enterobacter cloacae
aatggaaaaagtatgaagaactggaaaacgctgctactcggtgtcgctatggttgcgaataccagcttcgcggccccacaggttgtcgataaagtcgcggctgtggttaacaacggcgtcgtgcttgaaagtgacgttgacggtttgatgaaatctgtaaagctcaactcgggccaggcaggtcaacaacttccggatgacgctacgctgcgccaccagatcctggaacgtctgatcatggatcagattgtcctgcaaatgggccagaaaatgggtgtgaagatctctgacgagcagctcgatcaggcgatcgccaacattgcaaagcagaacaacattaccccggaccagatgcgtagccgcctcgcctatgacggcatcagctacgccacctaccgcaatcagatccgtaaagagatgctgatttcagaagtgcgtaataatgaagtccgtcgccgcgtcaccatcctgccgcaggaagtggatgccctggcaaaacaggtggggaatcagaatgatgccagcacagagcttaacctgagccacatcctgatcccactgccggaaaacccaacctccgatcaggcggcagaggcggaaagccaggcgcgcgctatcgttgagcaggcgcgtaatggcgatgacttcggcaagctggcgatcacctattccgctgaccagcaggcgctgaaaggcggccagatgggctgggggcgtattcaggagctgccatccctgtttgcccaggcgctgagcaccgcgaagaaaggcgatatcgtcggtccaatccgttccggtgtgggcttccacattctgaaagtgaacgacctgcgcggccagagccagaacatttcggttactgaagtgcatgcgcgtcatatcctgcttaagccgtctccgatcatgactgacgatcaggcccgtgcgaagctggaacagatcgccgcagacatcaagagcggtaaaaccaccttcgataaagcagcaaaagagttctctcaggatcctggctctgcaaaccagggcggtgacctgggttgggcggccgctgatatttacgatccggctttccgcgatgcgttaatgaagctgaataaaggccagatgagcgcgccggtacactcttccttcggctggcatctgatccagctgatggacacgcgcaacgtggataaaaccgacgcggcgcagaaagaccgcgcgtatcgcatgctgtttaatcgtaagttctctgaagaagccgcaacctggatgcaggaacaacgcgccagcgcttacgtgaaagtgttgagcaactga

SEQ ID NO: 1771 - DNA, 501 bp, Enterobacter cloacae
cgaccaagcagaacaaccagcgccagcgcaccaacaaccttcagcgctgataaggcaaatgcccccagcgtcgttgatgcgccgctggttgccagcagcgggatcatcgccaccagcgggatggcagcaatatcctggaacaacagtacggagaaggtgctgcgccccatttgcgacaccgtcaggttacgctcgttcatagcctgcatggcaatagccgtcgaggagagcgccagcgtcatgccgatcaactccgcgactttccactccatcccgagcagaatgcagaacccgcccaacagcagaccgcaggccagcatttgcagagcacctccgccaaacaccgaggcgcgcagtttccacagccgctgcggatccaactccaggccaatcacgaacagcataagcaccacgccgatctccgcaaaatgcaggatcgactcggcatccgtcaccagccgaaaaccccaggggccaattacacacccggcaatcagatag

SEQ ID NO: 1772 - DNA, 1437 bp, Enterobacter cloacae
  unsure (29)
ttcgggctcctggcggatagaaaactacngggaaccgcccgggtattggatcaggtgtggcgcttcaacatcgactacaccaaagtcagcgatccgtattacttcaacgactttgattctaaatacggctccagtaccgacggttacgccacgcagaaattcagcgtgggctacgccattgagaactttgacgcgacggtgtcgaccaaacagttccaggtgtttgatacgcaatcgcgtagtacctatggtgccgagccgcagctggacgtgaactggtatcagaacgatgttggtcctttcgacacgcgcgtttacgctcaggcggtccatttcgtcaacaccaactcggatatgccggaatcaacgcgtctgcatatcgagccgacgatcaacctgccgtggtcaaacgactgggcgagtctgaataccgaagccaaagtgatggccacccactaccaacagaagaatctggactggtataacaaacgttatggcaccgatcttgaagaatcggtaaaccgtacgcttccgcaattcaaaatggacgggaagctgattttcgaacgtgatatggctcttctcgcggatggatacacccagacgcttgagccacgtatgcagtatctttatgtgccttatcgcgatcagagcaaaattcaaaactatgactcgtccttcctgcaatcagactacagcggcctgttccgtgaccgtacctacggcggccttgaccgtattgcgtctgctaaccagttaacgaccggcgtcacaacgcgcgtatatgatgatgctgccgttgaacgttttaacgtttctgttggtcaaatctactatttcaccgagtctcgcaccggtgatgacgacattaactgggagaaagacaacaaaacgggctcactggtatgggcaggcgacacttactggcgcatgacggatcgttggggtctgcgcggtggtgttcaatacgatacacgactggacaatatcgcgacgggcagcgctgccatcgaatatcgtcgtgatgaagaccgcatgttgcagttaacgtaccgttacgccagcccggagtatatccaggcgacactgccaaattatgcgaatacagaccaatacaaagacggtatttcacaggtgggtaccgccgcgagctggccgattgccgatcgttggtcagtcgtcggggcctactactatgacacgaatgcccaaaaacctgctgaccagatgctgggtctgcaatataactcctgctgttacgcaatacgtgtcggttacgaacgcaaacttaacggttgggatacgcaaaacagtcagggcaaatacgataacgtgattggctttaatatcgagttgcgcggcctgagttctaactacggtctgggcacgcagcagatgctgcgctcgaacattctgccgtatcgtagttcattgtaa

SEQ ID NO: 1773 - DNA, 828 bp, Enterobacter cloacae
tactcaatgactaatcgagtccatcagggccacttagcccgtaaacgcttcgggcaaaacttcctcaacgatcagtttgtgatcgacagtatcgtttctgccattaatccgcagaaaggtcaggccatggtcgaaatcggcccgggacttgccgcgctgaccgagccggtaggcgaacgcctcgacgaactgaccgttatcgaactcgaccgcgatctggccgcgcgtctgcaaacgcacccgttcctcgggccgaagctgacgatttatcagcaggatgcgatgaccatgaactttggcgaactgtcagaaaaaatgggacagccgctgcgcgtgttcggtaacctgccgtacaacatctccaccccgctgatgttccatctgtttagctatactgatgccattgccgacatgcacttcatgttgcaaaaagaggtcgttaaccgtctggttgcagggccgaacagtaaagcgtatggtcgtttaagcgtgatggcgcaatattactgcaacgtgatcccggtattagaagtaccgccttccgcattcacgccaccgccaaaggtagattctgcggttgtgcgcctggtgccgcacaaaacgatgccgtacccggtcaaagacctgcgcgtgctgagccgtatcacgacagaagcctttaaccagcgccgtaaaacgattcgtaacagccttggcaatctgtttaccgttgacgtattagctgagttgggcatcgacccggcaatgcgtgcggaaaatatttccgtagagcagtactgcaagctggctaattacatcagcgacaatgcgccgccgaaggagagctaa

SEQ ID NO: 1774 - DNA, 381 bp, Enterobacter cloacae
gccatgattgattcgccccgcgtctgtgttcaggttcaaagcgtctacattgagtcccaatccacaccggatgaagaacgttttgtctttgcttataccgtaaccattcgcaatctggggcggatgcctgtgcaactgctcgggcgctactggcttatcaccaacggcaatggccgtgaaattgaagtccagggcgaaggtgtggtgggtgaacaaccccatatcgcccctggcgaagagtatcagtacaccagcggcgcggtaattgaaactccgctgggtaccatgcagggccattacgaaatggtcgatgccgacggtaatgctttccgcattgctattcccgtattccgtctcgccgtacctacacttattcattaa

SEQ ID NO: 1775 - DNA, 1050 bp, Enterobacter cloacae
agaagccgcaacctggatgcaggaacaacgcgccagcgcttacgtgaaagtgttgagcaactgatgaaaccgcatcgtgttgtgatcacccccggcgaacccgccgggattgggcctgacctggtggttcagctcgcccagtgcagctggccggtagagttggttgtctgtgcagatgcaacactgttacaagaccgggcagctttgctcggtctgcctttaacgctcctcccttacgttgaaggccaacagcccgcaccgcagcagtctggtactctcaccctgctttctgttccgcttcgtgcgcctgttgtccccggcgagttacacaccgaaaacggccactacgttgtcgagacgctggcgcgcgcctgtgacggttgccttcagggcgaatttgccgccctgatcaccggtccggtgcataaaggcgtgatcaatgacgcgggcattccgtttaccgggcataccgaatttttcgaagagcgttcgcacagcccgaaagtggtgatgatgctggcaaccgaagcaatgcgcgttgcgctggtaacaacgcacctgccgatcaaagccattccggatgccattacgcctgaactcctgcgtgagatcattggcattttgcatcacgatctgcaaaccaaattcggcattccgcagccgcatgtgctggtttgcggcctgaatccgcacgcgggtgaaggcggacatatgggcaccgaagagatagacaccatcattccagtgcttgaggagatgcgggcgaaggggatgaacctcagcgggcctctgcctgccgacacccttttccagcccaaatacctggataatgccgacgccgtactcgcgatgtaccacgatcagggtctgcccgtgctaaaataccagggctttggccgcggggtgaatatcaccctcggtttaccctttattcgaacgtccgttgaccacggtactgcgctggatctggcaggccagggaaaagcggatgtcggcagttttattacggcgcttaatctcgccatcaaaatgattgttaatactcaatga

SEQ ID NO: 1776 - DNA, 969 bp, Enterobacter cloacae
ttgaaactccgctgggtaccatgcagggccattacgaaatggtcgatgccgacggtaatgctttccgcattgctattcccgtattccgtctcgccgtacctacacttattcattaatctaatgtctacatatctgattggcgacgttcacggttgctacgatgaactgatcgcattattaaaacaggtcgacttcacccccgggcaggatacgctctggctgacgggcgacttagtggcgcgcggtcccggttccctggacgtcctccgctatgtcaaatcgctgggcgacagcgtgcgcatggtgctgggcaaccacgatctgcatctgctggccgtatacgccgggatcagccgtaataagccgaaagatcgcattacccccctgctggaagcgccggatgccgatgagttgctcaactggctgcgtcgccagccgctgctacagattgacgaagagaaaaaactggtgatggcgcatgccggcatcacgcctcagtgggatcttgagacggcaaaaacctgcgcgcgcgacaccgaagcggtgctggcgagcgactcctacccgttcttcctcgatgcgatgtacggcgacatgccaaataactggagtgatgatctcagcggcctggcgcgactgcgttttatcaccaatgcctttacgcgcatgcgctactgcttcccgaacggacagctggatatgtattgcaaagatacgccggaaaatgcgcctgcgccgcttaagccgtggtttgccattccgggccccgtgacaaacgaatatagcgtggtatttgggcactgggcatcgctggaaggaaaaggcaccccggaaaatatctacgcgctggacaccggatgctgctggggcggggatttaacctgcttacgctgggaagataagacctactttgtgcagccatccaaccgacagctggacttaggcgaaggtgaggcggtcgcctcctga

SEQ ID NO: 1777 - DNA, 471 bp, Enterobacter cloacae
tgcgccgctggttgccagcagcgggatcatcgccaccagcgggatggcagcaatatcctggaacaacagtacggagaaggtgctgcgccccatttgcgacaccgtcaggttacgctcgttcatagcctgcatggcaatagccgtcgaggagagcgccagcgtcatgccgatcaactccgcgactttccactccatcccgagcagaatgcagaacccgcccaacagcagaccgcaggccagcatttgcagagcacctccgccaaacaccgaggcgcgcagtttccacagccgctgcggatccaactccaggccaatcacgaacagcataagcaccacgccgatctccgcaaaatgcaggatcgactcggcatccgtcaccagccgaaaaccccaggggccaattacacacccggcaatcagatagccgagcaccgagcccagccccagacgaaccgccacgggcacaattaa

SEQ ID NO: 1778 - DNA, 3102 bp, Enterobacter cloacae
aaaaataataattttatgcttttttgttttgagctcaaccttaaagatagtcaatatacgttttacacacgttatctgatgttccttctcactcaaatggatgtgtacatgagcaaaaaattcttcaaattaaataatacaaccaaaactctagggaagatatttcctgctttgttgatatgcacccccgcggttgcattttctgcaatcattgatcaatcaacctctgtccctcaagatttttcagccgatgctgaatatgttattaataaagacgtgacgatatcctccgcgggtagtgaagcggcggtgtctgtcactggttttactaccactactaccactaattatggcaatatttctggcacgggaaatggcctggatattaatactggtgaacagcgcattttaattaataacgacatcggtgcaaccatttcctccaccaccgcgaatgctgttaatattcagtcaatgctcggtgattttaataacagtggaaatattatcggtgcggaaaatggcatgtttgtcggcgaaaactcttccgcagtaaacattatcaataccagcaccggaatgataaaaggaaaaacgggtctaagtactcggtatggtattggcattaataacagtggcgcaattatcggtacaaatggtgatgctattacggcaactaatggcaacaccaagcttactaacaatgcccttgtgcagggaaccgagaacggtatcaatgtaaaagatactgcaaaattggatatcaagaatagcggaacgattagtggtaatacagccgctattatgtttgccagcaataaaaataacacgctggtgcttgatacgggttccgtccttgtcggtgacgttatttccaccaattccacgggaaacaccctcactctgatcggcaccggtacagaagacagcaattttgtgggtctgaatgaaggggacggttttgccagcgtcacaatgaacggcgaaaactgggcgctgtcgggcgatattgacattattggctctgtcgactccttgatgatagacaagggcgcgttaaccctggcgggcgaagtatccaacaccggtaatacgcgggtggccaaacacgcctcgctgcaactgggcgatggcgaaaaaactgcgacgctcagcggtgggatcaccaacaacggtaccgtcattttcaatcagggtagcgatttcactttcgccaccgacatgaccggtagcggtaacgtcgaaaaagtagactccaacaccctgaccctgacgggcaaaaatagctacaaaggggatacggttctgcacggcggcaccacgctggtctccaccggcgcaacgctcggcgtcaagggcagtaacgccactgttaccgttgaaaatggcgcgacctttgccaccgcaggcgaagtgaacaacaacatcgcagttcttagcggcggtacgctggcggcatggaatgccgtccagggtaactccacgctcagcgcttccgacgtcgataccatcaacggcaacgtgactaatggtggtacgctgttactcagtgcggctgataatagcgttggcaataatttttcgattaatggcgactacaccggctctgacggtagccagattgtgatgaacagcaccctgggtgaagataattcaccaactgaccacctcactattacgggcagcagcttcggtcagtccggcgtcagcattaccaacattggcggcgcaggcgcgcaaaccattaacggtatggaaattgtcagcatcggcggcagttccgaagcccaactgacgctggcaaaaccggtcgtcgcaggcgcctgggaatataacctctaccagcacagtgacggcaactggtatctggaatcaaaggcgacgccttctgatgatccttctgacgacaccgatgacggtggcaataccgatgatggcggcaacaccgataacggcggcaacaccgataacggcggcaacaccgataacggcggtaacaccgacaacggcggtaacactgacaacggcggcaacaccgataacggcggtaacaccgacaacggtggtaacaccgacaacggtggtaacaccgacaacggcggtaacactgacaacggcggcaacaccgacaacggcggtagcactgacaacggcggtaacaatgcgccggaagtcatggcgcctgaagtgggtgcttacttaggcaactaccttgccgcacagggcatgttcctgcataaacgtgacgatcgcgaccagatcaccttccgcaatgaagacgacctgaacacctggatgtacgttaagggtcgctatcacgagaacgatgcgggtggcaataaagtcagctatgacaccaccacgaccgtactgcaagtcggcagcgatttcatgagcaagccaatggataacggtatcctgcgtgctggcgggatgttcggtgcaggccaggcgaagacccactctgatgcgaagcacaacgtgcgtgacgctcagggtaaggttgatggtttcaatgttgggctttacgccacctggcaggaagatcagaaattacgtctgggcagctacgttgatacctgggccgcatacagctggtacaacaacaaagtcaccagcaaccgcaacgacgaagactacgatagcgaaggtttcgccgcgtctgttgaagtcggccacgcgtgggttatccagtcagaaaatgaacgtacctggaagatcgagccgcaggcgcaggtgatctacagctatctcgatcaggaaaatcataccgatcgcgacggcgtacgcgtcactaccctggacaacgacagcgtctttggtcgtctcggcgttaaagcaagctacttccagcagaaggacgtcaaggcctggcagccgtacgtcgcggttaactggttgaaaggtgctggtcaaaacgatctggcattcaacgacgagaccgtcagcaacgatacgccggaagatcgtggtcagttagagctgggcgtaaccggcaacctgaacgaaaccacgacaatctccctgcgagccagcggcgaatggggtgaaaacagctatgccgcatacggcggtcatattttgttaaaccatcggtggtaa

SEQ ID NO: 1779 - DNA, 1221 bp, Enterobacter cloacae
aggttcatgtcccctatcgaaaaatccagcaagctcgacaacgtctgttacgacatccgtggcccggtactcaaagaggcaaaacgccttgaagaggaaggcaataaggttctgaaactcaacatcggcaaccccgcgccatttggttttgaagcgccggatgagatcctggtggatgtgatccgtaacctgcccactgcacaaggctactgcgattcaaaagggctttactccgcccgtaaagccatcatgcagcactatcaggctcgcggtatgcgcgacgtcaccgttgaagatatctacattggcaacggtgtctcggaactgatcgttcaggcgatgcaggcgctcctgaacagcggcgatgaaatgctggttcctgccccagattatccgctgtggacggctgcggtgtccctgtccagcggtaaagcggtgcactacctgtgcgacgaatcctctgactggttcccggatctggatgatattcgcgccaaaattaccccgcgcacccggggtatcgtgatcattaacccgaataacccgacgggcgcggtctattcaaaagagctgctgatggagatcgtcgagatcgcccgccagcacaacctgatcatctttgccgacgagatttacgacaagatcctgtacgacgcggcgcagcaccactctatcgccgcgctggcgcccgatctgctgacggtgacctttaatggactgtctaaaacttaccgcgttgccggtttccgtcagggctggatggtactgaacggtccgaaaaaacatgcgaaaggctacattgaagggctggagatgctggcatccatgcgtctgtgcgccaacgtaccggcgcaacatgcgatccagacagcactcggcggctatcaaagcatcagcgagtttatcgttccaggcggccgcctgtatgaacagcgcaaccgtgcgtgggaattgattaatgatattccgggcgtctcctgcgtgaagcctaacggcgcgctgtacatgttcccgaaaatcgacgcgaagcgctttaatattcacgacgaccagaaaatggtgctcgacttcctgttgcaggaaaaagtgctgctggttcagggtacggcgtttaactggccgtggccggatcacgtgcgtatcgtcaccctgccgcgcgaagacgatctcgaaatggccatcagccgcttcgggcgcttcctctccgggtaccatcagtag

SEQ ID NO: 1780 - DNA, 603 bp, Enterobacter cloacae
cctatgagtcagagtcatttctttgcccacctctcccgcctgaaactcatcaaccgctggccgctgatgcgcaacgtgcgcactgaaaatgtgtctgagcacagtttacaggttgccatggtcgcgcacgcgctggccgcgattaaaaaccgcaaattcaacgggcaggtgaatgccgaacgtatcgccctgctggcgatgtaccacgatgcatcggaagtgctgaccggggatctgcctacgccggtgaaatatttcaactcgcagattgcccaggaatataaagctattgagaagattgcccagcagaagctgatcgacatggtgcctgaagagctgcgcgatatcttcgggccgctcatcgacgagcatcagtatacggaagaggagaaatccctggttaagcaggccgatgcgctgtgcgcctacctgaagtgtctggaagagctgtccgccgggaataacgaatttttactggcaaaaacgcgtctggaaaaaacgctggaatctcgtcgcagcgaagagatggactactttatgcgcatgtttgtgccgagcttccatttgtcactggatgagattagccaggattcgccgctgtag

SEQ ID NO: 1781 - DNA, 435 bp, Enterobacter cloacae
aggatgaaactgaatcgcgtcctgtcagcaggaagatgtatgtctttaacccgaaaacggcgcagtaccggaaaagtaacgctcgcggatgtcgcgcagcttgccggcgtcggcacgatgactgtttcccgtgccctccgcacgcccgaacaggtttccgataaactgcgtgaaaaaattgaagccgcggtgcaggagctgggatacatgcccaatcttgccgccagcgcactggcatcggcatcgtcatggacgattgcgatggttgtacccaatctttccgaagctggctgttccgagatgttcgccgggctacagcaggtgctccagccagccggatatcagatcatgctggcggaatctcagcatcgtcttgaacaggaagagaaactgcttgaaacgctgctggcctcgaacatcgcggcggcgatatag

SEQ ID NO: 1782 - DNA, 624 bp, Enterobacter cloacae
ctcagcgtcgagcactttgataccgtgcgacactggctaaaaaacgcttatatcccggtgatggaaatgggtgcaatgcgtgccgatccgattgatatgaatatcgggattgataacgtcgccgccatgtatgaacttaccgagatggtgattcagcgcggctaccagaatatcggcgtgctgtgcgctaaccaggaacagtggatttttcagcagcatttgcagggctggtacaaggcgatgttgcgccaccacctggcgccgaacagagtgattaatgccgccatgccgccgaacttctccaccggcgcggcacaattgccagagttcctgctggcgtggccggagctggatgcgctggtgtgcgtgtcagatgaactggcctgcggcgcgctgtatgagtgccagcgtcggcgcatcaaggtgccggacgatttagcggtcgtaggttttggcgacagcgacgtcagccgcgtctgtcagccgccgctgacgacgatggcagtaccgcatcgcaagattgggattgaagccgggaaagcgttactggaacgtctgaatgacggagactggcgcgaccataaacccatcgcgtccagcctgtgtctgcgggaaagctgttaa

SEQ ID NO: 1783 - DNA, 1239 bp, Enterobacter cloacae
cgtttttttagccacgtatcaataataggtacttccatgtcgagtaagttagtactggttctgaactgcggtagctcctcactgaaattcgccatcatcgatgcgctcaacggtgacgagtacctctctggtttggccgaatgtttccatctgcctgaagcacgtatcaagtggaagatggacggcagcaaacaagaagcggctttaggtgcaggcgccgctcacagtgaagcgctgaactttatcgttaacactattctggcacaaaaaccagaactgtctgctcagctgaccgcaattggtcaccgtatcgtccacggcggcgaaaaatacaccagttccgtggtaatcgacgactccgtgattcagggtatcaaagactctgcgtctttcgcaccgctgcataacccggctcacctgatcggtatcgctgaagcactgaaatccttcccgagtctgaaagacaaaaacgtggccgtgtttgatactgcgttccatcagaccatgccggaagagtcttacctctatgccctgccatacagcctgtacaaagagcacggcgtccgtcgttacggcgctcacggtaccagccacttctatgtgactcaggaagccgcaaaagtgctgaacaagccggttgaagaagtcaacattatcacctgccacctgggcaacggtggttctgtttccgctatccgcaacggtaagtgtgttgacacctctatgggtctgaccccgctggaaggtctggtgatgggtacccgttccggtgatatcgacccggcgatcatcttccacctgcacgacaccctgggcatgagcgttgacgacatcaacaaaatgctgaccaaagagtctggcctgctgggcctgaccgaggtcaccagcgactgccgttacgttgaagacaactacgcagaaaaagctgacgctaaacgtgcaatggacgtttattgccaccgcctggcgaagtacatcggttcttacaccgcgctgatggaaggccgtctggatgctgttatcttcaccggtggtatcggtgagaacgcggcaatggtacgtgaactgtccctgggcaaactgggcgttctgggcttcgaagttgatcatgagcgtaacctggctgcccgcttcggcaagtctggcttcatcaacaaagaaggcacccgccctgctatcgttattccaactaacgaagagctggtcatcgcgcaagacgcacaccgcctgactgcctga

SEQ ID NO: 1784 - DNA, 2145 bp, Enterobacter cloacae
accgtgtcccgtactattatgctgatccctaccggaaccagcgtcggcctgaccagcgtcagcctcggcgtgatccgcgctatggaacgcaaaggcgttcgtctgagcgtctttaagcctatcgcccagccacgtgccggtggcgatgcgccagaccagaccaccaccatcgttcgcaagaactccaatctgccagcggctgaaccgctgaagatgagccacgttgaatctctgctctccagcaaccagaaagacgtgctgatggaagagatcattgccaactaccacgcaaacgcgcaggacgcggaagtggtgctggttgaaggcctggtcccgacccgtaaacaccagtttgcccagtctctgaactttgaaatcgcgaaaaccctgaacgcagagatcgtttttgtaatgtctcagggcacggataccccagagcagctgaaagagcgtatcgaactgacgcgcagcagcttcggcggtgcgaaaaacaccagcatcaccggcgtgattgttaacaagctgaacgcgccagtagatgagcagggccgtacgcgtcctgacctgtccgaaatttttgacgactcctccaaagcgaaagtcatcaaagttgacccggctaagttgcaggattccagcccgctgcctgttctgggcgcggtgccatggagcttcgatctgattgccacccgtgcaatcgatatggcgcgtcacctgaacgccaccgtgatcaacgaaggcgatatcaacacccgccgcgtgaagtccgtaaccttctgcgcacgtagcattccacacatgctggaacacttccgcgcaggttccctgctggtgacctctgctgaccgtccagacgtgctggttgcagcgtgcctggctgcgatgaacggcgtggaaatcggtgcaattctgctgaccggcggctatgaaatggacgcgcgtatcagcaagctgtgcgaacgtgcgttcgccactggcctgccagtcttcatggtgaacaccaacacctggcagacctccctgagcctgcaaagcttcaacctcgaagtgccggttgatgaccacgagcgtatcgagaaagttcaggaatacgttgcgggctacatcaatgcggactggatcgaatccctgacggcgacctccgagcgcagccgtcgtctgtctcctccagccttccgttaccagctgaccgagctggcgcgtaaagcgggcaaacgcgtggttctgccagaaggcgacgaaccacgtaccgttaaagcggcagccatctgtgcagaacgcggtatcgcgacctgtgtgctgctgggtaacccggatgagatcaaccgcgttgcggcgtctcagggcgttgagctgggcgctggcattgagatcgttgacccggaagtggttcgcgaaagctacgttgctcgcctggttgaactgcgtaagaacaagggcatgaccgaagccgttgcgcgcgagcagctggaagacaacgtcgtgctgggtacgctgatgctggagcaggacgaagttgacggtctggtttccggtgcggttcacaccaccgcgaacaccatccgtccaccgttgcagttgatcaaaaccgcaccgggcagctctctggtctcctccgtgttcttcatgctgctgcctgaacaggtttatgtttacggcgactgcgcgatcaacccggatccaaccgcagagcagctggcagaaatcgctatccagtctgcggactccgcgattgccttcggtatcgaaccgcgcgtcgcgatgctctcctactccaccggtacctctggtgcaggtagtgacgtagagaaagtccgtgaagcgacccgcattgcgcaggaaaaacgtccggatctgatgatcgacggcccgctccagtacgatgccgcggtaatggctgacgtggcgaaatccaaagcgccgaactcgccggttgcaggtcgcgctaccgtgttcatcttcccggatctgaacaccggtaacaccacctataaagcggtacagcgttcagcagacctgatctccatcgggccaatgctgcaaggcatgcgcaaacctgtgaacgacctgtcccgtggtgcgctggtagacgatatcgtctacaccatcgcgctgacggcgatccagtcttcgcagcagcagtaa

SEQ ID NO: 1785 - DNA, 636 bp, Enterobacter cloacae
cgattaatccgtaagttacaccacaactgcaaacgcgccgaaagagcgcttagacgagaaggtttcccgatggtggagcagaatcatttggcaagtactgaatgggttgacattgtcagcgaagaaaatgaagtgatcgcgcaggccagccgcgaacaaatgcgtgcggagcgtctgcgtcaccgcgcgacgtacatcgttgttcatgacggcatgggcaagattctggtccagcgtcgcaccgacaccaaagattttcttcctggtatgctggatgccacagcgggtggcgtcgtgcaggccgatgaagtgctgctggattccgcgcgtcgtgaagcggaagaagagttaggtatcgctggcgtgccgtttgccgagcacgggcagttttatttcgaagatgagcattgccgcgtctggggcgggctgtttagctgcgtttcccacggtccgttcgccttgcaggaagaggaagtgagcgaagtcagctggatgacgccggaagagatcaccgcgcgttgcgacgaattcactccggattcccttaaagcactggcgctgtggatgacccgcaacgccaaaaacgaatccgctaaaccggaaaataaggcggaaaaagaggaagaggctgagtaa

SEQ ID NO: 1786 - DNA, 306 bp, Enterobacter cloacae
tggggcgtactctactcaaaaaaggggataacaatgaaaatcatggctatttgcggctccggcctgggcagcagttttatggtcgaaatgaatattaaaaaggtgctcaaaaaactggaaattgaggccgaggttgaacactccgatctctcctcggctacgccgggcgcggcggacctgtttgtaatggcgaaagacattgccgcaagcgccagcgtgccggaaagccagctggtggtgatcaacaatatcatcgatattaacgaactcgaagcgcagttgcgcgcctggttcgaaagacaataa

SEQ ID NO: 1787 - DNA, 1404 bp, Enterobacter cloacae
ggcgaggtggatatgtttatccttgaaacgctgaacttcgttgttgatattttaaaagtcccttcagtgctggtcggtttaattgccctgattggtcttgtggcgcagaaaaaagccttttcggatgtggtaaaaggcacaattaaaaccattctcggctttattgtactgggcggcggcgcaaccgtgctggtgggctcattaaatccgctcggcggtatgtttgagcacgcctttaatattcagggcattattcccaacaatgaagctattgtgtcgattgccctggaaaaatatggcgcttccaccgcgctcattatggccttcgggatggtggcgaatattattgttgcgcgctttacccgcctgaaatacatcttcctcaccgggcatcacaccttctacatggcatgcatgattggcgtgatcctgacggttgcaggcttcgagggggtcgggctggtctttaccggctcgttgatcctcggcctgattatggccttcttcccggcgattgcgcagcgctatatgaagcgtattaccggcaacgatgagatcgccttcggtcatttcggcacgctgggctacgtgctgtccggctggattggcagcaaggtcggtaaaggttcgcgctccaccgaagagatgaacctgccgaagaaccttagcttcctgcgtgacagttcaatctccatctccctgaccatgatgattatctacctgatcatggcggtgagcgccggacgtgagtacgtggaggccaccttcagcggcggccaaaactacctggtgtacgccatcattatggccatcaccttcgcggcaggcgtgttcatcatcttgcagggcgtgcgcctgattctggcggaaatcgtcccggcctttactggcttctcggaaaaactggtgcccaatgcgcggcctgcgctggactgcccggtagtctacccgtatgcgccaaacgcggtgctgattggcttcctgtttagtttcctcggcgggattgtgggcttgttcatctgcggtcagtttagctgggtgctgatcctgccgggcgtcgtgccgcatttcttcaccggtgcaacggcgggcgtgtttggtaacgccaccggtggacgccgcggggcaatgattggcgcctttgctaacggcctgctgatcaccttcctcccggtcctgctgctgcctgttctgggcgcaattggctttgcgaatacgaccttctcggacgctgattttggtgcggtcgggattgtgctgggcaacctggcgcgcttcctgtcgccgtttgccatcaccggactggttgttgtgttgttcgcgctgctggtggcctacaacgtcttcgctaaaaacaaacctgccagcggtaacgcgcaggaaaaccccggagccaaatcatga

SEQ ID NO: 1788 - DNA, 1008 bp, Enterobacter cloacae
ctgaggagagcaaagcggcgctcaacgagacgattcgccaactggaggcttcacatgattaaggttgcaccgacaggacagaaagatgccgttgagatgcgtaaggtctacgcgggttttgtggcaaaacagattgaggccgggagcgagattattgcgctcgaagcggatctgatgagttcgatggcgatggacggcgtagcgcgtgattatccacagcacgtcatcaactgcggcattatggaggctaacgtgattgggacggccgccgggctgtcgctcaccggacgtaagccgttcgtccatacctttaccgcctttgccagccgtcgctgcttcgaccagctgtttatgtccctggactaccagcgcaataacgtgaaggtgattgcctcggatgcgggcgtgacggcctgccacaacggcgggacgcatatgtcgttcgaggacatgggcatcgtgcgcggtctggcgcattcagtggtgctggaggtgaccgatgcggtgatgttcgaagatgtgctgcgtcagcttatcgacctggaaggcttctactgggtgaggaccatccgtaaacaagccccgagcgtgtatgccccggggtcaaccttcaccatcggcaagggcaacgtgctgcgcgagggaaccgatattaccttgattgctaacggcattatggtggcggaagcgctggaggcggcgcgccagctggagcaggaaggggtaagcgcagcggtcatcgacatgtttaccctgaagcctatcgatcggatgctggtgaaaaactatgccgagaaaaccgggcgtattgtgacctgcgaaaaccacagcattcacaacgggctggggtcggcggtggcggaagtgctggtggaaacctgtccggtgcccctgcgtcgggtgggggtgaaggaacgatatggtcaggtgggcacgcaggacttcttgcaaaaggagtatggcctgacggcacatgacattgtgtcggcggcgcgggagctgttgtaa

SEQ ID NO: 1789 - DNA, 465 bp, Enterobacter cloacae
ggtacagccatgtcgacacccgaaatcccgtccgtgaacttttttagtctgtttcgtcggggacagcattacgcaaagacatggccgatggaaaagcgcctcgcgcccatgtttattgaaaatcgcactattcgcgccacgcgctatgcgattcgctttatgcccccgattgccgtttttaccctgtgctggcagatagcgttaggtggacagcttggccctgccgtcgcgacggcgctctttgcgttaagcctgccgatgcaggggctatggtggttaggtaaacgttccgtcacgccacttccgccttctattttacactggttttatgaagtgcgtggaaaactggaagaggctggccaggcgctggcaccggttgaaggtaagccggactatcaggcgctggcggataccctcaagcgtgcgtttaaacagcttgataaaacattcctcgatgacttgtga

SEQ ID NO: 1790 - DNA, 678 bp, Enterobacter cloacae
tgcctgacggaggtgcgtgtgcagtgtaaaggttttctgtttgatctggacggtacgctggtggattcgctgccggtggtggagcgctcgtggtgccactgggccgaccggcacggcattgaccatcaggacgtactaaatttcatccatggcaaacaggccattacttcattgcggcacttcctggcgggacgttctgaggaagagattcaggcggagttccgctatcttgagcagattgaagctaccgataccgagggtatcaccgcgctgcccggtgcgcgtgaactgcttgagcacctgaatgaagcgcagatcccgtgggctatcgtcacctccggctcggttcccgtcgcgcatgcacgccataaagcggcaggtttgccgacgccggacgtcttcattaccgctgagcgcgtgaagcgcggcaagcctgaaccggatgcgttcctgctcggcgctgaactgctcggccttgcgccagcagagtgcgtggtggtggaagacgcggcggcaggcgtgctggccgggctgaacgccggcagccacgtcattgccgttaacgtcccggcgggttccccccggctggaggaggcggatttcgtgcttaacaccctgaccgccatcgacgtctcgaaggcgtcagacggagttgtaaccgtctcgctaaaaatgtaa

SEQ ID NO: 1791 - DNA, 1845 bp, Enterobacter cloacae
caaggacatgttgtgaacggtgaactgatttgggtcctgagcctgctgttaatcgccatcattctttttgccacgggcaaggtgcgcatggatgccgtcgccctgtttgtgattgtcgcattcgttctaagcggtaccctttccctgccggaagccttttccgggtttagcgatcccaacgttattttgattgccgctctgtttattattggcgacgggctggtccgcaccggcgtggcgacaatgatggggtcgtggctggtgaaagtggcgggcagcagcgaaaccaaaatgctgatttacctgatgctgacggtcgccgggctgggcgcgtttatgagctctacgggcgtcgtggccatctttattccggtcgtgctgagcgtctgcatgaggatgcagatctccccttcgcggctgatgatgccgttgagcttcgccgggctcatcagcggcatgatgacgctggtcgcgacgccgccgaacctcgtcgtgaacagcgaactgatccgtgaggggcttgagggctttagctttttcagcgttacgccgatcgggctggtggtactggtgatgggcattatctatatgctattgacccgttttgcgctgaaaggggagaagcaggataaagccaaagagggctggaagcggcgctctttccgcgatctgattaaagagtatcgtctgaccgggcgtgcccgacgtctggctatccgcccggggtcgcctatggtggggcagcggctggatgaccttaagctacgcgaacgctatggcgcgaacgtcatcggggttgagcgctggcgtcgttttcgtcgggtgatcgttaacgtgaacggggtgtcagagtttcgcgcgcgtgacgtcctgctgattgatatgtccaccgcagacgtggatctgcgggagttttgtagtgagcagctgctggagccgatggtcctgcgcggcgagtatttctctgaccaggcgctggatgtgggaatggccgaggtgtcactgatcccggaatcggagttattgggcaaaaccgtgcgtgaaatcggctttcgtacccgctatggcctcaacgtggtaggcctgaagcgcgatggcgtagcccttgaaggggcggtggtggatgagccgatcctgctgggggatatcttcctcgtggtcggcaactggaaactgattagccagctcgggcagaaaggccgcgattttgtggtgctgaatatgccgattgaagagagcgatgcatcaccggcgcacagccaggcgccccatgcgattttttgcctggtattgatggttgccctgatgctgacggacgagatccctaacccggtggcggcgataatcgcctgtctgttaatgggcaaattccgctgtatcgacgccgaaagcgcttacaaagcgattcactggccgagcattattctcatcgtcgggatgatgcccttcgccctggcgctacagaaaaccggcggggtggatttgatcgtaaaaggcttaatggacgcgggcgggggatatggtccgtacctgatgatggtttgcctgttcgtcatgtgcgccaccattggtttgttcatctccaataccgcaacggcggtgctgatggcgcccattgcactggcgatggcaaaatcgatgggtgtttcgccgtatccgtttgcgatgatggttgcgatggcggcgtccgcggcatttatgacgccggtctcatccccggtcaatacgctggtgctggggcccgggaattataggttcagtgatttcgtgaagctgggtgtgccgttcaccgtgctggtgatggtggtgtgcgtggtgttaattccggtgttattcccgttttag

SEQ ID NO: 1792 - DNA, 894 bp, Enterobacter cloacae
aaagatatgataaatgcaaatcgtccgataatgaatctcgacctcgatctgctgagaacgtttgttgcggtcgccgatctcaacacttttgcagcagctgctgccgccgtttgccgtacccagtccgccgtgagtcagcaaatgcagcggctggaacaactggttggtaaagagctttttgcgcgtcatgggcgtaataagcttttaacagaacatggtattcagcttttgggttatgccagaaagatactgcgctttaatgatgaagcctgtatgtcattaatgtttagcaaccttcagggagtgttaacattaggggcgtcagatgaatcagcagataccattttacccttccttctcaaccgaattagctcggtttatccgaagcttgccctggacgttagcgttaaacgcaatgcgttcatggttgagatgctgacagaaaacgaggttgacctggtggtcaccacgcatcgacctggccagtttgacagcctgacgctgcgtacttctccaacgcactggtactgtgccgcggagtatgtattgcagaaaggtgagccgatacccctggtcctgctggatgatcccagtccgttccgcgatatggtgctggcagcgctcaacgaagccagtattccatggcgcctggcgtacgtggcgtcaaccttgcccgcagtgcgagcggcggtgaaggctgggcttggcgtaacggcccgtccggtggaaatgatgagccccgatctgcgtgtgctgggtcaatccgagggactcccgtcgttgccggatacggagtacctgctgtgccataacgccgccagcaacaacgagctggcaaaagtggtattcgaggcaatggaaaactaccacaatccatggcagtacgcggctgtt

SEQ ID NO: 1793 - DNA, 555 bp, Enterobacter cloacae
ctgatgaaactgatgtttgcgtcggatattcatggatcgctgcccgcgaccgaacgcgtgctttctctgttcgcccaaagcggggcgcagtggctggtgatcctgggcgatgtgttaaaccacggcccacgcaatgcgttgccggaaggttatgctcccgcgcaggtggcggaaaaacttaatcattttgcctcgcgcattatcgccgttcgcggcaactgtgacagtgaagttgaccagatgctgctgcattttcccattaccgctccctggcaacaggtgttgatggaaaacagccgtttgttcctgacccacgggcacctgttcggcccggataacctgccgtcactcgccgctggcgatgtcctggtttatggtcatactcatattccggtggcggaaaagcgcggggcgttttatcactttaaccccgggtctgtcagcattcctaaaggcggcaacccggcaagctacggcatgtatgaagacgggacattaagcgttatcgcacttaatgatcagcaagttattgcgcagatagcgattaatccgtaa

SEQ ID NO: 1794 - DNA, 447 bp, Enterobacter cloacae
aaaatgctcaaaaagtggatatatgatacaaccatcatcctacaggatagcgttgaaagctggccccaggcgctggaactgtgcgcgaaaccgctgctggatttgcaggtcattgcgccggaatatgtcacggctatcatcgagaagcatcacacgttaggtccctactatgtgctggctccagggctggcaatgccccatgcgcgaccggaagaaggggcgaaaggacttggcctgtcattattaaaactgaaacagggtgtctcttttggtgccggtgagtttgaccccgtcgatgtgattgtgatgctggcggcgccggacaagcatagccatatcgaaatgatctcagccttagcggaattattttccagcgacgaagatatggctgaattacatcgggcgaatacgctggaggagataaaaaccatcatcgatcgcttctga

SEQ ID NO: 1795 - DNA, 858 bp, Enterobacter cloacae
cgcgcaggaaaaccccggagccaaatcatgaatgagaatgaaataaccgaactggcgcgtcagattcgccttgagacgctgaaatcccttacgcagctgggttttgggcactacggcggcagcatgtcagtcgttgaaacgctggcggtgctgtacggcgcggtgatgaaaattgacccggccgatccggactggccagagcgcgattactttgtgctgtcgaaaggccatgcgggcccggcgctgtacagtacgctggcgattaagggctacttcccgattgacgagctgagcacgctgaaccagaacgggacgcgtctgccaagtcacccggatcgcctgaaaacacgcggcgtggatgccaccaccggatcactggggcaggggatctccattgctggcggcatggcgctgtcgcacaagctggcaggaaggccaaaccgggtgttctgcatcgtcggtgacggggagctgaacgaaggacagtgctgggaagccttccagtttattgctcaccatcgactgaacaacctgacggtattcgtggactggaacaaacagcagctcgacggcgagctggacgaaatcatcagcgccttcgacctggaaggcaaattccgcgcctttggttttgacgtggtaacggtgaaaggggatgacattccggcgctgctggaggtgaccgcgccgatccctgcggccgatgcgcgtccgcgggtggtgatcctcgacagcatcaaagggcagggggtgccatacctggaacagctcagcaactcgcatcacctgcgattaactgaggagagcaaagcggcgctcaacgagacgattcgccaactggaggcttcacatgattaa

SEQ ID NO: 1796 - DNA, 549 bp, Enterobacter cloacae
caatcagttaccgtgtcttttttttacagtgcaatgcgctacaggagtcgaaagatggaaatgacccatgctcaacgtctgattttgtctaaccagtacaagatgatgactatgcttgatcccgataacgctgcgcgctacagccgcctgcaaaccattgttgaacgtggttttggcttgcagatgcgcgaactggatcgcgaatttggcgaactgaaagaggaaacctgccgtatcgttatcgacatcatggagatgtaccatgcgctgcatgtgtcctggaccaatctgaaggaccagcagaccattgacgagcgccgcgtgacgttcctgggctttgatgctgcgacggaagcgcgctatctgagctatgtacgctttatggtgaataccgaagggcgctacacccattttgatgcgggtacgcacggcttcaacgcccagaccccgatgtgggataagtatcaacgtatgctgagcgcgtggcacgcctgtccgcgccagtaccatttaagcagcaacgaaattcaacaaatcattaatgcctga

SEQ ID NO: 1797 - DNA, 216 bp, Enterobacter cloacae
ccagttaaagggataaccggcgcggtactgcgtctgattgttttgtttacggactccgtagatctggacgctgctttcctgtccgccgaccagggctgttccggtgcatacgggttgctgcttctcaataacgccagcgcaaccggagagcaataccgctaccgccaggcaaagaatcatatttttcataggggttatatcccagggcattcatga

SEQ ID NO: 1798 - DNA, 1383 bp, Enterobacter cloacae
atcgtcttaaaacaagtgcccggtaacgcgcttaccgggccaacaaaatgtccggcacttacggacgctgcaagttggcaaatgcagtacgggggatatatgacctggtttattgaccggcgtcttaacggcaaaaacaagagcacggtgaatcgccagcgcttcttgcgccgttataaagcgcaaattaaacagtcgatctccgaggccatcaacaaacgctcggtgaccgacgtcgacagcggcgaatccgtctccatccccaacgatgacatcagcgaaccgatgtttcatcaggggcgtggcggccttcgccatcgtgtacacccaggtaatgaccacttcgtccagaatgacagaatcgagcgaccccagggcggaggcggcggttctggcagcggtcaggggcaagccagccaggacggagaaggccaggatgagtttgtcttccagatttcaaaagacgaatatctcgatctgctgtttgaggatctggccctgccgaatctgagaaagaatcagcaccgtcagctcaacgaatacaaaacccatcgtgcgggctataccgcaaatggggtgcccgccaacatcagcgtggtgcgttcactgcaaaactcgctggcgcgacgcacggcgatgacggcaggcaaacggcgcgaactgcgcgagctggaaaccagcctgaaagtagtggaaaacacggaaccggcgcaactgctggaagaggagcgcctgcgaaaagagattgccgaactgcgggcgaagatcgaccgggtgccgtttatcgacacgttcgacctgcgctacaagaactacgaaaaacgccctgagccttccagccaggcggtgatgttctgcctgatggacgtgtcaggttcaatggatcaggccaccaaggatatggctaagcgtttttatattctgctctatctgttcctgagcagaacgtataagaacgtggaggtggtctacatccgccatcacactcaggcgaaagaggtggatgaacatgagttcttctactcgcaggagaccggtggcaccatcgtgtcgagcgccctgaagctgatggatgaggtagtgaaggagcgctacgatccggcgcagtggaacatctacgccgcgcaggcatcggatggcgataactgggcggatgactcgccgctgtgtcatgaaattctggcgaagaagatcctgccggtggtgcgttactacagctacattgaaattacccgtcgcgcccaccagacgctatggcgtgagtatgagcatctgcaagcgatgtttgataactttgcgatgcagcacattcgtgaccaggatgacatctatccggtcttccgggaactgttccagaagcagagttcgacaacctccaattaa

SEQ ID NO: 1799 - DNA, 264 bp, Enterobacter cloacae
gtgaagacggtgcgcgccagagcgcataacaacggccgcaatccgaactggaccagctacgaaaaactgcgcaccgttatagagaagaaaatgttctctaacacggaagagctgttgccggttatctcgttcaacgccaaaacctcaaccgacgagcagaaaaagcacgacgattttgtcgaccgtatgatggaaaaaggctatacgcgcaaacaggtccgcctgctttgtgaatggtatctgcgcgtgcgtaaatcgtcttaa

SEQ ID NO: 1800 - DNA, 3363 bp, Enterobacter cloacae
cgatcagtgtgcggcagtaatgagagcgttaatgtaatggctgacgttgcttccctcgccgtcgggctgcatctcaacgcagccaattttaaatctcagctgatgggtgcatacggtgatgctgagaactcatcaaagcgtttcaaccgtaacgcacaggaagatgctaaaaggacagatgaagcctattcccggatggggaaaaccatcgcgggtgttgctggtcgcctggcgggatttgccggtgccggtttatcacttggcgccatcattactaccacgcgtgaatacggacaggctttatccgacctttcggctatcaccggcgctacaggcgcccagttaaaatcgcttgatgaagccgcccaggagatggggcgtagcactgaatacagtgcgagccaggcggtggaagccctgaagttgatggcgtccgctaaacctgaacttcttcagaccgcagacggacttactgaggcgacaaagagcgcactaacgcttgctcaggccgcaggctcaactttgccagatgcaacccgcactctggctctttcccttaaccagttcggggccggggctcaggaagcggatcgttatattaacgtgctggctgccggtgccaagttcggggcatcggaaatcgcagatacagctgcggctattaaaaatggtggggtggccgctgcacaggcaggagttggatttgaaacgcttaacgcagcgattcaggttctggctgagcgtgaaatcaaaggcggtgaagcaggaaccgcgctgagaaacgttattcttgcccttgagaaaggtacagacaaaacgctcaaaccatcggttgtggggctcagtggtgctctggataatctctcaaagaaaaacctttctacggctcaggctgtaaaactgttcggtgttgagaatatcaacgcggcatcagtgctggtggacaaccgcagcaaacttaacgcattaacccttgccctaactggaacacagactgcgcatgagcaggccgctattcgtgttaataacctgaatggcgacatcatggggctgaccagtgcttttgaaggcatgatcattaaaattggtcaaagtagtaccggaccgcttcgttcaggcattcagtcagtaactgacggtatcaacctgcttaccgataatttcaacgcggttgcaagtgtggccttatacacactgatcccggttctttcgaccaaactgacagctggtcttcgcgaaaacataagcgcatggcagcagaatcaggcagccgttaaagcagcagcagcggctcaggctgatggtgcacgtaaaacgctggaagctacttctgccacgctaaagcgaaatgatgcggaatttggttattaccgtcagctggaaaaaacggccaggcagcatggtttgaacgtaaattaccagggagagtttaaccgacttatccgtgaagaaaccgagcaaactaatctggccactcgtgcaaaaatgcagttggcagcagctaatcgtcaggtatctctgaccgctcgtgctgcctcggtagctgtggggctcgctcgcggggccctggcgcttgtcggtggaccttttggggctgcgatgctggcaggctccgcacttctgtattttcatcagcaggcgaaggatgcccgacagtcagcaattaacctcaaggatgctgtcattgaaaccactgctgcgctgatgcagatgtctgataaacagctcgccgttaagcagattgacctgcaagaccagtatgaaaatcaggtaactcagcgtaaccagctcatcaaggaaattcaggacgcagacagcagactagatagcctcggtggatttgacccattccgacagaaaaaaggggtagaggacagtaagaaacgggcagaagctgaccttgaagccgttaataaagggttagagacaacacagtctaaccttgagaatgtcagcaaggcgcgatttttggtccagacagggatcgccgatcaagcaaaatcgctcgcgaatgacatcaaaaatatcacagctcagacagctaaagccggagagggtgttaccacaccatggaccggtgaagatactcaaaaggctaggaaggaaacggtcaatcagtatcttcagttgcgcagggagatcgaagaagctcatgcaaccagtcttggaaaaattgatcttcaggagaaagccagtcaggaaaagctgatcgctgcggcgcgtaaaaatggagcaagccagcaggatctacagcgtgcgctgttaatgaatgctgaaaattatcagaagcaacgtaacgaacttgctgagcagtattccccggcacgatcggccatcaataaagagaaggaagcgagccaggagctcaagtctctccttgatgcacgtttgcttactgaaaaagagtacatggctgcgcgtgtcacactgtcacaggagacatcccgacaaatcctacaggcccaggctaatgctctatcagcaccacggcttgagcttgccggggacgttgatccgcttgcccagcaaaggaaccaacttgcacagcagcaaagtctggtagagacctattatcgcaatggtgcgctgagtaagcagcaatacgaaatgctgatgcagaagagcagtaaagattctgctgatgcacagtatcagaccgcgctggaattatatcgctcacagagtgaattcaataatctggcgatcggactggttgaggctacccgggagcgaaccactaatgtcctgacggggctgctgactaaaacgcagacctttaaagagggcgtgatcaacctcttctccacgcttactcagtcgataattcaaaacctcgtcgatatggcagcacaggcgctcgtaacaaatacaatcctgagttcaattatgggggttggttcgagtgtacttggcggtgttgggggaagtacggcaggcagctcagggacagcgattgccgattatgggagcaatttccagttcaatgccaaaggcggcgtttattcctcctcagacttaagtgcctatagcggccaggtagtcgataatcctacttttttcgcattcgcgaaaggtgccggagtaatgggtgaggcaggaccagaagcgatcatgccattgactcgggcagctgatggttcacttggggttcgcgcagtgtcaggcggtgcctctgaaggtgctgctcctcaggtattcatcactatcaatggcgatggcagtactgcatcacaatcatctggcggtctggaaaaattcggtaaaagcgtaggcaattttgtcagagatgaataccgaaagctgatacaggctgatcttcgtcccggaggggcaatctggaacagtacaaacgggaggcggtaa

SEQ ID NO: 1801 - DNA, 4020 bp, Enterobacter cloacae
ccgtgcatcgtatgcgtttggcggggtgacaaataccgccgcacagggttacccggttccgctcctttacggccgccggcgaatcggcggggcaattatttccgccgggatttatgtcgaagatcagcagtagataacaaacctttttacaagccaccttcgggtggctttttttatgggcgcgatatggcgaataaaattaccggacgaaaaggggggagctccagttcccgaactcctaccgaacagcctgatgatctgcaatctgtagcgaaggcaaagattctcgttgcgcttggggaaggggagtttgctggacagctcaccgggaaggatatctacctggacggaacggcgctggagaacgccgacggctcccaaaacttcagcggcgttacgtgggaatttcgctcgggtactcaggcccagaagtacattcagggcattcccggtaccgaaaacgaaatcagcgtgggaaccgaggtaacgagcgctacagcgtggacacgaaccttcaccaatacacagctttcggcggttcgtttacgcctgaaatggccttcgcttttcaagcaggaggacgatggcgatctggttggttactcggttaattatgcgattgacttgcagacggacggcgggacatggcagacagtcctcaataccagcgtgaccgggaaaacgacctcaggttatgagcgtagccaccgtattgatttacctcaggcgggcagcacctggacaatcagactacgcaaaattaccgctgacgccaacagcgcgaaaatcggcgacacgatgacgctacagagcttcactgaggtgattgatgcgaaattgcgatatccgaacaccgcgctgctctacattgaattcgactccagccagtttaatggttctatacctcagatctcctgtgagcctcgtggccgcgttattcgggttcctgatacttacgacccagaaacccgctcttacagcgggacatggaccggggcgtttaagtgggcatggacggataaccctgcgtggatattttacgatctggttgtttctgaccggttcggcctcggtcaccgtttgactgctgctaacatcgataaatggacgctttatcaggtcgcccagtattgcgatcagatggtgccggacggtaagggtggcgatggaacagaaccacgctatacctgcaacgtgtacatccaggaccgaaacgacgcttatacagtcctgcgtgattttgcggccatattccgtggcatgacgtactggggtggcgatcagatcgttgctctggccgatatgccccgtgatgtggattacagctacacgcgcgctaacgttgttggcggtcgcttcacctattcaagcagcacaacgaaaacccgctacactacagcgctggtttcatggtccgatcccggtaacgcctatgctgacgcgatggaacccgtattcgagcaggcgctggtggcgcggtacggcttcaatcagctggaaatgacagccatcggctgtaccagacagtcagaagcgaaccgaaaggggcgctggggtattctcaccaacaacaaggatcgagttgtttcgttcgatgtcgggctggacggaaacataccgcagcctggctatatcatcgctgtggcagacgagctgctttccggaaaggttatgggcggccgcatcagcgccgttaacggtcgcgttatcaaacttgaccgtgtagctgatgcagcagcaggtgatcgccttatcctcaaccttccctccggagcgtcacagagcaggaccattcaggcggttaacggggaatcggtcacagtaaccaccgcgtacagtgagacgcctcaggccgaagctgtctgggtggttgagtcaaacgaactctacgcgcagcagtatcgtgttgtgagcgtcgctgataacgatgatggcactttcaccattaccggtgcatggcacgatccggataaatatgcccgaatcgataccggagccatcattgaccagcggccggtgagcgtgatcccgccgggcaaccagacgccgcctgcgaacatcgtgatcagctcgttttctgtggtgcagcaaaatatcagcgtcgaaacgatgcgcgtgagctgggaccaggcgcagaacgctgtcgcctatgaagcgcaatggcgccgcaacgacgggaattgggttaacgtgccgcgcagctccacaacgtcatacgacgtacccgggatttatgccgggcgctacctggtgcgcgtacgcgcaatcaatgccgcagaaatctcgtccggatggggctattcagaagagaaaacgctgacggggaaagtgggcaatccgccgaaaccggtcggcttcatcgcttctgataatgtggttttcggtatcgagctgagctggggattcccggcgaacaccgacgacacgctgaagacggaaattcagtacagcctgaccgggagggaagacgatgcgatgctgctggcagacgtaccctatccgcagcgcaagtatcagcagatgggccttaaggcagggcagactttctggtaccgggcgcagctggtagatcgaagcggaaacgaatcagggtatacagactttgtgcgcgggcaggccagcatcgatgtatccgatatcaccgatgcaatcctggaggacatgaaaggctccgatacgttcaaagacttgatcgagaacgcggtggacagcagcggaaaactggcagaactggctgatgcaatcaaagagaacgcagacggccttgctgctgcggttggctcgaacaagcagaccgctgaagcaatcatcggaaacgcgctggctattgccgatgttgtcgtgcgccagacagcccaacagggcgctaactctgcgacattcgaacagctccgggaggtgatcgctactgaaacggaggcgcgcgtaacggatgttacccgtcttgaggcaaaaactgcgcagaacgaggcgggagttaccgaggtaaggcaggctctgtcagatgaagctcaggcaagggctactgctgttgatcagctcactgcgagcactcaggtcatttctgataaagctgattcagcttcgagtaaagctgacgctgcatcaggtaaggcagatgcggccgaacaagccagctcgcaaaatactgctgatatcaccacgttgcgacaggttgtcaccgacacgacttcatcaatggcatcccgcctggaggagctgggagcaagaaccgatactgccagcggcggcatccagaataacgctatcgcgctaataacgagtacgctggcgcaggttgatcagcgggtgagactcagcgcgcagtacggtgacagcaaggccagcatcgatcgtattgataacgtcatggcaagcgacagggaggcaacagcacgttcgctgctaagtttgcagactgacgtgaacggcaacaaggcatccatcaacagcctgaaccagacgttctccgattatcagcaggccacggccacgcagataaacggaatcacggcgaccatcaacgggcatacgtcagccattaccactaacgctcaggccattgcgaacgtcaacggggatctgaaggcgatgtacagcatcaaggtcgggttagccagcaatggtcagtattacgcggcagggatggggatcggcgttgagaatacgccgtccggcatgcagtcgcaggttatcttcgtggctgaccgcttcgccgtaacgcaccaggccggagcgaccgttacgcttccgttcgttattcagaacgggcaggtgttcatcagagacgcgctgataggtgatggcaccatcaacaacaacaagatcggcaaatacatccagtccaataactttgtcgctggctcagtcgggtggaggctggataagggcggtacgtttgagaactacggttcgacagctggtgagggggccatgaagcagactaatcaaacgatcagtgtcaaggatgccaacaatgtgttgagggtgcagatagggagaattacgggaacatggtaa

SEQ ID NO: 1802 - DNA, 762 bp, Enterobacter cloacae
accatgagcttaaacgcagattatcagaagctggaatcagggaacgacgttcgcctgattgaggtggacggttcttcttttggattgacggaagttctccgctttcacaattacaacattccccacaccgaagaggaaatagtcgccgccggcggggatgaggccaagctcccggcgaaaccaatctggtggcagggtaatgaatattccgcctggccgtatcagctggaagggctggagaaatcgaccagtggcagcaatgcgacgccatcactgacggtcgcgaacatcgaaagctctatttctgccctgtgtcttgcgtatgacgatttgctacaggctaaggtcaccattcacgacacaaaggcaaaatatctcgatgcgaaaaacttcgcaggcggtaaccctacagcagatccgactcaggagaaacttcaggtctggtatatcgacgggaaaacgaccgagcttgctggcgaaaccattgagtttgtactgtccagtcccatggatcttcagggacaaatgatccccacgcggcagcttcattccctgtgcacatggtgcattcgtaataagtaccgcaccggcgacggttgcgactatgccggtacgcgctatttcgacaaaaacaacaacccggtaagcgatccgtcactggatgaatgcaacggcacgctgacggcctgcaaacttcgattcggtgaaagcaacgaactctcgtttggtgggttccccggtacgtcgctgatcaggagctga

SEQ ID NO: 1803 - DNA, 609 bp, Enterobacter cloacae
aaagtcgagggtacgatgcaagaggtaatgacgcgaattgaactaggtggggagccgggtaagatctttggaaagatacaccatcgccttatcaataaagtatcagaagctggaacggccctcgctaaaactattcccggatttgaaagctatatgattagcagcaaaagtcgcgggctaacatttgccatcttcaaaggtaaaaagaatattggagtagacgaccttggttttccagttacaggagaggtcatcagaattgttccagtaataattggaagtaaaaaggatggtttgctacagactattcttggtgcagtaattattgcggcatctgcaattggcagttattttgcaccgggaaacccgatttctgcgtttggatacaaatttggtgcagccatgatgttgggtggagttgttcagatgctttcgcctcagcctacagggttagccagcaaacaaagcgcagataaccgtgcatcgtatgcgtttggcggggtgacaaataccgccgcacagggttacccggttccgctcctttacggccgccggcgaatcggcggggcaattatttccgccgggatttatgtcgaagatcagcagtag

SEQ ID NO: 1804 - DNA, 672 bp, Enterobacter cloacae
atggcggagtatggcgttttactgacgaccacgagcggggaagtatgggtgaccgcgaacagctcgccaatcgctcttcaggcgcgaaagacagcggcacttcagggaacatcggggttcaataccaaagtgacgcacacattccccgcaggtcagcccgttgtcgcgttcgttcattgcacggttgaggtcgaaatcactcagacgataagcgggaacaccatcacgattgattttctcagaccgaatgcaaccggcacagcgtacgtttattttttctctattttcccgcagacaaagccagactacggactggctgtgtgggatgcatcagggacgctgattttaacaaacgaaacgcgcacgctgagcgatgttgtcaccctcggtaccgccggggtggatgccagctcaggatacaacatcaatacaactctggtggggaagtgggcctgtatgcctgccatgctggggctaattaccggggttatatcggctggcggtcagccgcagccatactcggccatatacaagagcatggcaaaacttgagggaagcaatacgcggatattcgccaggccgcagacaacccccggcggcaaccttcagaacgttacgtattcgaatctgaggaacgtgattatggccattaactgcgccaattatgattga

SEQ ID NO: 1805 - DNA, 360 bp, Enterobacter cloacae
ccggtactggattctgagaaacatggggagtgtcctctgatgggatttgcatcacctgcgaccgattacgtcgaacgccaactttctccatccgttctgtgcaacataggggccgaaagcagggtgcttgaaacagatgttgggtttgcagtcattgagccagccacgaaaaaaaggccaggagatgtattgttaattttgtgcgacggccacacgcagtttgcaaaactgatgggtaagtcattgatcacggatgatggcgaggcaatagagggaaccgctctggaagaggtggaagtgttgggcagagtgacgttcttcatcaatcgtgcattagatgatgattgccctgcaatatag

SEQ ID NO: 1806 - DNA, 1122 bp, Enterobacter cloacae
aaagaggggcagaagtcaggcaggctgtcagaagaaacaaaagctgccgttgataaaatggcttctgagttcaacgcgctgcgtgaagctgaaaaaaccctgaaggccgcaatgggcgaactggagcaacatgttgcccagatgccgctggcaaacgcaaaacaggttatcgagtccgttggccaccaggtgatctccgctgaagccctgaaaacctttgcttccagcgtggaaggcggtaagcgcatcagcatcccggtcaaggccgccctgacttcggtggatgtgcctgatggtgtcgtggagccacagcgcctgccgggtattgatacggcaccgaagcagcgcctgttcatccgcgatctgattgctccaggccgtacgtcctcctcagctattttctgggtgcagcagacaggctttaccaataacgcgaaagtggttcctgaaaatacgcagaaaccatacagcgaaattgagttcacgccgaaaatcactggcgtcagcaccatcgcccacctgttcaaagcctcaaagcagatcctggatgacttcgcacagttgcagtccaccgttgatgccgaaatgcgctacggactgaagtatgcagaagagcaggaaattctcttcggtgatggtaccggcgttcatttgcacggcatcgttcctcaggcgtcagctttcaatccggcgttcactgtcgaacagcagagcgggattgacgatctgcgtctggcaatgttgcaggcacagctggcacgcttcccggcgtctggtcatgttcttcacttcattgactgggcgcggatcgagctgaccaaagacagcctgggtcgttacattctggcgaaccctgcggcgctgactggtccgactctgtggggcctgccggttgttgcaacggaagcggcagccttccagggtaaattcctgaccggtgcatttaacgctggcgcgcaaatcttcgatcgcgaagatgcgaacgtggttatctccacggagaacgccgacgacttcgagaagaacatgatcaccatccgttgcgaagaacgtcttgcgctggctgtgaaacgccctgaggcgttcgtgtacggttcattcagcaccggcgcgggtagctga

SEQ ID NO: 1807 - DNA, 387 bp, Enterobacter cloacae
tcttcgtcccggaggggcaatctggaacagtacaaacgggaggcggtaatggcgctggaaacttttaactggagccctagggtgaatccttctcaggacgtcaccatgcgtacgcgtgaggcgcagttcggagatggttacacccagacatccggtgacggacttaaccctcgctcacaaagctgggatctgacctttgtaggcctggaaccctatatcaagtcgatcaaagactttcttgatcgtcatgagggaacaaaagcatttgcatggaagccgccgctagaggacttgggtctctatcgatgcaaacagtacaagccctccccaatggggggaggcaactggtctttgactgcaacattcatccaggcatttaaaccatga

SEQ ID NO: 1808 - DNA, 723 bp, Enterobacter cloacae
tcaggagctgatatgcgtcagaaaacaattgatgcgattatggcgcatgccgccgctgaatatcctcgtgagtgctgtggtgtggtggcgcagaaaagccgcgttgaacgttattttccttgccggaatcttgccgcgacgccggaggacaattttgtcctttgcccggaagattacgcagctgctgaggactggggtacggtgatcgccatcgttcacagtcaccctgacgccactacgcaaccgagcgaactggataaagcgcaatgcgacgcaacgcttttaccctggcatatcgtgagctggccggagggggatttacgcaccatccagccgcgcggagagctgccgttgctggagcgtccttttgtgcttggtcacttcgactgctgggggctggtaatgagttatttccggcaaacgcatggtatcgaactccacgattaccgggttgattatccctggtgggaaaaagactatccggacaacttctatcaggattgctggtacgagtgcggattccgtgaattcgacgggccgccgaaacctggcgatatggtgatcatgcaggtccaggctgataagtggaaccacgcgggaattctgctggagggcaatatgctgctgcaccacctgtacggtcatctgagtcagcgcgtgccgtatggtggatactggcaggaacgaacgatgaagattctacggtacaaatctctgtgctaa

SEQ ID NO: 1809 - DNA, 1398 bp, Enterobacter cloacae
cctgctgtcagcctgcgcatgggcggcgctgtatgtcggcatcgtcaccggcatcagcatctgaacgtattcatcagtttgagaaatgcttcccgaaaaaacggtcaccagtctgtcacactcagcgtaacgataaaaacgcatgaggaaaaagggatgagaaaagcactactcgctgtcgccgtggcaggaacgctttcagtgacgtttggggcgcaggcacaggacacgccggatggctatcagctggaacaggtgctcatcatgagccgccacaacctgcgcgcgccgcttgccaataacggcagcgtgctggagcagtccacgccgaagcagtggccggagtgggacgtcccgggtggacagctcaccaccaaaggtggcgtactggaagtgtatatgggtcactatatgcgcgagtggctggcagagcaggggatggtgaagacgggtgaatgcccgccagcggataccgtctatgcctacgccaacagcctccagcgcaccgtggcgaccgcgcagttctttatcaccggcgcgttccccgggtgcgatgttcctgtgcatcaccaggaaaaaatgggcaccatggaccccaccttcaatccggtcattaccgataactcccctgagtttcgcgagaaagcgctgaaagcgatggagacggaacggcagaaaatgcagctggatgaaagctacaaactgctggaacagctgacaaactacagcgactcgccgtcctgcaaggagaaaaaagtctgctccctgacggaggcgaaagatacgttcagcgccgattatgaaaaagagccgggcgtctccgggccgctgaaggtgggtaactcgctggtagatgctttcacgctacagtattacgaaggcttcccgacagaccaggttgcctggggggaaatcaaaaccgatcagcagtggcgcgtgctgtcgaagctgaaaaacggctatcaggactcgctgtttacgtcgacggaggtggcgcagaacgtggctaaaccgctggtgaagtacattgataaagcgctggtgaccgaccaggcaaaagcgccaaaaatcaccctgctggtagggcacgactctaacatcgcctcgctgctgaccgcgctggacttcaggccttatcagctgcacgaccagcaggaaagaaccccgattggcggtaaaattgtcttccagcgctggcatgataaaaacactaaccaggagctgatgaaaattgagtatgtttaccagagttcagatcagctgcgtaacgccagcgtactgtcgctgcaatcccctgcgcagcgcgtgacgctggagctgaagggctgtccggtggatggcaacggcttctgtcctgtcgataaattcaatgcggtgatggataacgcggcgaaatag

SEQ ID NO: 1810 - DNA, 195 bp, Enterobacter cloacae
tgtttcacactctggaggttagagatggcaaaccatcgtggtggttcaggtaatttcgctgaagaccgtgaaagagcatcagaagcaggtcgtaaaggtggccagtctagcgggggcaactttaaaaacgaccctcagcgcgcatcagaggctggtaaaaaagggggtaaaaatagccacggcagcaacaagtag

SEQ ID NO: 1811 - DNA, 666 bp, Enterobacter cloacae
gcgcaggacagaaaatggagagcgaaaatgacacaaggcgcagtgaaaacaccaggtaaacgttcgcaggcggtgagcgccaagaaacaggcgatcctcagcgctgcgctggagacattttcgcagtttggtattcacggtacgcgccttgagcaggtagcggagcaggccggggtgtccaagaccaatctgctctactactacccgtcgaaagaggcgctgtatgtggcggtgatgcagcagatcctcgatatctggctcgcaccacttaaagcatttcgcgaagagctggccccgctggtggcgatagaggaatacatacgcctgaagctggaggtatcgcgtgattacccgcaggcatcaaggctgttctgcctggagatgttgcagggcgcgccgctgttgcaggcggagctgacgggagatctaaagcagctggtggacgataaatcggccattattgccggatgggtcgccagcggaaaactggcgcccgtcgatccgcatcaactgatcttcatgatttgggcctcaacccagcactacgctgacttcgcggcccaggtcgaggcggtgaccggtaaaacgctccaggacgaggcgtttttccagagcaccctggaaaacgtacagcggatgattatcgaagggatccgtgtgcgctaa

SEQ ID NO: 1812 - DNA, 651 bp, Enterobacter cloacae
atgtggttttcaatgttggctttggcttccgcgtcgatcaccggcccgatgtcggtagtgagacggcccgggttgcccatgcggcattccgccatcgcaccgcgcagcatcttcagcgtgtggtcagccacgtcatcctgtaagcacagtacgcgcagggcggaacagcgttggcccgcgctgtcgaaggcagaggccagcacgtcaacgacgacctgctcggtgagtgcggaggagtccacgatcatggcgttcatgccgccggtttcagcgatcagcggggtaggacggccctgcgcatccagacgggtggcgatgttgcgttgtagcagggaggccacttcggtagaaccggtaaacatcacgccgcgtacgcggttatcggaggtcagtttggccccgaccgtttcaccgcgccctggcagcagctgcaccacgcccgccggtacgcccgcttccagcagaatgttaatgccctgggcggcaatcagcggggtctgctctgccggttttgccagcacgctgttgcctgcggcaagggccgcggcaatctggccggtgaagatcgccagcgggaagttccacgggctgatacacaccaccgggccgagcggacggtgggtttcgttgtcgaaatcatcgcgcacctga

SEQ ID NO: 1813 - DNA, 534 bp, Enterobacter cloacae
atggagaattcatttgttaccggagagagtaaaatggcatggctggacacgctgctggatcattttgcgcattatccgacgcatctgttcgcgctgctcgttgttatggcgttgagtaaatcgacggtgctggtctcctcggtgctgccgcccgcatcggtcatgctgatggcggggatcgccgtcagccagtcgagtctgcatcccggaatgacgtggctggcggtggtgatgggcgctacggcaggttcggtgctgaattaccatatcggccagctgatggggcatacccggctggtgtcacgcctcaccgcaaaacatgccgataagattctgcgggtacagcatcagctgcaaaagaacggcgtagtcgcgctgttcacgtcgcgtttcctggcggtgctgcgttatatcgtgccgctggcggccggcatgctcaggatgagcgcgatgaaggtttacgtcgttagcctgctgtcagcctgcgcatgggcggcgctgtatgtcggcatcgtcaccggcatcagcatctga

SEQ ID NO: 1814 - DNA, 1509 bp, Enterobacter cloacae
atggctattagcacaccgatgctggtgacatttctcgtttatatttttggcatgatcctgatagggtttttggcatggcgttccactaaaaactttgacgactacatcctcggcgggcgcagcttaggcccgatggtcaccgcactctctgcgggcgcttccgacatgagcggctggctgctgatggggctgccgggcgcgattttcatctccggtatctccgaaagctggatcgccatcggcctgaccgttggcgcatggatcaactggaagctggtagcaggccgtctgcgcgtgcataccgaagccaacaacaacgccctgacgctgccggactacttcaccggacgctttgaagataacagccgtatcctgcgcattatctctgcggtggtgatcctgctgttcttcaccatctactgtgcttccggcatcgtggcgggcgcgcgtctgttcgaaagtaccttcggcatgagctatgaaaccgccctgtgggccggtgcggccgcgaccatcctctataccttcgtgggcggattcctggcggtaagctggaccgacaccgtgcaggcgagcctgatgattttcgccctgatcctgaccccggtgattgtcattttcaccgtcggcggctttggcgaatcgctggaagtgatcaagcagaagagcattgaaaacgtcgatatgctgaaagggctgaactttgtcgccatcgtctccctgatgggctggggcctgggctacttcggccagccgcacattctggcgcgtttcatggcggcggattctcaccataccatcgttcacgcgcgtcgcatcagcatgacgtggatgattttgtgtctggcgggcgcgtgtgcggtcggtttcttcggtatcgcctactttaataacaacccggcgcaggcgggcgcggtgaaccagaacgccgagcgcgtgttcatcgaactggcgcagatcctgttcaacccgtggattgccggtatcctgctctccgcgatcctggctgcggtgatgtccaccctgagctgtcagctgctggtgtgctccagcgccatcaccgaagacctctacaaagcgttcctgcgtaagggcgcgagccagaaagagctggtgtgggtagggcgttttatggtgctgctggttgcgctggtggcgattgcgctggcagcaaacccggaaaaccgcgtgctggggctggtgagctacgcgtgggcgggcttcggtgccgcgtttgggccggtagtcctgttctccgtcatgtggtcacgcatgacccgcaacggcgcgctggcggggatgattattggtgcggtgaccgttatcgtctggaaacagttcgcctggctgggcctgtacgaaatcattcctggcttcatcttcggcagcatcggtatcgtggtcttcagcctgctgggtaaagcaccgtctgcctccatgcagaaacgctttgcggaagccgacgcgcactaccacactgcgccgccgactaagcttcaggctgagtaa

SEQ ID NO: 1815 - DNA, 975 bp, Enterobacter cloacae
actgtcatcaaaggcatcgcacactacaggattgattcttcgtgctggtgtcccatgtccgtttcccgttttaccttatccattaagcctcaggaagccatcctgattttgatcaccatgttctggggcggaacctttcttgccgttcagtacgcggtcacgatgagcgatccgtttttctttgtagggctgcgttttgcaaccgctgcggttgccgtggcgcttatttcactgaaaaccctgcgcggattgaccctgagagagcttaaagcgggcgtcgccattggcgtggcgattgccatgggttacagcctgcaaacgtgggggctccagtctatctccagcagtaaatccgccttcatcaccgccatgtacgtaccgctggtgccgctgttgcagtggctgtgcctcggcagaatgccgggcctgatgtcgtgcattggcatcgtgctggcgttcatcggccttattttattagccgggccggaaaataatctgctggcgctggggccgggggagatcatcactctggtgggggccgtcgccattgcggcagaaattattctgattagcgcctgggcaggaaaagtggacgtcaagcgggtgacggtggtgcagcttgccaccgcgtcgctggtggcgttcgcgacgatggtgccggcaggggagtccgtcccgccgatgtctaccgggcttatcgtcgtggcgctggggctgggtattttcagcgccattatccaggttaccatgaactgggcgcagcgcagcgtatccccgacacgggcgacggtcatttacaccggtgaaccggtgtgggcgggtattttcgggcgactcgccggggagcgtctgccgctgctggcgctggtgggcgcggcatttattatcgccggggtgctggtgagcgagttgaagttaaaaaaacgacgtaaggcgactgccggattgagcgctgaacaaagggcagatagctaa

SEQ ID NO: 1816 - DNA, 1092 bp, Enterobacter cloacae
gacgttttacagctgatcgtgattgaaattgcgctggcgttctttttcctgcatgcagaaagcggtctgtttattattaaatacgtctccggtttctttgagtcgctgcttaaattcgctgccgaagggacgaattttgtctttggcgggatgggtgaaaaagggctggcgtttattttccttggcgtgctctgccccattatttttatctcagcgttgatcggtattcttcagcactggcgcattctgccgatctttattcgggtgatcgggacgctgctgtcaaaactgaacggcatgggcaagctggaatccttcaacgcggtgagctcgctgatcctcggtcagtcggaaaactttattgcctacaagggcgtactcggggatctctcctcacgtcgtctgtttacgatggctgccacggctatgtcgacggtgtcgctgtcgattgtcggggcctatatgaccatgctcgacgccaaatttgtcgtcgcggcgctgatcctgaacatgttcagcacctttattattctttcggtcattaacccgacccgcccggaagcggagccggatatcaagctggaaaaactgcacgaatcccagagcttctttgaaatgctgggcgagtatattctggccggttttaaggtggcaatgattattctggcgatgctgattggttttatcgcccttattagcgccgttaacgccctcttctccagcatatttggcatgagcttccagcagattctgggttatgtgttttatccgctggcgtggcttattggtattccgttgagcgatgccttaaacgcggggagcattatggcaactaaactggtggcgaatgaatttgtggcgatgatcgagctgcaaaaaattgcccatcaaatgtcacctcgcgggctgggtattttgtccgtgttcctggtgtcgttcgctaactttgcttccattggcattgtggcgggggcaataaaaggtctgaacgagcagcagggcaacgtggtgtcgcggtttggtttgcgtctggtgtacggcgcgacgctggtgagcctgctttcggcgagctttgcggggttggtgttgtaa

SEQ ID NO: 1817 - DNA, 324 bp, Enterobacter cloacae
cctggccagccgcagccgtcgccgcctgatgatccgtctggtgaagggcgcctactgggacagcgaaatcaaacgcgcccagatggaaggtctggaaggctatccggtctatacccgcaaggtctacaccgacgtctcctacctcgcctgcgcgaaaaaactgctcggcgtgccgaacctgatttatccgcagttcgccacccacaacgcccacaccctggcggcgatctacagcctggcgggtcagaactactatccgggccagtacgagttccagtgtctgcacggcatgggcgaaccgctgtacgagcaggtgaccggtaa

SEQ ID NO: 1818 - DNA, 441 bp, Enterobacter cloacae
tttctgcgacgcgctggatcccccgctcgcccgtatcgcctgaggagaaccgctatgccgaaatccgtgattattccgccgggcaccagcactccgattgcccccttcgttcccggcaccctcgccgacggcgtggtgtatgtctcgggcacgctgccgtttgataaagacaacaacgtggtgtttatcaacgacccaaaggggcaaacccgccacgtgctggagacgatcaaaaccgtgatcgaaacggcgggtggtacgatggaggacgtgaccttcaacagcatctttatcaccgactggaaaaactacgccgcgattaacgaaatctacgcggagtttttccccggcgataaaccggcgcggttttgcatccagtgcgggctggtaaagcccgaagcgctggttgaaattgccaccgttgcgcacatcgcgaagtga

SEQ ID NO: 1819 - DNA, 1116 bp, Enterobacter cloacae
cttcccttgcgggatacggtgtacagtgctgaacccaggacgtggggatctcctttccgacatgccctgtcttgctcgcccctgagagattttattattcaaagggaatttactatgtcttacgctattcacaaccaaaacctggctttcaatgacagcgccatcgcgcaatatatgaataccgattttatcgttattgatatttcattatgcgtggctctggcacgcgagcagttctttgaaaaattaaaagatgatgatattccgtcgcatatttttatcgaagataacggtcgcatcgcgggtttgatcgccgtacgcaaattgttgcaggccaccgacaccgtgcagcccgttaaggggttgatgatatcggattttattcagctcaaaccggaagatgagcgggcggatgtcgccgggctgctggcgcatgcgggtgcggatgtagtgccggtggtgacccacggcaagctggtgggctgccttaccgagcgtgaaatcgcccatctgctggaagatgacgttactgaagatgcccagcttcagggggcgacgctgccgctggagaagccctatctggaaaccagcgccttcagcctgtggaagaaacgctccgtctggctgctgctgctgtttgtcgcggaagcgtataccagctcggtgatccagcattttgaagaggcgctggaatccgccattgcgctggcgttctttattccgctgctgattggcaccggcggaaacagcgggacgcagatcacctcgacgctggtgcgcgccatggcgctgggtgaagtccaccttcgcgatgtgggtcgcgtgctgcgcaaagagatgagcacctcgttaatgattgccgccacgctgggtctggcgggttgcgttcgcgcctggatgatgggcattgggatggaaatcacgctcatcgtcagcctgacgctggtctgcattacgctgtggagcgccatcgtctcgtcggtgatcccgatggtactgaaacgctgcaaaatcgacccagcggtggtctccgcaccgtttatcgccacgctaatcgacggcaccgggctgattatctacttcaaaattgcgcagtatacgctggggctggaataa

SEQ ID NO: 1820 - DNA, 537 bp, Enterobacter cloacae
ctttgtttaacgacgattatgaattttttatttatcagtgataactattacctttgccatggtgtatcaagctccctgacatcaacccatttgattcgcgatgacgcggatattcacgatcttgatggggtcgatcaggcgatggattttatcattgcgattgaacaggataagttacgcaataaaaccattcggcaggtcaaaaaagttaagtgtgattacattgtcctgatgcatgagatagaagccaatagcgcggtgagaattgataatattatctattcgtcgatgcattttactgctcacccttttcagcagctgatgcgcttttaccgggcgctcagaacacactcctttacgcgacgcgaatatgacgtgctgaagctgtttcatttggaaaaccatgagatcgcgaaaaagctgcaattgtcacaaaaaacgaccagcacctaccgcgtgaggatcctcgagaaattaaatatgcgctcaaaaaacattctggcgatgacccgtgtaaaatcggcgatcgtcgattaa

SEQ ID NO: 1821 - DNA, 4092 bp, Enterobacter cloacae
tcgttaacaatccattcattttccagcttgcagaccaggtcacatttaacacggttgcacaaagttgcaacatggtggatatttcacgctatcaacagaacgctattacagaacaacaggagttttggcatggggatgaccaccatgggggttaagctggatgacgctacccgcgaacggattaaaaccgctgcgacccgcatcgaccgcacaccgcactggttaatcaagcaggcgatttttaactatctggaaagactggagagtgaagaaggtctgccggagctgcctgccctgctggcgggcgcagcgaacgaaagcgaagaagccgcgacggccgttgaggagaaccaccagccgttcctcgaatttgccgagcagatcctgccgcagtccgtcagccgcgccgccattaccggcgcctaccgccgtgccgaaaccgacgccgtgccgatgctgctggagcaggcgcgcctgccggaagccgttgccgctcaggcgcacagcctggcgtatcagctcgccgacaagctgcgtaatcagaaaaccgccagcggacgcgccggtatggtgcagggtctgttgcaggagttctccctctcctcgcaggaaggcgtggcgctgatgtgtctggcggaagcgctgctgcgtattccggataaagccacccgcgatgccctgatccgcgacaaaatcagcaacggcaactggcactcccacattggccgcagtccgtcgctgttcgttaacgccgccacctggggcctgctgtttaccggcaagctggtctccacccataacgaagccaacctgtcgcgctctctgaaccgcatcatcggcaagagcggcgagccgctgatccgcaagggcgtggacatggcgatgcgcctgatgggcgagcagttcgtcaccggggaaaccattgccgaagcgctggcgaacgcccgcaagctggaagataaaggcttccgctactcctacgacatgctgggtgaagcggcgctgaccgccgccgacgcgcaggcctacatggtatcttaccagcaggcgatccacgccatcggtaaagcgtccaacggtcgcggtatttatgaaggcccgggcatctccattaagctctccgccctgcacccgcgctacagccgcgcgcagtacgaccgggtgatggaagaactctacccgcgcctgaagtccctgaccctgctggcgcgccagtatgatatcggcattaacatcgacgccgaagatgcggaccgtctggagatctccctcgatctgctggaaaaactgtgcttcgagccggagctggcgggctggaacgggattggtttcgttatccaggcctaccagaaacgctgcccgttcgtcattgactacctgattgacctggccagccgcagccgtcgccgcctgatgatccgtctggtgaagggcgcctactgggacagcgaaatcaaacgcgcccagatggaaggtctggaaggctatccggtctatacccgcaaggtctacaccgacgtctcctacctcgcctgcgcgaaaaaactgctcggcgtgccgaacctgatttatccgcagttcgccacccacaacgcccacaccctggcggcgatctacagcctggcgggtcagaactactatccgggccagtacgagttccagtgtctgcacggcatgggcgaaccgctgtacgagcaggtgaccggtaaagtggccgacggcaagctgaaccgtccgtgccgtatttatgccccggtaggtactcacgaaactctgctggcctacctggtgcgtcgtctgctggagaacggggcgaacacctccttcgttaaccgcatcgccgataccaccctgccgctggacgaactggtggccgacccggtacaggccgttgagaagatggcggcgcaggaaggccagattggtctgccgcatccgaagattgccctgccgcgcgagctgtatggtgcaggtcgcgtcaactcggcgggtctggatctcgccaacgaacaccgtctggcctcgctctcttctgccctgcttaacagcgcattgcagaagtggcaggccaggccgatccttgagcagtccgttgaggacggtgaaatgcagccggtgatcaacccggcagagccgaaggatatcgtcggctacgtgcgcgaagccacggaaacggaagtggagcaggccctggagagcgcggtgaacaacgcgccaatctggtttgccaccccgccgcaggagcgtgccgccattctggaacgcgcggcggttctgatggaagatcagatgcagcagctgatcggcattctggtgcgtgaagcgggtaaaaccctcagcaacgccatcgccgaagtgcgcgaggcggtcgacttcctgcactactacgccggtcaggtgcgcgatgatttcgacaacgaaacccaccgtccgctcggcccggtggtgtgtatcagcccgtggaacttcccgctggcgatcttcaccggccagattgccgcggcccttgccgcaggcaacagcgtgctggcaaaaccggcagagcagaccccgctgattgccgcccagggcattaacattctgctggaagcgggcgtaccggcgggcgtggtgcagctgctgccagggcgcggtgaaacggtcggggccaaactgacctccgataaccgcgtacgcggcgtgatgtttaccggttctaccgaagtggcctccctgctacaacgcaacatcgccacccgtctggatgcgcagggccgtcctaccccgctgatcgctgaaaccggcggcatgaacgccatgatcgtggactcctccgcactcaccgagcaggtcgtcgttgacgtgctggcctctgccttcgacagcgcgggccaacgctgttccgccctgcgcgtactgtgcttacaggatgacgtggctgaccacacgctgaagatgctgcgcggtgcgatggcggaatgccgcatgggcaacccgggccgtctcactaccgacatcgggccggtgatcgacgcggaagccaaagccaacattgaaaaccacattcagaccatgcgtgcaaaaggccgtccggtgttccaggcggtgcgcgagaacagcgaagatgcccgcgagtggcagaccggcaccttcgtgccgccaacgctgattgagctggcaagcttcgacgagctgaaaaaagaggtcttcggcccggtactgcacgtggtgcgctacaaccgtaacaacctcaacgagctgatcgatcagatcaacgcctcgggttacggcctgacgcttggcgtgcatacccgtatcgacgaaaccattgcccaggtgaccggcaatgctaaagttggcaacctgtacgtcaaccgcaacatggttggcgcggtcgtgggcgtgcagccgtttggcggtgaaggtctctccggcaccggcccgaaagcgggcggtccgctctatctgtaccgtctgctggcaaaccgtccggaaaatgcgctgggcgtgacgctggcgcgtcaggacgcggaatatccggtggatgcgcaggtgaaagccgtgctgacccagccgctggacgcgctgattaagtgggctgaaaatcgtcctgagctgcgtgcgattgcacagcagtacggcgagctggcgcaggcgggaacacagcgtctgctgccgggtcctaccggcgagcgcaacacctggacgctgatgccgcgcgagcgtgtgctgtgcgtggcggataacgagcaggatgcgctggtgcagctggcagccgcaacggcaacgggctgtgaggtgctgtggccggaagatgccctgcatcgcgacctcgccaaacagttgccaaaagcggtctcggcccgcattcgctttgcgaaggccgatgccctgctgacccagccgtttgacgcggtgatctaccacggtgattccgaccagctgcgcgaactgtgcgagcaggttgcggcccgcagcggtgccatcgtttccgtgcagggctttgcgcgcggggaaaccaacctgctgctggagcgtctgtacgttgagcgctcgctcagcgtcaacaccgcggcggcggggggtaacgccagcctgatgacaatcggctaa

SEQ ID NO: 1822 - DNA, 447 bp, Enterobacter cloacae
cgctgtgctaataaggctccggagacggagccttattttattggggagtgtatgaaacgatatcttatcgcaggcgcagcactgctgctcagcgccagcgcgctggccgacgagtgcgacaaagcgaccacccagacagaactcagtgcctgtgcggcagagcagtaccaggctgcggataaaaagctcaaccagacgtaccaggccgccatcaaacgcgcggcagcccctcagcgcgacctgctgaaaaaggcgcagcaggcgtggatcgccctgcgtgacgcagactgtaaattgatgggttcaggaaccgaaggtggcactattcagccgatgattatcaaccagtgcctgacggagaaaacagcggagcgcgaagcctttctggcctcgttgatgcagtgtgaagagggcaatttaagctgccctttccaaccggctgattag

SEQ ID NO: 1823 - DNA, 783 bp, Enterobacter cloacae
ttttctcaccggcgtggaaaccttcggcgagcgcattcagccgctgatgcagtgccgcgcccacatccctgccgtgacgaaggaggtggcgtaatgacgaccctcaacgctcgcccggaagccattacctttgacgcgcagcgcagcgcgctgatcgtggtggatatgcaaaacgcctatgccagtaaaggcgggtatctggatctggccgggtttgacgtctccaccacgcagccggtgatcgagaacattaaaaccgccgtgcacgctgcgcgcgctgcgggcatgctcatcgtctggttccagaacggctgggacgaccagtacgtcgaagctggtggtcccggctcccccaactttcacaaatccaacgccctgaaaaccatgcgccaacggccagaactccagggcacgctgctggcgaaaggcggctgggactatcagctggtggatgagctggtaccggaagccagcgatatcgtactgccgaaaccgcgctacagcggctttttcaataccccgctcgacagcctgctgcgcagccggggcattcgtcatctggtctttacgggcattgccaccaacgtctgcgtggagtcgaccctgcgcgacggctttttcctcgagtattttggcgtggtgctggaagacgctacccatcaggccgggccggattttgcccagaaagccgccctgttcaatatcgaaaccttttttggctgggtcagtaacgtcaatgatttctgcgacgcgctggatcccccgctcgcccgtatcgcctga

SEQ ID NO: 1824 - DNA, 858 bp, Enterobacter cloacae
agcccgaagcgctggttgaaattgccaccgttgcgcacatcgcgaagtgaggccgccatgaaactgtccatttccccgcccccctttgcgggcgcgcccgtggtggtactgattgccgggctcggcggcagcgggagctactggctgcctcagctcgccgtgctggggcaggagtatcaggtggtgtgctacgaccagcggggcacgggggataacccggataccctgccggaagactacaccctcgcacacatggccgacgagctcgcactggcgttagccggggcagggatcgcccgttactgcgtggtcggccacgcgctgggggcgctggtgggcctgcggctggccatcgataagcccgacgcccttaccgcgctggtctgcgtcaacggctggctgacgctcaatgcccatacccgacgctgttttgacgttcgcgaacgtctgctgcatgcgggcggcgcgcaggcgtgggtagaggcacagcccttgttcctctacccggcagactggatggccgcccgcgccccgcggctggaggccgaggacgcgctggcgctggcccattttcagggcaaagccaatctgctgcgcaggctgcatgcgctgaagcaggccgatttcagccgccacgctgcacgcgttcgctgccccgtgcagattatctgttccaccgacgatctgctggtgccgtccgtctgttctgatgaactgcacgccgcactcccgcacgcccgcaaaacggtcatgcgccagggcgggcatgcctgcaacgtgaccgcgccggacatctttaacactctgctgctgaacgggcttgccagcctgctgcacagcccagaacccgctttgtaa

SEQ ID NO: 1825 - DNA, 591 bp, Enterobacter cloacae
atgagcgaagccatcacgcccgccgcgctggaaacgctgtttaccggcgcacgtacccataacggctggctggatataccggtcagtgacgagacgctgcgcgagatttatgacctgatgaaatgggggccgacgtccgccaactgctccccggcgcgcattgtgtttgtgcgaagcccggaaggaaaagaaaagctgcgcccggcgctctccagcggcaaccttgagaaaacgctcactgccccggtcacggcgattgtcgcctgggacagcgagttttatgagcgcctgcctgaactgttcccgcacggcgatgccagaagctggtttaccgcaagccccgcgctggcggaagaaaccgcctttcgcaacagctcaatgcaggccgcgttcctgattttcgcctgccgcgcgctcgggctcgacaccgggccgatgtccggttttgaccgggaaaaagtggacgcggcctttttcacgggcacgctgcttaaaagcaatctgctgatcaacatcggctacggcgatacgaccgaactgtacggacgcctgccgcgtctgaccttcgaagacgcctgcgggctggcgtaa

SEQ ID NO: 1826 - DNA, 603 bp, Enterobacter cloacae
tgcaaaatggcaaaagttctggtgctctattattccatgtatggacacattgaaaccatggctcacgcagtagcagaaggcgcaaacagagtagacggcgttgaggtcgtggttaaacgcgtaccggaaaccatgcaggcggaagccttcgccaaagccggggggaaaacacaaaacgccccggtcgccaccccgcaggagctcgcggactatgatgccattatcttcggcaccccgacccgcttcggcaatatgtccggccagatgcgcaccttcctcgaccagacgggcgggctctgggcctccggcgcgttatacggcaagctggccagcgtgttcagctctaccggcacgggcggcggccaggagcagacgatcacttccacctggacaacgcttgcgcatcatgggatggtcattgtgccgattggctacggcgcgcaggaactgtttgatgtctcccaggtccgtggtggtacgccctatggcgcaacaacgattgccggtggggatggttcacgtcagccaagcaatgaagaactttcaatcgcccgctatcagggtgaatacgtcgcgggtcttgccaaaaaactgaacggctaa

SEQ ID NO: 1827 - DNA, 246 bp, Enterobacter cloacae
cctaacaggaggacaagtatgccaactcaagaatccaaagctcaccacgtgggcgaatgggcaagtttacgcaatacctctccggagattgccgaagccatctttgaagtcgccaattatgacgaaaagctggctgaacagatttgggaagaaggcaacgatgaagtgctggttcgcgccttcaaaaaaaccgacaaagactcgctgttctggggcgagcaaaccatcgaacgtaaaaacgtctga

SEQ ID NO: 1828 - DNA, 183 bp, Enterobacter cloacae
ccctgctggcgcgccagtatgatatcggcattaacatcgacgccgaagatgcggaccgtctggagatctccctcgatctgctggaaaaactgtgcttcgagccggagctggcgggctggaacgggattggtttcgttatccaggcctaccagaaacgctgcccgttcgtcattgactacctga

SEQ ID NO: 1829 - DNA, 1179 bp, Enterobacter cloacae
caccctaataacaaagtgattttcaaaactggcactgcctttgcaaaaacaccgttacacctgcgacgtaatgaagagaggttcgtgatgaaaattggcgtatttgtacccatcggcaacaacggctggcttatctcgaccactgcaccgcaatacatgccgacctttgagctgaataaagccatcgtgcagaaagcggagcactaccatttcgactttgcgctttcgatgatcaagctgcgcggcttcggcggcaaaaccgaattctgggatcacaacctggagtccttcaccctgatggccgggctggccgcggtcacctcgcggatccagatctacgccaccgcagccaccctcaccctgcccccggcgatcgtggcacgcatggcctccaccatcgactccatctccggcgggcgctttggcgttaacctggtcaccggctggcaaaaaccggagtacgagcagatgggtctctggccgggcgacgattacttctctcgccgctacgactacctgaccgagtacgtgcaggtcctccgcgacctgtggggtaccggcaaaagcgatttcaagggtgacttcttcaccatgaacgactgccgcgtcagcccgcagccgtcggtgccgatgaaggtgatttgcgccgggcagagcgacgccgggatggaattctcggcgaaatacgccgacttcaacttctgcttcggtaaaggggttaacacgcctgccgccttcgccccgaccgccgcgcgcatgaaagaagccgccgacaaaaccgggcgcgacgtgggctcctacgtgctgtttatggtcattgccgacgaaaccgacgaggccgcacgcgccaaatggcagcgctataaggacggcgccgacgaggaggccctgagctggctcaccgagcagagccagaaggacacccgctccggcgcggacaccaacgttcgccagatggccgacccgacgtctgccgtcaatatcaacatgggcaccctggttggctcgtatgccagcgtcgccagaatgctcgacgaagtggctgccgtgcccggcgccgaaggcgtgctgctgaccttcgatgattttctcaccggcgtggaaaccttcggcgagcgcattcagccgctgatgcagtgccgcgcccacatccctgccgtgacgaaggaggtggcgtaa

SEQ ID NO: 1830 - DNA, 504 bp, Enterobacter cloacae
ggagccatcatgacgacccttgatcaacaaacgttccgtgatgccatggcctgcgtcggtgcggcggtcaatatcatcaccaccgacggcccggcgggaatggcgggctttaccgcaagcgcggtatgcagcgtaaccgataccccgcccactctgctggtgtgcctcaaccgcggcgcgtcggtctggccgattttcagcgagaaccgcaccctgtgcgttaacacgctgagtgccggacaggagcctttatccagcctgtttggcgggaaaacgccgatggcggaccgctttgccgctgcccgctggcagacgggggagacgggctgcccgcgtctggaggcggccctggcctcattcgactgccgcatcagccaggtggtgagcgtcggcacccacgacattctgttttgcgacattgtatcgattatccgccacccggcgccgcaagggctggtgtggttcgaccgcggctatcacgcacttatgcgacccgcctgttaa

SEQ ID NO: 1831 - DNA, 1344 bp, Enterobacter cloacae
tccgcattcaggagacagatcatgttcggacttccccactggcagttgaaatcgacctccacagaagaaggcgtggtcgcgccggatgaaaggctcccgctcgggcagaccatggtgatgggcgtgcagcatgcggtcgcgatgtttggtgcgacggtgctgatgcccatgctgatggggctggatcctaacctcgccattttgatgtcgggtatgggtaccctgctgttcttttttgtcaccggcgggcgtgtgcccagctatctgggctccagcgccgccttcgttggggtggtcattgcagcgaccgggtttaacggtcagggtattaaccccaacctgagcgtggccctcggcggcattatcgcctgtgggctggtctataccctgaccggtctggtggtgatgaaagtcggcacgcgctggatcgagcggatgatgccccccgtcgtcaccggggcggtggtgatggcgataggcctgaacctcgcgccgattgcggtgaagagcgtttccggctcaccgtttgaaagctggatggcggtgattacggtgctgtgcatcggcgtggtggcggtctttacgcgcggcatgatccagcggctgctgatcctggtcgggctgattgcggcctgtctggtctacgcgctgctggcgaacgtgttcggcctcggcaaaccggttgatttcacactgattcatcaggccgcctggttcggcatgccgcacataacctcgcccacctttaacgttcaggcgatgatgctcatcgcgcctgtcgcggtgattctggtggctgaaaacctgggccatttgaaagccgtagcgggaatgaccggccgcaatatggacccgtatatgggacgggcgtttgtgggagacggtctggcgaccatgctctccggctcggtcggcggcagcggcgtgacgacctacgcggaaaacatcggcgtgatggcagtgaccaaagtctactcgacgctggtcttcgtggcggcggcggtgatggcgatgctgctcggcttttccccaaaattcggcgcattgatccacaccatcccggcacccgtgattggcggcgcctcgattgtggtatttggtcttattgccgtcgcgggggcacgtatctgggtgcagaatcatgttgatctgagccagaatggtaacctgatcatggtggcggtaacgctggtgctgggggcgggtgatttcgccctgacgctgggcgggtttacggtgggcgggattggcacggcgaccttcggcgcgatcctgctcaacgccctgctgagccgccggaaaagggatgtaccgcaaggaaaagccatcaccccttccacctga

SEQ ID NO: 1832 - DNA, 2682 bp, Enterobacter cloacae
ctattcttgcagtggaatggctggacagccgcttactttgggacgcacatgagtcaggaaacgcccgcttcgccgactgaagcgagaattaaaacaaaacgccgcatttcgccattctggttgctacctgtcatcgcgctgatgatcgcaggctggcttatctggacgagctatgaagatcgcggaagtaccatcacgattgatttccagtctgcggacggcattgtcgccggacgtacccccgttcgcttccagggggtggaagtgggtaccgtgcaggatatttccctcggcaaagggctgaacaaaattcaggtccgggcgagcattaagtctgatatgcaggatgccctgcgcgccgaaacgcagttctggctggtcacgcctaaagcctccctggccggcgtttccgggctggatgcgcttgtgggcggtaactatatcggcatgatgcccggcaaaggcgagccacaggatcactttgttgcgctggatacccagccgaaatatcggctgaataacggcgatttgatgatccacctccgcgcgccggatttgggctcgctgaacagtggttctctggtctatttccgcaaaattccggttggtcgcgtttacgactacgccattaacccgaacaaagatggcgtgaccattgatgtactcatcgagcgccgttttaccaacctggtgaaaaaaggcagccgcttctggaacgtctccggcgtcgatgccgacctgagcttaagcggtgcgaaagtgaagcttgagagcctggcggcgctggtgaatggcgctatcgccttcgactcacctgctgactccagccctgccgccgcagaagatacctttggcctgtacgccgacctggcgcacagccagcgcggtgtcatcgtcaagctgaccctgccggatgccaaagggctgaaagccggttcgaccccgttgatgtaccagggtttagaggtcgggcaactgacaaaattaaccctcaatgcgggcggctccgttaccggcgaaatgacggtggatccgagcgtggtggatctcctgcgggaaaaaacgcgcattgaactgcgtaatccgaagctctccctcagcgacgccagcatcagttccctgctgacgggaagcacctttgagctgatccccggtgaaggcgcgccgaacaaaaactttgttatcgccccggcggataaagccctgctgcaaaaaccgggcgtgttgacggttacgctgaatgcgccggaaagctacggtatcgaagccgggcaaccgctgatcctgcacggtgtgcaggtgggccaggtcctcgaacgtaagctgaaagaaaaaggggtctccttctccgccgccatcgatccgcagtacagcaatctggttcacggcgacagtaaatttgtggttaacagccgggtcgacgtgaaggtgggtctggacggcgttgagttcctcggcgccagcgccagcgagtgggttaacggcgggatccgcattctgccgggcagcaaaggtgcgctgcgcgagagttatccgctgttcgccaatctggacaaagccattgaaaacagccttggcgacctgccgaccaccacgctgaccttaagcgctgaaacgctgccggacgtccaggcaggctccgtcgtgctttatcgtaagtttgaagtcggggaagtgatcaccgttcgtcctcgtgcagacgcgtttgatatcgaactgcatatcaagccggagtaccgcaagctgctcacgccaaacagcgtgttctgggctgaaggcggcgcgaaagtgcagctcaacggcagcgggctgaccgtacaggcgtctcccctctcccgtgccctgcgcggtgcgatcagcttcgataacctgagcggcgcgggcggcaacatgcgtaaaggtgacaagcggatcctcttcccgtccgaaaccgcggcgcgcgcagtcggggggcagattaccctgcacacctttgatgccggtaaactggctgaaggcatgcccatccgctatctcggcattgatatcgggcagatccagaagctgacgctgatcaccgcgcgcaacgaagttcaggcgaccgccgtgctttatccggaatatgtgcagacgttcgcccgggcaggctcgcgcttctcggtggttacgccgcaaatttctgccgcaggggttgagcatctcgacaccatacttcagccgtacataaacgttgaaccgggtcgcggcaacgcgcgtcgtgaatttgagttgcaggaggcaaccatcaccgactcccgttatctggacggtctgagcattgtggttgaagtgccggaagccggttcgctgggcatcggtacgccggtcctgttccgcggcattgaagtggggacagtaacaagcctgacgctgggtaatctgtccgatcgcgtgatggtcggcctgcgcatcagccagcgttatcagcatctggttcgcaacaactcggtgttctggctcgcttcaggctactcgctggacttcggcctgaccggtggcgtggtcaaaacggggacctttaatcagttcattcgcggcggcattgccttcgcgacgccgcctggcacgcctctggcgcctaaggcgcaggcaggtaaacacttcctgctgctggaaagtgaaccgaaagagtggcgcgaatggggaacggcgctgccgcgttaa

SEQ ID NO: 1833 - DNA, 285 bp, Enterobacter cloacae
ctgcactggtcataccagattttgggcaacaaaccggagagcattatgacgaaaaccagcgtacgcattggcgcttttgaaatcgacgacgctgaattgcgcggcgaatcacaaggcgaacgaacgttaagtattccctgcaaatccgatccggatttgtgcatgcagctggacgcctgggatgcagataccagcgtcccggcaatccttgatggggaacattccgttctgtaccgtgagcattacgacagtaaaaccgatgcctgggtcttgcgtcttgcctga

SEQ ID NO: 1834 - DNA, 1104 bp, Enterobacter cloacae
actggcgtcggatttcgcgaatccaaacaaaccataaaccagccggaaataaagatcgctgcgctattaatcccttattccctggcctttaaaatagagcggaataaaaagagggattttcacgtgtcaaacatacacctgcaaaacgatgttttttatccgcatcgcacaaatattatttctgaactggtgagaggaaaacgcgttcccggcccaatctggcacaaacgtgattaccggttaaagttccttctgcgctcgcttttattctggtcctccacccatcgcatgctggaggccctgtccgggcgcgatgatttcgacaggctgctcacctctcaaattaccttgccgagcaaaactcaccgccagtatctgatgcgcggcctgaactcaaacgaccgggccgatgctatcgtcagccactatcagtggattgatagtctgaaaaacatcgccctcgcccacgcgctgaccagcccgcaagaggtgccggttgtccggttcgaggcaaaaaacggcgaaatctataccgtccacgcctcgtccgcaggtaaggccgaacgcgaaggcgaaagcacgctttggctgcacgacaatgacaatacgctgcttgccagcctgacgttctgtgtcgcacgcagtaacggccgtacggtgctggtgatcggcggccttcagggtccacgtcgtcatgtttcacgggaggtgattaagcaggctacccgtgcctgccatggtcttttcccgaaacgcgtgctgatggaggtgatcttccagcttgcctcacgctcgaacatcagcgcgatttttgccgtcagcgatgaaggccatgttttccgcgcgctgcgctaccgtctgagcaaaggccgtcattttcacgccagctacgacgagttctgggaaggcctgaacggaaagaaactctcccccttctgctggcagttgccgctccagatggagcgtaaagcactggaggagattgccagcaaaaaacgcgccgaataccgtcgccgctttgcgttacttgatgatattgcggcttccgtacaggcgcgcattgatcccgcagtcgtctcaggcaaaatacaaacaaaaatttaa

SEQ ID NO: 1835 - DNA, 273 bp, Enterobacter cloacae
acaatcgcggtaacgttgccgccgcagaaaaaggagaaggaaatgaacgttaacctggccgcccttcctcaggacgagatggacaaagtgaatgtcgatctcgccgccgcgggtgtcgcattcaaagagcgttacaacatgcccgtcgtagctgaagtggtagagcgtgaacaacccgcacatctgcgcgactggtttcgcgaacgtctcattgcgcatcgcctcgcctccgtcaatctctcgcgcctgccgtacgaacctaaagttaaataa

SEQ ID NO: 1836 - DNA, 684 bp, Enterobacter cloacae
aatcccagcgacttagtgtataaggaagtcacgatgtcacgatggaatattgccgcggctcagtatgccccgcggcacaactgtgttgatgagcacgtaaaacatcacctgcactttattgccgaagctgcctggcatgggtgcgatttgatcgtctttccggagctttcgcttaccggcccaggcggaacatccttacccccacctcctgacgatttgcagcttgcccccctccttcacgccgcccagtcacgtttcatcacggtgattgctggtattacgctccagcaacacggccagcgccagaaaggactcgcgcttttcacccctaacctgtcgaccatccggcgttatccgcagggcaacggtgcgggtgttattcctggcgataaaaggttaaccatcgtggataaccaggctgacgccccggaactggacccggaggcaacgctgttcaccagcagcctggccgtgggcgagcaccgctggcgacaatcgatcggttcgttacaacgcttcgcgcacaagtacgccatcgcggtattaatggcgaacgcgcgcggcggtagcgcgttatgggatgaaaaaggtcagctgattgtacgtgccgataagggagaactgctgctaaccggttctttaggccaacagggttggcaaggcgatatcattccattaggctag

SEQ ID NO: 1837 - DNA, 678 bp, Enterobacter cloacae
gatcaggagcgatcaatgctgcgcgttatcgataccgaaacctgtgatttgcagggtggaattgtggaagtcgcttctgtcgacgtgattgacggaaagatagtcaacccaatgagccatctggtgcgcccggatcgtcccatcagtgcgcaggcgatggctatacatcgcattacggaatcgatggtggcggataagccgtggattgaagagatcatccctctttaccacggtagccagtggtatgtcgcccataacgccagctttgaccgccgcgtgctgccggagatgcccggcgaatggatttgcaccatgaagctggcgcgccgtctgtggccagggatcaaatacagcaatatggcgctgtataagtcgcgcaaactcagcgtgcgaacgccggaagggctgcatcatcaccgtgccctctatgactgctacatcaccgcagcgctcctgattgatatcatgaatacttccggctggacgccagacgatatggcgaccattaccgggcgccccgcgctactgactacctttacgttcggtaaatatcgcgggaagccagtatcggaagtggcggacaaagatccgggctatctgcgctggctgtacaacaacctcgacagaatgagcccggaactgcgcctgacgctgaagcattatttaggcgaagcctga

SEQ ID NO: 1838 - DNA, 1314 bp, Enterobacter cloacae
ctttcaacaatactaatctgtgtgcgactgatggccctaaaaacaccccaaattacgccgacacgaaagatcgttgtccgtacggtaagccaggctctgccccgtgcacattatcagcgttgtccccagtgcgatacgctttttatgttgccgaagatgaaatcgcaccaaagtgctttttgtccatgctgcgatgccaaaattcgcgatggccgggactggtcattgacgcgtctggcggcaatggcggtaaccatgctgctgctgatgcccttcgcctggaccgagccgctgttaaagctatacctgcttggcgtgcgtattgacgctaacgtgttgcaggggatctggcagatgacgcgccagggcgatccgcttacggccgccatggtgctgttctgcgtcgtcggcgcgccgttggtgctggtcgcggcaattgcctacctgtggtttggcaacatactggggatgaacctgcgccccgtcctgctcatgctggaaaagctcaaggagtgggtgatgctggacatctatctggtgggcgtcggcgtggcgtctatcaaggtgcaggattatgcatttttacaacctggcattggcctttttgcgtttatttcactggtcctgctgagtattctgaccctgattcatctcaatgttgaacaactttgggagcgattttacccgcagcgtcccgcgacccggcctgatgacaacctgcgcgtctgcctggggtgccattacaccggttttccggataaacgcgggagatgtccgcgctgccacattccgttaagattgcgacgcaacaacagcctgcaaaaatgctgggcggcgcttatcgcctccctggtatttttgttcccggccaacatgctgccgatctccgtaatttatgtgaacggcgcccgtcaggaagatactatcctttcagggattatctctctggcgcacagtaacgtgggggtcgccgccattgttttcatcgccagtattctggtgccctttaccaaagtggtggtgatgtttacgctgcttatcagcattcactttaaatgcgaacaaggactacgcacccgcatcctgcttctgcgattcgtgacctggattggtcgctggtcgatgttggatctgttcgtgatttcgctgatgatgtcgctcatcaatcgcgatcagttacttgcttttaccatgggacccgcagctttttatttcggctctgcggtgatattgactattcttgcagtggaatggctggacagccgcttactttgggacgcacatgagtcaggaaacgcccgcttcgccgactga

SEQ ID NO: 1839 - DNA, 1464 bp, Enterobacter cloacae
atgtttccctgtggtgtgcccgtggctcaaaactccgtatttcttcccgaacaattcctcgcacagatgcgcgaggcgcttccagctcatctctctttcgacgatttcgtcgccgcatgccagcgccctttgcgccggagtattcgcgtcaatacgctgaaaaccagcgtcggggcgtttctggatctcgtctccccctacggctggcaattaacgccagtgccgtggtgtgaagagggtttctggatcgaacgggatgacgaggagagcctgccgctcggcagcaccgccgagcacctgagcgggctgttttatattcaggaagccagctccatgctgccggttgctgcgctgtttgccgatgggaaccagcctgagcgggttatggatgtcgcggcggcgccgggctctaaaaccacgcagattgccgcccggatgaacaaccgcggcgcgatcctcgccaacgaattttccgccagccgcgtcaaagtcctgcacgccaatatcagccgctgcgggatccacaacgtcgcgttaacgcacttcgacggtcgcgtgtttggcgctgccctgccggaagcctttgatgccatcctgctcgacgcgccctgctccggcgaaggcgtggtgcgtaaagatcctgatgcgttaaaaaactggtccgttgaaagcaacctgcagatcgccgccacgcagcgcgaactgatcgacagcgcgtttcatgccctgcgcccaggcgggacgctggtttactctacctgcacgctgaatcgcgatgaaaacgaggacgtctgcctgtggctcaagcaacgctatgtggatgccgtcgagtttctgccgctggacaccctcttcgactcggccagccatgcggccacgcctgaaggcttcctgcatgtcttcccgcagatttacgattgcgaaggcttctttgttgcccgtctgcgtaaaacccgcgccgtcgatcccttgcctgcccctaagtttaaggtcggcaacttcccgttcgcgccggtcaaaggccgtgaggcggcacaggcgcaagcggctgcgagcaaagtcggcctgcactgggatgagagcctgcgcctctggatgcgtgacaaagagctgtggctgttcccggtcaacatcgaaccgctgattggtaaggtgcgtttctcccgcctcggtattcgcctggcggagatccacaacaaaggctatcgctggcagcacgaagcggtcattgcgctggccggcagtgagaacacctttgccctgacgcatcaggaagcggaagagtggtatcgcggtcgtgacgtttacccggaagacggcccgttacaggatgaagtcatcgtgacgtatcagggctatccgctggggctggcgaaaaaagtcggctcgcggctgaaaaacagctatccgcgcgaactggtacgcgatggccgcctgtttaccggtaacaaccgcagcgcctga

SEQ ID NO: 1840 - DNA, 1275 bp, Enterobacter cloacae
agaagcgcaaatttcccccttgtccggttatccccatacaagacagacgcaaacgttttcgtttatactacccgcatctttttcagggggatttttatgactcttttaggaaccgcgctgcgccctgccgcgacgcgcgtcatgctgttgggatcgggtgaactgggtaaagaagtggccattgaatgccagcgtttgggcgtggaggtgattgcggtggaccgttacgcgaacgcccctgccatgcacgttgcgcatcgctcgcacgtcatcgatatgcttgacggcaatgccctgcgggcgttaattgccgaggaaaaaccggatttcgtggtgcctgaaattgaggccattgccactgagatgctggttgcccttgagcaggaaggccagcgcgtagtgccttgcgccactgcggcaaaactgaccatgaaccgggaaggcattcgtcgcctggcggcagaagaattacagctcccgacctccagctaccgttttgccggggataaagctgcgtttctccaggccgtcgaagagattggctacccgtgcatcattaagccggtaatgagctcctccggcaaagggcagagctttatccgcgacagcagcacgctggaccaggcctgggactatgcccagcagggcggtcgtgccggtgccgggcgcgtcatcgtggaaggcgtggtgaagtttgatttcgaaattaccctgcttaccgtcagtgccgtggacggcgtttatttctgcgacccgattggtcatcgtcaggaagacggcgattatcgagaatcctggcagccgcagcagatgagcgcgctggcgctggcacgcgcgcaggagatcgcccgcaagacggtgctggcgctgggcggctacggcctgttcggcgtggaattgtttgtttgcggcgacgaggtgatcttcagcgaagtctcccctcgcccgcacgataccgggatggttacgctgatttcacaggatctctccgagttcgcgctgcacgtgcgcgctttcctcggcctgccggttggcggcatccgtcaatacggcccggcagcctccgcggtgatcctgccgcagctgaccagccagaatgtcacctttgataacgtcgaaggtgcggttggtgcaggcttacaggtcagactgttcggtaaaccggagatcgacggaagccgtcgtctgggcgtggcattagcaaccggggaaaacgtggacgaagccgtcgcgagagcgaaaatagcggccactgcggtaaaagtgacagggtaa

SEQ ID NO: 1841 - DNA, 285 bp, Enterobacter cloacae
tgcacgggtagccaatctcttcgacggcctggagaaacgcagctttatccccggcaaaacggtagctggaggtcgggagctgtaattcttctgccgccaggcgacgaatgccttcccggttcatggtcagttttgccgcagtggcgcaaggcactacgcgctggccttcctgctcaagggcaaccagcatctcagtggcaatggcctcaatttcaggcaccacgaaatccggtttttcctcggcaattaacgcccgcagggcattgccgtcaagcatatcgatga

SEQ ID NO: 1842 - DNA, 876 bp, Enterobacter cloacae
aatagtatgctggccctgagctacgtcgcgttactctttatccattttgctgcgctgatgctgcttttcggcaacgcgctttacagcgtctggtttgcaccgtcttcgttgcagcgcctcatgacccggcgtttccagcggcagcagaaactcgcggccttaatcagcctgatggcggctctgctgatgtttggcctgcaaagtgggttgatgggcaacggctggagcgatgtcattcgtccggcggtctggcgcagcgtgctgggaacgcaatttggcggcgtctggttgtggcaaatggtgctggccgctgtgacggcgggcgctgcatggcttaccccgcaaaaaggctcacggctgttactgctcgtgatggggcagctggtgctgttggcgggcgtgggacatgccgcgatgaacggtggcgcaccgggagcattgcatcgtctcaaccatgcgcttcacctgctctgcgccgcgacctgggtgggtggtttactgccgctgctgttttgtatgcgtctggcgaaaggccgctggcagccagccgctatctttaccatgatgcgcttctcccgcgtggggcattacgccgtggcaggcgtgctgctgaccgggataatcaatacgctctttattgttggcataaatgtgccgtggcatgcgccttatgtccagctgttgttgctcaaatgtgcgctggtcatgatgatggtggcaattgcgctggcgaatcggtattttcttgtgccacgctttcgcccggaggccgggcgggaacaacagatttttatcaggatgacacaggcagaggtggtgctgggcgcgctggtactggcggccgtcagcctgttcgcgacctgggaacccttctga

SEQ ID NO: 1843 - DNA, 687 bp, Enterobacter cloacae
gctgtgaaggttacgcactgttacgtgaggaaaaatatgtcaggctggatgaatcaactgcaatccctgttgggacaaaaaggctcgtcgtcgggcgagcagggtctaagcaagctgctggtgccgggtgcgcttggcgggctggccggtttgctggttgccaataaatcatcgcggaaactgcttaccaaatacggtaccggcgcgctgctggcgggcggaggggctattgcaggctccgtcttatggaacaaatacaaagacaaggtgcgcagcgcgcatcaggatgaaccgcagtacgggaagcaggtatcaccgttagatttacgcaccgagcgcctgatcctcgccctggtctttgcagccaagagcgacgggcatattgatgccagtgaacgtgccgcaattgaacagcagatgcgggaagcgggcgttgaggagcagggcagggcgctggtggcgcaggccattgaacagccgctcgatccgcagcgtctggcgcaaggcgtgaaaaacgaagaagaggcgctggaactctattttctgagctgtgccgccatcgatatcgatcactttatggagcgcagctacctgaacgccctgggcgatgcgctgaagatcccccaggacgttcgcgagggaattgagcaggatattcagcagcagaagcagactctcgcgggctag

SEQ ID NO: 1844 - DNA, 2103 bp, Enterobacter cloacae
gatgtaaaacgaaaaagtaagaatgccatgcctccaaaagcccgacgtactccttatgcgatcaccacgcatggcgatacgcgtatcgataactactactggctgcgggacgattctcgttcccggccagaggtgctcgactatctgcacgaggaaaacgactatggccgccaggtcatggccagccagcaggcgcttcaggatcagctcctgaacgaaatggtgcagcgtatcccccagcgtgatgtctctgccccgtggtgcaaaaacggttatcgctatcgccatatttatgagccgggaaacgaatatcccatctaccagcgccagtctgtgctgagcgccgagtgggacgaatgggagatcctgctggatgccaacaaacgtgctgcccacagtgagttttatacgctgggcggcatgtccatttcccccgataacgccattatggcgctggctgaggattacctctcccgccgccagtacggtttgcgtttccgcaatcttgaaacgggaaactggtatcccgaaatgctggataatgtctcccccgatttcgtctggggtaacgattcagaaacggtctactacgttaaaaagcatgcctcaacgctgctgccttatcaggtctggcgtcatacggtggggaccgattccgccgacgatgaattagtctacgaggaaaaagacgagacgttctatgtcagcctgcacaaaacgtcgtctcgccactacgtgatcattttcctctccagcgccaccacctcagaagtgctgctgctggatgcagagctgccggatgcgcagccgctgtgcttcctgccgcgccgtaaagatcatgagtacagcctggatcacttccagcacagcttttacctgcgttcgaaccgcgagggcaaaaactttggcctttataaaaccaaagtgcgcgatgaacgcaaatgggaagtgttaattcccgcgcgcgatcaggtgatgctggaggggttcaccctgtttaccgactggctggtggtggaagagcgtcagcgcggactgaccagtatccgccaaatcaaccgcaaaaaccgcgaagtggtgggcattgcgttcgatgacccggcttacgtaacgtggatcggctttaacccggaaccggaatcgtcccgcctgcggtacggctattcgtcgatgaccaccccggatacgttgtttgaactggatatggacaccgggcagcgtcaggtgattaaacaggctgaggtccggggttttgagtcggaaaattatcgcagtgagcacctgtgggtgaccgcacgcgacggcgttgaagtccctgtatcgctcgtctatcacaaggcgcacttcaacaaaggtaaaaaccccatcctcgtctatggctatggctcctatggatccagcatggacgccgatttcagcagcagcaggctgagcctgctcgaccgcggttttgtttatgcgattgcccatattcgcggtggcggcgaactgggtcagcactggtatgaagacggaaaatttctcaaaaagaaaaatacctttaacgactaccttgatgtctgcgatgcgctgatcgcgcagggttatggcgatccgcagctctgctttggcatggggggcagcgccgggggcatgctaatgggtgccgtcatcaaccagcggcctgaactgtttaaaggcgttatcgcccaggtgccgtttgtggacgtggtgacgaccatgctggatgagtccattccactgaccaccggggagtttgaagagtgggggaacccgcaggatgaaacctattatcgctacatgaaagagtacagcccgtacgataacgtcgaggcgaaagcctatccgcatatgctggtgaccaccggcctgcacgattcccaggtgcagtactgggagcccgcgaaatgggtggcgaagctgcgtgagctgaaaactgacgataatctgctgctgctgtgtaccgatatggactcagggcacggagggaaatcagggcgatttaaatcctatgaaggggtggcgctggagtacgcctttttgattggcctggcgcaggatacgctgccaggccgggcggggactcaggcttcgcctaaataa

SEQ ID NO: 1845 - DNA, 342 bp, Enterobacter cloacae
catatgaaaaagacactgctttctcttttacttctcacctgtgccagcagtgcgctggccgcgccgcaggtcatcaccgtcagccggtttgaagtgggcaaggacaactgggcatttaatcgtgaagaggtcatgctcacctgccgtcccggtaacgcgctgtatgtcattaatcccagtacgctcgtgcagtatccgttaaatgacgtagcggagcagcaggtggccagcgggaaaagtaacggacagcctgtcagcgtgatccaggtggatgacccggcaaaccccgggcagaagaaaagtctggcaccgtttattgagcgcgctgaaaagctctgctag

SEQ ID NO: 1846 - DNA, 501 bp, Enterobacter cloacae
ataatgaacaaaacagaattctacgcggatctgaatcgcgattttaaggcattaatggcaggggaaaccagtttcttagccactctggcaaataccagtgcgttactgttcgaacgcctttctgacgtgaactgggcgggcttttatctgctggaaggcgacacgctggtactggggcctttccaggggaaactcgcctgcgtgcgtatcccggtaggtcgcggcgtgtgcggtaccgcagtggcgacccgtcaggttcagcgtgtcgaagatgttcatgcgtttgacggccacatcgcctgcgatgccagcagcaattctgaaatcgtactgccgctggtggttaaaaatcagattattggcgttctggatatcgacagcacggtcttcagtcgctttactgccgaggatgagcaggggctgcgcgcgctggccgcaaacctggaaaatgttctggcagacaccgattatcataaattctttgcgagcgtcgcaggataa

SEQ ID NO: 1847 - DNA, 516 bp, Enterobacter cloacae
tcaggaaatttcatggaaaatcaacctaagttgaatagcagtaaagaagttatcgcatttctggccgagcgtttcccgcagtgcttcagcgctgaaggtgaggcgcgtcctctgaaagtcggtatctttcaggatttggtcgcgcgcgttgagggggagatgaacctcagcaaaacgcagcttcgttctgccttgcgcctttatacctcgagctggcgttacctgtacggtatcaagccgggtgcgacccgtgtcgaccttgacggcaacccgtgcggtgagctggacgagcagcacgtagaacatgcgcgtaagcagcttgaagaagccaaagctcgcgtgcaggcacagcgtgcggaacagcaggcgaaaaaacgcgaagccgcagcggcaaacggtcaggaagacgcccctcgtcgcgagcgtaaaccgcgcccggcaccgcgtcgtactgaaaataacgatcgcaaaccgcgtgctgtcttcacccacgggcctggaaggaccgcgattgcg

SEQ ID NO: 1848 - DNA, 390 bp, Enterobacter cloacae
cgaaaaggaatgattgtgatgcactttaccccttcccgcgtcgcgtgcgcgctggcatttttgctctcttcagcaaccgcgacctcagctctggcccatgcgcatcttaagcagcaatccccgcaggaaaataccgttgcggtggcaccagaggtcattaccctgaacttctcggaaggcattgagcctgccttcagcggcgtggtggtgacggacgcgcagcagcacaagatccagaccggcgcggtgaagcgtgacgagaaggataacgcaaagctgattgttcctcttgagaaaccgttgacgaccggcacctacacggtggactggcatgtggtctccgtggacggccacaaaaccaaaggcagctatcactttagcgtgaaatag

SEQ ID NO: 1849 - DNA, 777 bp, Enterobacter cloacae
aggccagggaataagggattaatagcgcagcgatctttatttccggctggtttatggtttgtttggattcgcgaaatccgacgccagttcatgacattttctgtggcagctatacttcttacaggaggcgttatatatcagaaaatagagggagaacactggcgtcatgtctgggttgccagcgatattcatggttgctatcagtggcttatggacgagctgaaacgacgacattttaatcctgatacggatctgctgatctcggtgggggatattatcgaccgcgggcctgacagcgtaaaatgtttacagctgatgcaggaaaactggttttatgcgatacgcggtaatcacgagcaaatggcgttagatgcgcttataaataatgattttagtctctggtcgataaatggtggtaactggtttaccggtcttaaggacgctcaacaaaaacaggcgaagggtttactcgacgcgtgtcgggacttaccgcacattattgaaataacctgcaaaaacggtctcaacgtgattgctcatgcggattatccctccgccgaatatggctggcataagccggtggatgcccagcgcgtgctgtgggatcgcgaccggttaatgggctttatggtgggcaaagggcagggcattagcggcgcggatcacttctggtttggacatacgcctgtggacaaacgctacgattttaacaatctgcactacattgatacgggggcagtattcgggggctttctgacgctggcgcagcttcagtaa

SEQ ID NO: 1850 - DNA, 216 bp, Enterobacter cloacae
gaacaaggagagcgcgccattatgaatatcagcgatatcatccaactggttgttctgtgcgcgctgatttttttgccgcttggctactatgcacgccattccctgcgccgtattcgcgatacggtcagattactgttcgtcaaacctcgctatattaaacccgccggaacactgagtcgcgctccgaacgtcaaggcaaaccgaaaacatgactaa

SEQ ID NO: 1851 - DNA, 1587 bp, Enterobacter cloacae
aaattcgacgaaaagagggacaccgtggactccatattttctattggcatccagtcattatgggacgaattgcgccacatgccagtcggaggagtctggtgggttaatacggatcgtaatgaagatgccatcagtctggtaaaccagacgatagcggcgcaggggaaggattcccgcgtggccataattacgatgggcgatgagccaaagtcaatcatcaggctcgacagtaaccgtggaccccagacagtacgattattttccatgcctgcggaggctgacagtctatactttttaccccgcgatattcagtgttctattgttcctgaacactatttactggttctaaaatgctctaataacggcctgcaaaatatcccctctgaaaaactgctgaaatggctggaaagaatcaacagatgggcaaaaaatcaaaattgcaccttattggttgttaacccaggcagtaataatgacaagcttttttcacttttaatgagtgaataccgttctctctatggcctggccagtattcgtgtccagaccgacagccatctttacgacgtggctttctggtgcaatgaaaaaggggtgagctcccgacaacaacttaccctcaaacatgtcggggatgagtggcatcttgctcaacaggaagagacggtagttcagccacgcagtgatgaaaaacgcgttctgagccatattgcggtactggaaggtgcgcctgcactgtctgagcactggtcactgttcgataccaatgaagccttatttgatgaggcgcgcaccacgcaggcggcgaccattattttctcgttgatccagaataaccaaatcgaaacgctggcaaggcacattcacacattacgtcgccagcgcggcagcgcgttaaaaattgtggtgcgtgaaaataataccagcctgcgcgccaccgatgagcgcttattactgggctgcggcgcgaatatggtcatcccgtggaatgctcccctgtcgcgctgtctgacgctgatcgaaagcatccagggccagcagtttaatcgacatgttccggaagatatcagcaccctgctttcaatgacgcagccgatgaaactgcgcggctaccagaaatgggacaccttctgcgatgcggtgggcaacatgatgagcaatacgctgttaccggcagacggaaaaggggtgatggttgccctgcgccccgtgccgggtattcgcgttgagcaggcgcttactctgtgccgccctaaccgtatcggggatatcatgaccattggcgataaccgcctggtgctgttcctctccttctgccgggtgaacgatctggatacggcgcttaaccatatcttcccgcttcctaccggggatatcttctcgaaccgcatggtctggtttgaagataatttgatcagcgctgagcttgtccagatgcgtgccctggctcctgaaaagtgggcgaaaccgttgcctgtgacaagcggtgccaaaccggttctgaacgcgaaacatgacgggcatgtctggcgtcgggtacctgagccgctacgcttactggatgagaacaaggagagcgcgccattatga

SEQ ID NO: 1852 - DNA, 1713 bp, Enterobacter cloacae
gtcgcgctccgaacgtcaaggcaaaccgaaaacatgactaattctacctatacctcttcggcgccatcgccactctggcaatactggcgcggcctgtccggctggaatttctactttctggtgaagtttggtctgctgtgggcaggctatcttaatttccaccctctgcttaacctggtgtttatggcattcctgctgatgccaatcccgaacctcaggctgcaccgtatacgtcactgggtcgctatccccatcggtttcgccctgttctggcatgatacctggctgcccggccctgaaagcatcatgagccagggctcccaggtcgcaggtttcagtgcggactatatgctcgatctggttgagcgctttattaactggcagatgattggcgcggtatttgtcctgctggtcgcctggctgttcctgtctcagtggatccgggtgacggtgtttgtcgtcgcgattatgatctggcttaacgtcctgacgctgacgggcccgagcttctcgctgtggccagccggtcagccgacgacaaccgtgaccaccacgggcggttccgccgccgcgaccgtcgcgacagcaggggatacgcctgtggttggggatattccagcgcagactgcaccgccgacatccacgaacctgaacgcgtggctctccagtttttacgctgcggaagataagcgtcagacgaaattcccggacgcgctgcctgccgatgctcagccgtttgagctgctggtcattaacatctgttctctgtcctgggctgacgttgacgcggctggtttgatgtcgcacccgctgtggtcgcatttcgatattcagttcaaggacttcaactcggccacgtcgtacagcggcccggcggctatccgcctgctgcgcgccagctgcggacagccttcgcataagaacctctaccagccggcagctaaccagtgttatctgtttgataacctggcaaaactgggctttacccagcacctgatgatgggtcataacggtcagttcggtaacttcctgaaagaagtacgtgaacagggtggcatgcaggccccgctgatggaccagaaagggctgccggttacgttgctgggctttgatggctcgccggtgtatgacgataccgccgtgcttcagcgctggttagataccgtcggcaaagaggaagggacacgtagtgcgacgttctataacacgctgccgctgcacgacgggaaccattatcccggcgtgagtaaaacggccgattataaggcccgtgcgcagaagttctttgacgagctgaacgcgttcttcaacgagctggaaaaatcaggccgcaaagtgatggtggtggtagtaccggaacatgggggagcgctgaaaggcgacaggatgcaggtgtctggtctgcgcgatatcccaagcccgtccatcactaacgttccggccgggattaagttctttggcatgaaggcgccgcatcagggagcgccagttgagatcacccagccaagcagctatctggctatctcggaactggtcgctcgcgcagtagacggtaagctgtttgtggaagatagcgtgaactgggatcagctcaccagcgggctgccgcagacggcggaggtatcggaaaacgccaatgcggtggtgatccagtatcagaataagccttatgtccgactgaatgccggggattgggtgccgtatccgcagtga

SEQ ID NO: 1853 - DNA, 1014 bp, Enterobacter cloacae
agttcgctttattggccgaacgggcgaagtgaatgccgtggagaccattgcgtgaaggacaatactattccgttaactctcatcggtatccttgctgatggcgagtttcattctggcgagcagctgggcgaacagctgggcatgagccgcgctgccatcaataaacatattcaaacgctccgcgactggggcgtggatgtgtttacggtgccgggaaaaggctacagcctgccggaaccgatccagttactgaatgaagagatcatccgcagccagattgggcacggtaacgtcgcggtattgccggtcattgattcgacgaaccagtatctgctggatcgcctgagcgagctgaaatccggtgatgcctgcgttgccgagtaccaacaggcaggacgtggccgccgggggcgtaagtggttctcaccatttggcgccaacctctacctttccatgtactggaggcttgcacaggggccagctgcggccatcgggctgagcctggtcatcggcattgtgatggcagaggtgctgcacgatctgggtgccgatcaggtgcgggtaaaatggcccaacgatctgtatctcaacgatcggaagctggcggggatcctggtcgaactgacgggaaaaacaggcgatgccgcacagatcgttattggagcggggctgaacatggtgatgcgaaacgtgcagaacgatgtcgtgaaccaggcctggaccaacctacaggaagcggggatcaccatcgatcgcaatacgcttgccgtccgcatgatcaatgagttgcgtagttcgctgacgctctttgaacaggaggggttagcgccattcctgtcccgctgggaaaagctggataactttattaaccgaccggtgaagctgctgattggggataaagagatttacggcacatcacgcggcattgacgcgcagggtgcgttgcttcttgaacaggatggtgtgattaagccctgggtgggcggtgaaatttcgttacgaagtgcagagtaa

SEQ ID NO: 1854 - DNA, 2643 bp, Enterobacter cloacae
acggccggagcctgccgggagttcagtatgagccgcctgactaactggctgctcattccgccggtcagttcgcgcttaagtgaacgctaccgccattaccgttatcacggcgcctcgtcgctgagcgcagcgctgggctgtttgtggatgattctggcgtggatgttcatccccctcgagcatccccgctggcaacgcattcgcgcgcgccacggtgaactctatccgcatatcaaccctgacaagccgcgtccgctggatcccgcgcgctacgctattcagtccatctggctactggcgacctcaacgggcgcggagaaaaaaacgtcccgctggcgcagcttcgatcgtgtgcagaacctgcgtgaacactaccaccagtggcttgaccggctacccgaccgggtgggcgacaaaacgggtcatttagataaccaaaaagagctcgggcacctacacccgggcttgaggcgttttattctcggcgtggttgtggtgttctcgctgattcttgcgctggtctgtattacccagcctttcaacccgctggcgcagttcaccttcctgatcctgctgtggggcgtggcgctgctggtgcggcgcataccagggcgtttttctgccctgatgctgattgtgctatcgctgaccgtttcctgccgctacatctggtggcgatatacctcaacgctgaactgggacgatccggtcagcctggtgtgcggcttagtcctgctgtttgctgagacttacgcctggatcgtgctggtgctgggttacttccaggttatctggccgctgaatcgacagccggtgccgctgccaaaagacacgacccagtggcctacggtggacctcttcgtgccgacctacaacgaagacctgtcggtggtaaaaaacaccatttacgccgcgctgggtatcgactggccgaaggataaaatcaaaatctggatcctcgatgacggtggccgcgccgagttccgccagttcgcggacgaagtgggggtagagtacatcgcccgtaccacgcatgaacacgcgaaagccggtaacatcaacaatgcgctgaaatatgccaaaggggagttcgtctctattttcgactgcgaccacgtgccaacgcgctcgttcctgcaaatgaccatgggctggttcctgaaggagaaagagcttgcgatgatgcagacgccgcaccacttcttctcaccggacccgtttgaacgtaacctcggtcgttttcgtaaaaccccgaacgagggcacgctgttctatggcctggtgcaggacgggaacgacatgtgggacgccacgttcttctgcggctcctgtgcggtgatccgccggaaaccgctggatgaaattggcgggatcgccgtcgagacggtcacggaagatgcgcacacctcgctgcgtctgcaccgtcttggctatacctcggcctacatgcgtattcctcaggcggcggggttggccacggaatccctgtcggcgcacatcggccagcgtattcgctgggcccgcggcatggtgcaaattttcaggctcgataacccgctgatgggtaaagggctgaagctggcgcaacggctgtgctacgtcaacgccatgttccacttcctgtcgggtattccacggcttatctttctcacagcgccgctggcgttcctgctccttcacgcttacatcatctatgcgcctgcgctgatgattgccctgttcgttctgccgcacatgatccacgccagcctgacgaactcgaagattcaggggaaatatcggcactccttctggagtgaaatttacgaaacggtgctggcctggtacatcgcgccgccaaccatggtggcgctgattaacccgcataaagggaaattcaacgtcaccgcgaagggcgggctggtggaagaggagtatgtcgactgggtgatctcccggccctatatcttcctggtgctgctgaatattgtgggcgtgattgttgggatctggcgctacttctacggcccggaaaacgaaattctgacggtcttcgtgagtatggcgtgggtgttttataacctgattatcctcggtggcgcggtggcggtatcggtggagagcaagcaggttcgccgcgcgcatcgcgtcgaaatcagcatgccagcggccattgcccgcgacgatggacatctcttctcctgtaccgtacatgacttttcggatggcggtctgggtatcaagatcaacggtcaggcgaaggtgctggaggggcagaaggtcaacctactgcttaagcgcggccagcaggagtatgtcttcccgacgcaggtggtgcgtgtgagaggaaatgaagtgggtctgcaactgatgccgctgaccaaaaaacaacacattgattttgtgcagtgtacgtttgcccgcgcggatacgtgggctctctggcaggacagcttccctgaggataagcctctggaaagcctgctggatattcttaagctggggttccgtggctatcgtcaccttgcagaatttgccccgtcgtcggtgaaattaattttccggtcacttacttcactggtttcctgggtcgtgtcgttcattccgcgtcgacctgagcgagatgaagcgaagcaggcggacccggttatggctcaacaatga

SEQ ID NO: 1855 - DNA, 3507 bp, Enterobacter cloacae
attactaccggattggggccaggaatgcgcacgttcacactgaatctactcaccttatcgcttggcctggcgctaatgcccctggcccaggccgccaactccccgcagcagagacagctgctggaacaggtccgtctgggggaatccacccagcgtgaggatttagtgcgccagtcgctctatcgccttgagctgatcgatcccaacaacccggatgtgattgccgcgcgcttccgctacctgttacgacagggcgatacggcgggcgcgcaaaaagagctggatcgcctgaaaggaatggcagccgattccagtgcctaccagtcctcccgtactaccatgctgctctccacgccggatggtcgccaggccctccagcaggctcgcctgcttgccaccaccgggcacacgcaggaagccattgccgcgtatgacaaactgtttgacggtaagccgcccagcggcgacatcgcgacggagtactggaacgtggtggcgaaagagccagcccgccgcaacctggccattaatcagcttaagaaaataaacgccagcagtccgggcaacgtcccgctacagtcctcgctggcacagcttctgttccagagcggacggcgtgatgaagggttcgcggtgttgcaggagatggccaaatcgaataatggccgcagtcaggcgtcggacatgtggtaccagcagatcaaagatcagccggtcagcagcgccagcgtcaccgcgctgcaacaatacctgagcgtattcagcgatggcgataacgtgacggcggcgcgcacccagcttgaagcacagcaaaaacagctcgccgatccggcgttccgcgccaaagccgaagggttagccgcagtggatgccgggcagggcagtaaagcggtaacggagttgcaaaaagcagtcagcgccaaccacgctgacagtgaagccgtaggcgctctggggcaggcctattctcagaaaggcgatcgcgcgcgtgcggttgcgcagtttgaaaaggcgatcgccctcgatccgcagagcgataaccggggcaaatgggacagcctgctgaaggtcaaccgatactggctgctgatccagcagggggataacgccctgaaagccaacaatacggcccaggccgaacgctattaccagcaggcgcgcaatatcgacaatactgacagctacgcggttctggggctcggtgatgctgcggcggcgcgcaaagataacgacgcggccgagcgctattaccgccaggcgttgcggatggacagcggcaacagcaacgcggtgcgcggtctcgccaatatttatcgcgcgcagtctccggagaaggcgacgcagtttattcagtcgctctctgccagccagcgccgcagcattgatgatattgaacgtagcctgacgaacgagcagctgtcagcccaggctgaacagctggaaagcgaggggaaatatgcgcaggccgcagaaattcagcgccgacgccttgcgctttccccgggcgacgtgtggatcacctaccgactgtcacgcgatctgtatagcgcgggtcagcgcagccaggcggataacctgatgcgtcagctggcaagtcagaaaccgggcgatccggatcaggtttacgccagcgggctgtacctgtccggtaacgatcaggaccgggcggcgctggcgcatctgaacacgctgccgcgcgacaagtggaacggcaacattcaggcgctggcggaccgcctgcaaagtaaccaggtgctggaaaccgccaaccgcctgcgcgacagtggaaaagagcaggaggcggaaacgttgcttcgccagcagcctccgtccacccgtatcgacctgacgctggcggactgggctgaacagcggggcgatcatgaggccgcgaaaaccgcctacaacaccattctgcaacgcgaaccgcagaacgaagacgcgatcctcggcctgaccgaggtctctcttgcccagggcaacaaggacgcggcgcgcgcggcgctggcgaaactgcccgcggcacagaacggcgaaccgctctccatcaatatgcagcgccggcttgccatggcgcaggccggactgggtgatcctgccgcggcagaaaagaccttcaacgccattcttccgcaggccaaatcgcagccgccttcgatggaaagtgcgctggtgatgcgcgatgccgcccgtttccaggcacaaaatggtcagcctcagcaggcgctggacacctggaaagatgcgatggtctcatcgggcatcacaacgacccgtcccaccgataacgacagctttacgcgactcacgcgtaatgatgagaaagatgactggctgaagcgcggcgtgcgcagcgatgcaggcgatctttatcgtcagcaggatctgaacgtcacgctgcaacacgactactggggctccagcggcacgggaggctattccgacctgaaagcgcacaccaccatgctccaggttgatgcgccgctgtcggatggacgtatgttcttccgtagcgatctggtcaatatgaacgccggttcctttgacaccgataacggaacttacgatccgacatggggtacctgtgccgaaacgccatgtcacggcagcacgaaccagtcggccaacggcgccagcgtggccgtcggctggcagaacaaaacctgggcgtgggatatcggtacaacgccgatgggcttcgacgtggtcgatgtggtgggcagcctgagctacagcaacgatttagggccgattggctacaccctgaacgcccatcgccgtccgatttccagctcggtgctggccttcgccgggcaaaaagatcccaataccgacaccacctggggcggcgtgcgtgccaccggtggcggcgtgagcatgagctacgacaaaggcgaagctaacggtatctggtcaagcctgagtgccgacagcctcaccgggaagaatgtcgaagataactggcgcgtccgctggatgaccggctattactacaagctcatcaatcagaacaacgaacgcctgacggtgggcgtgtccaacatgctctggcattacgataaggatttaagtggctattcgctgggccagggcggttactacagtccccaggagtatgtgtcgttcgccttaccggtgaactggcgtaaacgcacagagaactggtcatgggagctgggcggctccgtctcctggtctcattcaaaaacaaaagatgtgatgcgttatccgttacaggggctgatcccggacaatgagccaggccgttataccgataaaggtgtgatggaaaccggaagtagctcgtcaggcacgggttataccgcaagggcgattgttgaacgccgcgtgacgtccaactggtttgtcggtctgggcgtcgatattcaggaagcaaaagactataccccgagccatgcgctgctctacgttcggtattctgccgcgggctggcagggtgatatggacttaccaccggaaccgctggtgccttatgcagactggtga

SEQ ID NO: 1856 - DNA, 2100 bp, Enterobacter cloacae
gtctgtcttaaaagtgcagctatcgggtatactcggacgcaccaggtttacaccctggtgcgccctgcgcttcgagttttgtggagagtcattttgcgtgtcagccgttccttaacgatcaaacagatggcgatggtgtctgccgtcacaatgctgtttgtcttcatcttctgcgtcattttgctgtttcactccgtacagcagaatcgctacaacacggcttcgcaactgggaagtattgcccgctcggtgcgggaacccctgtcagcctcgatcctgaaaggggatatccccgaggcggaatccatcctgaagcgcattcagcccgctggtatcgtgagccgcgcggatgttgtactgccgaaccagttccaggcgctgcggatgagctttatcccggagcgttccgtcccgatgatggtgatgcgcctgtttgaactgccggtgcaaatttccctgcctctttattccctggaaagaccggctaacccgcaaccgttggcctacctggtgctacaggccgactcgtaccgcatgtataaattcgtcatgagttgggttgctacattagtgaccacttacttacttttgacattaatgctgagcgtggcgctgacgtggtgtatcaaccggttaattgtgcatccgttgcgccgcatagcccgggagctgaacgacctctctccacaggagcacatggggcatcagcttccgttgccgcgcctgcatcacgatgatgaaattggcatgctggtccgcagttacaatatcaaccagcagcgtgtcctgcgtcagcaggaagagctcagtagcaacgccacccgttttccggtatctgatctgccaaacaaagcgtttttaatggccttgctggagcagaccgtcgcccgccagcagaccaccgcgctgatggtaattgcctgcgaaaccttgcaggacacggcgggcgtgctgaaagagagccagcgcgaaatgctgttactgacgctggtggaaaaggtgaaatccgttctggcgccgcgcatggtgctcacccaggtcagcggctatgacctggtggtgatcgcgcacggtgttaaagagccgtggcacgccattacgctaggtcagcaagtactcactgtcattaatgagcggctgcccattcagggtatccagcttcgcccgagcgccagcatcggtattgcgatgtactacggggggctgaccgccgagcagctttatcgtcgggctttctcggccgcgttcaccgcgcgccggaaagggaaaaaccagatccagttctttgatccggagcagatggaaaaagcccagcagcgcctgacggaagagagcgacattctgacggcgatggacaatcgccagtttgcgctctggttacagccgcaggtcaatttgcgcacgggtgaagtgaccagcgccgaagcgttgctgcgtatgcaacagccggacggcacgtgggagctgcctgaagggatgatcgaacgtatcgagtcctgcggcctgatggtcaccgtcggctactgggtgctggaagagacttgccgccagcttgcggcctggcaacaacggggcatcacgctgccgctgtcggtgaatctctctgcgctacagctgatgcacccgaccatggtgccggagatgcttgagttgatccatcgctaccgcatccagccccacacgttgatcctggaagtcaccgagagccgttgtatcgataatcctgacgacgctgtcgccatcctgaaaccgctgcgtaatgccgggatccgcattgcgctggacgatttcggtatggggtattccggcctgcgtcagctccagcacatgaaaacgttgccggtggacgtcctgaaaatcgacaaaacctttgtggaagggctgccggaggattgcagcctggtgcaggccattattcagatggcgcacagcctgaatctgcacgtcattgccgagggtattgaaaccgacgcccagcgtgagtggctggctgcggcgggcgtagagagcggacagggcttcctgtttgatcgcgccgtaccgacggatatctttgagcaacgctatctcgccgacgctggcaataacgcaaaagtgtaa

SEQ ID NO: 1857 - DNA, 567 bp, Enterobacter cloacae
ccttacaaagcctgtagtttttctttccagggacaccctatgaaaacctcactcttcaaaagtctttacttccaggtcctgacagccatcgccatcggtattctgctcggtcactactacccggagctgggcgcgcagatgaaaccgcttggcgacgcgttcgttaagctcatcaaaatgatcatcgcgccggtcattttctgtaccgtggtgaccggtatcgctggcatggaaagcatgaaggcggtcgggcgtacgggggcggttgccctgctgtacttcgagattgtaagtaccatcgcgctgattatcggcctgattattgtcaacgtggtacagcctggcgcgggcatgaacgttgatccggccacgctggatgcgaaagcggtggcggtttacgctgaacaggcgaaagatcaggggattgttgccttcctgctggacgtgatcccgagcagcgtgattggcgcgttcgccagcggaaacatcctccaggtactgctgtttgccgtgctgtttggctttgttcttcaccaacagggggccgaaggatccgcacatgcccgt

SEQ ID NO: 1858 - DNA, 1176 bp, Enterobacter cloacae
ggaactgccaggcatcaaacaagtgaagaggccatccgcaaggatggcctttttgcgtttctacacctgcttcctttccataaacaaatcacctatccccccatatatacggtaaactatcccggtttttgcatcaggatagcgtctatgaatcactcccttaagccctggaatacctttggtattcaacggaatgctaatcaaattgtacgtgccgaaagtgctcagcagttgctgaatgcatggcaaaacgcaacaggaaacggtgaacccgtacttattctgggcgaaggaagtaatgtcctgtttctcgatgattttgcggggacggtaatcgtcaatcgcatcatggggattgagtgtaaagagagcgctgacagctggcatttacacgtgggtgctggcgagaactggcaccatctggtgcaatatacccttgaaaaagggatgcccggactggaaaacctggccctgatcccgggctgtgcaggatcatctcctattcaaaacatcggtgcctacggcatcgaactgaaacacgtctgcgaatatgtcgattgcatcgaactcgcgaccggaacggcgaagcgcctgaccgcagagcagtgccgctttggttatcgcgacagcattttcaagcacgattatcaggatcgtttcgtcattgtggccgttggtctgcgcctggcgaaagcctggaaacccgttctgacttacggcgatctgacccgtcttgacccggctaccgtcacaccgcgtgaggtatttgattccgtatgccacatgcgcatgaccaagctcccggacccgaaagtcaacggaaatgcgggcagtttcttcaaaaacccggtgatcagcagcgaaaatgcaaaagcatttctcgctggctggccaacggccccgcattatcctcaggcggatggcagcgtgaagctggccgcaggctggcttatcgatcagtgtgaattaaaaggtactactcttggtggcgctgctgttcatcgtcagcaggcgctggtactgatcaaccagtccaacgcgacaagtgaggatgtcgtcaacctggcgcaccatgttcgtcagcgcgtgggcgaaaaattcaacgtctggctggagcctgaagttcgctttattggccgaacgggcgaagtgaatgccgtggagaccattgcgtga

SEQ ID NO: 1859 - DNA, 783 bp, Enterobacter cloacae
gtttgcccaacaacaataaggaagccattgatggctgtactaggattacagggcgtccgtggtggggtgggtacaacttccgttaccgcggcgctggcgtggtcattgcaggtattaggtgaatcggtactggtcattgatgcctgttccgataatttgctgcgcatgtcattcaatgtcgactttacgcatgcaaacggctggggacgtgcgcttctggacgataaagactggcgggatgcgggtttgcgttatacctcccagctcgatttgcttccctttggtcaattgaccgaaaccgagcgcgggaatgaagccgcgtaccagcgcctgttctctcgcttcatcaccgcattgcagagcctgaaagagagcgggcactaccagtggatcctgctggacctgccgcacggtgccgcgtcgctgacccgccagctgctggcgcagtgcgaccatgtgctctccatcgcgaacgtagatgcgaattgtcatatccgtctgcatcagcagccgatgcctgccaatgcccatattctgatcaacgatctgcgcattggcagccagatccaggacgatctctaccaggtctggctccagagtcagcgccgcctgttgccgatggtgatccatcgtgacgaagcgatggcggagtgcctcgcgtccaaacaacccctcggggagtaccgtagcgattcactggcggcggaagagatcctgacgctggccaactggtgtctgctgcactttgctaaacggccggagcctgccgggagttcagtatga

SEQ ID NO: 1860 - DNA, 2541 bp, Enterobacter cloacae
ttttccggtcacttacttcactggtttcctgggtcgtgtcgttcattccgcgtcgacctgagcgagatgaagcgaagcaggcggacccggttatggctcaacaatgatgataacgcgatgaaaacaaaactttcctggttatgtgcagtggcaatggggatgagtgcgctccctgcaacagtggctaacgcggcgcctgataacgcagcgaccacgcccgcgccaacggtgcctgtcgtcgcgcaagcgaccgatccggttgtgacggccgcgccggggcagacggagaacgttgtcccgaatcagccgacgacggggaatacgctgcccggcgacaacccggtggttgggcaggtcatgcctggcgtgccgggagccagtgcgccggtggttgccgaaaatacgccgtcgcgtgacgttaagctgacgtttgcccagatcgcgcctcctccgggcagcatggttctgcgcggcatcaacccaaatggcggtatcgaattcggtatgcgcagcgatgaagttgtgtcaaaagcgatgctcaacctggaatacaccccatcgccgtcgttgctgccggtgcagtcccagcttaaggtctatctgaatgacgagctgatggacgtcctgcccgtcaccaaagagcaactgggtaagaaaaccctggctcaggtgccgattaatccgctgtttatcaccgactttaaccgcgtgcgtctggagtttgtcggccactaccgcgatgtctgtgaaaacccggccagcagcaccctgtggctggatgtcgggcgtaactcttcgcttcagatgacctatcagccgctggcgttgaaaaacgatctctccgccttcccggtgccgttcttcgacccgcgtgataaccgtccgctgaatctgccgatggtctttgccggctcgccggatgtgaccgaacagctggcggcctctatcgtggcatcctggtttggttcccgctccggctggcgtggtcaaagtttcccggtcatgtacgacaaaatgccagacaaaaacgcgattgtgtttgccaccaacgccaaacgcccggcattcctgcgtgaccatccggaggtgaaagcacccaccatcgagatgatcagccatccggacaatccgtacgtgaagctgctggtgatcttcggccgtgatgacaaagatctggtgcaggcggcgaagggcattgcgcagggaaatatcctgttccgcggtaacagcgttgtggtggatgaggtgaaaccgctgctggcgcgtaagccttatgatgcgccgaactgggtacgtaccgaccgggcaatcacctttggcgagctgaaaacctatgaagagcaattgcagtcaaccgggcttgaaccttctcctgtcagcctgtcgctgaacctgccgccggatctctatctgctgcgcaccaacggcattgatatcaacctgaactaccgttacaccgcgccggcaaccaaagacagctcgcgcatggatatcagcctcaacaaccagttcctgcaatcgttcagcctgaccagcagccaggagacaaaccggttgatgcttcgtctgcctgtattgcaggggctgctggatggcaaaaccgatgtgtcgatcccggcgctgaagctcggtgcggtgaaccagctgcggtttaacttccagtatatgaaccccatgccgggtggatcggtggaaaactgtattaccttccagccggtgcaaaaccacgtggtgattggcgatgattccacgatcgacttctcgaagtattaccactttatcgcgatgccggatctgcgtgcctttgctaacgccagcttcccgttcagccgcatggctgatctctctgaatcgattgtcgtgatgccaaaagcggccaacgaaggtcaggttgccacgctgctggacaccatgggtaccgttggggcgcaaaccggcttgccggctatcaacgtgacggtgacggatgacggtagtcagatccagaacaaagatgccgatatcatggtcatcggcaacattccggacaagctgaaagacgagaagcgcgtcgatctgctggtgcaggcggctcagtcatgggtcaacacgccgctgcgtcagaccgagttcccgagcatcatgccggacagcggcgatcgtcaggccaatatcaggacgaccgtaagttcaacgggtccgatggccgcgattgtcggcttccagtcgccgtataacgaccagcgcagcgttatcgccctgctggcggacagcccacgcggctatgagctgctcaacacggccatgaacgacagcggtaaacgggcagcaatgttcggttccgtctcggtgatccgtgagtcgggggtaaacagcctgcgcgtgggggatgtctactacgtcggtcatctgccgtggttcgaacgcctgtggtacgccctgtctaaccacccggtgctgctggccgtgctggctgcgctcagcgtcgtattgctggcgtgggtactgtggcgtctgctgcgaatcatcagccgtcgtcgtcttaacccggaccatgagtaa

SEQ ID NO: 1861 - DNA, 1113 bp, Enterobacter cloacae
gcggtgatgaaaatctttcgcgggtgtgtagtcgcagcgttgatgctggcggcggcgaatcttcacgctgcctgtcgctggcctgcctgggagacgttcaagcaggattatatgagcgaaagtgggcgggtcattgatcccagtgacgcgcgcaaaatcaccacctccgaagggcaaagctacgggctgttctttgccctcgcggcaaacgatcgcaaggcgttcgatctgctgctggcatggacgcgcgataaccttgccgagggagatttagcccaacatctcccggcctggctgtggggaaaaaaggacgacgaaacctgggcggttatcgaccctaactccgcgtctgatgccgatatctggattgcctggtcgctgctggaagccgggcggctgtggaaaaatcccgattacacgcgcacgggtaaggcgctgttgacgcgcattgccagtgaggaagtggtgaaggtgccggggctgggttctatgctgctgccgggtaaagtcggttttgccgaagagagtgtctggcgcttcaaccccagctacctgccgccgcagcttgcgagctatttcacccgttttggcgcgccgtggacgacgctccgtgaaactaacctgcgtctgctgctggagaccgcgcctaaaggattttccccgaactgggtgaaataccagaaaaagggcggctggcagctgtcgcaggatgcatccctgatcggcagctacgatgcgattcgcgtctatctgtgggtagggatgatgaacgataacgatccgcagaaagcccggctactggcgcgtttcaagcccatggcgaccaccacgatcaaacaaggcttgccgccggagaaagtggatgtagcaaccgggaaacgcaccggagatgggccggtagggttttctgcctctctccttccgtttttacaaaaccgggacgcgcaggcggtgcaacgccagcacgtcgccgatcgttttcccgataacaatgcttattacagctacgttctgaccctctttggacaagggtgggatcagcatcgttttcgtttcaccgtgcaaggtgaattactaccggattggggccaggaatgcgcacgttcacactga

SEQ ID NO: 1862 - DNA, 249 bp, Enterobacter cloacae
tgggcaggacgcctcgctgcatctgaatcttatgattttactcaaagggatgaaaaaagaatgcaaaataacgaacccgcaaccccagtcgactcaagtctgggttacacattccagaacgattttttggcactcacgcaggctttttctttgcctgaaatagattacaccgatatttcccagcgggaacagttggcggcggctattaaacgttggccgttattagctgagtttgcccaacaacaataa

SEQ ID NO: 1863 - DNA, 348 bp, Enterobacter cloacae
cggaacttacgatccgacatggggtacctgtgccgaaacgccatgtcacggcagcacgaaccagtcggccaacggcgccagcgtggccgtcggctggcagaacaaaacctgggcgtgggatatcggtacaacgccgatgggcttcgacgtggtcgatgtggtgggcagcctgagctacagcaacgatttagggccgattggctacaccctgaacgcccatcgccgtccgatttccagctcggtgctggccttcgccgggcaaaaagatcccaataccgacaccacctggggcggcgtgcgtgccaccggtggcggcgtgagcatgagctacgacaaaggcgaagctaa

SEQ ID NO: 1864 - DNA, 1020 bp, Enterobacter cloacae
gtaaggtgtatgtcacccaccatctatgatattgcccgcgttgctggtgtttcgaaatcaaccgtgtcgcgcgttctgaataaacaaacgaatatttctcctgaagcgcgcgaaaaggtgttgaaggcgatagaagaattaaattatcaaccgaataaacttgcccgcgcactcacctcttctggcttcgacgccattatggttatttcgacccgttcaaccaaaaccaccgcagggaatccgtttttctctgatgtactgcatgccataacggcaaaagcagaagaagaaggttttgatgttattttacaaacgtccaaaagcagcgaagatgatctgcaaaaatgcgtgggtaaaataaagcagaagatgatcaaagggatcatcatgctaagctcgccggcgaacgagtcttttttcgcgacgctggacgaatacggtgtgcccgtggtcgttattggtaaagtggaaggcaattaccagaatatctattctgtcgacacggataatttccacgacagcgccatattaaccgactcatttatcaaacatggtcgcactaaaattgcctgcctgcatgccccgctcgattatcacgtttctatcgatcgcctggcgggctataaatcgagccttgagaagcacggtattgcgattaatccggactgggttattgatggcggatatacccatgaaagcgcgcttcaggcggcctgtcagctactctcatcagacaacccgcctgatgcagtttttgcgacggacagcatgaaattgctaagtctttatcgtgccgcggatgagctaaatctgacgatcccggaacaggtcgcaatggcaggatacagcgacccgatgctatctctcattttaacccctgcaccaggcggttttgatatccccacgagaaagctgggcgaagagagctgcgatttgttgttcaggtgcattgcgggtaaacctgccccgcataaggtattggttgaaacgcatttttcagatgcggcttcattacgctaa

SEQ ID NO: 1865 - DNA, 807 bp, Enterobacter cloacae
tgtcaggcaattttccacacacacggaaactatttgattaagcgcggcttttgcacaacactgccagaagtgactttatcatcagggtttactatggcaactacccgaccaagaacggaacgcggcgccttcccgcccggaactgaacattatggacgctcatttttaggcgcgccgctgatctggtttccggcccccgaggccgatcgcaatagcggcttaatcattgcaggcacgcatggcgatgaaaactcgtctgtcgtgacactctcgtgcgcgctacgtacgctggcccccgatttacgacgtcatcatgtgattttgaccgtcaacccggacggttgtcagcttggattgcgggcgaatgcacgcggcgttgacctgaacaggaacttcccggcggcaaactggcgcgccggtgaaacggtgtatcgctggaacagttcggcgcaggagcgagatgtggtcctgctcacgggagacaaacccggttccgaaccggagactcaggcgctatgccagcttattcataagatccacccggcctgggttatctctttccacgatcccctcgcctgtattgaagatcctcgtcatacggcgctcgggcagtggctggcggatgcgtttgctctacctctggtgagcagcgttggctatgaaacacccgggtcgtttggcagctggtgcgcagacctcagccttcactgtatcaccgcagagtttccgcccatctcctcggatgaagcgagcgaaaaatacctgcgggcgatgacagatctcctgcgctggcagcctcaaagatga

SEQ ID NO: 1866 - DNA, 531 bp, Enterobacter cloacae
ctatttgtaaacaggaagatatctatgtcacaactcgttcatttccagggcaacccggttgctgttgcaggttccatcccacagtctggcagcaaagcacagccttttactctggtggctaaagatctgtctgacgtcacgctgagccagtttgctggcaagcgtaaagtcctgaacattttcccaagcatcgatactggcgtttgcgctgcatcagtgcgtaaattcaaccagctggcgaccgaaatggacaacaccgtagtgctgtgcatttctgctgacctgccgtttgcccagtcccgcttctgcggcgctgaaggcctgagcaacgtcatcaccctatccactctgcgcagcccggatttcctggaaaaatacggtgttgccatttccgaaggcgcgctgaaaggtctggctgctcgtgcggtgctggtgatcgacgaaaacgacaacgttgttttcagtgaactggtgaacgaaatcactaccgaaccggattacaccgctgcacttgaggcgcttaaagcctaa

SEQ ID NO: 1867 - DNA, 838 bp, Enterobacter cloacae
gttgatccgagcgaatgtccttcctgccgcctcgtgtgaaaacggcgacattatcggatctggtgcggacgtgacggaataccagatcggcgacagcgtctgctgctacggcccgttgcaggaaacggtcatcgtaaacgcggtgaacaactataagctgcgcaaaatgccgcagggcgcatcctggaaaaacgccgtttgctacgatccggcgcagttcgccatgagcggcgtgcgtgatgctaacgtccgcgtaggggatttcgtcgtggttgtggggctgggcgcgattggccagattgcgattcagctggcgaaaaaagccggcgcgtcagtggttattggtgtcgatcctatcgaacatcgctgtgagatcgcccgccgtcacggtgcggaccactgcctgaacccaatcggtaccgatgtcggtctggaaattaagaaactgaccggcaagcagggcgccgatgtgatcatcgaaaccagcggatttgcagatgcgctgcaatctgcgctgcgcggtctcgcctacggtggaacgatctcctacgtggctttcgccaagccgtttgcggcaggcttcaaccttggtcgcgaagcacacttcaataacgccaaaattgtcttctcccgcgcatgcagtgaacccaacccggattatccgcgctggagccgcaagcgtattgaagagacctgctgggaattgctgatgaacggttatctcaattgcgaagatctgatcgacccggtcgtcaccttcaccaccagcccggaaagctatatgaagtatgtcgatcagcacccggaactcagtatcaaaatgggcgtcactttttaa

SEQ ID NO: 1868 - DNA, 1077 bp, Enterobacter cloacae
atgctaaggatgacgagcgtgatgagtgcttctacacctttgcctctgcgcgtcgccatcattggcgccgggcaggttgcagacaaagtgcatgcctcgtattacgccacgcgcagtgatgttcaaatggtggctgtcatggacagccgccttgagcaggcacaggcgttcgcggaacgttatgctattccatcggcatggcaggacgctcacgagatgttgcaggaagtaaaaccggatgtggtgagcgtctgttcgcctaaccggttccattttgaacatgtgatggcggctctcgaagcaggttgtcatgtgatgtgtgaaaagccgccggcgatgacgccgcaccaggcggatgagatgcgtctcgcggcgcgcaaggccggaaaagtcctcgcgtacgattttcaccatcgctttgcgctggatacccagcacctgcgcgatgcggtaatgaacggaacgctcggtgaaatttacttcacctccgcgcaggcgctgcgtcgttgcggtgtgccggggtggggcgttttcaccaataaatcgctccagggcggcgggccgctgatcgatatcggcattcatatgctggacgccgcgatgtacgtgctgggtttcccgcccgtgaagcgggtaaccgcgcacagcttccagagactggggaaccggaaacacaccggccagtttggcgaatgggatcctgcgcagtttaccgtggaagatgccctgtttggcacgattgagttctgcaacggtggcattctgcgtctggacacctcttttgcgcttaatatccgcgagcagtcgatcatgaacgtctctttctgcggtgagaaggcgggtgcaacgctgttcccggcacacatttataacgacgaagccggtgttttacagacgctgacccagcgggaagaagctgacgatcgccgacatctgcgcagtatggacgcgtttgttcgccacgtattgggcgagccggtcatgattgccgatgcggagcaggggctggtgatccagcaattagtcgcggcgttatatgaagccgcggaaacaggggaaagcgtgacgttatgctga

SEQ ID NO: 1869 - DNA, 765 bp, Enterobacter cloacae
cgctgtggggtaaaacgctgcatgtatcagggcggaaggtctgtgaacgtaaggactttcttgtacctgttaatgggaccgctaccacggaggggcgccatgacgcttaacgctgttgtattcgatctggacggggtgatcaccgataccgcgcatcttcactttctggcctggcgcgccgtggcggaggagattggtatcaccttcgatgaagtatttaacgaacagctgaagggaataagccgtatggactccctccagcgcattttgatacatggcgggaaagaggggatgttcagtgacgagcagcgcctggcgctggcgaggaaaaaaaacgcgctttacgtccagtcgctgtcatcactgacgcaggattcgctgctgccgggtattcgcgacgtgctggcggatattcgcgccgcgaaggtcaaaattggcctggcatccgtatcgcttaatgctcctgggattttgcacgcgttgggtattcatcaggctttcgatttttgcgccgatgcttcgcgtattagccgctcaaagccggacccggaaatcttccttgcggcctgtaaaggactgaacgtgcgtcctgaagaggccattggtatcgaagatgccgccgcaggggtagatgcgatcaacgccgcaggaatgctgtcggtcgggattgggcctggcctgaaccatgcgggattacaacttcattcaacgcaggaactgacctgggaacgcctgacggcgttctgggcatcccgggcgtattga

SEQ ID NO: 1870 - DNA, 927 bp, Enterobacter cloacae
aggaatattttaatgagtactctactaagaagtgctgcgctcgtcctgtgcgcaggggtgagctgcgcgcaagcaactgaatcagccaaacagtgggaatttaatattggtgccatgtatgaaattgaaaacgtcgaaggtcaggccgacgataaagatggattatatgaaccctccgtgtggtttaatgccacttgggatgcatggaccatttcgctggctatgtatcaggaagggccggttgattacagtagcatgacgcgcggcacctatttcgatcgccccgaggtagaattacgctatcgtattattggtaccgatgatttcacgctgggactgacgggtggtttccgtaattacagctatcatttcaaagatgaggatggcgcgaaagcgggcagcgcaaatatgcagcgctataaaattcaaccggactgggatgtaaaattaaccgatgactggcgttttggcggatggtttgccatgtaccagtttgcgaatgacctggcaaaaaccggttattctgacagccgtgttgaaacggaaaccggttttacctggacaattaacgaaaccgtctctgcaaaagttaattactatttagagcggggtttcaatatggacagttcacgtaataacggtgaattctccactcaggaaattcgcgcctatctgccgatttcattgggtcagacgacactaacgccttatacccgtctgggactcgatcgctggtcaaactgggactggcaagacgatcctgagcgtgaaggacatgatttcaaccgtttgggtatgctgtacgcctatgattttaacaatggtttatccatgacgctggaatatgcctacgaatgggaaaaccatgacgaaggggaaagtgaccgcttccactatgccggtatcggcgtgaattacgcgttttga

SEQ ID NO: 1871 - DNA, 1032 bp, Enterobacter cloacae
tgtatgtcatccgcagttagcacggcaaaccaattttctgcctttccggcctgcaaggagtcagtgatgagaagcgttaaggtctatgaagaagcctggccattgcacaccccgtttgtgatctcgcgcggcagccgtaatgaggcctgcgtggtcgtggttgaatgtgaagaggacggcgtaaaaggcgtcggagaatgtaccccttatcctcgctacggagaaagcctggcgtcagtcatggcgcaaattatgacggtggtgcccgagttgcaggcgggcctgacgcgtgaggctcttcagcttcggttgccggccggcgcggcacgcaacgcgattgactgcgcactctggagtctggaagcggcgaaacgacaaaaaccgctgcctgcgctgctggacgttacgctgccgcaatcgatcgtcaccgcgcaaacggtggtcatcggtgaaccagagcaaatggccgccagcgctcaggcgttgtatgccacaggtgcaacattattaaaggtgaagctcgacgatcgtctgattagcgaacgcatggtcgccattcgtgcggcggtacctgatgccactcttatcgtcgatgcgaacgaatcatggcacagcgaagggctggcagcccgttgtcagctgcttgccgatctgggcgttgccatgctggagcaacccctcccggcagaagacgatgccgcgctggcgaattttattcatccgcttcccgtctgtgcagacgaaagctgtcatacccgtgagagcctgtcagccctcaagggacgttacgaaatggtgaacattaagctggataaaacaggtggattaaccgaggctctggctctggcacaagatgcgcaggcgcaaggctttgctctgatgctgggctgtatgttgtgtacgtccagagcgatcggcgctgcactcccgctggtgaacagcgtgcgctttgccgatctggacggcccaacctggctggcggttgacgtctcacccgcgctgaattttacctccggcgtacttcatctttga

SEQ ID NO: 1872 - DNA, 858 bp, Enterobacter cloacae
agtatgtcgatcagcacccggaactcagtatcaaaatgggcgtcactttttaagctaaggacagcaatcatgaaaatcgcaacacaaaaccaggcctttttcccgaccgctatcatggaaaaattcgaatacatcaaagcgatgggatttgatggctacgaaattgatggccgactgctggtggaaaacctcgacgaagtaaaagcggctatcaaagccaccggcctgccggtcacgacggcctgtggcggatacgatggctggatcggggatttcattgaagaacgccgcctgaacggtctacagcagattgaacgcattctggaagcgctggcagaagtgggcggaaaggggattatcgttccggctgcctgggggatgtttaccttccgtctgccgccaatgacttcgccacgtagtctggacggcgatcgcaaagcggtcagcgcttccctgcgctggctggatgaggtggcagcgcgcaccggtactaccgtctacctggagccgctgaaccgctatcaggatcatatgatcaacactctggccgacgcgcgtcgttatatcgaagagaacggcctgaagcacgtgcagatcatcggtgatttctaccacatgaatattgaagaagactccctgacggaagcgctgcatcagaaccgcgacctgctgggtcatgtgcacattgctgataaccaccgctatcagccgggcagcggcagcctcgatttcgccagcctgttcgatcagctgcgtgccgataattatcagggttacgtcgtgtacgagtgccgggtgcgtgccgacgatccggctcaggcctataaggactctctcacttacttgcgtgaatgctaa

SEQ ID NO: 1873 - DNA, 1125 bp, Enterobacter cloacae
cggcgttctgggcatcccgggcgtattgataaggaattaataatggctcaactgtctctgaaacacattcagaaaatttatgataaccaggtccacgtggtgaaggatttcaacctcgaaattgaagacaaagaatttatcgtcttcgtcggtccatcgggttgtgggaaatccacgacgctgcgaatgattgccggcctcgaggagatcagcgcgggtgaactgattattgacggggtttgcatgaatgatgttcccgccaagtcccgtgatatcgcgatggtcttccagaactatgcgctctatccgcatatgacggtctacgacaacatggcgtttggcctgaaaatgcaaaaaattgcgccctccgtcattgaagaacgcgttacctgggcggcacagatcctgggcttgcgcgattacctccagcgtaaacctggcgcgttgtccggcggtcagcgtcagcgcgtggcgttaggcagggcgatagtgcgcgaagcgggggtgttcctgatggatgagcccttatccaacctcgatgccaaacttcgtgtgcagatgcgcgctgaaattagcaagctgcatcagaagcttaataccaccatgatttacgtgacgcacgatcagacggaagccatgacgatggcgacccgcatcgtgattttaaaggacggcatcattcagcaggtgggcgcgccgaagcaggtctacaacgagccggcgaatatgttcgttgcaggatttattggctcaccggcgatgaacttcattcgtggcgcaatcgacgaccgctattttgtgacggaaacgctgcgtctggagatcccggaggacaagctggccgtactgaatgcgcaaggttaccagcgtaaagcggttgtctttgggatccgtccggaagatattctcaccgtacagcgaagcggcgaaaacatcacggcgaagatcagcgttgctgagctgaccggggctgaatttatgctttatgccaccgtgggtgggcatgaactggttgtccgtgcgggagcggcggatgattacgttgccggagataatatcggcatccagttcgacatgaataagtgccatttcttcgatgctgatactgaaacagctattagataa

SEQ ID NO: 1874 - DNA, 1059 bp, Enterobacter cloacae
attgcgatgacggaaccgttaaaaccacgcattgattttaccggccagcttgagcagacgccccatgaggcgtttaaaacggcgcaaaccttcagcggcccgcaggctgacaactttgctcccgtgctggcagacgagccgatggttgaagaggggcaggcggaagcggtggttgatgcggcactgcgcccgaaacgcagcctgtggcgtaagatggtgaccgccgggttagccctttttggtgtgagcgtaatcggccagggcgtgcagtggggcgtcaatgcctggcaaacgcaggactgggtggcgctggggggatgcgccgccggggcgttgattgttggtgcgggcgttggctcagtcgtcagcgagtggcgtcgcctctggcgtttgcgtcagcgtgcccacgaacgcgatgaagcgcgggatctgctgcacagtcacggcacaggaaaagggcgtgctttttgtgaaaagcttgcggctcaggccgggatagatcactctcacccggcgcttcagcgctggtatgcggcgatccacgaaacccagaatgaccaggaagtggtcacgctctatgcgcacattgttcagccggtactggatgcgcaggctcgtcgtgagatcagccgttcggcggcggaatctaccctgatgatcgccgtcagtccgctggcaatggtggacatggcctttatcgcctggcgcaacctgcgtctgatcaaccgcatcgccaggctgtacggcattgagcttggctattacagccgactgcgcctgttcaaactggtgttgctgaatatcgccttcgccggggcaagcgaactggtacgggaggtcgggatggactggatgtcgcaggatcttgcggcgcgtctctctgcccgggcggcgcaggggattggtgccggtctgctgacggcacgcctgggtatcaaagcgatggaggtttgtcgtccactcccctggatcgatggcgataagccgcggctgggggatttccgtcgcgaattgattggccagcttaaagagacgctcaataaaaaacctgctcagtga

SEQ ID NO: 1875 - DNA, 1638 bp, Enterobacter cloacae
tcgtgcgggctgtcaatatttgttgacagccaccttcccgaacaccgtgatctgacatatcattttactgttattggcttaaacggtgaatttcccatgcgtctggaagtcttttgtgaggaccgtctcggtctgacccgcgagttactcgatcttcttgttttacgtagcattgatttacgtggcatagagatcgaccctgtcgggcgaatttacctcaattttgccgaaattgaatttaataccttcagtagcctgatggcggaaatccgccgtatcgctggcgttacggatgtacgcaccatcccctggatgccgtccgagcgggaacatcttgcgctgagcgcgctgctggaagcaatgccggagccgtttctctctctcgatctgaaaaataaagtcgagcgcgttaaccaggccagctgccagctgtttgcgcagactcaggaaaaacttatcgggcaccacgccacgcaactgatcaccggttttaatttccagcgctggctggacagcaacccgcaaaatacccatagcgagcatgtcgtcatcaacggacagaatttcctgatggagatcacgccggtctacctgaaaggggaaaatgccgcgcgggtgctgaccggcgcagtgatcatgctgcgctccacggtgcgaatggggcgtcagttacagaacctttccagccaggacgtcggcgcattcagccagattattgcggtgagcccgaagatgcgtcatgtgatcgaccaggcgcgcaagctggcaaatcttacggcgccgctgctgattaccggggataccggtacggggaaagatctgctggcgcatgctgtgcacatggccagcccgcgtgcggcaaaaccgtatctggcgctgaactgcgcctctattcctgaagatgccgttgaaagtgagctgttcgggcatgcgccggaaggtaaaaaaggcttctttgaacaggcgaatggcggctcggtgctgctggacgagattggcgaaatgtcgccacgcatgcaggcgaaactgctgcgtttcctcaatgacggcacgttccgccgcgtgggggaagatcatgaagttcacgtggacgtgcgcgtcatctgcgccacccagaaaaacctggtggagctggtgcagaaaggggtattccgcgaagatctctactatcgtctcaacgttctgacgctcaatattccgccgctgcgcgattgcccacaggacatcatgccgttgacagaactgttcgtggcccgttttgccgatgagcagggcgtgccgcgtccgaagctctctgccgacctgggcaccgtgctgacgcgttacggctggccgggcaatattcgtcagcttaaaaatgcggtctatcgcgcattaactcagcttgaagggtatgaactgcgccctcaggatattctattgccggattacgatgccgggacggtctcggtaggcgaagaggcaatggaaggctcgctggatgacatcaccagccgtttcgagcgttcggtgttaacgcagctatatcgcagctatccgagcacgcgcaagctggctaaacgtcttggggtgtcacataccgcgattgcgaataagttgcgcgagtatgggttaaatcagaagaagggtgacgaataa

SEQ ID NO: 1876 - DNA, 2310 bp, Enterobacter cloacae
agccgcggaaacaggggaaagcgtgacgttatgctgaaccagtctgtattaaccgatccgagcttttgcccgcatagcctgaataagtacgcgtccattatggcctgcggcaatggctacatgggcattcgcgccacgcatgaagaagattacacccagcagaccagaggcatgtatctcgcggggctgtatcatcgcgcgggacgcaacgaaaccacagagctgatcaatctgccggatgtcaccggggttgaagttgagctggacggcgtcaatttcacgctcctgtcaggcgaaattcttgagtggcaacgcgagctggcctttgctaacggcgaactgcatcgtaacgttgtctggcgttcgccggacggaaaacgctatcgcctcgagagccgtcgttttgtttcgctggaccagttgcccttagtggcaatgcggctctcgattacaccgcttgacggcgccgctcaggccgtgctgaaaaccggcatagatgcgacacagacgaacagcggcaggcagcatctggatgaaatctcggtcagggtttttgaccagcactacatgcagggtgtgtatgaaacgcaggaccgggcgtctgaagttgttgtttcggcgttttgtcagctctccgctcagagcgacagctgtttcaccgccaaaaatcgtcgcctcagcgttcatcattctctgactatctcgcaaggtgacaccgtcacgcttgagaagatcgtctggctgacccatcgcagcgataaagcgctctcacaggagtctttcgcccgcaacgcgctggccgatctcaaagtctgcgcggcaagaggctacgatgcgttgcttgaaagctcagcgtacgcctgggaagcggtctggcgtgacgctcgggtggaagtgacttgtgcagaacagcaggatcagcttgcactggattatgccgtctggcacctgacgacaatgacgccagcccatagcgaaagaagcagcattgccgcgaaagggctgacgggggaagggtacaaagggcacgtcttctgggataccgaaattttcctgttgccgttccatctgtttacccgtccacagattgcccgcagcctgctgcgctatcgctggctgaatctttctggcgcgcgtgaaaaagcacgccgtaacggttggccgggcgcgttgttcccgtgggaaagcgccgccagcggagaggaagagacgccagaattcgcagccattaacatccgcaccggggttcgccagaaggtcgcctccgcactcgctgaacaccacatcgtggctgatattgcctgggccgttgtcgcttactggcaggcaacacacgacgatgcctttatgcgcaatgagggtctgacgctgctgatggaaaccgcttcgttctggatgggacgcgcgacggaaattaatggtcgtcttgagatccatgacgtgatcggaccggatgaatacaccgagcatgtcaacaacaacgcttacaccaactatctggcctggcacaacgtggcctgcgcgcgtcagtttatggcgaaatttgggcgtgaagatgcgcgttttacggagaatgccggtaagttcctggcgcgcctgtggctgccagaggccgacgcagagggtgtgatcccgcaggatgataccttcatggcaaaacctgccatcgatctgagccgctataaagccaaagcgggtaagcaaaccattctgcttgattactctcgcgcggaagtgaacgagatgcagatcctgaagcaggccgacgtggtgatgcttaactacctgctgccggaacggtttacgccgcagcaatgtgccgccaatctggcgttctacgagccacgcacgatccatgattcatccctgagtaaagccattcacggcattgtgctcgcacgctgcggtgacaccgagggggcgtatgccttctggcgcgatgggattgccatcgacctgggggacgacccgcacagcagtgatgacggtattcatgccgccgccaccggtgcgatctggttgggcgccattcagggatttgctggcctgcacattagcgaaggggagctgcatcttgcgccgaagctgcctgctcactggcagaaactcgccttcccactgcggtggcggggcgcaacaatgcacattacctgtgaagatgacctgttaaccattgaaaccaccgcacctgtcacgttgacgctgtggggtaaaacgctgcatgtatcagggcggaaggtctgtgaacgtaaggactttcttgtacctgttaatgggaccgctaccacggaggggcgccatgacgcttaa

SEQ ID NO: 1877 - DNA, 1407 bp, Enterobacter cloacae
aggacggcgatgaagcgacttaaaaacgaattcaattctctggtgaaccgtggcgttgatcgccatttgcgtcttgccgtgacggggctgagccgcagcggtaagacagcattcattacggcgatggtcaatcagctgttgaacctgcatgcaggggcgcgcctgccactgcttagcgcagtgcgcgaggagcggttgctgggggtgaaacgcgtaccgcaacgtgattttggcatcccccgtttcacctatgatgaaggtctggcgcagttatacggggaacctcccgcctggcccaccccgacgcgtggcgtgagcgaaatccgtcttgcgctgcgtttccgctcgaatgaatccctgatgcgtcacttcaaagaaacgtccacgctctatctcgaaattgtggattatccgggagaatggctgctcgatttaccgatgctggcgcaggattacctgaactggtcccgacagatgaccggtttgttgcaggggcagcgggcagagtggtcgacccaatggcgccagctttgcgaagggctggacccgctggcgccggcggatgaaaaccgtctggccgtcatagccgaagcctggacggattacctgcatcagtgcaagcaggaggggttgcatttcattcagccgggccgcttcgttctgccgggtgatttagccggtgctcccgcgctacagtttttcccgtggccggacgttgacagcatcggcgaatcgaaactggcgcaggcggacaagaccaccaacgccggtatgctccgcgagcgatacaattattactgtgagaaggtggttaagggcttttataaaaatcactttttacgctttgaccgccagatcgtgctggtggactgcctgcaaccgctcaacagcgggccgcaggcgttcaatgatatgcggctggcgctgacgcagctgatgcaaagctttcattatggccagcgtacgctgtttcgccgtttgttctcgccggtcatcgacaagctgctgtttgccgccacaaaagctgaccatgtgacggtcgatcagcacgccaacatggtatccctgctgcaacagctggtgcaggatgcctggcagaatgcggccttcgaagggatcagcatggactgtctggggctggcgtccgtacaggctacgcagagtgggttgattgacctgaatggcgagaaaattccggccctgcggggcaaccgtctcagcgacggcgaaccgctcacggtctatccgggggaagttccggcgcgtctgccgggccaggctttctggcaaagccagggttttcagttcgaagccttccgtccgcagagcatgaacgttgatcagccattgccgcatatccgtctggatgctgcgctggagtttttaattggagataaattgcgatga

SEQ ID NO: 1878 - DNA, 1626 bp, Enterobacter cloacae
ggggatcgtatgaagcatcctgtttcgcttctttgtactgcgctgtggctgtgcgggctttcttcactttcatatgccgcggaggttcccgaaggaacggttctggcgcaaaagcaggagctggttcgacatatcaaagatgagcccgcttcgctcgatccggcaaaagcggtgggattgcccgagatacaggtgattcgcgacctctatgaagggctggtaaatcagaacgaaaaaggggagttagttcccggcgtggcgacgcgctggcagagcaatgacaaccgcgtctggacgtttacgctgcgggataacgctaagtggtctgacggtaccccagtgacggcacaagattttgtctatagctggcgtcgtctggttgatcctaaaacaacgtcacctttcgcctggtttgcggcgctggcgggcattaacaatgcccagtccatcatcgacggcaaagctgctccggatacgctcggcgtgacggcggtcgatgctaaaacgctgcgcgtgcagctggacaaaccgctaccctggttcagtaatctgacggctaacttcgcgttttatcctgttcaaaaggccaatgtggagagcggtaaggaatggacgcgccctggcgcgctcattggcaacggtgcttatgtgctgaaagatcgcgtggtgaatgaaaaactggtggttgagccgaattcacattactgggataacgccaggacggtgcttaaaaaagtcacctttgtgccaatcaaccaggagtcctcagcgaccaaacgctatctggcgggcgatatcgatattacagaatcgtttccgaaaaacatgtaccagaagctgcttaaagatattccgggacaggtatatacaccgccacagcttgggacctattactacgcgtttaatacgcaaaaaggcccaaccgcggatgcacgcgtacgtctcgcgctcagcatgactatcgacagacgtattatggcggaaaaagtcctggggaccggcgagaaaccggcctggcattttactcccgatgtcactgcgggttttacgccggaaacctcgccatttgagcagatgtcacagcaggagctgaatgcgcaagcgaaaacgttgttgcaggcggcaggctatggcccccagcgtccgctaaaattaacgctgctgtataacacgtctgaaaaccaccagaaaatcgcgattgccgttgcatccatgtggaagaaaaatctgggtgttgacgttaagttgcagaatcaggagtggaaaacctacatcgacagccgcaataccgggaattttgacgtcatccgtgcatcgtgggtaggggactacaatgagccgtctacattcctgtcgctgctgacctcctcccatagcgggaatatctcacgattcaacgatcctgcttacgataagattattcatcaggcgacgctcgaaactactgaaaaagcgcgtaatgccgactacaacatggccgagaagatcctcaccgagaaagcaccgattgcccctatttatcagtacaccaatggccgtctcatcaagccatgggttaaaggttatccgataaataacccggaggatgttgcgtacagccgtacaatgtatattgaaaagcattaa

SEQ ID NO: 1879 - DNA, 1098 bp, Enterobacter cloacae
ttaccggcggcgggccaacctattcgacctatctgttctcgctctacatctacgacaccgcctttaagtatttcgatatgggctatggcgcggcgctggcgtggatcctgttcctggtggtggccgtcttcgccggtatcgcctttaagtcgtcgaaatactgggtgttctactccgccgataaaggaggcaaaaatggctgatattcaacaactctccacggcaagaagcgtcgccgaacgcgaagtggcccgcacgctgcgcagagagaaaatcaacgcctccgttcgctatgtgattctgctggttgtcggcctgctgatgctttacccgctggtgtggatgttctccgcgtcgttcaaaccgaaccacgagatcttcaccacattgagcctgtggcctgcccacgccacctgggatggtttcgtaaacggctggaaaaccggcaccgagtacaacttcggccattacatgctgaacacctttaagtatgtgatcccgaaagtgatcctgaccattatctcctccaccatcgtggcgtacggctttgcccgcttcgagatcccgtggaagaagttctggttcgccacgctcatcaccaccatgctgctgcccagcaccgtgctgctgatcccgcagtacctgatgttccgtgaaatgggcatgctcaacagctatatgccgctgtacctgccgctggccttcgccactcaggggttcttcgtcttcatgctgatccagttcctgcgcggcgtcccgcgtgacatggaagaggcggcgcagattgacggctgtaactccattcaggtgctgtggtacgtggtagtgccgatcctgaaaccggccattatctccgtcgccctgttccagttcatgtggtccatgaacgactttatcgggccgctgatttacgtctacagcgtggataaataccccatcgcactggcgctgaaaatgtccatcgatgtcaccgaaggcgcgccgtggaacgaaattctggcaatggcgagcatctccattctgccatccatcattgtcttcttcctggcacagcgctacttcgtacagggcgtcaccagcagcggaattaaaggttaa

SEQ ID NO: 1880 - DNA, 1140 bp, Enterobacter cloacae
gagggaaataccatggctgaagttattttcaacaagctggaaaaggtctactccaacggctttaaagcggtacacgctatcgatcttaaaattgctgaaggggaattcatggtgatcgtcggcccatccggctgcgccaaatccacgaccctgcgcatgctggcggggctcgaaaccatcagcggcggcgaggtgcgcattggcgacaagatcgtgaacaacctcgcgccgaaagagcgcggtattgcaatggtgttccagaactatgccctctatccgcacatgacggtgcgcgagaatctggcctttggtctcaaactgagcaaactgccgaaagatcagattgagtctcaggtgaatgaagctgccaaaattcttgaactggaagagctgctcgaccgcctgccgcgccagctttccggcggccaggcgcagcgcgtggcggtaggccgtgcgattgtgaaaaaaccggatgtgttcctgttcgatgagccgctttcaaacctcgacgccaaactgcgcgcttcgatgcgtattcgtatttccgacctgcacaagcagctgaagaaatccggaaaaccggcgaccaccgtttacgtgacacacgaccagaccgaagcgatgaccatgggcgaccgcatctgcgtgatgaagctcggccatatcatgcaggtggatacgccggacaacctctaccacaagccgaggaacatgttcgtggcgggctttatcggcgcgccggagatgaatatacgcaaaagcgtgctggtcgaaaaagcgggccagctgcacatcgccattggcgatgaaaccatgccgctgaacgcggagaagcaggagaaagtcgcggcctacgcgggtcaggagatttactacggcgtgcgtccggaatttgtgtcgctctctgatgagcccttcccgaacggcggctgtagcggggagatggtgcgcgttgagaacatgggccacgaattctttgtgtacctgaaggtcgcggactacgaactgaccgcccgaatcccgtccgatgaagctaagccaatgattgataaggggcttcatcgtaaggtgtatttcacgtttgagatgaacaagtgtcatatttttgacgcaaaaactgaacagaacctctctctctga

SEQ ID NO: 1881 - DNA, 1023 bp, Enterobacter cloacae
atggcgacaattaaggatgtggctcgtctggccggtgtttccgtcgcgaccgtctcccgcgtaatcaacaactcccctaaagcgagtgatgcatcgcgccaggccgtgcaggacgccatggaaaacctgaattatcaccctaacgccaacgcgcgcgcccttgcccagcagtcgacagaaaccatcgggctggtggtcggggatgtatccgatccgtttttcggtgcgatggtcaaagccgtagaacaagtctcttatcacaccggaaatttcctgctgattggtaatggctaccacaatgaacagaaagagcgccaggccattgagcagctgatccgtcatcgctgtgcggcactggtggtccatgccaaaatgatccccgacgccgagctgatccatctgatgaaacagatgccggggatggtgattatcaaccgtattattcccggttttgaaacccgctgcgtggcgctcgacgaccgttacggcgcatggctcgcaacccgtcacctgatccagcagggccatacccgaattggttatctgtgctccaaccacccaatttccgatgcggaagatcgccttcagggctattacgacgcgctgcgcgaagccggtctgccctgcaacgatcgtcttgtggcgtacggagaaccggatgagagtggcggcgagcaggcgatgaccgagctgctgggacgcgggcggaatttcaccgccgtggccagctataacgactccatggccgccggcgcaatgggcgtgctgaatgataacgggatcgacgtcccggcagaaatttcgctgattggctttgatgatgtgctggtgtcgcgctacgtgcgccctcgcctgaccaccgtgcgttacccgattgtaaccatggcaacgcaggcggcagaactggcgttagcgctggccgagcatcgcccgccaccggaaattacccacctgttcagcccaaccttagtgcgccgtcactcggtggtatcgcccgcggaagccgtgagcgaacagcgatag

SEQ ID NO: 1882 - DNA, 957 bp, Enterobacter cloacae
tatggaacacgctcagccatcaggtgccctatgcccgccgttaacctacgccatatcgagatttttcatgcggtgatgaccaccggcaatctcactgaagccgcgcacatgctgcacacctcgcagccgacggtcagccgcgagctggcgcgttttgagaaagtgctggggctgaagctgtttgaacgcacccgcggcaggctgcatccaacggtgcagggtttacgtctgtttgaggaggttcagcgctcctggtacgggctggacaggatcgtgagcgcggcagagagcctgagggagttccgccagggcgaactgtccatcgtctgcctgccggtcttttcccagtcattcctgccggtactgttacagccgtttctggcccgctatccggaggtcagcctgaccatcgtgccgcaggagtcgccgctgctggaggagtggctttcggcccagcgccacgatctgggtctgactgaaaccctcgtcacgccagcgggaacggaacgcacggagctgctgtcgctggatgaggtctgcgtgctgcctgccagccacccgcttgcccacaaaacggtgctgacaccggcggattttcacggtgagaactatatcagcctgtcgcagaccgacagctaccggcagcttctggatggcctgtttgccgaacatcaggtgaagcggcggatggtgatggaaacgcacagtgcggcgtcaatttgcgcgatggtgcgcgcgggcgtgggtatttcggtggtgaacccgctcacggccatggactacgccagcagcggcgtggttctgcgccgttttagcgtttccgttccctttaccgtgagcctgatccgcccgctgcaccggcccgcctcagcgctggttgatgcctttagtgaacatctgattgcgcacgcgcgtcaggtggcgcttcgcttacctgacctgcaaaaacctttatga

SEQ ID NO: 1883 - DNA, 336 bp, Enterobacter cloacae
cagggcgaaaatatgtttattttccataaagagaccacgcttgaggatctgggcaacggcgtgacgcgtcgtattctggcgcacgacggcaggatgatggcggtggaagtgaatttcgaggaaggcgcgattggcccgatgcataaccacccgcatgagcaactcacctacgttctctcgggggaatttgagttcaccattggcgaggagaagcatgtggtgaccgcgggcgacaccctctataaagcgccgcacgtgatgcacggctgcgtttgcctgaaacccggcaccctgctggatacctttacgccggtacgcgaagatttcctgaaataa

SEQ ID NO: 1884 - DNA, 1350 bp, Enterobacter cloacae
acaagtgtcatatttttgacgcaaaaactgaacagaacctctctctctgatggagtgataaaaatgaaaaaagtgcttttaagcgcagcaatctccgcgaccctgggtcttaccgctttgccatcgatggcgcagaatgtggatttacggatgtcctggtggggcggcaacggccgtcaccaagtcaccctgaaagcgctggaagagttccataagcagaacccggacatcaacgtgaaagcggaatacaccggctgggatggtcacctctcccgtctgaccacccagattgcgggcggcaccgagccggacgtaatgcagacgaactggaactggctgccgatcttctcgaaaaccggtgacggcttctacgatctgaacaagatgaaggacgtgattgacctgtcgcagttcgatcccaaagagctgcaaaccaccaccgtggacggcaagctgaacggcattccgatctcggtgacggcgcgcgtgttctacttcaatgacgaaacctggaaaaaagcgggtattgcgtacccgaaaacctgggacgagctgatggcggccggtaaaaccttcgagagcaagctcggcaagcaatactatccggtgatactggagcatcaggatacgctggcgctgctgaattcgtacatgatccagaagtacaacattcctgcggtggatgagaaaaccaaaaagttcagctacacaaaggaacagtgggtagagtttttccagacctacaaaaagctgatcgacagccacgtcatgccggacaccaaatactatgcctctttcggtaagagcaacatgtatgagatgaagccgtggatccagggtgaatggggcggcacctacatgtggaactccaccatcaacaaatattccgacaacctgaagccaccggcgaaactggagctgggcaactacccaatgctgccgggcgccaccgacgcaggtctgttcttcaaaccggcgcagatgctgtcgattggtaagacgaccaaaaacccggaggcggcagcgaagctgattaatttcctgctcaacagcaaagaaggggtcgatacgctgggtcttgagcgcggcgtaccgctgagcaaagtagcggtgcagtatctgaccgaagacggcaccattaaagaggacgatccttccgtggcaggcctgcgcctggcgcagtcgctgccggcgaaactcaccgtctcgccatactttgacgacccacagattgtggcgcagttcggtacctctttgcagtatatcgactacgggcagaaaaccgtggaagagacggccgctgacttccagcgtcaggcggagcgtattttgagacgtgcgatgcggtaa

SEQ ID NO: 1885 - DNA, 1119 bp, Enterobacter cloacae
ggttttgcccttcccacgtcgcttatgcgccggatggtctgtgttaaactgcaaaccattacgtggaaacaggaatttcgaatggcaacaatgctggatgtctcactgcgtgcgggcgtgtcgaaggccaccgtttcgcgcgtgctgaacggcacaggtcaggttaaagagagcacgcgtcagcaggtatttcgcgcgatggaggagctgggctatcgtccgaactttctcgcgcgttcgctggctaaccagaccagcaacagcattggtcttgtcgtctcgacgttcgacggtttttactttggtcgtttgctacagcaggcgtcacggcagaccgaaaagcacggaaaacagctgattgtcaccgacggtcacgacgcccctgaacaggaagaacaggcggtgcagatgctcgccgaccgcaagtgcgacgccatcgtgctgtacacgcgatacatgagcgaaaagacgatcctgaagctgatcaacagcgtgcagacgccgctggtgatcattaaccgtgaagtgagccaggcggcggatcgctgcgtcttctttgaacagcaggacgcggccttcaaagcggtggattacctgataagccagggtcatcgggagatcgcctgtatcaccgtcccgatccacaccccaacgggtaaagcgcggctgatgggctaccgtaaggcgctggagaagcacggtattcgtctcgacgagcggcggattaaatacggcgatgcaggcatgacgcggggttacgagctgtgcaaggagctgattgcggaaaagacatcgttcagcgccctgtttgcctgtaatgatgatatggccctgggcgcctccaaagcattacaccaggccgggctgaagatcccgcaggatatttcgctgtttggttttgacgatgcccccagcgcaaagtggctggagcctgccctgtcgtcggtatatttgccgatcgacaacatgatcgtcacggcaatcgaccaggcgatccggctgacaaaaaaccagccggttgaagcgatcccgccgttcaccggcacgctggtgttacgcgattcggtgacaacagggccgtggtttaatcagaccagctctaacgccagcagctcctga

SEQ ID NO: 1886 - DNA, 897 bp, Enterobacter cloacae
gtatgtatgaatgaaaacaagctgctggggctcgcatggatatcaccctatatcatcgggctgatactctttacggcattccccttcgtctcatcgtttttcctcagctttacggattacgatttgatgagtccgccggtgtttaacggcatcgaaaactatcgctacatgtttaccgaagacacgctcttctggaaatccatgggcgtgacctttgcctatgtatttttaaccatcccgctaaagctcgcctttgcattaggaattgcctttgtcctgaactttaaattacgcggcatcggctttttccgaacggcctactatattccgtcgatcctcggcagctccgtcgccattgccgtattgtggcgcgccttatttgccatcgatggcctgctgaacagctttatcggcgtttttggctttgatccggtgaactggctgggcgagccgtcgctggcgctgatgtccgttaccctgctgcgcgtctggcagttcggttccgcgatggtcatcttcctggccgcgctgcaaaacgtaccgcagtcccagtatgaagcggcaatgatcgatggcgcatcgaaatggcagatgttcatgaaggtgaccgtgccactgattacgccggtgatcttcttcaacttcatcatgcagaccacgcaggcgttccaggaatttaccgggccgtacgtgattaccggcggcgggccaacctattcgacctatctgttctcgctctacatctacgacaccgcctttaagtatttcgatatgggctatggcgcggcgctggcgtggatcctgttcctggtggtggccgtcttcgccggtatcgcctttaagtcgtcgaaatactgggtgttctactccgccgataaaggaggcaaaaatggctga

SEQ ID NO: 1887 - DNA, 1425 bp, Enterobacter cloacae
tcacagaacaaagcgcctgtgggcgctatttttggcataccaatagtatccggctgtccatcttattcaataaaagcccttttactgaggtattaccctatggcatttcaggaaaaactgatcgacgctctgggcagttttgccaccacattcaacagctatcgctatatccaggcgatcaagtctgcgtttattaccttaatgccggtcatcattgtgggggcgttctcggtactgatctccaatatggtgctggatccgaaaaacggcctggcgagctttcagtcgctgtcgtttcttgcggcgttaaagccgatcaccagcgcgctcaactatgccacgcttaactttctcaacatcggtgcggtgtttttaatcggcattgagctggggcgtattaacggcattaagtccctgttccccggcctgctggcggtgatctgctttatctgcgtgacgccaaccacggtggaaatgctggtggacggcgagatgcacgtggtgaaagacgtgctgctgcgccagttctctgatacccgcagcctgttcctcggcatgtttatcgccatcctgtcagtggagatttactgctggctggaaaaccgcagggggctgaaaatcaggatgccggacacggtgccgccgaacgtcgctgcgtcgttctctgcgctgatcccggccattatcaccaccaccgccatcgccacctttggcttcgtgtttcatcagattaccggcatgtatctctacgacgcggtttaccaggtggtgcaacagccgctggagcgcgtggtgcaaagcctgccggggatcctgctgctgatgtttgtcgcccagctgttctgggtgattggtattcacggcaaccagatgatcaagccgatccgcgagccgctgttgctgggggcaatcaccgttaacatgagcgcgttcgagcagggcaaagaggtgccaaacatcatcaccatgccgttctgggacgtttatatgagcatcggcggctccggcctgaccatcggcctgctgatcgccgtcatgattgccaccaaacgtaaagagatgaaggagatcgctaagctctccatcggcccgggtatttttaatatcaacgagccggtgatcttcgggatgccaatcatgctcaacccgatcctggctatcccgttcatcatcacgccgctggtgacgggctcgattggctactttgccaccgtgaccggatttgccgggaaagccgtggtgatggtgccctggaccacgccgccgctgatcaacgcctggctgtcaaccgcgggctccatgggggcggtgatcacccagtttatctgcatcgtgaccgcggtgattatctatctgccgtttgtgaaaattgcctcacgccgcgcagagcaggccgcgctgcaacaagccaccgataacgcatga

SEQ ID NO: 1888 - DNA, 1494 bp, Enterobacter cloacae
aaattgcctcacgccgcgcagagcaggccgcgctgcaacaagccaccgataacgcatgaggaccggatgagcataaaacagataactataccgcaggattttatgctgggcgcggcggcatcggcctggcagaccgagggctggagcggcaaaaagccggggcaggattcgtggatcgatctctggtacaagaacgatcgtcacgtctggcacaacggctatggcccggcggtggcaaccgactttattaatcgcttccgtgaagacgtggcgctgatgaagcaggcgggcctgacgcactatcgcacctcgatcaactggtcgcgctttttgaccgactatgaaaacgccaccgtagatgaagagtacgccgcctattacgacgcgctgttcgatgaaatgcaccgtcagggcattgagccgatgatctgcctggaacactacgaattgccgggcgtgcagctggaaacctacggcggctgggcgtcgaagcacgtcgtcgagctgttcgttcgctatgcggaaaaagtgtttgagcgctttcacggcaaagtcacccgctggtttaccttcaacgagccgattgtggtccagacgcgcgtctaccttgacgcactgcgctggccctatgagcagaacaccagcacctggatgcagtggaaccaccataaagtgctggcgacggcgaaagtggtgaagctgtttcgcgagaaagggtatgacggctcagtgggttgtattcttaacccggaagtgacctatccacgctcgcgcgcaccgcatgacgagcgagcggcagagatgtacgatctgttctacaaccgcgtctttctcgacccactggtgcacgggcgctatccgcaggcgctctttaccctgctggcgcagcatcaggtgcagtgggactatacggctgacgagctggcgctgattgccgacaacaccgtcgacgagctgggcattaacctctattacccgcatcgcgtcaaagccccgtcccgcgcctggcacccggagacgccgttccacccggcgtattactacgagccgttcgagctgccggggcggaggatgaacacctcccgcggctgggagatcttcccgcgcattatttacgacatggcgatgcggattaaaaacgactatcgcaacattgactggtttgtagcggaaagcgggatgggtgtggagaacgaagcgcagtttcgcaatcgcgacggcattatcgatgacacgtaccgcatcgcgtttatcagcgaacatctctactacacgctgctggcgcgggaggcgggggcaaactgtcacggctatatgctgtgggccttcaccgacaatgtctcgccgatgaacgcgtttaaaaaccgctacgggctgattgagatcgaccttgaaaatcaacgcgcacggcgggcaaagaaatcagcgtcctggttccgccagctgcgcgatgagcgtgtgctgacgctcagggtagacgatgaatggaagtaa

SEQ ID NO: 1889 - DNA, 795 bp, Enterobacter cloacae
ctgaaaaacacaggtgaaaacgtggataaggctgtcatcctgccggaaaaaaaacagtaccaggagattggcgaggatttacgggcgcagattatccaggggcattatcccgtgggatcgcgtctgccgccggagcgcaacatcgccgagacgtatggcgtgagccgcactattgtgcgcgaggcgctgctgatgcttgagcttcaggggacggtggatattcgccaggggtctggcgtgtacgtgatgcgcattccggaggagcatgaaaacgaggaagagcgttttctgaacagtgacgtagggccgtttgaaattctccaggcgcgtcagctgcttgaaagcaacattgccgcctttgccgcaaaaatggcgacgcgggcggatatcgacaacctgcgccgcatcatcgagcaggagcaacgggcgattgccgccgacgatcgcagccaggacaacaacaaaatgttccaccttgtactggcgggggccacacaaaaccagatgctgctggcgaccgttgaaagcgtctggcatcacatggacagcagcccactgtggcagcaattcaacggccacatcgccagccgcgcatggcggctgaaatggctcggcgacaggcaaaccattctcgctgcgctccgccgccgcgacgtgatgggggcgtggcaggcgatgttccagcatcttgaaaacgtcaaaaagagcctgcttgagctgtcagacgaagacgcacccgatttcgacggctatctcttcgaatcggtccctcttttccaggggaagctggtgtga

SEQ ID NO: 1890 - DNA, 2322 bp, Enterobacter cloacae
ttggtgagaattcctggtacgttttcgtactcttctcttgcaccaacctgcgcggatgcgcaggttttttttcgcctctgtttttgctatcgctccctcactacttctcgtgtaatctgccaccatttatacctttcacactggctggcaaagggagttgaaatgctttttgggttcttccgcacactgtttcgtgtcctgtttcgcatccgcgtgactggcgatacgcaggcactctatggcgagcgtgttcttatcacaccgaatcacgtctcttttcttgatggcgtattgctggcgctgtttttgcccgtgcggcccgtcttcgcggtgtacagctccatcagtgaaaaatggtacatgcgctggctcaaaccgctgattgattttgtcccgctcgatccaaccaaaccgatgatgattaaacatctggtgcgtctgattgggcaggggcgtccggtggttatcttcccggaagggcggatttcagtgacgggctccctgatgaaaatttacgatggggccggttttgtcgcggcgaagtctcaggccaccgtcgtgccgctacgcatcgacggggctgagctgacctttttcagtcgtctgaaagggctggtgaagcagcgtctgttcccgaaaattacgctgcatatattaccgccgacgtcactgccgatgcccgaggcgccgcgtgcgcgcgaccgccgtaaaatcgccggggaaatgctgcaccagattatgatggaagcgcgcatggccgttcgcccgcgcgagacgctgtatgaatcgttgctgtcggcccagtatcgctacggtgcgaagaaaaactgcattgaagacatcaactttacgccggatacctaccgtaagctgttgaccaaaacgctgtttgtcgggcgtatcctggaaaaatacagcaaacagggtgaaaagatcggcctgatgctgccaaacgcgggtatcagcgcggcggtgatctttggtgccgtctcccggggccgcattccggcgatgatgaactacacggcgggcgtgaaagggctctccagcgcgattaccgcggcgcaaatcaacaccgtctttacctcccgccagttcctggataaaggcaagctgtggcacctgccggaacagctgacgcaggtgcgctgggtgttcctggaagatctgaaagcagacgtcacgaccgccgacaagctgtggattttcgcgcacctgctgatgccgcgtctggcgcaggttaagcagcagccggaggatgatgccattatcctctttacctccggctctgaaggcaacccgaaaggtgtggttcacagtcacaaaagcattctggcgaacgtcgaacagattaaaaccattgctgactttaccgccaacgatcgctttatgtcggcgctgccgctgttccactcatttggtctgaccgtggggctctttacgccgctgctgaccggtgccgaggtgttcctctacccaagcccgctgcactaccgcattgtgccggaactggtttatgaccgtaactgcacggtgctgttcgggacgtccaccttcctcggaaactacgcgcgcttcgccaacccgtatgatttcttccgcgtgcgctacgtggtggcgggggcggaaaaactccaggacagcacgcgccaaatctggcaggacaagtttggcctgcgcattctggaaggctatggcgtgacggagtgcgcgccggtggtctccatcaacgttccgatggcggcaaaacccggaacggttggccgcattctgccggggctggacgcgcgtctgctggcggtgccgggtattgaagacggcggacgtcttcagctgaaagggccgaacgtcatgaacggctatttgcgtgtggaaaacccgggggtgcttgaggcgccgacggctgagaacgtcaatggcgaggttgaaacgggctggtacgacacgggcgatatcgtgcgcttcgacgatcagggcttcgtgcagatccagggacgcgcaaaacgcttcgccaaaatcgccggggaaatggtctctcttgaaatggtcgagacgctggcgaccgcagtctcagcagagaaaatgcatgcgaccgtggtgaaaagtgatgccagtaaaggcgaggcgctggtgctcttcacgacagacggtgaactgaagcgtgacgcgctgctcaggtatgcacgcgaacacggtatccccgagctggcggtcccccgcgatattcgttacctcaaacagttaccggtgctgggcagcggtaaacccgatttcgtgaccctgaagggcatggttgaagaggcagaacagcaaaatgcgtga

SEQ ID NO: 1891 - DNA, 1215 bp, Enterobacter cloacae
  unsure (468)
ttcttacattcttgtatgatttgttacaccggaaccagtcaggcagaatttcactgcatccttaaaagaagaacagttatgtcagcgatggatttcaaaaaacatacggatctcaattttcctcactatgctcccccggcggtcagcgctaaagaaatagatcttctgggtctgctggacgtcctgctggcagcaaaaaaacgcatcatcaccattgtctttgcatttgcactggtcggcctggcaatcgcctttctgataccgcaaaaatggaccagtaaagcggtcattacgcccgcggaacagacgcagtggagttcgctgcgccagatgatggtggcgctccaggtgcttgatgtcgacgtgaaaattacccgtgcggatgtgtgtaatctgtttatcaaaaagtttcagtcccagtctctgcttgaagagtacatgaagagctcaccttacgtgatggctcanctcgatggcgctgatgttgacccgctggagctgcaccgcgcggtggtcaatattgccgaaaagatgaaggctgttgataacacgcaggaaaaaaatgccgataaagcaccatacctctcctggacgttaagcttcacagccccaacggcagaggatgcgcagaaagtgttgaatggttacattcagtacatctcccgcatcgtcgagcaggagaccatgcaaaacattcgcgatcagctgatcctgaaaaccaaaacggtacagcagcagctggagtcggatcgggtccgtctgaccaatatccacaataccaacctgcaacgcctgaactactcgctggaagtggcgaacgcggctgggatcaaaaagccagtttacagcaatggacaggcggtgaaagacgatccggattattccgtcgccctcggtgctgacgggattgcgcagaaattgcagattgaaaaaaatctcaaggacgtttctgagctgaacgccgatttccagaaccgcgaatactatctggcacagctgcaaaaactctccttcgaagatgtgagcctggagccgttcaaataccagctttcaccttctatgccggtgaaaaaagatggcccgggcaaagccctgatcgtgctgctggcgtgtattctgggtggactgttcgcctgtggcagcgtgctgctgcgcgaggctatgagcacccgcaacccgctgccggaacaacttcctgagccggtaacggaataa

SEQ ID NO: 1892 - DNA, 1185 bp, Enterobacter cloacae
catcaaaaaaggcgctcaactgagcgcctttttttatttcaggaaatcttcgcgtaccggcgtaaaggtatccagcagggtgccgggtttcaggcaaacgcagccgtgcatcacgtgcggcgctttatagagggtgtcgcccgcggtcaccacatgcttctcctcgccaatggtgaactcaaattcccccgagagaacgtaggtgagttgctcatgcgggtggttatgcatcgggccaatcgcgccttcctcgaaattcacttccaccgccatcatcctgccgtcgtgcgccagaatacgacgcgtcacgccgttgcccagatcctcaagcgtggtctctttatggaaaataaacatattttcgccctgttatgtaatgaaacattgtttcaattaacttatctcacccgccgagaaaaggaaacgtttagccaaataactggaaaggcgatcacaagtttgcttcactgggtgaaacgcacaggaggaaagatgaaaacgatcggtctgttagggggcatgagctgggaatcaacgatcccgtactaccgcctgattaatgaaggcgttaaacagcgtctgggcggtctgcattcggccagcctgctgctgcacagcgtggatttccatgaaatagaagcctgccagtcgagcggggagtgggacaaagcggggcagatactggcggacgccgcgctcgggctggagcgtgcgggcgcgcagggtattctgctgtgtaccaacaccatgcataaggtggcgtcgcacattgaagaccgctgttcgctgccgttcttacatatcgcggatgccaccgggcgtgccatacgtaccgccggcatgacgcgcgtggcgctgctggggacgcgctacaccatggaacaggatttttaccgcgggcggctgagcagccagttcgggattgaaagcctgatcccggaggaggctgaccgggcgcgcattaaccagattatttttgatgagctgtgtctgggcaccttcagcgaagcttcgcgcgcctggtacgtcagcgtgatagagaaactggcgcagcagggagcggaaggggtcatcttcggctgtaccgaaatcggtctgctggtgccggcagaccgaagcccgatatcggtcttcgataccgccgccatccatgccgcggatgcggtggagtttatgctgtcataa

SEQ ID NO: 1893 - DNA, 1365 bp, Enterobacter cloacae
gcgtgttccatatcatttttgcatagactcacgataaaacgatattttttattctcttcaggctatggcgtaatgataaaaaacagatttccggagacgaccatgccacgcccgctcaaccagaccgaaaccgatttaaacgccgataacctgctgcgcctgcctgccgaattcggctgtccggtgtgggtttacgatgcgcagattgtccgcgagaagatcgccgcgctgcatcagtttgacgtggtgcgttttgcgcagaaggcctgctccaatattcatattctgcgcctgatgcgcgagcagggcgtgaaggttgactccgtatcgctgggtgagatcgaacgtgcgctggtggccgggtttgatccgaaagccgacagcgacgcgatcgtcttcaccgctgacctgatagacgacgccacgctggcgcgcgtgcacgagctgcaaatcccggtcaatgctggttcggtggatatgctggaacagcttgggcaggtctctcctggccatcgcgtctggctgcgcgtcaacccgggctttggtcacggccacagtcagaaaaccaacaccgggggcgaaaacagtaaacacgggatctggtatgccgatatgcctgcggcgctggaggttttacaacgctacaacctcaagctggtgggcattcacatgcatatcgggtccggcgtggattatggccatcttgagcaggtctgtggcgcaatggtgcgtcaggttatcgattttggtcaggatctggaggcgatctccgccgggggagggctttcgatcccttaccgcgaaggagaagaggcgatcgacacggatcactattacggcctgtggagcgccgcgcgtgacaggatcgctgcccatctgggccatgcggtgaagctggagattgagccgggtcgtttcctggtcgccgaagctggcgtgctggtggcgcaggtgcggagcgtgaaggagatgggaagccgtcactttgtgctgattgatgctggcttcaacgacctgatgcgcccgtccatgtacggcagctatcatcacattaccgcgcttgccgccgatggccgcgatctggtcaacgccccgcgcatcgagaccgttgttgccggcccgctgtgtgaatccggtgacgtctttactcagcaggaaggcgggaaagtcgaaacccgttcgctgccagaggtaaaaccgggagattatctggtgctgcatgataccggtgcgtacggggcgtctatgtcttccaactacaatagccgcccgctgctgccggaagtattgtttgataacggcgtggcgcggctgattcgccgtcgccagaccattcaggagctgctggcgttagagctggtctga

SEQ ID NO: 1894 - DNA, 930 bp, Enterobacter cloacae
agggcatggttgaagaggcagaacagcaaaatgcgtgagtcagtgcacactaacacttcaatctggtcgaaaggcatgatggcggttatcgccgcccagtttctttccgcgttcggcgataacgcgttgctgtttgccacgctggcattgctgaaagctgagttttatcccgactggagccagccgatcctacagatggtgtttgtgggtgcttacatcgtatttgcgccgtttgtcggccaggtggcggacagcttcccgaaaggtcgtgtcatgatgtttgccaacagccttaagcttctgggcgcggcaagtatctgctttggtatcaacccgtttgtcggctacacactggtgggcattggtgcggcagcctactccccggcgaagtacggtattctgggtgagctcaccaccggtgataagctggtgaaggccaacggcctgatggagtcctccaccattgcggctattctgctgggttcggtggcgggtggcgtactggcagactggcatgtgctcgccgcgcttggcatctgcgccctgatgtacggtggcgcggtgatcgccaacctgtttatccccaaactggccgtggcgcgtccggggcaatcctggcgcttcgggcccatgaccggcagcttcttcaacgcctgccgcgtactgtggcgtaacggtgaaacactcttctcgctgatgggcaccagcatgttctggggggccggcgttacgctgcgtttcctgctggtgctgtgggtgccggtggcgctgggcattactgacaacgccacgccgacttatctgaatgccatggtcgccgtccggattgttgtccgggccggggctgccgctaaactggtgaccctggaaaaccgtccccgcgctgcatgcctgccggggatcctggattggggtccggcgttctgttcc

SEQ ID NO: 1895 - DNA, 540 bp, Enterobacter cloacae
tccagagggagaataaagatgcagtatacccggctcggtaaaagtgacttactggtctcccgcatctgtatgggatgtatgggatttggcgacccgttaacgggccagcatcgctggacgctggacgaaacagcaagccgggacatcatccgctacggtctcgaaaagggtatcaatttttacgataccgctatcgcctatcagaacggctccagcgagcgatacgttggccgggcgctgcgggagatggcaaaacgcgaggacgtggtgctggccaccaagtttctgccacgaaccgccgcgcaaattgccgctgggatcggcggaaaagaggcaatagcccgatcgctcgaccagagcctgcagaatctggggatggactacatcgacctctacatttaccacatctgggattacaacacgccagttattgaggtgcttgaagcgcttcatgccgccgttactgcgggcaaagtgcgcgctattggtatttccaattgctatgcctggcagcttgcgaaagcgaacgcccttgcctaa

SEQ ID NO: 1896 - DNA, 363 bp, Enterobacter cloacae
cgcgaagggctgacggcctttgtttccgtgcaaagccactacaacctgattatgcgtgaagatgaacgagagctcttcggtctgtgcgctgaagatgatatcgccatgaccccctatagcgcgctggccagcggtcgtctctcccggaaagaaggccacacgcggcgagcctccgaggatgcctatgcccgcggaaaatatgatagcacggctgaacaggatcggagcattatcgagcgcgtcgccgagcttgctgaacgacatcaggtgtccatgacggaaatctcactcgcctggctgctgacaaaagtcacgtcacctgtcgtaggggccagaaaaaagatcacgtcgatggcgcggtaa

SEQ ID NO: 1897 - DNA, 609 bp, Enterobacter cloacae
accaggatctacagagtgttatgccagcagggtatgccgcttcgtctattatctatatataactcccacttaaggaatactatgcatattcgaaaaggattaagcaccgaccttgcccgtcttgaatgctgtgatttttcttttacggtcgatgagattgccagagagccttttctcaatggtgatttgcatatcgaggcgctgaccgaaccttatcttaaaacctatgaactggatctccagacgctggaaaatcattgcgttaatccggattcaatatttcttatcgccgaaacggatgacggtgaaatcgccggttttattaccgcgtcctgcaactggaataaatttatatcggtggattacattgccgtggagcgttcaaagcgtcgtacgggcgcggcgcacaagctgatgtccgccacccacgtctgggcgcgaagcctcaatgcgcccggattacggctggagacgcagaacgttaatgtttctgcctgtcttttttatcgtcactatgggtttattctcggcggttacgatcgctatctttacaacgccctgccggaaaaagatgaggtcgcccttttctggtattacatgctggcttga

SEQ ID NO: 1898 - DNA, 591 bp, Enterobacter cloacae
cgactaatcttggaattgactattaaggaggccggtatgtctacaggaaataatcacacgctgcattaccctcgtccaccgtttgctgaacaaccgcaaagggcccccgggctggcatcggaaatgaagccaataccggatcatggtgaaacaagttatatcgggtcaggaaaactggcaggaaaaaaagcgctgattaccggcggtgattccggaattggtcgcgcggtagcgatcgcctatgcccgtgaaggcgcagatgtcgctattggctatctgccggaagaggagtccgatgcggcatcggtcattgcgctgattcaggctgaaggccgtaaagcggtcgccattccgggcgacattcgcgtggagtcgttttgcgatacgctggtggaaaaagccgtcgcggaactgggtggcctggatatcctggtgaataacgccggacgccagcagtactgcgaatcgatcgacgatctcaccacggcagattttgacgcgacgtttaagaccaacgtctatgcccccttctggatcaccaaagctgcgctgcgtcttcacccacgggagcgtgccaggagccgcgcttag

SEQ ID NO: 1899 - DNA, 1209 bp, Enterobacter cloacae
gggggttcccaacctgggtggggaatcccttcgggaggcctggggcgttttattcagaagcccccgaattgttcggaaaatgtgttaatggacggtcgccttatcagggggcagaatcctgtttcagcgcacggtgtcggtggggcgctgttaaatgccgtcggccagccaagtaaaaacattcatctgtctttcaccgttactcaccctctttggccggtttacgtcagcaacgttccggccttttttcaggagctgaatatgaaatctcttccttcagtcgcgctcggcacatggtcctggggcacaggctttgccggtggcgacaccgtcttcggcaatcatctttctgatactcagatggcagacgtgttcaccacggccatgagtaagggtctcaatctttgggataccgcagcagtatatggcatggggagttccgaggcagcgctgggagcattagtccgtcagttcccccgcgaggatatgattttatccaccaaattcacgccgcagattgcgaacgaacagtcagcgcagcctgtcagcgatatgcttgaggccagcctcggacgcctgggcgtggacgcgattgatatctactggatccacaatcccctcgacgttgagaaatggacgccaggactgatcccacttttacaaagcggtaaggtcaaacgcgtcggggtttccaaccacaatctggcacaaatcagacgcgccaacgaaatccttaacgcttccggttattccctcagtgcagtacagaatcattacagcctgctctatcgcgcctctgaagaggccgggatccttggttactgccgacaaaataacatcacgttctttgcttacatggtcctggagcaaggcgcgctcagtggtcgttatgattcaaatcatcccatgcctgccgggagtggccgggccgaaagttataacgccgtactgccgcagttagagagattaaccgccgccatgaaaaaaatgggggccgataggaatgccagcgttgcgcagatagccatcgcatgggctattgcaaaaggtacccttcccctcgttggtgcgactaaagtccatcacgttctggacgccgcctgcgcttcagacatccagttacgcgatgaggaaatcatcctgctggaacaactcgccacagagaccagagtggatacacgaggcgcctgggaaaaaccgatggtgtaa

SEQ ID NO: 1900 - DNA, 1074 bp, Enterobacter cloacae
tctgcatcacttttactgctttgtatgaagggtgagaatatgaaaatcatttgcctcgaagaacattatctcgacagcgagttagggcgagcgtgtatgcctgttgcgcttgagcaggcacctttccttggcgactgggggaaaaccgtcgctgatggtcataatcctgaccgaagccggccgcagatagaaaagaatgcgctgataaacgcgaaaggcgctgatttgggaagccgccgcctcagggatatggatgaggctggaattaccctgcagatcctctctgtgggcggattcccccagctggcacccggggatgaagcggtaacattaaatacggcggcaaacgaccgccttgccggggcggtaagaaatcatccggatcgcttcgcggcatttgccacacttccctgggcacagccggaagaggctgaaaaagagcttgtccgcgcagttgaaaaactggggtttaagggggctcttctgaatggccgaccctcttcatgctttctcgatcatcctgactatgactccctgctttcccgctttaataaactgaatgtgccactctatcttcatcccggattaccgcttaaaagcgtacagcaggcctacttcacgggcttcaatgcagaggtcaacgcccggctctccatgtttggctggggctggcatcacgaagccgggatccatttgttacggctgatgttatcgggcgcatttgataaatatccccacctgcaggtaatcagtggccactggggggagatgctgcccttctggctgcagcgtcttgatgacagccttccgctggctgcaacgggtctgtcacgcacgctaacgagaaccttccaggagcacgtttacgttaccccgtcaggtatgctgacactgccgcacttccagtttatctacgcgttaatgggggcagacaggatcctgttctccgttgattacccctatcagaccctggacggtgtaaaaacatttatcgacagtctgcccgtcaacaaggctgaaaaagaggccatcgcatttcgcaatgcagaacgtttactgggcatcacggcgtag

SEQ ID NO: 1901 - DNA, 582 bp, Enterobacter cloacae
ctcattgaaatgaaaaatatccttattgtttcaggccatcctgagcttacccattccgtcgccaatgccacgatccttgatgaagtggcgaccgcccttcccgatgctgaaattcgtcgtctggactggctctatccggacggcaaattcaatatcgctgcggagcaggaaagcctgctcagggccgatgtgattgtctggcagtttcctttttcctggtatgggctgcccgggttaatgaaacaatggctggacgaggtctttgtccacggcttcgcgcatggctcaacggcgaaactgggcggtaaaaagctgctcctctcctttactacaggggcgccacaggcgctctataccgctgacggtttctttggccatgccattgaagagtatctaattccgttcgagaccacagcaaaactgtgcaatcttgagctgctggagccggtttatacctgcggtatcagctatgccgatcgggatgccgacaaactcgcgcagcaaaaaacgcttgcccgggaacacgctttaaggctcgtccatctgctcaattccgtcgtgaataatccagagggagaataa

SEQ ID NO: 1902 - DNA, 642 bp, Enterobacter cloacae
cgttttacagtcctgttaagacaaaggaggtttatgatggtgttacttcagcgcagagcagcagcattgtttttgtttgcctttatcttcctcatgcccgctagtcatgctcatagccgtgaaaagaccgacattaaaacgctcgttatcgtctctcacccttatccggaacgctcagttctgacaaaagggctgcaggaagccgctgagagtctggaaggcgtgacggttcgcaaccttgagacgctgtatggctatgacacacgtcggattaatggcgacgcggagcgaaaaatgatgcgtgagcacaggcgtgttgtttttatcttcccgacacactggttcaacattacaccaatgatgaaggcctggctgaatgaaacctggggaagtgtcggacccggtctttggcagggaaaggagatgtttattgtcagtacggctgcggggggaagctccacttacgggacggacggcaggatcggggtatcgcttgcggatgtgtttttaccgatgaaggcaagcgccctgcacgcaggtatgacgtggcttcctcccctggtctttgagagcgccagcagcgatcggttaccttcttaccaacaccaacttatagaacgtcttaaacagccatttcagtaa

SEQ ID NO: 1903 - DNA, 762 bp, Enterobacter cloacae
aacgtcttaaacagccatttcagtaaaaggatcatcgtgaaaaagactcttatgcttttaatttgcatgctgataagcagccctgtctttgcaacaaaactggacgcgccggataagcgagtgatgaatatctttgagctcggcgtcaggcccgatcgggacaaagattttgcagacgtagccagacagacgatttccgcttcggttgatcatgaagcaggtacgctggcgatgtacgccctgcaccgcagcgacaatccacgtcaggcattcatggtcgaactctatgaaaacgagaatgcttaccgcaaacatctgaatgccgaaccatacaaggcattcgctgaccgggcacctgacattatcgatcagaaaaataaaatcactctggagccccaatttctgggggacaaacacatcataccggatgagcgaaccattaataatctggtgatcgtcgaggtaaagcctgaatttcagaccgaatttaaaaacatcgtcctgcccgaaatggcggaatcgctcaaagtagagaaaggcgtattagcgatgtatgccgctacagactcacagactccgaaccgctggtatttctatgagatttacgccagtgaggaagcgtatcaactgcaccgacaaacgccacacttccgtgactatctcaggcaaacggcgcatatgagcgccagtaagaacgctatcccggtaaaaccggtatttcttcgtaacaaaagcggaatcaaacaggatccgcaccgttga

SEQ ID NO: 1904 - DNA, 819 bp, Enterobacter cloacae
ccagtgaggattaacatgaaaagcgtaattgcagcggcggccatgtcgcttgttatttctgattttgctactgctgaggaaacaagaggtaaagcgatgatgaaaattgaaccttcaacaatttcggaagctgatattcgttccgtctcaccggctcttgcgcgctttggtcgagaagcgattactgaagatctgtggacacgcgatgccctctcgcccagggatcgtagtatggtgaccgtcgccatgctaattgccagaaaccagcctggcgaccttaagcactatatggacattgcccttgataatggtgttacgccagcggagttgtcagaaatcattacccatctggcgttctactcaggttggccaaatgccatgtcagccgtcagcgtgaccaaagcagtatttgaaactcgtggcgtcacggcagatgcacttcctgacgcttctccggacctgcttcctctcaatcagcaagcagaaaagcagcgttcagagacagtggaaaaaaatgttggcccaatatctccaggcctggttaaatttactgctgaccccctgttcctggatctctggcaaagacccgcgctgaaaccccgcgacagaagcctgattacggtcagcgccttaatcgcatccggacagagcgcgcagattggctatcacctcaatagagcaatggataatggactttctgttgaggaagctggtgagatcgttacccaggccgccttctatgctggctggccaaacgcatttaccgctgctccggttgtgggagaggtgctaaacaatcgatcatcgagtaaaaggtaa

SEQ ID NO: 1905 - DNA, 1491 bp, Enterobacter cloacae
ggcgtttcatgcaacgataaagtgcaaatggtgcgccttccgccctgtaaaagccatctttatagttttgtcatccatacactcttctcagaggacaacctgatgacgctcttttccagtcaacccggcgacgaaggactgcctggcccggcgcgcgcacgggtgatggccgcaattatgaccaccaccttaatgggcgtgtttgatggcaccatgatcaacattgccctgccctccatggctcaggagatgcaggtacctgccagtattgccgtctggttcgccaacgggtatctgctggcggccgcgatgtcgctggcgatattcgcggcgcttgcggcccgcctgggttatcgccccgtttttctggcaggtctgacaacctttaccctaacatcgctgggttgcgcgctggcgaagacgcccgaagtgctcatcggtatgcgcgtgcttcaggggatcggcggcgcggcgacgctgagtattgcccccgcaattctgcgatccgtatttcccgggcgattacttggccgcattctggggttacacgctctgctcatcgcctccagctccgctatcgggccggtattgggtgggacgatccttcacaccctgagctggcaatggctgtttgcgataaacgtggttcccggcaccctcgccttactgctggcggtcaaagcgctgccgcgggatgcggttcgaaagcaagcgcccttcgacaccccgggcgccatattgtcggcgctgctgctggggtcgacgatcatggcggcgaacagcctccaggaggctacttatcaccccggcagtctttgctggacggtgctcgctgcgctgagcggcatggcgtttatctggcagatccgccgcacggataaccccttgctgccgccgacgatgtttaaaaatgaacgttttaccctcgcggccttcacgtcaatgattgcttttgtcagccaggggatcacttttattgcactgcctttcctgtttcagagcgaatacggctacagtccggtgttgtctgccctgctgtttacgccgtggccgctagggatcgtactgattgcgccgcatgcaggccggtgggcggacacgatttcagccccggcgatatccaccctggggctggtgatttttgtcgtgggtttgatccttcttgcgacattacccgaccgccctacaatgtgggatatctgcctgcggagtctggtatgcggcatggggtttggctgctttcagagtcccaataaccgggaaatgctctccaacgttattcgtgagcatgcgagctatgcatccggtgttttatccattatgcgcacgttcgggcagtgtctgggcgccgccgccgtggccgttctgctggccgcagatgaaaggtcaattcatgttgcactgtgggtcgcagccgcagcttctgcggtagcggtcgtcgtcagcgcgagtcggttgcgtaaaatcactcatcctgcggaaacaggatga

SEQ ID NO: 1906 - DNA, 549 bp, Enterobacter cloacae
catgctcgatgccccggtcgcggacgatcctgccatagaaaaactgctggcaaggaaaccgcagtgggacgtgtaacagcgccagagcccttatccagcgtccatcaactggcggagttcgtcagcggagaggccgtgcttgacgaatggctaaaacaaagaggtctgaaaaaccaggcgctcggcgcagcccgaacgtttgtcatttgtaaaacgggcacgaagcaggtcgcgggattttactcactggctaccggcagcgttaaccatacgcaagcgacaggtaatctgcggcgtaacatgccggatcccattcccgtgattatacttgcccgtctggctgttgatgtctcgttacgcggaaacgggttgggagccgatttactccacgatgcggttttacgctgttatcgggtagctgagaatattggggtgcgggcgatcatggttcatgcactcactgaggaagccaaagcgttttatatccaccatggttttaaagcatcgcagactcaggaacggacactgtttctccggcttcctcagtag

SEQ ID NO: 1907 - DNA, 2484 bp, Enterobacter cloacae
tggagaagcagcgctatgatcccttcctctacttaccgaattcagtttcgcaacggcatgacctttgaccgcgttgcagacctgattccgtatatgaaagacctcggtatcagccatctttacgcgtcgcctgttttcaccgcaaccacgaattccacccacggctatgacgtgaccgaccccaacgaaattgacccggcgattggcgggcgggaagggtttgaccgcatggcggcggcgctgaaacaggcggggatggggctgattctggatatcgttcctaaccatatgtcgacctcgctggaaaaccgctggtggcgcgatgttatcgaacatggcgggcagagccgctatgcggcgtattttgatatcgactggtcccgaccgctgacgttgccgtttcttggcgacacctttgaagccgagctggagcgggggactatcaccttaaaacgtgacagtgtcaccaacagcgcagcgctggtttactatgataccgcctatccgcttaatcccggcacgtatgccgaaggcaagagcatcgctgagatccacgaggcgcaaagctggcggctgatgtcctggcgtgaagcgccgaaacagctttcatggcgtcgcttttttgaaatcaccgggctggtcggcgtgcgggtagaggatgaggcggtattcgcagatacgcaccacctgatccttgagcttgttcacgccggggttgtcgacggcctgcgcattgaccatgtggacgggcttgccgatccgctgggctatttgcagcgactgcgtgcggctaccggaccggattgctacatcacggtggaaaaaatcctcgccaaaggggaacagcttcctccggagtggcccatctcaggtactacgggttatgagtttatcgcctccctggcggaagtgctggtggatgataccaacctctcgcggctggagatgctctacgacgagacgctgggtacgaccgtggacaggcaggcggaacttcgcaacgccaaagggctgatgaccgatcgtaattttgagggtgaatttaccacgttgctcaaaatagccagcgagctggccgggcataacggcgccgaagtggagcatgatgatatccgccatgcactgcgtgagctgcttatcgcgtttccggtgtatcgcacctacggcaccgctgagggactgacgccaccggatgtggcgctgctcagccgtgtggtcgccagcgtcaacgcctctgaacccgctctgagcctgatagtgcgtattcttaccggcgatctgccggagcatgaccacgcgctggcctcgcttttccgcacccgttttcagcaactgaccgggccgctgatggcaaaatcggtagaggatacgctgttcttccgccataacctggagctggccctgaacgaagtcggcgccgacccgacgccgcgcgcgttttcactttcccgttttcatcaggaaatgcgcattcgtcttgcccgccagcccgatgcgctgctgggaacctccacccacgacaccaaacgcggcgaggatgcacgagctcgtctctatacgctgacggaagcgccagatctgtggggagaaaatctggcgcgctggcggcagatgaaccagacgcaggtccgattcctcaacgatggcaccgcgccgaacgccgccgacacctggatgatcttccaggcgctggcgggcgtctggccagcaaccctgtcgcctgaggatcgtgatggccttaagtcactggaagagcgtttcctcggctttatcgagaaagccctgcgcgaggccaagcagcgtaccgactggatcgacagcaacgaaggttacgagagcgtggtcctggactacgtgcgccatctgctttccccggataacaccctgttcctgcgtgatttcagtgccgcactccagccgtttattcgggctgggttaatgaacagcctgagccagacggtgatcaagctgactgcgcctggcgtaccagacatctaccagggcagcgaggggcttaacttcagcctcgtcgacccggataaccgccgcgaaccggatttcgccgcactggcggaaaacctcagcgtagcggatggcaccgtttttaacgatgcgcaacgctggcgagacggcagcgtgaagcagtacgttaccgccacgctgttacggcttcggccacattaccccgcacttttccgctacggcgactggctgccgctgaaggtaaccggtgagcgggaggagaatctgatcgtttatgcccgcataaaagatgacgaggcgctgatcgtcgccgtgccgcgtctggtgtttgacgtcaccgacaatgcgttgctgtgggccaacactatcgtggccataccccaggagttggccgggaagcactaccgggatctgtttaccggtgagcgtcgccttctgccagatacgctggatttaacgtctgaaaagggatgtttgttggttctgcttacctgcgactaa

SEQ ID NO: 1908 - DNA, 2091 bp, Enterobacter cloacae
tcgaggagaacaaaaatgccaaaggatacaacgtttgaaattcgggccggtcatggccagcagttgggcgcaaattatgacgggaaaggggtaaacttcgccctgttttccgcccacgcggagcgggtggagctgtgtctgtttgatccttcgggaaaaacagaaatcgcccgactggaactgccggaatatacccatgaggtctggcacggctatgtgccggatctgaaaccgggggcgctgtatggctaccgtgtgtatggcccctacgatccggagaacggtcaccgttttaaccccaataagctgcttattgacccctatgcccgtgaactggtgggtgacattgagtggaacgatgcccacttcggctatgagctgggacacgatgagctggatctcagttttgacacgcgagacagcgcgccatttacgcccaaatgtaaggtcatcgaccccaatgccgttgactggcaggactcacgccggcccgatatcccgtggccgcataccgtggtctatgaaagccacgtaaaaggctttacccagcttaacccggctattcagcctgaactgcgcggtacgtttgaggggatggggcataaagcctcggtggagtacatcaaaagcctcggcattacctcggtcgagctgctaccggttcactggttccctgacgatcagcacctgctcgatcgcggcctgaaaaacttctggggctataactcgctcggtttctttgcgccagcgtcccgctattacggcccggcgggcatccagggtttccgcgacatggtgcgtgcctatcatgacgcgggcatcgaggtgatcctcgacgtggtctataaccacacggcggagggcaacgagctgggaccaaccctgtcgtttaaggggattgataacttctgttattaccgcaccatgccggatcagcaccggtattacatcaacgacaccggcaccgggaacaccgttaatacatcgcacccgcgcgtgttacagatggtcatggactccctgcgctactgggcggagtcgatgcagattgacggtttccgctttgacctcgggaccattctcggacgtgagccggaggggttcgatccgcgcggcggcttctttgatgccgtgacccaggatccggtgctgtcgaagctgaagctcatcggtgagccgtgggatatcggccccggcgggtatcaggtggggggcttcccacctggctggggtgagtggaacgacaaataccgcgatacggtacgtgaatactggaagggggataacgtttctaacgattttgccgcccgtctgttagggtccggtgatttgtacgatctgcgcgggcgtcgtccgtgggccagcgtcaattttatcaccgcgcatgacggcttcacgctgaacgacctggtatcgtacaacgagaaacataacgccgataacggggaagataataacgacggacataacgataaccgttcgtataactacggcgaggaagggccgacggaaaacccggatatcattgccacccgcgagcggcaaaagcgcaacttcctcaccacgctcttcttctcgcacggcacgccgatgctgctggcaggcgatgagtttggccggacgcaaaagggcaataataacggctattgtcaggacagcgagatctcctgggtaaactgggaaggactcactgaaaacgacgagaagctgcgcgactttacccgtcggttgattgccctgcgcgcgacgcagccgctgctgcgacgtgagaactggcgcgacgggctggagatccgctggtttaacgccggtggcggaccgcagcagtcggaacagtgggacgagggttccacccttggtcttgccatcagccgtcctgatcttgagcaggaagagggcgtctggcaagacgtgctgatgctgtttaacccgtttgaaggtacggtgccattccagatcccgcagtttggcgaagggggttgggtgctcgaactctcgacgtcggaggatgccaccacgggtgaaatcatcactgaatctgtcgattacgagctggccgggcggagtatcaccctgttccgccgtccttaa

SEQ ID NO: 1909 - DNA, 963 bp, Enterobacter cloacae
aacgccttatctgaatgtacaggaatgagcgctatgaccgatccagattttaatttactgattgcactcgacatattgctgagcgaagcgagtgtcgcaggtgcggcacgccgtctgaacctcagcacctcggccatgagccggacattaagcaggttacgcgacgttacaggcgacccgatcctggtgcgcgccgggcgtaacatggtactaaccccgtgggccgaagcgacccgggatcgcgccaggcgtgcagtgcacgagaccagggcggtattgcagccctcaactgaaacgttcagcgcgcgaagtctggcgcgtctttttaccatcagggcaaacgatggttttgtggtggcgtttgggcctgcgcttatagcggctgtggccgacgccgcgccggacgtctgtatacgcttcgcgccgaagccggaaaaaacgtcgcgctatcttcgggaagggctggttgatctggagattggcgtccagagcaatatggggcctgaaatacggctgcaacgactgtttgaggatcggtttgtgggcgtcgtgcgtaaagggcatccgctggctaatcaggcagaaataggggtgaaggattatgtcgcctggggccatgtggtagcgtcacctgagggcgcgttgcacggttccgttgacgatgcgctggccgaactggggacaaaacgtaaaatcgccagcgtcgtaccgggatttccgacggcgctgtccgtggcgctggcatcagatcttgttgccatgatacccgcgctctatttactcaatcagcagataacggagcagttacacgttttcgagctgccgttcaaaagccgtcgtattacggtttcacagatgtggcacccaagaatggaacgcgaccctggtcaccgctggctgagagagcaaattcttgcgatatgcggtgtggagaggtcagacatgataaagagcgctgtatag

SEQ ID NO: 1910 - DNA, 294 bp, Enterobacter cloacae
agcaattgctatacaagaggtatacccatgaaatcagatgttcaactcaatctcagagccaaagaatcccagcgggcgcttatcgatgccgccgcagagatcctccataaatcacgtacagacttcattctggagatggcctgtcaggcagccgagaatgtgatcctcgatcgacgtgtattcaattttaacgatgaacagtacgcagagttcattgacatgctcgatgccccggtcgcggacgatcctgccatagaaaaactgctggcaaggaaaccgcagtgggacgtgtaa

SEQ ID NO: 1911 - DNA, 1788 bp, Enterobacter cloacae
atggaattcagaacatgtcgcaggcactggggtgctgagtttatttccgatgacgttgtacgttttcgcgtctgggcagaagggcaaaaagatctcacgttgcgtttaaccgataccgacattcccatggcggcggtgggcgacggctggtttcagattgacgtgcccggcgtcaggcacggtacgacgtatcagtttgttttacaggatggaatggcggtgccggacccggcctcgcgcgcgcagcaggctgacgtcaatggcccgtcggtggtgatcgacccgcgtcgcagcctgcccgctcagcgcgaatggcaaggacgaccgtgggaagagacggtgatctacgagctgcatatcggcaccttcaccggggaaggaaccttcaggtcggccatagacaaactgccttatctggccgaactgggtattacgcaactggaagtgatgcccgtgtcccagttcgggggcgcgcgcggatgggggtatgacggtgtactgctgtatgccccgcactcggcttatggtacaccggatgattttcatgccttcattgatgccgcccacgcgctcgggctttccgtggtgctggatatcgtactcaaccactttggcccggaagggaactacctgccgttgctctcgccggcgtttttccatcaggatcgtatgaccccgtggggcaacggtattgcctatgaggttgaagctgtccggcaatacatcgctgaggcgccgttattctggctctcggagtatcatcttgacggtctgcgcttcgacgccatcgaccagatccatgacgacgctgagacccatattcttcccgagatagcgcaacggatccgcgacgcctttccggatcggcatatccatctgaccaccgaagacagtcgcaacgtgattttcctgcatccgcgtgatgagcatggtcagacgccgcttttcaccgccgaatggaatgatgattttcacaacgccgcgcatgtcttcgcgacgggagaatcacacgcctactatcaggattttgcctttgagcccgagaaaaaactggcgcgggcgctggcagaaggctttgtctaccagggagaaatctcgcttcagaccggaaaatcgcgcggggtagagtgtcgcgagcaacccccacagttttttgtcgattttattcaaaatcacgaccaggtcggcaaccgtgcccagggggagaggcttatctctctggctggggcggataaaacgcgcgtgctgttcgcggcgctgctcctgtcgccccatattccgctgctgtttatgggcgaggagtatggcgaaacgcatccgttcctctttttcaccgacttccacggcgacctggcgaaagcggtgcgggaagggcgcgcgaaagagtttaccggccatgccgggcacgatgaaaccgtaccggaccccaatgacttaaatacctttatgcggtcgaagcttgactggaacaaggcagacacggaggaaggcagggcgtggctgcacgtcacgcgcgagctgattgtgctgcgtcagcgctttatcgtcccgttactgaaacagcggggcaccgtggagggtaacgtcctgcaaacggcgctcggtatggttgccgtgagctggcgttttccgtccggcacgttgtcgctggcgttgaatatcggcaaaaagccgctcgccttaccggacctgcccggaaaaacgatctttagctggccggaggcagtcgaaaacctgccgccgaacagcattgttgttcgctttgctgatggagaagcagcgctatga

SEQ ID NO: 1912 - DNA, 663 bp, Enterobacter cloacae
tgtttcataagcgccgatcctgccagctcccgtggtgaagacttagtcggtaaaaaagtgggtatgacccgcatcttcactgaagatggcgtttctatcccagtaaccgtaatcgaagttgaagcaaaccgcgttactcaggttaaagatctggctaacgatggctaccgcgctattcaggttaccactggtgctaaaaaagctaaccgtgtaaccaaaccagaagcgggtcacttcgctaaagctggcgttgaagctggccgtggtctgtgggaattccgtcttgctgaaggcgaagagttcaccgtaggtcaggacattagcgttgagctgtttgctgacgttaaaaaagttgacgtaaccggtacctctaaaggtaaaggttttgctggtaccgttaagcgctggaacttccgtacccaggacgctactcacggtaactccttgtctcaccgcgttccgggttctatcggtcagaaccagactccgggcaaagtgttcaaaggcaagaaaatggcaggtcagctgggcaacgaacgtgtaaccgttcagagcctggacgtagtacgtgttgacgctgagcgcaacctgctgctggttaaaggtgcggtcccgggtgcaaccggtagcgacctgatcgttaaaccagctgtgaaggcgtaa

SEQ ID NO: 1913 - DNA, 368 bp, Enterobacter cloacae
  unsure (301)
aggcgtaaggggatagcaatggaattagtattgaaagacgcgcagagcgcgctgactgtttccgaaactaccttcggtcgtgatttcaacgaagcgctggttcaccaggttgttgttgcttatgcagctggtgctcgtcagggtactcgtgctcagaagactcgtgctgaagtaactggttcaggcaaaaagccatggcgccagaaaggtaccggccgtgcgcgttcaggttctatcaaaaacccgatctggcgttcaggtggcgttgacttcgctgcgcgtccacaggaaacacagtcanaagttaacaaaaagatgttacgcggcgcgctgaaaagcattctggtccaactgggtacgtcaggatc

SEQ ID NO: 1914 - DNA, 921 bp, Enterobacter cloacae
ctacaacatgatggttcactaagagcggcgagtatgtttaagcaatacctgcaagtcacgaaaccaggcatcatctttggcaacctgatctccgtaatcggagggttcctgctggcctctaaaggcagcattgattacaccctctttatttacaccctggtcggtgtgtcactggtggttgcgtccggttgtgtatttaacaactacatcgacatggatatcgacaagaagatggaaaggaccaaaaatcgggtgctggttaaaggcctgattgccccttccgtctcgctggtgtacgccaccttgctgggtattgctggctttatgctgctgtggtttggtgctaacccgctggcctgctggctgggggtgatggggttcgtggtgtatgtacgcgtctacagcctgtatatgaaacgtcactccgtctacggcacgctgattggttctctctccggcgctgcgccgccggtgattggctactgcgccgtcacgaacgagttcgacagcggtgcgctgatcctgctggctatctttagcctgtggcagatgccgcactcctacgccatcgcgattttccgctttaaggattatcaggcggcgaacattccggttctgccggtcgtgaaaggcatttcggttgccaagaaccacatcacgctctacatcatcgcttttgccgtggcaacgctgatgctctctctgggcggttacgccggatataaatatctggtggtagcagctgcggtgagcgtctggtggctcggcatggccctgcgcggttacaaagtggaagatgacaaggtctgggcacgcaagctgtttgtgttctcgattgtcgccatcacctccctgtccgtgatgatgtccgtagacttcatggtgcctgattcacaaaacctgctgacttacgtctggtaa

SEQ ID NO: 1915 - DNA, 1374 bp, Enterobacter cloacae
actgaggtggtaatgaacgattataaaatgacgccaggcgaactgcgtgcgacctggggtttagggactgttttctcgctgcggatgcttggcatgtttatggtcctgcccgttctgaccacatatggcatggcgttacagggtgccagcgaagcgctgatcggtctggcgatcggtatctacggcctggcgcaggcaatattccagatcccctttggcttgctctccgaccgcgtgggtcgtaaaccgctgattgtcggcgggctgctggtgtttgtgctcggcagcatcatcgccgccctctcccactctatctggggaattattcttgggcgcgccctgcaaggttccggggcgattgccgccgccgtgatggcgctgctgtcagacttaacccgcgagcaaaaccgcaccaaagccatggcgtttatcggcgtcagctttggcgtcacgtttgccattgccatggtgctggggccgattattacccattcactcggcctgcacgccctgttctggatgattgcgatgctggcgaccatcgggatcgcactcacgctgtgggttgtacctgacagtaaaaaccacgtcctcaaccgtgaatcagggatggtgaaaggctgcttcagcaaagtcatcgtcgagccgcgcctgcttaagctgaacttcggcattatgtgcctgcacattctgctgatgtccacctttgtcgccctgcccggtcaacttgccgcagcaggtttcccggcggcagagcactggaaaatttatctggtcacaatgctgatctcgtttgtctccgttgtgcccttcattatttacgccgaagtgaagcgcaaaatgaaacgcgtcttcgtgggctgcgtggcgttactgttgattgccgagattgtgctgtggggcgccggcccgcatttctgggagctgatcgctggcgtacaactgttcttcctggcctttaatctgatggaagccctgctgccgtcgcttatcagcaaagagtctccggcaggatacaaaggcaccgcgatgggcatttactccaccagccagtttctcggcgtggcgatcggcgggtcactcggcggctgggtggatggtctgtttgactcccagaccgttttcctcgccggtgcgctgctggcgatgctctggctgtttgtggccagcaccatgaaagagccgcgttacgtgagtagcctgcgggtagaaattcccgatgacgtggcaatcggtgacgcgttacaacagcgtctggaagcgacagagggcgtgagcgaagtgctgattgtcccggaagagcgcagtgcgtatgtcaaaattgacagcaaagtgactaaccgctttgaggtagagcaggcgctgaaggcctga

SEQ ID NO: 1916 - DNA, 615 bp, Enterobacter cloacae
gacaaaggatctatgcctgacggcactatcctgtctaccattgcagcaatctgtgatttcaaggaattaaacgcaatgacaagacgttacctgaaaatagtgctggtggggagcctgttcacgcttagcgcctgcgcacagcaaagcgaagtccgcgagatgaaacaaagcgtgaatacgcttaacgtggcgatggacaaacttaataaagaaaccgtgaagatcacccagcagaacgcgctgaatgccaaatccagcaatggcgttcatttattgccaggtgcaaacacgcccgcgcgtctgaacagccagattggcacgctaaagatgtctctggtgaatgttgcagcgaatgccgatggtactcgcgcaacattacgcattcagggtgagtccaacgatccgctgcccgcgttcagcggcaccgtagagtggggccagattcagggcaccacggagagctatcaggaagtgaacgtgaagaatcagcttttcaccgcccccgccagcacgctggcgccgagcgatgttgacatcccgctccagctgagcggactgacgccagaacagctgggctttatccgtattcacgacattcaacccgccgcgcaataa

SEQ ID NO: 1917 - DNA, 2031 bp, Enterobacter cloacae
gccacgcggaaaccgctcactaaggggccgaggaagaaaatgttcggaaaattgacactggatgcagtgccctaccatgaaccgattattatggttacggtggctgcaattatcattggtggcgcggccttagttggcctgatcacttacttcggtaagtggagctacctgtggaatgagtggctgacttcggttgaccacaaaaaactcggtatcatgtactgcatcgtcggtatcgtcatgttaattcgtggctttgcggatgcaatcatgatgcgtagccagcaggcgcttgcgtctgcgggcgaagccggcttcctgccaccgcaccactacgatcagatctttaccgcccacggcgttatcatgatcttcttcgtggcgatgccgctggtaatcggtctgatgaacgtggtcgttccgctgcaaatcggcgcgcgcgacgttgcgttcccgttcctgaacaacctgagcttctggttcacggttgtcggcgttatcctggttaacctgtcactgggtgtgggcgaatttgctcagaccggctggctggcctacccgccgctgtcgggaattgagtacagtccgggcgtgggcgttgactactggatttgggcgcttcagctctccggtgtcggtaccactctgaccggtattaacttcttcgtgaccatcctgaagatgcgtgcaccaggtatgacgatgttcaagatgccagtatttacctgggcatctctgtgcgccaacgtcctgattatcgcgtcgttcccaattctgaccgtcaccatcgcgctgctgaccctggatcgctatctgggtacccatttcttcacgaatgatatgggtggcaacatgatgatgtacatcaacctgatttgggcctggggtcacccggaagtgtacatcctggttctgccggtgttcggtgtgttctccgaaatcgcggcaaccttctcgcgtaaacgtctgtttggttacacctctctggtgtgggcaaccgtatgtattaccgttctgtcgttcatcgtctggctgcaccacttcttcactatgggtgcgggcgccaacgtaaacgccttcttcggtattaccaccatgattatcgcgatcccgaccggggttaagatcttcaactggctgttcaccatgtaccagggtcgtatcgtgttccactcagccatgctgtggaccatcggcttcatcgtaaccttctccgtaggtgggatgaccggggtactgctggcggtacctggtgctgacttcgttctgcacaacagtctgttcctgattgcgcacttccataacgttatcatcggtggtgttgtcttcggctgcttcgctggtgtgacctactggtggccaaaagccttcggtttcaccctgaacgaaaaatggggtaaacgcgcgttctggttctggatcattggcttcttcgtagcatttatgccgctgtacgtgctgggcttcatgggtatgacccgtcgtctgagccagcagatcgatccgcagttccacccaatgctgatgattgcagcgggcggcgcagcgctgattgcctgcggtattctgtgccagctgattcagtactacgtgtctatccgtgaccgtaacctgaaccgcgacctgaccggtgacccgtggggtggccgtacgctggagtggtctacctcttctccacctccgttctataactttgccgtagtgccgcacattcatgagcgtgacgcattctgggaaatgaaagaaaaaggtgaagcgtacaagcaacctgaacattacgaagagatccatatgccgaaaaacagcggtgcgggcatcgtcattgccgccttcgcaacggtatttggtttcgcaatgatctggcacatctggtggatggcgattgttggcttcgctggcatcgtaatcagctggattgtgaagagctttgacgaggacgtggactactacgtaccagtccgtgaagttgaaaagctggaaaaccagcattttgacgagatttctaaagcggggctgaaaaatggcaactga

SEQ ID NO: 1918 - DNA, 423 bp, Enterobacter cloacae
ccgtacccgtattatgtgcctgagcctgttctggcacttcctggacgtggtatggatctgtgtgttctctgttgtctatctgatgggggcgatgtaatgagtcattctaacgatcatggcgcttcccacggcagcgtaaaaacctacatgacaggtttcatcctgtcgatcattctgacggtgatcccgttctggatggtgatgaacggttctgcatctaagccggttatcctgggcgcaatcctggtgaccgcggtgattcagattctggtgcatctggtttgcttcctgcacatgaacaccaagtccgatgaaggctggaacatgacggcctttatctttaccgtgattatcatcgctatcctggtagttggttccatctggattatgtggaaccttaactacaacatgatggttcactaa

SEQ ID NO: 1919 - DNA, 921 bp, Enterobacter cloacae
ggaggaacgatgaaagtaacagtgcttggatgcggagcccttggccaactctggcttacagcgctatgcaaacagggacacgacgttcagggctggctgcgaattccccagccctattgcagtgtgaacgtgatgggtacagacggttcaatttttaatgagtctttgacggcaaacgatccggaatttcttgccaccagcgatttgctgctggtcacgctgaaggcctggcaggtctccgatgcggtgaaaagcctggccgcccagttacctgaaagcacgccaatcctgctgattcacaacggtatgggtaccattgaagagctaaaatctgtccggcaaccgctgctgatggggacaaccacccacgcggcgcgtcgcgacggtaacgtcattatccatgttgccagtggcatcactcatatcggtcccgcgcgtgaacagcccggcgattacagctatcttgcggataccctgcaaagcacgctgcctgacgtcgcctggcacaataacattcgcgcggaactgtggcgcaaactggcggtgaactgcgcgattaatccgctgaccgccctgctggattgccctaacggtgaactgcgccagcatcctgatcgggtagcgctgatttgccgggaagttgccgccgtcattgaacgcgaaggctaccacacctcagagtccgatttacgttattatgtcgaccaggtcattgagagtacggcagaaaatatctcctcaatgttgcaggatatccgggctatgcggcataccgaaattgattacattaccggttatctgttaaaacgcgcccgggcacacggcattaccgttgcggaaaacagccgtctgtttgagttagtaaaacgaaaggagagtgagtatgagcgcatcggcactggtatgcctcgcccctggtag

SEQ ID NO: 1920 - DNA, 1005 bp, Enterobacter cloacae
acgtattgtttaaacagcaggagcggaaccatgcaatacacgacattaggaaaaacggaccttaaggtgtcccggctttgcctgggatgcatgacgtttggcgagcctgaccggggaaatcatgcctggacgctgccggaagagagcagccgccccatcatcaagcgcgccattgacggcggcatcaacttcttcgataccgccaacagctactccgacggcagcagcgaagagattgttggccgcgccctgcgagattttgcccgtcgtgatgacgttgtggtcgccactaaggtgtactacccgtcaggcgacctggcggaaggcctttctcgcgcgcagatcctgcgttctattgatgacagcctcagacgcctgaacatggattacgtcgacctgctgcaaatccaccgctgggattacaacaccccgatcgaagagacgcttgaagcgttgaacgacgtcgtgaaagccggtaaagcgcgctacatcggcgcatcgtccatgcatgcctcacagtttgcccaggcgctcgatctccaggcacagcacggctgggcgcgctttgtcaccatgcaggatcactacaacctgatttaccgggaagaagagcgcgagatgctgccgctctgctaccaggaaggcgtggcggtgatcccgtggagcccgctggcgcgcggaaggttaacccgtccgtggggcgaaaccaccgcccggctggtatcggacgaagtgggtaaaaacctgtatgacgatacagaaaccagcgatgcgttaattgccgaacgcttagccgggatcgccgacgatatcggtgcaacgcgcgcgcaggtggcactggcgtggctgctgagcaagcgcggtgtcgccgcgccgattgtgggcacatcgcgggaagaacagctggatgagttgttgagtgcggtggacttatcgttgacgccggagcagattgccgagctggagacgccgtatcagcaacatccggtggtagggtttaaataa

SEQ ID NO: 1921 - DNA, 618 bp, Enterobacter cloacae
aaaatggcaactgatactctggcgcactcgactgcccacgcgcatgaacatgcgcaccatgatacaggaccgacgaaagtcttcggtttctggatctacctgatgagcgactgcatcctgttctgctgtctgttcgcaacctatgccgttctggtgaacggcacagcgggcggcccgaccggtaaggacatctttgagctgccgttcgtactggttgaaaccgcactgctgttattcagctccatcacctacggcatggcggctatcgccatgtacaaaaacaacaagagccaggttgtctcctggctggcgttgacctggctgtttggtgctggctttatcgggatggaaatctatgaattccatcacctgatcatggaaggtttcggcccggatcgtagcggcttcctgtcagcgttcttcgcgctggtcggcacccacggtctgcacgtgacctcgggtctgatctggatggcggtactgatgttccagatctcccgtcgcggcctgacaagtactaaccgtacccgtattatgtgcctgagcctgttctggcacttcctggacgtggtatggatctgtgtgttctctgttgtctatctgatgggggcgatgtaa

SEQ ID NO: 1922 - DNA, 609 bp, Enterobacter cloacae
aacgaaaggagagtgagtatgagcgcatcggcactggtatgcctcgcccctggtagcgaagagacagaagcggtcaccaccattgatttgctggtacgtggtggtattaaggttactaccgccagcgtcgccagcgacggaagcctggcgattacctgctcgcgtggggtgaagattctggcggatgcaccgcttgtacaggtggcggacggtgattacgacattatcgttctgccgggtggtctgaagggggctgagtgtttccgcgacagcccgctgctggttgaaaccgttcgtcagtttcatctttccgggcgtatcgtcgcggcaatctgtgcagccgcaggtacggtgctggttccgcacgacattttccccatcggcaatatgaccggcttccctggtctgaaggatacaattccggaagaccagtgggtggataaacgcgtggtctgggatccgcgcgttaacctgctcaccagccaggggccgggcaccgccattgattttggcctgaagattattgacctgctggttgggcgcgaaaaagcgtacgaagtggcttcgtcgctggtgatggcggcggggatttataactactacgaataa

SEQ ID NO: 1923 - DNA, 249 bp, Enterobacter cloacae
ttcactatgccgaagaagaacgacgcaccggccagttttgaaactgcgctgagtgagcttgagcagattgttacccgcctcgagagcggcgatttaccgctggaagatgccctcaacgaatttgaacgcggtgtgcagcttgcgcgccaggggcaggtaaagcttcagcaggccgagcagcgtgtgcagatcctgctttccgacagcgaagacgctaaaaccacgccattcacaccggacgccgagtaa

SEQ ID NO: 1924 - DNA, 900 bp, Enterobacter cloacae
atggatttctccaacgcgcttcaggcgcgcgtcatccgcgccaacgatgcgctgcgccgattcattgagccgcagccttttcagaacactccactggttgaagccatgcactatggcgcactcttggggggtaaacgcctgcgtccgttcctggtatatgccacgggcaacatgttcggtatcagcgataacacgctggacgccccggcagccgccgtggagtgtatccacgcctattcgctgatccacgatgatttgccagccatggacgatgacgatctgcgtcgcggtcagccaacctgccatatcaaatttggcgaagcgaatgccattctggcgggtgatgcgctgcaaactctggccttctccattctgagcgatgcgccgatggttgaagtgagcgatcgcgatcgtctggcaatggtgtccgaactggcaatggccagcggcgtcgccgggatgtgcggcggccaggcgctggatttagaggctgaaggtcgtcaggttactctggaacagctggagcgcatccaccgtcacaaaacgggcgcactgattcgtgcagccgttcgcctgggcgcgctgagcgcgggtgaacgcgggcgtaaagccctgccgattctggacagatacgcagaaagtatcggtctggcattccaggttcaggatgacattctggatgtggtgggcgatactgcaacattgggaaaacgtcagggtgcggatcagcagcttggcaaaagtacctatcccgccctgttgggccttgagcatgcccaacgtaaagcccgggatctgatagacgatgcccgccagtcgctgaatgagctggccgcgcaatcgctggatacctcggcactggaagcgctagcggactacataatccagcgtgataaataa

SEQ ID NO: 1925 - DNA, 1887 bp, Enterobacter cloacae
actataaatctcgatgagcctttgatgagttttgatattgccaaatacccgacactggcgttagttgactccactcaggagttacgtctgttgccgaaagagagtctgccgaagctgtgtgacgagctgcgtcgctacctgctcgacagcgttagccgctccagcggccacttcgcctccggacttggcacggttgagctgaccgtggcgttgcattacgtctataacacgccgttcgatcagctgatctgggatgtcggccaccaggcctatccgcacaaaattctgaccggtcgtcgcgataaaattggcaccattcgccagaaagggggcctgcacccgttcccgtggcgcggcgagagtgaatatgacgtgttaagcgtcggccactcttccacctccatttctgcgggcattggtattgccgttgccgccgaaaaagagaataaacaacgtcgcactgtctgcgtgattggcgacggggcgatcaccgccgggatggcctttgaggccatgaaccacgcgggcgatatcaaaccggacatgctggtgatcctcaacgataacgaaatgtcgatctccgagaacgtcggcgcgctgaataaccatctggcgcagctgctgtccggcaagctttactcctcactgcgtgaaggcggtaaaaaagtcttctccggcgtaccgccgatcaaagagctgcttaagcgtaccgaagaacacatcaaaggcatggtcgtgccgggtacgctgttcgaagagctgggctttaactatatcggcccggtggacggccacgatgtgctgggcctggtgacgacgcttaaaaacatgcgcgacctgaaaggccctcagttcctgcatatcatgaccaaaaaagggcgtggttacgaaccggcggagaaagatccgatcaccttccacgcggtgcctaagttcgaccataccagcggctgcctgccgaaaagcagcggcgggatgccgagctactcaaaaatcttcggcgactggctgtgcgaaacggcggcgaaagacaacatgctgatggcggtgacgcctgccatgcgtgaaggctccggcatggtggagttttccaaaaaatacccggaccagtatttcgacgtcgccattgccgagcaacacgcggtcacttttgctgcgggcctggcgattggcggctacaagccggtggtggcgatctactctaccttcctgcaacgcgcctacgatcaggttatccatgacgttgccatccagaagctgccggtgctgtttgctatcgatcgcgcgggcattgtgggggctgacggccagacgcaccagggcgcgtttgatctctccttcctgcgctgcatcccggacatggtgatcatgacgccaagcgacgaaaacgagtgtcgtcagatgctgtataccggttaccactatcaggacggcccctgcgccgtacgttatccgcgcggtaatgcccttggcgttgaattacagccgctggaaaaactggatatcggtaaagctctggtgaaacgccgcggtgaaaaagtggcgatcctgaactttggtacgctgatgccggaagcggcaaaagtcgctgaaaaccttaatgcgacgctggtcgatatgcgcttcgtgaagccgctcgatgaatctctgattctgagcatggcggaaagccatgacgtgctggtcacgctggaagagaacgccatcatgggtggcgcgggtagcggcgtgaacgaagtgctgatggcgaaccgtaaagccgttccggtgcttaatctcggcctgccggaccacttcatcccgcaaggcacccaggatgaggcgcgcgccgacattggtctggacgccgccggtatcgaagccaaaatccgcacctggctggcctga

SEQ ID NO: 1926 - DNA, 1209 bp, Enterobacter cloacae
aaaagctcgataaagtcgcctatatccgctttgcctccgtttaccgcagcttcgaagacatcaaagagtttggcgaagagatcgcccgcttacaggattaagaccatgcacgacgagatgtacatggcgcgagccatgaagctggcgcagcgcggtcggtttaccactcaccctaaccccaatgtcgggtgcgtcattgttaaagatggtgagatcgtgggggaaggttttcactatcgcgcaggcgagccgcatgctgaagtgcatgccttgcgcatggcgggggagaaagcgcgtggcgcgacggcctatgtgacgctggagccatgcagccaccatgggcgtacgccgccgtgctgtgaagcgctgattgcggcgggcgtctcgcgcgttgtcgccgccatgcaggatcctaacccgcaggtagcgggccgcggactgtatcgtctgcaacaggaaggaatcgacgtcagccacggcctgatgatgcaggatgcggaagccctgaataaaggcttcctgaagcgtatgcgcaccggcttcccgtttatccagcttaagcttggcgcgtcactggatggccgcacggcgatggcgaacggcgagagccagtggatcacctcgccacaggcaaggcgcgatgtgcaacgtctgcgcgcgcaaagccatgctattctcaccagcagtgaaacggtactggctgacgatccggccatgaccgtacgctgggaagagctgaatgcagatacgcaggcgctctatccgcaggagaacctgcgtcagccgctgcgcattattattgatagccagaaccgcgtgacgccggagcaccgcatcgtgcagcagccgggggaaacctggattgcacgcaccaaagaagatacgcgcgaatggccgcaaggcgtgcgcagcattacggtgccggaacataacgggcatctggatctggtggtgctgatgatgttgctcggcaaacagcaggtcaacagtatctgggttgaagccggtccgacgctcgccggcgcactgcttcaggcggggctggtggatgagcttctcgtctacgttgcgcctaaactgttaggtaacgacgcgcgcggcctgtttgtgctgcccggccttgaaaaactggccgatgcgccgcaactctcattcagtgagattcgtccggtaggcccggatgtctgcctccatttaacgacagcgtaa

SEQ ID NO: 1927 - DNA, 480 bp, Enterobacter cloacae
aggaagagtatgaacattattgaagctgctgtagctaccccggacgctcgcgtcgccatcaccattgcgcgtttcaacaacttcatcaatgatagcctgctggaaggtgcggttgacgccctgaaacgtatcggccaggttaaagatgacaacattaccgtcgtttgggtaccaggtgcttacgaactgccactggcagcgggcgcgctggcgaaaaccggtaaatacgacgcggtgattgcgctgggtactgttattcgtggcggcactgcgcacttcgaatacgttgcgggcggtgcaagcaatggtctggcgcacgttgcgcaggatgctgaaattcctgtcgcgttcggcgtgctgaccaccgaaagtattgaacaagccatcgaacgtgctggcaccaaagccggtaacaaaggtgcagaagctgcactgaccgcgcttgaaatgatcaatgtattgaaagccatcaaggcctga

SEQ ID NO: 1928 - DNA, 441 bp, Enterobacter cloacae
tttttttgtaaggggaattccgtgaaacctgctgctcgtcgccgcgcccgtgaatgtgccgtccaggcactttactcctggcagttgtcccagaacgacatcgctgatgttgaataccagttcctgtcagaacaggacgtgaaagacgttgacgttctgtacttccgtgaactgctgtcgggagtggcgactaatagcgcgtatctcgatggtctgatgaagccatacctgtcccgtctgctcgaagagctgggccaggtcgaaaaagcagtgttgcgtatcgcgctgtttgagctgtctaaacgtgatgatgtgccgtacaaagtggccatcaacgaagcgatcgaactggcgaaaaccttcggcgctgaagacagccacaagtttgttaacggcgtgctggataaagccgcacctgcgatccgtccccacaaaaagtga

SEQ ID NO: 1929 - DNA, 555 bp, Enterobacter cloacae
gcttctcgttatgcctcgttgcgggtattatgcaacgcaacaaaaatgaagggagaagaaaagatgccatctttcgatattgtttctgaagttgatttgcaggaagcgcgtaacggcgtagaaaatgctgtccgtgaggttgagtcacgtttcgattttcgtggcgttgaggcgaccattgaactgaacgacgcgaacaagacgatcaaagtcctgagcgagtctgatttccaggtcaaccagttgctggatatcctgcgcgccaagctgctcaagcgcggcattgaagggacctcactcgatgtgccggaagattttgttcacagcggcaaaacctggtttgtggaagcgaagctgaagcagggtattgaaagcgccgtgcagaagaaaatcgtgaagcttatcaaagacagtaagctcaaagtgcaggcgcagatccagggggaagagatccgcgtaaccggaaaatcccgtgatgacctgcaatccgtgatggcgctggtgcgtggcggcgatctcggtcagccattccagtttaaaaacttccgcgattaa

SEQ ID NO: 1930 - DNA, 462 bp, Enterobacter cloacae
cagggacatcgtatgcattgcccattttgctccgctgtggataccaaagtcatcgactcacgtcttgtaggcgaagggtcttccgtgcgtcgtcgtcggcagtgtctggtgtgcaacgagcgttttaccaccttcgaggtggcagagttggtaatgccgcgcgtggtaaaaagtaacgatgtgcgcgaaccgttcaatgaagaaaaactgcgtagcgggatgctcaaggcgctggaaaaacggcccgtcagctccgatgacgtcgaaatggcgttaaaccacattaaatcttatctgcgggggttaggtgagcgcgaagtgccgagcaaaatgatcggcaatctggtgatggaacagctgaaaaagctcgataaagtcgcctatatccgctttgcctccgtttaccgcagcttcgaagacatcaaagagtttggcgaagagatcgcccgcttacaggattaa

SEQ ID NO: 1931 - DNA, 975 bp, Enterobacter cloacae
cgtatggcatgtggcgaattctccctgattgcccgttatttcgaccgtgtcagaacctctcgtcttgatgttgaaaccggcatcggcgatgactgcgcacttctcaatattcccgaaaaacagacgctggcaatcagcaccgacaccttagtgtgtgggcgacatttcctgcccgacatcgatcctgccgatctggcgtataaagcactggcggttaacgtcagcgatctggcggcaatgggcgccgacccggcctggctgacgctggctctgaccttgccagaggtggatgaagcctggcttgaagccttcagcgatgccctgtttgagcagctgaattattacgatatgcagctgattggcggtgataccactgccggtccgctgtcgatgaccctggcaatccacggctatgtgcctgccgggcgcgcgctgaaacgttcgggcgcaaaaccgggcgactggatctacgtgaccggtacgccgggggatagcgcggcagggctggcaatccttcagaaccgtttaacggttgaagatgctgacgatgcggcgtacctggtgaagcgccatctccggcccacgccgcgtattttgcacggccaggcgctgcgcgagcgggccagttcggctatcgatttgtctgacgggctgatctccgatctcggccatatcctgaaagccagcggcgtgggcgcgcggatcgatctggatctgtttcctctgtcagagccgttgcgtcgccatgccgagcctgagcaggcgctgcgatgggcgttatccggtggagaagattatgagctgtgcttcacggtgcctgagctgaatcgcggaacactggatgtggcgttagcgcatctgggggcgaaatttacctgcatcgggcaggtgatgccggaaagtgaagggctgctgtttgtccgcgacggcgccccggttacgcttgactggaaagggtacgatcacttcgcgtaa

SEQ ID NO: 1932 - DNA, 1473 bp, Enterobacter cloacae
gcttgcctaagaaacattgccgccatgaagtttatcattaaattgttccctgaaatcaccatcaaaagccaatctgtgcgtttgcgctttattaaaattctcaccgggaacattcgtaacgtattaaaacactacgacgaaacgctcgctgtggtgcgtcactgggaccacgttgaagtccgcgcgaaagacgaaagcaaacgtcttgatattcgcgacgcgctgacccgtatcccgggtattcatcatattctggaagtggaagacgttccgttcagcgatatgcacgatatcttcgaaaaggcgctggtacagtaccgcgaccagatcgaaggcaaaaccttctgcgtgcgcgtgaagcgtcgtggtaaacacgagttcagctcgattgaagtcgagcgctacgttggcggcggtctgaaccagcacgttgagacggcgcgcgtgcgcctgactaacccggacgttaccgttaatcttgagatcgagaacgatcgtctgctgctggttaagggtcgttatgaaggtattggtggtttcccgatcggcacgcaggaagatgtgctgtcgctgatctcgggcggcttcgactccggtgtctccagctatatgctgatgcgtcgcggctgccgcgtgcactactgcttctttaacctgggcggcgcggcgcatgaaatcggcgtacgtcaggtggcgcattacctgtggaaccgcttcggcagctctcaccgcgtgcgttttgtggcgatcaactttgagccggtggtcggggaaatcctcgaaaaagtggacgacggccagatgggcgtggtcctgaaacgtatgatggtgcgcgcggcgtccaaagtggctgagcgctacggcgtgcaggcgctggtcaccggtgaagcgctggggcaggtctccagccagacgctgaccaacctgcgtcttatcgacaacgtgtctgatacgctgatcctgcgcccgctgatctctcacgataaagagcacatcatcgatctggcgcgtaaaatcggtactgaagattttgcccgtaccatgccggaatattgcggtgtgatctcaaaaagtccaaccattaaagcggtgaaggcgaagatcgaagcggaagaagagaacttcgatttcagcatcctggaaaaagtggtggcggaagcgtccaacatcgatatccgtgagatcgcccagcagaccgagcaggaagtggttgaggtggagacggtcagcggctttggtgctaacgatacgattctggatatccgttctgttgatgagcaggatgacaagccgttgcaggtggaaggcgtggaggtggtttcgctgccgttctacaagctgagcacccagtttggcgatctcgaccagagcaaaacgtatctgctgtggtgtgagcgtggggtcatgagccgtttgcaggcgctgtatctgcgcgagcagggcttcgcgaatgtgaaggtgtatcgcccgtag

SEQ ID NO: 1933 - DNA, 2160 bp, Enterobacter cloacae
aggagtgaacgaattttggcaacgacaaccgcagagcgcgtgattcaggcaacgccggattaccacgcattaaacgccatgctaaacctctatgaccgggaggggcgcattcagtttgataaagatcgtgaggcggtggacgccttttttgccgctcatgtgcgcccgaacagcatcgtttttggcagccagcaggaacgtctcgactggctggtaaaagagggttattacgaagagcgtgtcctgacccgctacgaccgcgccttcgtggtggcattgtttgaacgggcgcacgccagcggttttcgcttccagacgtttctcggcgcgtggaagtattacaccagctacaccctgaaaacctttgacggcaaacgctatttagaaagctttgaagatcgggtggtgatggtggcgctgacgctggcgcagggcgatgaagtgctggccgaaagtctcacggaggagatcctctccggccgcttccagcccgccacgccaacgttccttaactgcgggaaagcccagcgcggcgagctggtctcctgcttcctgctgcgtattgaagacaatatggagtcgattggccgtgcggtaaattcggcgctacagctttcgaaacgcggcggcggtgtggcatttctgctttcgaacctgcgggaagcgggcgcgccgattaagcgcatcgaaaatcagtcctccggcgtcatcccggtgatgaagatgctggaagatgccttttcgtacgccaaccagcttggcgcgcgtcagggcgcgggtgcggtttatctgcacgcgcaccacccggacattctgcgttttctggataccaaacgtgaaaacgccgatgaaaagatccgcattaaaaccctgtcgctcggcgtggtgatcccggatatcacgtttaagctggctaaagagaatgccgacatggcgctcttctcaccgtatgatgttgagcggatttacggcaaagcctttggcgacgtggcgataagcgagctgtacgacgagctggtggccgacgatcgcattcgtaaaaaaaccatcaacgcccgggatttcttccagacgctggctgaaattcagtttgaatccggttatccgtacatcatgtacgaggatacggtgaaccgcgccaacccgattggcgggcgcatcaacatgagcaatctgtgctcggagattttgcaggtcaacagcgcgtccagctacgacgagaacctcgactacgcggacgtgggcaaggatatctcctgtaacctcgggtcgctgaatattgcccacaccatggactctcccgattttggccgcacggtagagaccgccattcgcggactgacggcggtatcagacatgagccacatccgcagcgtaccgtctattgaagcgggcaacgccgcgtcgcatgccatcggccttgggcagatgaacctgcacggctatctggcgcgggagggcatcgcctacggcagccccgaagggctggatttcaccaacctttatttctacaccgtcacctggcatgcggtgcatacctcgatgatgctggcgcgcgaacgccaccagcggttcgcaggctttgagcagtcccgctacgccagcggagagtatttcagccagtatctggaaggcgactggcagccgaaaaccgaaaaagtacgcgcgctgtttgcccgcgctggcatcaccctgccgacgcgtgagatgtggcaacagctgcgtgaagaggtgatgcgctacggcatttataaccagaaccttcaggcggtgccgccaaccggctccatttcctatatcaatcacgccacgtcgagcatccaccccatcgtgtcgaagattgaaatccgtaaggaaggcaaaaccgggcgcgtctactaccctgccccgtttatgaccaatgagaatctggctctgtaccaggacgcctatgaaattggcccggaaaagatcattgatacctacgccgaggcgactaaacatgtggatcaggggctgtcgctgacgctcttcttcccggacaccgccaccacgcgggatatcaacaaagcgcagatctacgcctggaagaaaggcatcaaaacgctgtactacattcgcctgcgccagctcgcgctggaaggcaccgaaattgaaggctgcgtgtcctgcgcgctgtaa

SEQ ID NO: 1934 - DNA, 969 bp, Enterobacter cloacae
ggagaatggatgaaactgtcacgcgtaagcgccgttaactggaacaaaattcaggatgataaagacctggaggtatggaaccgcctgaccagcaacttctggctgccggaaaaggtgccgctctccaacgatattccggcctggcaaactctgagccatgccgagcagcagctgacaatccgcgtcttcaccggcctgacgctgctggacaccattcagaataccgtgggtgcgcccgcgctgatgagtgatgcgctgaccccgcacgaggaggcggtaatgtcgaatatcagctttatggaggcggtgcatgcccgctcttacagctcgattttctccactctgtgccagaccagggacgtggacgccgcctacgcctggagtgaagagagcgcgtcattgcagcgcaaggcagatctggtgctggaatattaccgggccgacgagccgctgaagaagaagatcgccagcgtattcctggaatctttcctcttctattccggcttctggctgcctatgtactggtcgagccggggcaagctcaccaacaccgccgatttgattcgcctcatcatccgcgatgaagcggtacacgggtattacatcggctataagtaccagaaaggactggagaaagtcatcccggaaaaacgcgaggaactcaaaggttttgccctcgatttactgatggatctgtatgacaacgagctgagttataccgaggagctgtacgccggaacgggctgggaagaggacgtaaaagccttcctctgctacaacgccaacaaggcgctgatgaacctgggctacgaagcgttattcccaccggaaatggcggaagtgaacccggcgatcctcgcggcgctgtcgcccaacgccgatgaaaaccacgacttcttttccgggtccggctcgtcgtacgtgatgggtaaagcggtggagacgcaagacgaggactgggatttttaa

SEQ ID NO: 1935 - DNA, 1221 bp, Enterobacter cloacae
caggacactctctattgcatggcaattaaattagaagtgaaaaatctttataaagtatttggcgagcacccgcagcgtgctttcaaatatattgagaaaggcctttcgaaagagcaaattctggaaaaaaccgggctatcgcttggcgttaaagacgccagtctggccattgaagaaggcgagatttttgtcatcatgggattatccggttcgggtaaatccactatggttcgccttctcaatcgcctgattgaacccacccgcggacaggtgctgattgacggcgttgatatcgccagaatatcagacgcggaactccgcgaggtgcgcagaaagaaaattgcgatggtgtttcagtcatttgcactgatgccgcacatgacggtactcgataataccgcctttggcatggagttagccggtatccccgctcaggaacgtcaggaaaaagcccttgatgcactgcgtcaggtcgggctggaaaattatgctcatgcgtatccggatgaactctccggcggtatgcgtcagcgtgtgggattagcgcgcgcattagcgattaatccggacattttattaatggacgaagccttctcggcgctcgatcccttaattcgcaccgagatgcaggatgaactggtaaaattacaggccaaacatcagcgcaccattgtttttatttctcacgatttggatgaagccatgcgtattggtgaccgtatcgccattatgcaaaatggtgaagtggtgcaggtcggcacaccggatgaaattctcaataatccggcgaatgattatgtgcgcaccttcttccgcggcgtggatattagccacgtattcagtgcgaaagatattgcccgtcgaacaccaaacggcattattcgtaaaaccccaggttttggcccgcgctccgcgctgaagctgttacaggacgaagaccgtgaatacggttatctggttgaacgcggcaataaatttgtcggcgtggtctccatcgactctctgaaaaccgccctgagcgaaaaccagggaatcgatgcggcgttgattgacgctccgcttgccgtggacgccgaaacgccgctcagcgagttgctctctcacgtgggtcaggcgccgtgcgccgtgccggtcgtcggtgaagaacaacagtacgttggcatcatctcaaaacggatgctgctacaggctttagatcgcgaggggacaaacaatggctga

SEQ ID NO: 1936 - DNA, 1212 bp, Enterobacter cloacae
tcacttaactcacgattcctgaaactaatgacaaaaacaactcaagggcttagccccgcactcatccttttaatgtccgtggcaacgggtctggccgtcgccagcaactattacgcacaaccactgctcgacaccatcgcacgcgccttcgatctttcagccagctccgccggctttattgtcaccgcagcacagctcggctatgcggccgggctgctgttcctggtgccattaggcgatatgtttgagcgccggatgcttatcgtctccatgacgctgctggcggcgggcggaatgttgatcaccgccagcagccagtcgttaacgatgatgattatcggcaccgcgctgacggggctgttctcggtggtggcgcaaattctggttcccctcgccgcgacgctggcttccccggaaaaacgcggcaaagtggtcggtactatcatgagcggcctgctgctgggcatcctgctggcgcgaaccgttgccgggctgctggcgagcctcggcggctggcgcaccgtttactgggtggcgagcgtgctgatgcttatcatggcgctggccctgtggcgcggcctgccaaaggtgaagcaggaaaatcacctgaactatccgcagctcctcgcctccgttttcagcctcttcacccgggataaactcctgcgcacgcgcgccattctggggtgtctcaccttcgccaacttcagcatcttatggacgtcgatggcgtttctgctcgccgcaccaccgtttaactactcagaaggcgtgattggcctgttcgggctggcaggcgcggctggcgcactgggcgcgcgcccggcgggtgggctggccgataaaggtaaatctcatatgaccacctccgcagggctggttttactcctgctctcctgggcggccatctggtacggacacgtctccgtgctggcgctgattgtcggtattctggtgctagacctcaccgtgcagggcgtacacatcaccaaccagaccgtgatttaccgcatgaagccggacgcccgtaaccgtctgacggccgggtacatgaccagctactttatcggcggcgcggcgggctcgctcatctcagcctccgcctggcagcatgcgggctggacgggcgtgtgcgccatcggcgccatcgtcgcggcgataaatctgctggtatggtggcgcggctatcaccgtcaggaagcaattcactaa

SEQ ID NO: 1937 - DNA, 1224 bp, Enterobacter cloacae
caacaggtcggctcagccgatgtgaaaataaaaagatcgtggagaacaacaatgagcgcaaatgcggagaacacccccccgcagcaaccggtcaacaaaaagggcaaacgtaagagcgcccttattctgctgaccttgctctttattattattgccgtggcatatgggatctattggtttttagtcttgcgtcatgttgaagagacagacgatgcatacgtggcagggaatcaggttcaaatcatggcccaggtgtcaggcagcgtgacgaaagtctgggctgataacaccgactttgtgaaaaaaagcgatgtgctggtcacgctcgatccaaccgacgcccaacaggcttttgaaaaagcacagacggctctggcctccagcgttcgccagacccgccagctgatgatcaacagcaagcagcttcaggccaatatcgacgtgcagaaaacggcgctggctcaggcgcagagcgacctcaatcgtcgtgttcctctcggcaccgccaacctgattggccgtgaagagttgcagcacgcccgcgatgcggtggccagcgcacaggcgcagctggacgtggcgatccaacagtacaacgctaatcaggcgatggtgctgggtacttctctggaaaaccagccggcggtgaaacaggcggcgaccgaagtgcgtaacgcatggcttgccctgcaacgtaccaaaatcgtcagcccgatgaccggctacgtttcccgtcgttccgtacagccaggggcgcagattagcaccaccacgccgctgatggcggtcgttccggcgaacaatctgtgggtcgatgcgaacttcaaagagacccagctggcgcatatgcgtatcggccaaaccgcaactgtggtcagcgatatttacggcgatgacatcaagtacaccgggaaagtggtcggtctggacatggggaccggcagcgcgtttagcctgctgcctgcacagaacgccaccggcaactggatcaaagtggtacagcgcttgcctgtgcgtatcgaactggatcctaagcagctggcagaccatccgctgcgaattggcctttccacgctggtgacggtcgataccgccaaccgagacggtcagatcctcgcaagccaggtgcgcagtacgccagcttatgaaagtaacgcccgtgaaattagcctcgatcccgtcaataagctgatcgatgacatcgtgaaggcaaacgccggttaa

SEQ ID NO: 1938 - DNA, 486 bp, Enterobacter cloacae
aacgccacttttttgtcctgttcgaggagttcagacatgttctcaccgcagtctcgcctgcgccatgcggtagcggatacgttcgcgatggtcgtttactgttccgtcgtgaatatgctgattgaaattttcctgtcgggaatgtcctttgagcaatctctctcgtcgcgcctggtggccattccggtgaatatcatgatcgcctggccgtacggcctgtaccgcgatgcagtgatgcgtttagcccggcgtattagcccggcgggttgggtaaaaaacctggcggacgtgctggcttacgtgacgttccagtccccggtgtatgtgtttattttgctgacggtgggcgcagactggcatcaaatcgccgctgcggtaagttcaaatatcgtggtatccatgctgatgggtgcggtgtacggttactttcttgactactgccgccgcctgttcaaagtcagcccttatagccaggcaaaagcgtaa

SEQ ID NO: 1939 - DNA, 546 bp, Enterobacter cloacae
tcaggtgcccgacgcggcagacaccctgcgggcgcagggtttccgtcagcttccggttgtggttgccggcgacaccagctggtctggcttccgtccggacatgatcaaccgccttgccgctcagggcgtcagtgcatgagcacgctggtctacttttccagcagctcggaaaacacgcttcggtttatggagcgtctcgggctgcccgcgatacgcattccgctgaacgagcgggagcgtattcaggtagacgaaccctacattctggtggtgcccagctatggcggtggcggcaccgcaggggctgtgcctcgtcaggtgatccgctttctgaacgatccccataaccggcagctgattcgcggcgtgatcgccgcaggcaatcgcaacttcggcgaggcctttgcccgcgccggggatgtcatctctcaaaaatgcggcgtgccgtatctctatcgttttgaactgatggggacacagcaggacgtagagaacgtgcgtaaaggagtgaacgaattttggcaacgacaaccgcagagcgcgtga

SEQ ID NO: 1940 - DNA, 1083 bp, Enterobacter cloacae
atcgcgaggggacaaacaatggctgatcaatcaaacccatggggcaccactgaagcagcggacagcgcggcgcaatctgccgatgcgtggggttcgacgcctgcgcctgccgatggcggcggcgcggcagactggctcaacagcgcaccagcgcctgccccagagcatttcaatattatggatccgttccacaagacgctgatcccgctggatagctgggtaacggaggggatcgactgggtcgttacccacttccgtccggtgttccaggggatccgcatcccggtggattacatcctgaacggcttccagcagctgatgctgggcatgcccgcgccggtggcgattatcctgttctcgctgatcgcatggcagttcggcagcgcgggtatggggatcgccacgctgatctccctgattgccatcggcgcgattggcgcgtggtctcaggcgatgatcaccctggcgctggtgctgaccgccctgctgttctgcgtggtgatcggcctgccgatggggatctggctggcgcgcagcccccgggccgcgaaaattatccgcccgctgctggatgcgatgcagaccacgccagcgttcgtttacctggtgcctatcgtgatgctgttcggcatcggtaacgtaccgggggtggtcgtgaccattatcttcgcccttccgccaattattcgtctgaccattctgggcattaaccaggtgcctgcggatctgatagaggcatcgcgctcgttcggcgccagcccgcgtcagatgctgtttaaggttcagcttccgctggcgatgccgaccattatggcaggtgttaaccagacgctgatgctggcgctgtcgatggtggtgatcgcctcaatgattgccgttggcgggttaggtcagatggtactgcgcggcattggtcgtctcgatatggggctggcgaccgtcggcggcgtcgggattgtgatcctcgccatcattcttgaccgcctgacccaggctgtcggtcgtgattcacgcagtcgcggcaaccgtcgctggtacaccaccggccctgtcgggttactcacccgcccattcacaaaataa

SEQ ID NO: 1941 - DNA, 1005 bp, Enterobacter cloacae
ggaacaacgatgcgacataacgtactttttgccacagcgtttgcgacccttgtctccaccagcgcagttgccgctgacctgccgggcaaaggcattaccgtgcagccggtgcagagcactatttcggaagagtccttccagacccagattgtcagccgtgcgctggagaaactgggctatacggtgaataccgccagcgaagtggattacaacgtgggctatacctctattgcctccggcgatgccacctttaccgccgtgaactggcagccgctgcacgacgatatgtatgccgccgcaggcggtgacaagaaattctaccgcgaaggcacctttgtgaccggcgctgcgcagggatatctgatcgacaagaaaaccgccgataagtatcacatcaccaatattgaacagctgaaagatccgaagatcgcaaaactgtttgataccaacggtgacggcaaagccgacatgatgggctgctcgccgggctggggctgtgaagcggtgattaaccaccagaataaagccttcgatctggcgaagaccgtcgacgtgagccacggcaattactctgcgatgatggccgacaccatcgcccgctttaaagaaggcaagccggtgatctactacacctggacgccgtactgggtgagcgacgtgctgaagccgggcaaagacgtggtgtggttgcaggtgcccttctcttccctgccgggcgagcagaaagatatcgacaccaaactgccaaacggcatgaactatggcttcccggtgaatactatgcatatcgtggcgaacaaagcctgggccgagaaaaacccggcggcggcgaagctgttctcggtgatgaaactgccgctggctgacattaacgcccagaacgcgatgatgcacgcgggtaaatcatccgaagcagatatcaaaggccacgtggatggctggatcaaagcccaccagcagcagttcgatggctgggtgaaagaggcgcttgaggcgcagaagtaa

SEQ ID NO: 1942 - DNA, 1581 bp, Enterobacter cloacae
aggcaaacgccggttaagccgaaggtgagcgttatgcaacagcaaaagccgcaaaaaccgctggagggggcgcaactggtcattatgaccattgcgctgtcgctggcgacattcatgcaggtgctggactccaccatcgcaaacgtggcgatccctacgatcgccgggaaccttggctcatcgctgagccaggggacctgggtcattacctcgttcggggtggcgaacgccatctccattcccatcaccggctggctggcgaagcgcgtcggtgaagtgaagctgttcctttggtcgacgatcctgttcgtgctggcctcctgggcctgcggcatgtccagtagcctgacgatgctgattttcttccgcgtcatccaggggattgtcgccgggccgttgattccgctgtcgcagagtttgctgctgaacaactatccgcccgccaaacgctccatcgcgctcgcgctgtggtcgatgacggtgattgtcgccccaatttgcgggccaatcctcggcggctatatcagcgataactatcactggggctggatcttcttcatcaacgtacccatcggtgcgctggtggtactgatgacgctacagtctttgcgtggtcgcgaaacgcggactgaacagcggcggatcgacggcatcgggctggcactgctggttgtcggcatcggcagcctgcaaatcatgctcgaccgcggcaaagagctggactggttcgcctctacggaaatcatcgtgctgacggtggtcgctgtggtggccatcagcttcctgattgtctgggagctgacggacgataacccgatagtcgacctctcgttgtttaaatcgcgaaacttcaccatcggctgcctgtgtatcagcctcgcctatatgctctacttcggcgcgattgttctgctgccgcagctgttgcaggaggtgtacggctataccgcaacctgggcggggctggcctccgcgccggtggggttaattccggttctgctgtcgccgattattggccgtttcgcccataagctcgacatgcgcaggctggtgacgttcagcttcatcatgtacgccgtgtgcttctactggcgcgcgtatacgtttgaaccgggaatggactttggcgcctccgcgtggccacagtttattcagggcttcgccgtagcgtgcttcttcatgccgctgaccaccattacgctttccggcttgccgcctgagcggatggcggcggcatcgagcctgtcgaacttcacccgtacgctggcgggctccatcgggacatcgatcaccaccacgctgtggaccaaccgggaatcgatgcaccatgctcaactcaccgaagcggtgaacccgttcaaccctaacgctcagcagatgtatagccagcttgaggggatggggatgacggagcagcaggcgtccggctggcttgcccagcagatcaccaaccaggggctgattatctcggcaaacgagattttctggatatcggcagggatctttatcgtcctgctggggctggtgtggtttgccaaaccaccgtttggggccggtagcgggggcggtggggcgcattag

SEQ ID NO: 1943 - DNA, 354 bp, Enterobacter cloacae
acgggaacacaaattatggaggatcgtatgtttaacagaccgaaccgaaacgatattaatgacgacacacaggatattcgtaacgatgtcagccaattagcggacacgctggaagccgtattgaaatcctggggctctgacgcgaaggacgaagcagatgccgcgaaacgtaaggctcagtctctgctgcgtgaaacgcgggcaaggatgaatggccgctcacgtaccactcaggcggcctgcgacatggccagctgcgccaccaccttcgtacgtgaaaaaccgctttgtacgctgggaacggtcgcggcggtcgggatttttgtcggcgccctgcttagtctgcgtaagtaa

SEQ ID NO: 1944 - DNA, 255 bp, Enterobacter cloacae
atggaaatgcgaatcatgagcattattatttacactcgtaacgattgtgttcagtgccacgccacgaaacgggcgatggagagccgcggcgtggcatttgagatggtcaatattgatcaggtgcccgacgcggcagacaccctgcgggcgcagggtttccgtcagcttccggttgtggttgccggcgacaccagctggtctggcttccgtccggacatgatcaaccgccttgccgctcagggcgtcagtgcatga

SEQ ID NO: 1945 - DNA, 627 bp, Enterobacter cloacae
catacgtttggcggatataaccgcacaaataattcatttacattatttgtcactgtcgttactatatcggctgtaattaatgaggttatgcccaaaatggatagttcgtttacgcccattgaacaaatgcttaagttccgcgccagtcgtcatgaggacttcccgtatcaggaaattctgctgacccgcctgtgcatgcacatgcagggtaagctgctggaaaatcgtaacaagatgctgaaagcgcaagggattaacgagacgttgtttatggcgttgattacgctggagtctcaggaaaatcacagcattcagccatcggaactgagctgtgcgctggggtcatcccgtaccaatgcaacccgtatcgcggatgaactggaaaagcgcggctggattgaacgccgtgaaagcgataacgatcgccgctgcctgcatctgcaactgaccgagaaaggtcacgaattcttgcgcgaagtgctgccaccgcagcacaactgcctgcaccagctctggtctgccctcagcaccgccgagcgcgaccagcttgagcatattactcgcaagctgctcacccgtctggaccagatggatgaagatggcgtcatccttgaggcgctgcgctaa

SEQ ID NO: 1946 - DNA, 1695 bp, Enterobacter cloacae
aatcgattcacgatagtgaaaagacaacaggagcgcaccatgctgaacacacccgccgacaaataccagccttaccccaccctttcgttgcccgaccgccgctggccggagcagattatcacctgcgccccgcgttggctctcgaccgacttacgcgacggtaaccaggcgctggccgagccgatggacagcgcgcgcaagctgcaattctgggatctgctgctgacctgcgggtttaaagaaatagaagtcgccttcccgtccgcctcgcagacggactttaattttgtacgtcagctgattgaggagaatcgcatcccggatgacgtcaccattcaggtgttaacgcaggcgcgggacgatcttatccatcgcactttcgactccctgcgcggcgcgaagcaggccaccgttcacctgtataacgctaccgccccgctgttccgccgtctggtattcggcatggagaaagcgcaaatcgtcgagctggcgacgcgcgcgacgcgcctgattcgtcagctgtgtgaagagaaccctgacacccgctggcagtacgaatactccccggaaaccttctgctttaccgaaccggagtttgcgctggagatttgtgaagccgtggcggagatctggcagccgtgcgcggcgcgtccgatgatcgtcaacctgcccgctaccgtcgaagtgagcacgccgaacgtctatgccgaccagatcgagtatttctgccgccacttcagccgccgcagtgatgtctgtatcagcgtacatccgcataacgatcgcggaacgggcgtcgccagcgcggagctggccgtcatggccggggctgaccgcgtggagggctgcctgtttggcaacggtgagcgcacgggcaacgtctgtctggtgacgctggcgatgaacctctacagccagggcattagcccgaatctggatttcagcgatatgaatcgggtggttgaaacggtagaaacctgcaaccagctgcccgtccatccgcgccatccgtgggcgggtcgtctggcttacaccgccttctccggctcgcaccaggatgccatcaagaaaggtttcgatgcccgtaagcctggcgaacgttgggagatgccctatctgcccgtcgacccgcaggatattggctgtacctatgaagcggtgatccgcgtgaacagccagtcaggaaaaagcggaagcgcctggcttattgagcaaaaccacggcctgaaattgcctcgcgccctgcaacaggattttagccagcacgtgcagcaggaaacggataaccatggaaaagagatgacgcagaatgcgctctggcagctgttccgcgcccgttacggcctggtggcgagcccgccattagcgctgcaatcgtaccgcagcgacagccagcaggacggccagctgcggctgacggcaagcgtcgccacgcatgggggcacccgccagctggaaggccagggaaacggtttgctctccgccgccgctcacggcttaagccgctggatcaacgcgtcgtttgtgatcaaggattatcacgaacatacgttaggcgaacgcagcgacagccgctcggtggcctatatccgctgcctgttccaggatgggaccagccgctggggcgtgggcatcgacagcgacgtggcacgcgcgtcgattcaggcgctttttaacgcggtcagtcgttcctga

SEQ ID NO: 1947 - DNA, 435 bp, Enterobacter cloacae
tcgtttagcgagagcacgatgtacgcacagtatgacggtttgatcttcgacatggacggcaccctcctggataccgaacccacgcatcgtcaggcctggaccgaagtcctgggccgttacggtatgcgtttcgatttacaggcgatgattgccctcaacggatcgcccacctggcgtatcgcacaggccgtgattgagctgaatcaggccgatctcgaccctcaccagctcgcgcgtgaaaaaaccgacgcggtaaaagccatgctgttagacaccgtgcagcctttaccactcattgacgtcgtcaaggagtggcacggccgtcgtcctatgtctgtcggtacgggcagcgagagcgcgattgctgaagcgctactcaatcaccttgggcctgcgccactatttttctgccgtcgttgccgccgatcatgttaa

SEQ ID NO: 1948 - DNA, 462 bp, Enterobacter cloacae
tgccggaatggcggcggtggacgttcgcttactgtgagtgacgcgctgtcactcgcttcattattcgccagcagttttttaagctccaccctcttaccggggaattcggaagtggtgctggtggcgatgctgttgtccggcgtaagtcagccctggttgctggtcttaatagcaacaatgggtaatagccttggagggctgactaacgttattcttggacgtttctttccgctacgcgaaaaatctcgctggcaggaaaaggcagtgggctggctaaaacgctatggcgctgccacgctgttattaagctggatgcctgtaataggcgatttactgtgtctgctggcgggatggatgcgcatctcctggggaccggtgctcttttttttgtgccttggcaaggcgttacgctatgttttactggcatgggtaacactacagggtataacgtggtggcactaa

SEQ ID NO: 1949 - DNA, 885 bp, Enterobacter cloacae
tgttcgtgtaaacagcaacgacgagctggccctgccaaaagaaaaacttcaggaactgcacatttagtatcgtgcctgtggatgcccggtggcgcttcgctgaccgggcctacaatcctgatgacgacaaccaccaccttctcctttacccatcgcccgcttgtgccgttttcgcatgattatgctcatggcgacagcgagccgtggcatcagcacgactgcgcgcagctcctgcacagcctcaccggcgtcgtgcgggtggataccgcatccggctgctgggtggtgccgcccggtcgcggcgtctggctacctgcgggtacgcagcacgccctgcgcatcaccggcaacgttgccgcccgcacgctgtttatcgacccgctggcgcgcgccgatctcccggcgacctgccagatcgtgcagatctcgcccctgctgcgcgagctgatcctgacctcccttacgcttcctgaatcttacgcacccggaagccgcgatgaacgtgtttatgagctgatcctcgatgaaattcgtctcatgccggtgctgccgtttcacctgcccgagccggaaagcgaagcgctgcgccatctctgccagcagattcgaatggccccgggagaaagctggagcagcgcccaggccgcaggtattgtggggatgagcgaacgcacgctgaaccgtcattttcagcagcagacaggcctgagctacggcgaatgggtgagaagggcgcgactgctggaagccttagtgcggctggcgcagggccagccggtattacgcgtggcgctggatctggggtatggcagccacagcgcctttacggcaatgtttcgccgggtaatgggtctctcacccagcgattacttcaggaacgactga

SEQ ID NO: 1950 - DNA, 354 bp, Enterobacter cloacae
ggaaaagatatgtatttacgacccgatgaggtggcgcgcgttcttgaaaaagaagggttcaccatggatgaggtaacatcaaaagcgtacggatatcgccgtggtgagaattatgtttacgtcaaccgtgaagcaagaatggggcgtactgctctcattattcacccgacactcaaagacagaagcctgtcatttgctgagcccgcctcggatattaaaacctgcgatcattatcagcaatttccgctctatttaggcggcgagacgcatgaacattatggtattccgcacggtttcagctcgcgtatggcgctggagcgattcctgaaagggctgtttggcgacgtacaataa

SEQ ID NO: 1951 - DNA, 315 bp, Enterobacter cloacae
acaccgtgcagcctttaccactcattgacgtcgtcaaggagtggcacggccgtcgtcctatgtctgtcggtacgggcagcgagagcgcgattgctgaagcgctactcaatcaccttgggcctgcgccactatttttctgccgtcgttgccgccgatcatgttaaacatcataaacccgcaccggataccttcctgctctgtgcagaattaatgggtgttccacctgcaaaatgcgtggtgtttgaagatgctgattttggtattcagcccgcgcgtgatgccggaatggcggcggtggacgttcgcttactgtga

SEQ ID NO: 1952 - DNA, 519 bp, Enterobacter cloacae
cgtatgccgttattagatagctttactgtcgaccatacccgtatggaagcaccagcagtccgcgtggcgaagaccatgaacacgccgcacggcgacacgatcaccgttttcgacctgcgcttctgcgtgccgaataaagaagtgatgccagagaaaggcattcacacgctggaacacctgttcgccggattcatgcgcgaccacctgaacggcaacggcgtggagatcatcgatatctctccgatgggctgccgcaccggtttctacatgagcctgattggtcagcctgaagagaaacgcgtcgcggatgcgtggaaagcggcgatggaagacgtgctgaaggtgaaagagcagaaccagatccctgagctgaacgtttaccagtgcggcacttaccagatgcactctctggaagaagctcaggagattgcccgtcatatcatcgaacgtgatgttcgtgtaaacagcaacgacgagctggccctgccaaaagaaaaacttcaggaactgcacatttag

SEQ ID NO: 1953 - DNA, 1572 bp, Enterobacter cloacae
caattttttgacaggcgggaggtcaaattgatcccggacgtatcacaggcgctggcctggctggaaaatcaccctcaggcactgaaggggattcagcgtgggcttgagcgcgaaacgctgcgcgtaaatgcggatggtagcttagcgactacgggacacccgaaggcgttaggctcggcgctgacacataaatggatcacaaccgatttcgccgaagcgctgctggagttcatcacgccagtagacggtgatattgatcatatgctgacgatcatgcgcgacgtgcatcgcttcaccgcccgcaacctcggcgacgagcgtatgtggccgctcagcatgccgtgctatatcgagcaggggcaggatatcgagctggcgcagtacggcacctcgaatattggtcggctgaaaacgctgtatcgcgaaggactgaaaaaccgctacggcgcattgatgcagacgatctctggcgtgcactacaacttttctctgccgatggcgttctggcaggcgaagtgcggtgaaacggataaagaagcgatctccgcgggctacttccgcctgatccgcaactactaccgttttggctgggttattccgtatctgttcggcgcgtccccggctatctgttcatcgttcctgcaagggaaaccgaccacgctaccgttcgagaagaccgaatgtggcatgtattacctgccatacgcgacctccctgcgcctgagcgaccttggctataccaataaatcgcaaagcaatctcggaattacgtttaacgatctgcacgaatatgtggcaggcttgaagcgggcgataaaaaccccgtcggaagagtacgaaaaaatcggcctcgaaaaagacggcaaacgcctgcaaattaacaccaacgtgttgcagattgaaaatgaactgtatgcgccgattcgtccgaagcgcgtgacgcgcagcggtgaaacgccgtcggatgcgctacagcgcggcgggatcgaatacattgaagtgcgctcgctggatatcaacccgttctcaccgattggcgttgacgagcagcaggttcgtttccttgacctgtttatggtctggtgcgtactggcggatgcgccggaaatgagttccgacgaactgctgtgtacccgtgccaactggaatcgcgtgattctggaagggcgcaagccgggcctgacgttaggtattggctgtgaaacggctcagttcccactgtctaaggtagggaaggatctgttccatgacctgaagcgcgtagcccagacgctcgatagcgtgtacggcggcgaagcttaccagaaggtctgcgacgaactggttgaaagctttgataacccggaactgacattctcagcacgtattctgcgttctatgattgagcagggaattggtggcacagggcgttcactctcagcggagtaccgtgagatgctgatgcaggagccgttagagatcctgagcgaagcggattttgtggcagagcgcgatgcgtccgttgtgcgtcagaaagaggtcgaagcggcagatactgagtcgtttgaggcgtttctggcgaagcaggcctga

SEQ ID NO: 1954 - DNA, 357 bp, Enterobacter cloacae
ccaaccgaaaaaagatgcggtgaaacagggttaattgtcccggcttgctttacactgaagcctccccatcaggaggcttcagcaatggctacaccacgtttgacccagaaagacatgaccgaagccgagcagcgcgaacttaaaacgcttctcgaccgcgcccgcatcgcgcatggccgcacgctgacgaacgccgaaaccaatcaggttaaaaaagagtacatcgacaagctgatggcgcaacgtgaggctgcggcgaaaaaagcccgcaagctgaaaaaagagcaggcttataagccggatgcagaggcgaccttttcctggtccgccaatacatcaacccgtggaaggcgctaa

SEQ ID NO: 1955 - DNA, 1362 bp, Enterobacter cloacae
cacgaggttgttatgacgagttttgtggtcgccaagtttggcggcaccagtgtggcagactacgatgccatgaaccgcagcgccgatgtggtgctggccgatccgaatacccgcctggtggtactttccgcctcagccggcgtgacgaacctgctggtttctctgtctgaaggactggaagcgaccgagcgtttcgtgaagctggatgcactgcgcaaaattcagttcgacattctcgagcgtctgcaaaacccgaacgtcattcgtgaggaagtggaacgcctgctggaaaatatcaccactctggccgaagccgcgtcgctggcaacctctaccgccctgaccgatgagctggtcagccacggtgaactaatgtctaccctgctgttcgttgagatcatgcgcgagcgcaatattcaggcgcagtggttcgacgtgcgtaaagtcatgcgcaccagcgaccgctttggccgcgccgagccggacgtggaagtcctggctgagctgactaaccagcagcttgccccgcgcctggatgaaggcatagtgatcacccagggctttatcggcagcgaagccaaagggcgcacaaccacgctgggccgtggcggtagcgactacaccgccgccctgctgggtgaagccctgcacgccacccgcgtggatatctggacggacgtgccgggaatctacaccaccgacccgcgcgtggtctctgcggcaaaacgtattgacgtgatcgcctttgaagaagcggctgaaatggccaccttcggcgcgaaagtgctgcacccggccacgctgctgcccgccgtgcgcagcgacattccggtcttcgttggctcaagtaaagatccaaaggcgggcgggacgctggtctgcaagaaaaccgagaacccgccgctgttccgcgcgctggccctgcgtcgtaagcagacgctggttaccctgcacagccataatatgctgcattcccgcggcttcctggcagaagtgtttggcatcctggcgcgccacaatatctctgtagatttgattaccacttctgaagtgagtattgcgctgacgctggacaccaccggttcaacctcaacgggtgataccctgctgacgcagtcgctgctgatcgagctttccgagttgtgccgtgtggaagtggaagaagacctggcgctggtggccatcatcggcaacaagctgtcgcgcgcctgtggcgtgggtaaagaggtgttcggcgtgctcgacccgttcaatatccgcatgatctgctacggtgcatccagctacaacctctgcttcctggtccctgccgatcaggccgagcaggtcgtgcagaaacttcatcagaatttgtttgaataa

SEQ ID NO: 1956 - DNA, 1020 bp, Enterobacter cloacae
acaatatcgataagccgggcacagacccggcttttttataacaaaacaacacgacaatactgcaaggaattcactatgctctccgctatcacccggctgttcccgttatgggcgctgctgctctctgtactcgcgtattacactcctgccacgttcacgggcattggtccgtgggtcaccacgctgctgatgctgattatgttcggcatgggcgtgcatctgaaaattgacgatttcaaacgcgtgctgtctcgcccggcgccggttgccgcagggattttcctgcactacctggtgatgccgctcgcggcctggctgctggcgatggcctttaagatgccgcccgacctttccgccgggatggtgctggtggggagcgttgccagcggcacggcatctaacgtcatgatctatctggcgaaaggcgacgtggcgctttccgtcaccatctcgtccgtttccacgctggtgggcgtgattgccacgcctctgttaacccgcctgtatgtcgacgcgcatatccaggtggacgtgatgggcatgctgctcagcatcctgcaaatcgtggtgatcccgattgcgctggggctggtgatccaccatctcttcccgcgggtggtgaaagcggttgagccgtatctgcccgcgttttcgatgatctgcatactggccattatcagcgccgtggtagccggttccgcatcgcacattgcttcggtgggctttgtggtgatcgtcgcggttgtgctgcataacactattggtctgctgggcggttactggggcgggaagctgtttggctttgacgaatccacctgccgcacgctggcgatcgaagtggggatgcagaactccggcctggcggcggcgctgggtaaaatttacttctcaccgctggcagcgctaccgggggcgctgttctccgtctggcataacctgtccggttcgctgttagcagggtactggtccggtaagccgattgatgaccaaccgaaaaaagatgcggtgaaacagggttaa

SEQ ID NO: 1957 - DNA, 933 bp, Enterobacter cloacae
catgagacatgttcactatcactcctccgatcagtcaggaaagcggttgcaaaaccaccaaataaaacgaaaatgatttccacgatacagaaaaaggagttcgtcatggttacgaccgttcccgctaaacgcggcagaaaacctgctgcaaccaccgctgcacaacctggcggacaggttcaatccctgacgcgcggcctgaagctgctggaatggatagccgaatcgcacggcagcgtggccctgacggagctggcgcagcaggctggcctgccgaactccaccacgcaccgtctgctgaccaccatgcagcagctgggattcgtgcgtcaggtgggcgagctgggacactgggcggtgggggcgcatgcgtttattgtcggcagcagcttcctgcaaagccgcaacctgctggcgattgtccacccgattctgcgcaagctgatggaggagtccggcgagacggtaaacctggccgtactggatcagagcgatcaccaggcgattattatcgaccaggtgcagtgtacgcagctgatgcgcatgtccgcaccgattggcggcaagctgccaatgcacgcctctggcgcagggaaagcgtttctctcgcagctgagcgaagagcaggtaacggggctgctgcaccgtaaagggctgcacgcctatacccacgccacgctggtgtcgcccgtgcatctgaaagaagatctggctctgacccgcaagcgcggctattcgtttgatgacgaagaacatgccctcgggctgcgctgcctcgcgtcctgcatttttgacgagcaccgcgagccgtttgccgccatctccatctccgggccgatttcacgcatgaccgacgaccgcgtcaccgagctgggcgcgatggtgattaaggccgcgaaagaggtgacgctggcgtatggtgggattcgttaa

SEQ ID NO: 1958 - DNA, 318 bp, Enterobacter cloacae
atcacagggagtaatatgaaggagatcgttcagacagaatccttccgacgctgggagcaaaatttaaaggacaggcgggcaaagacgattatcgcttcccgcctctttaggctggcaaatggcttagcgggcgacattagacccgtgggggaaggtatcagtgaactgaggatccactttggcccgggctacagagtctattttaaggaccagggcaattgcatcatcgtgctgttatgtggtggtgacaaaagcagccaggccagagacatacttatggcaaaaatgctgagcaatgtatcccaatggcaggagtga

SEQ ID NO: 1959 - DNA, 294 bp, Enterobacter cloacae
atgagcatgcataaattaacaccctacgatccagccaacgcactggtggatgacgaggaaatcgctgtgtttatggctgatgcattagagacgggtgactcagcgtacattgctaaagcgctgggcgtcatcgcccgagcgaaagggatgtcgaccatttcccagcaaacgggcctgtcacgagaacaactgtatcgatcattcagtgataaggggaacccaacgctcaaaaccacgctggcggtcatgaaagcattgggccttgggttaacaatcaaaccctctggggattaa

SEQ ID NO: 1960 - DNA, 942 bp, Enterobacter cloacae
ggatttaaggttatgccgattcgggtgcaggacgagctaccagccgtcaatttcttgcgtgaagagaatgtcttcgtaatgacaacttcgcgtgcttctggtcaggaaattcgcccgctgaaggtgctgatccttaatttgatgccaaagaagatcgaaacagagaaccagttcttgcgtttgctctccaactctccgcttcaggttgatatccagttgctgcgcattgacgcgcgtgagtcacgcaacacgcctgctgagcatctgaataacttctactgtaattttgaagatattcgcgatgagaacttcgatggattgatcgtcaccggcgcaccgctgggtctggtggaatttaatgacgttgcctactggccacagatcaggcaggtgctggagtgggcaaaagatcacgtcacgtccaccttgtttgtctgttgggcggtacaggccgcattgaatatcctgtatggtattcccaagcaaacccgcagcgacaaactttctggcgtatacgaacaccacatccttcacccgcatgcgctgctgacgcgtggtttcgatgacactttcctggccccgcattctcgctacgccgattttccggcacagctgatccgagattacaccgacctggaaatcctggccgaaacggaagacggcgatgcctacctgttcgccagtaaagacaaacgcatcgcgttcgttaccggccatcctgagtacgatccgcataccctcgcggcagagtattttcgtgacgttgaagcgggtctgaatccggatgtcccgtacaactatttcccgaaaaacgatccacaaaacacgcctcgggcaacctggcgtagtcatggaaatttgctgtttaccaactggctcaactattacgtctaccagattacgccgtacgatcttcgccacatgaatccgacgctggagtaa

SEQ ID NO: 1961 - DNA, 1365 bp, Enterobacter cloacae
ccctgccgggctaccgcttcctggcgtaattcaccacataacaatatggagcatctgcacatgaaaacccgtacccaacagatcgaagagttacaaaaagagtggacccaaccgcgctgggaaggcattcgccgcccgtacagcgcagaggaagtggtgaagttacgtggctcggttaacccggaatgtacgctggcgcagaacggcgcggcaaaaatgtgggatctgctgcacgggggagctaaaaaaggctatatcaacagcctcggcgcactgactggcggtcaggcattgcagcaggcgaaggccggcattgaagctatctatctttccggctggcaggtcgcggcggatgctaaccttgcctccagcatgtatccggatcaatctctttatccggcgaactcggtgccgtcagtggtggatcggatcaacaataccttccgccgtgcggatcagatccagtgggccgcgggtatcgaaccccacgatccgcgttttatagactatttcctgccgatcgtcgccgatgcggaagccggtttcggcggcgtgctgaacgcctttgagctgatgaaatccatgattgaggccggtgcagcggccgttcactttgaagatcaactggcgtcggtcaagaagtgcgggcatatgggcgggaaagtgctggtaccaacccaggaagcgatccaaaagctggttgccgcgcgtctggctgctgacgtgctcggcgtgccgacgctggtgattgcccgtaccgatgctgatgcggcggacctgatcacctctgactgcgatccgtacgacagcgaatttattaccggcgagcgcaccagcgagggattctatcgcacgcatgccggtatcgaacaggccatcagccgcggtctggcctatgccccttacgctgacctggtttggtgtgaaacctccacgccggatctggcgctggcgaagcgttttgccgatgcgattcatgcgaagtatccgggcaagctgctggcctataattgttcgccgtccttcaactggcaaaagaatctggacgataccaccatcgccagcttccagcagcagctgtcggatatgggctacaagtaccagttcatcaccctggcgggtatccacagcatgtggttcaacatgttcgacctggcgcacgcctacgcgcagggcgaaggcatgaagcactatgttgagaaggtgcagcagccagaatttgcggcaggcaaagagggatataccttcgtttcgcaccagcaggaagtgggaaccggctacttcgataatgtgaccacgattattcagggcggggcctcctccgtcacggcattaacgggctcaacggaagaagcacagttctaa

SEQ ID NO: 1962 - DNA, 1803 bp, Enterobacter cloacae
tcttttccccctctcccccctcggggagagggttggggtgagggggaatatatgtcgcgtggtctggaattactgattgcccaaactattttgcagggcttcgatgcccaatatggccgctttctggaagtcacctccggcgcgcaacagcgttttgagcacgccgactggcatgcggttcagcaggccatgaagcagcgtatccatctttatgatcaccatgtaggtctggtggtggagcaactgcgctgtatcaccgacggtaaaagcccggatgcggattttttactgcgcgtgaaagagcattacacccatctgttacccgactacccgcgcttcgagattgcggagagctttttcaactccgtctattgccggttatttgaccaccgctcattatctcctgagcggttatttatcttcagctcccagccggagcgccgcttccgtaccattccgcgtccgctggcgaaagatttctttcccgatcgcggctgggaaaagctcctgcaccgtgtcttaacggatttgccgctgcgcctgccgtgggagaataaaccccgggatatcggctatatccacgcgtatctcagtgaaaccttcggcgaggaggtgctcagccgcagccatttgcaggttgccaacgagcttttctaccggaataaggccgcctggctggtgggcaaactggttacgccgacagccatcgtgccgtttctgctgcccattcaccgtaccgacgacggcgaactgtttgtcgatacctgcctgactaccagcgctgaggccagtatcgtatttggcttcgcccgttcctattttatggtgtacgctccgctgcctgccgccctggtggagtggctgcgcgagatcctgccgggcaaaaccaccgccgagctgtacatggcgattggctgtcagaagcatgccaaaacggaaagttatcgggaatacctgcgttatgtcaccacggctgatgagcagtttatcgaagcgccggggatccgcggcatggtgatgctggttttcacactgccgggcttcgaccgcgtgtttaaggtgattaaggataaattcgccccgcagaaggagatgagcgccgcgcacgttcgcgcctgctatcagctggttaaagagcacgatcgtgtcgggcgaatggccgatacccaggagtttgaaaactttgtgctggataagcagcagatcgatccgtcgctggtgtcgctgctaatgcaggaagcgccgacgaaaattaccgatcttggcgataagattgcgattagccatctctatatcgaacgccggatggtgccgttaaatatctggctggagcagtccgaaggccaggctttacgagacgccattgaagagtacggcaatgcgattcgccagctcgccgccgccaatattttccccggcgacatgctgtttaaaaacttcggcgtcacccgtcacgggcgggtggtgttctacgattacgatgaaatttgctacatgaccgaggtgaacttccgcgatatcccgccgccgcgctatccggaagatgaactgtccagcgagccgtggtacagcgtatcgccgggcgatgtgtttccggaggagtttcgccactggctgtgtgccgacccgcgcatcgggccgctattcgaagagatgcatgccgatctgttccgcgccagctactggcgcgggctgcaaacgcggatcaaaaatggacacgtggaagatgtctacgcttaccgccgcaagcagcggttttgcatccgcttttctccctctccctgtgggagagggccggggtga

SEQ ID NO: 1963 - DNA, 3702 bp, Enterobacter cloacae
gcgttgtcgggagcaagtgtgagcagcaaagtagagcaactgcgtgcgcagttaaatgaacgaattctggtgctggacggcggcatgggcaccatgatccagggctatcgtctgtgtgaagacgatttccgcggagagcgctttgccgactggccttgtgacctgaaagggaacaatgacctgctggtgttgagtaaaccgtcagtcatcagagatatccacaacgcttacttcgaagcgggtgcggatattgtagaaaccaacaccttcaactcgacaaccatcgccatggcggattaccagatggagtccctgtcggcggagatcaactttgaagcggcgaagctggcgcgcgcctgcgccgacgaatggacggcccgtacgccggacaagccgcgctacgtagccggggtgctgggcccgaccaaccgcaccgcgtcgatttctccggacgtgaacgacccggcgtttcggaacatcacgtttgaccagctggtggccgcgtatcgggagtccactaaagcgctggtggaaggcggctccgacctgatcctgattgaaaccgtattcgacaccctcaacgccaaagcggcaatttacgcggtaaaagaggagttcgagtcgctgggcgtcgacctgccgatcatgatttccggtaccatcaccgatgcctcggggcgcacgctttccggccagacaaccgaagcgttttataactctctgcgccatgccgaagcgctctccttcggcctgaactgcgcgctggggccggacgagctgcgccagtacgtgcaggagctttcccgtatcgcggaatgctacgtcaccgcccacccgaacgccggtctgccgaacgcgtttggtgagtacgatctggatgccgacaccatggcggcgcaaatccgcgaatgggctgaatctggtttcctcaacatcgtcggcggctgctgcggcaccacgcctgagcatatcgccgccatgagcaacgccgtcgccgggcttccaccgcgcaagctacccgagcttccggttgcctgtcgcctgtccggcctggagccgttgaccatcggcgacgacagcctgtttgtgaacgtgggtgagcgtacaaacgtcaccggctccgcgaagttcaagcgtctgatcaaagaagagaagtacagcgaagcgctggacgttgcccgccagcaggtggaaagcggcgcgcagattatcgatatcaacatggacgaggggatgctcgacgccgaagcggcgatggtgcgtttcctcaacctgattgccggtgagccggatatcgcccgcgtgccgatcatgattgactcttctaaatgggacgtcatcgaaaaagggctgaaatgcattcagggcaaaggcatcgttaactccatctcgatgaaagagggggtcgatacctttatccaccacgcgaagctggtgcgtcgctacggggccgccgtggtggtgatggccttcgatgaagtgggtcaggccgatacccgcgagcgcaagattgagatttgccgccgcgcgtacaaaattttgaccgaagaggtgggcttcccgccggaagacatcatcttcgacccgaacatcttcgccgtcgcgaccggcatcgaagagcacaacaactacgcccaggacttcatcggcgcgtgtgaagacattaaacgcgaactgccgcatgcgctgatctccggcggcgtgtcaaacgtctcgttctcgttccgcggcaacgacccggttcgtgaggcgatccacgccgtgttcctctactatgccatccgcaacgggatggacatggggatcgtcaacgccggccagctggcaatttacgacgatctgccagccgagctgcgcgacgccgtagaagacgtgatcctcaatcgtcgtgacgacgccaccgaacgcatgctggatctggcggaaaaataccgcggcagtaaatctgacgaatcagccaacgttcaacaggccgaatggcgctcctgggatgtgaataagcgtctggaatactcgctggtaaaaggcattaccgagtttatcgagcaggatactgaggaagcgcgtcagcaggccgcccgtccgattgaagtgatcgaagggccgctgatggacggcatgaacgtggtcggcgatctgtttggcgagggcaaaatgttcctgccgcaggtggtgaaatccgcccgcgtcatgaaacaggcggtggcgtatctggaaccctttatcgaagccagcaaagagaagggctccagtaacggtaaaatggtcatcgccaccgtgaagggcgacgtacacgacatcggcaaaaacatcgttggcgtggtgttgcagtgtaataactacgaaattatcgatcttggcgtgatggtcccggcggataaaatcctcaggaccgcgcgcgaagtgaatgcggatttgattggtctttccgggctgattacgccgtcgctggacgaaatggtcaacgtggcaaaagagatggagcgccagggcttcaccattccactgctgattggcggggcaaccacctcgaaagcccacacggcggtgaaaatcgagcagaactacagcgggccgacggtgtatgtccaaaacgcctcgcgcaccgtgggcgtggtctccgcgctgctgtccgacacccagcgcgatgactttgtcgcccgcacccgcaaagagtatgaaaccgtccgcattcagcatggacgtaagaaaccgcgcacgccgccggtttcgcttcaggcggcgcgcgaaaacgatctggcgttcgactggtccagctatacgccgccggtcgcacaccgtctgggcgtgcaggacgtgacggccagcatcgaaacgctgcgtaactacatcgactggacgccgttcttcatgacctggtcgctggcgggcaaatatccgcgcattcttgaagatgaggtggtgggcgaagaggcgaagcgcctgtttaaagatgctaacgacatgctcgacaggctgagcgcagagaaagccctcaacccgcgcggcgtggtggggctgttcccggcgaaccgcgtgggcgacgacgtggaaatctaccgcgatgaaacccgcacccatgtgctggccgtgagccaccatctgcgccagcaaaccgagaaagtgggctttgccaactactgcctggcggatttcgtcgcaccgaaactctccggtaaagccgactatatcggcgcctttgccgtaaccggcggtctggaagaagacgcgctggcggatgcgtacgacgcgcagcacgatgattacaacaaaatcatggtgaaagcgattgccgatcgcctggcggaagcctttgccgagtatctgcacgagcgcgtacgtaaggtgcactggggctacgcggcgaatgagaacctcagcaacgaggagctgatccgcgaaaactaccagggcattcgtccggcaccggggtatccggcgtgtccggaacataccgagaagggcactatctggaaactgctggacgtagaagcgcatacgggcatgaagctcaccgagtcatttgccatgtggccgggcgcgtccgtttccggctggtacttcagccatccggacagcaagtacttcgccgtggcacagcttcagcgcgatcagattgaggattacgctctgcgtaaaggcatgagcgtgtcagaggtggaacgctggctggcgccgaatttaggctacgacgcagactaa

SEQ ID NO: 1964 - DNA, 954 bp, Enterobacter cloacae
aaaacccgtctcagtaaccgtcggctaatctttttttccagcccaaacctaaggtatatttcgcccttcacaggagaaactatgctgccaactcaatcaacccgattaaacaaatacattagcgagagcgggatctgctcacgtcgcgaggctgaccgttacattgaacagggtaacgtgtttcttaacggcaaacgcgccaccattggtgatcaggtggtacctggcgatgtggtgaaagtgaatggtcaggtcatcgaaccgcgtgatgccgaagacctggtgtttatcgcgttgaacaaaccggttgggattgtcagcaccacggaagatggcgagcgggacaacattgttgatttcgtgaaccacagcagccgcattttcccgattggccgtctggataaagactctcaggggctgattttcctcaccaaccacggcgatctggtcaacaaaattctgcgtgccggtaacgaccacgagaaagagtacatcgtgacggtgaacaagccggtgacggacgagttcattcgcgggatgggcgcaggcgtgccgattctgggcaccgtgacgaagaagtgtaaagtcagaaaagaggcgccgtttgccttccgcattaccctggtgcagggcttaaaccgccagatccgccgcatgtgcgagtattttggttatgaagtgacgaagctggaacgcacgcgcatcatgaacgtcagcctgtccgggatcccgctgggcgagtggcgtgacttaacggacgacgagctgatcgagctgttcaaacttatcgaaaactcctcgtccgaggcgaagccgaaagctaaagccaaaccgaaaacgcagacgattaagcgtccggtggtgaaggcaccgcaggcggaagagaaagggcggggcaagccgggcaacggaaaacgctttacccagccggggcgcaaaaagaaagggcgctaa

SEQ ID NO: 1965 - DNA, 225 bp, Enterobacter cloacae
aagagcattacacccatctgttacccgactacccgcgcttcgagattgcggagagctttttcaactccgtctattgccggttatttgaccaccgctcattatctcctgagcggttatttatcttcagctcccagccggagcgccgcttccgtaccattccgcgtccgctggcgaaagatttctttcccgatcgcggctgggaaaagctcctgcaccgtgtcttaa

SEQ ID NO: 1966 - DNA, 1629 bp, Enterobacter cloacae
tttggatctttgatgaggagcagaacgatgactcaacaggcaacaacggtcgatgaactgacctttacccagccgaatggtgagcaagaacagcaagttttgacggcagaagcggtagagtttctgactgaactggtgactcgctttacgccacagcgtaataaactgctggcggcgcgcattcaccaacagcaggggatcgataacggcaagttgccaggatttatttcggaaactgcttccattcgtcatggtgattggaaaatccgcggaatccctgaagatttacaggatcgtcgtgtggagatcaccggcccggtagagcgcaaaatggtgatcaacgccatgaatgccaacgtcaaagtctttatggccgattttgaagactcgctggcaccggactggcagaaagttatcgacgggcagatcaacctgcgcgacgccgtcaatggcaccatcagctataccaacgaagccggtaaaatttaccagctcaaaccgaatccggcggtgctgatctgtcgcgtacgcggtctgcatttgccagaaaagcacgtcacctggcgcggagaagcgattccgggcagcctgttcgactttgcgctgtacttcttccacaaccataaaaacctgctggcgaaaggcagcggcccctatttctatctgccgaaaacccagtcctggcaggaagcggcgtggtggagtgaagttttcagctacgcagaagaccgcttcagcctgccgcgcggcaccattaaagccacgctgctgattgaaaccctgcctgccgtattccagatgcatgagatcctccatgcgctgcgtgaccatattgtgggcctgaactgcggccgctgggattacatcttcagctacatcaaaacgctgaaaaaccatgccgaccgggtattgccggatcgtcaggttgtgactatggataaaccgttcctcagcgcctactcgcgcctgctgattaagacctgtcacaaacgcggcgcctttgcgatgggcggcatggcggcctttatcccgagcaaagatgctgagcgtaacaaccatgtgctcaacaaggtgaaagccgataaagagctggaagcccgtaatggccacgacgggacgtggattgcccatcccggtctggccgatacggcgatggaagtctttaaccgcgtactcggcgacaacaaaaaccagctgtttgtcacccgtgaagatgatgcgcccatcgcagaagaacagttgctcgcgccgtgtgcgggcgagcgtacggaagagggcatgcgcgccaatattcgcgtcgccgtgcagtacatcgaggcatggatctccggcaacggctgcgtgccgatttacggcctgatggaagatgccgccacggcggaaatttcacgtacctccatctggcagtggatccaccatcaaaaaacgctcagcaacggcaaaccggtaaccaaagccctgttccgtcagatgctggccgaagagatgcgggtcatccaggacgaactgggcgagcaccgcttcagcagtgggcgttttgacgatgctgcacgtctgatggagcaaatcaccacctctgatgacttaatcgacttcctgaccctgccgggctaccgcttcctggcgtaa

SEQ ID NO: 1967 - DNA, 1647 bp, Enterobacter cloacae
ggaggaatgcctaccgtgttgacgttgttacacctgctctccgcagtcgcactgctggtatggggcacccatatcgttcgtaccggcgtgatgcgtgtgtttggcgcacgtttacgtaccgttctcagcggcagcgttgagaagaagccgctcgccttctgcgcgggtattggcgtcacggcgctggtgcaaagcagcaacgccaccaccatgctcgtcacctcgttcgtggcgcaggatctggtggcgctcgccccggcgctggtgattgtcctgggcgccgacgtcggtaccgcgctgatggcgcgtatcctgacgttcgatctctcctggctgtcgccgctgctgatttttatcggcgtcattttcttcctcggccgtaagcaaagccgtgccgggcagcttggccgcgtcggtattggcctcgggctgatcctgctggcgctggagttgattgtgcaggctgtcacgccgatcacccaggccaacggtgtacaggtcatcttcgcctcgttaaccggcgatattatgctggatgcgctgatcggcgcagtattcgccatcgtcagctactccagcctggcagcggtcctgctgacggcgaccttaaccgccgcaggggtcatttccttcccggtggcgctgtgcctggtgatcggagccaacctcggctctggcctgctggcgatgctcaacaacagcgccgccaacgctgccgcccgccgggtggcgctggggagtttactgtttaagctggtgggtagcctgatcattctgccgtttgtgcacccgctggcgaacctgatggataatctctctctgccgaaagcggaactggtgatctacttccacgtcttctacaacctggtgcgctgtctggcgatggtgccgtttgccgcgccgatggcccgcttctgcgagcggctaattcgtgatgaaccggagctggacgcgcgccttaaaccgaagcatctggacacctctgtgctggacacgcccgcactggccatcgccaatgccgcccgcgaaacgctgcgcatgggtgacgcgatggaaaccatgctggaagggttgcaaaaggtgatgcacggcgagccgcgcgaagaaaaagagctgcgcaggctggcggacgatatcaacgtgctgtataccgccatcaagctctatctggcgcggatcccccaggacgagctggcggaagaggaatcccgccgctgggcggaaattattgagatgtcgcttaacctggagcaggcttcggatattgtcgagcgtatgggcagtgaaatcgcggataaatccctggccgcacgtcgggcgttttctgtggaagggctgaaagagctggaagcgctgcacgaacagctggtcagcaacctgaagctggcgatgtcggtcttcttctccagcgacgtgccgagcgcgcgccgcctgcgccgcaacaagcatcgtttccgcatccttaatcgccgctactcgcacgcccacgttgagcgtctgcatcagcagaacgtgcagagtatcgaaaccagctcgctccatctggggctgctgggcgatatgaaacgtctcaactcgttgttctgcgcggtggcgtacagcgtgatggagcaaccggatgaagatgacgagcgggatgagtattaa

SEQ ID NO: 1968 - DNA, 432 bp, Enterobacter cloacae
gccccttttttgtctggagaatttattatggcgaaagaatttggtcgcccacagcgcgtcgcgcaggagatgcagaaagagatcgctctcattctgcaacgtgaaatcaaagatccacgcgtgggtatgatgaccaccgtgtctggcgtggaaatgtcccgcgacctggcgtacgccaaagtgtttgtaactttcctgaatgaccaggatgaagacgctgtgaagaacggcattaaagcgttgcaggaagcctctggtttcattcgctctctgcttggcaaagcgatgcgcctgcgtatcgtgccagagctgaccttcttctacgacaactcgctggttgaaggtatgcgtatgtccaacctggtgaccagcgtggtgaaacatgacgatgagcgtcgtgttaacccggcggacgacagcaaggaggactga

SEQ ID NO: 1969 - DNA, 525 bp, Enterobacter cloacae
cggaaggtgacgaagggaaattcatcggtatgggcgaaatggacggcgaagggcgtgtggcgccgcgtcgtctggtcgtcgaatatccggtcgaagcgtgacggtgataacgccttaccttgcgataaacaggggagacgagtagaatatcgccgcttaacgcctggtaaattgtttaacaatctgcggggcgtacatgggatagctgaattagagatcggcatccttacattctttatactttggagtttgaaaatgtctctaagcgttgaagctaaagctaaaatcgtttctgagtttggtcgtggtactaacgacagcggttctaccgaagttcaggttgcactgctgactgcacagattaaccacctgcaaggtcactttgcagagcacaaaaaagatcaccacagccgtcgtggtctgctgcgtatggtttctcagcgtcgtaaactgctcgactacctgaagcgtaaagatgttgcacgctacaccgcgctgatcgagcgtctgggtctgcgtcgctaa

SEQ ID NO: 1970 - DNA, 555 bp, Enterobacter cloacae
caggactatagctatcagggagtaaagctcgtgctggataaactgcgttcacgtctcgtacaatttggtccatcaatgctgagcgtgccggtaaaactggcgccgttcgcgcttaaacgccaggtgctggaacaggtactgagctggcagttccgccaggcgctacaggacggtgagctggagtttctggaaggccgctggttaaagattgaagtgcgcgatatcgggttgcgctggtttacttccgttgagaacgatcggcttatcgtccgtgaaaccgccgaggcggatgtcagctttagcgcggatgccagcgatctgctgatgatcgccgcgcgcaaacaggatccggacaccctcttcttccagcgtcgtctggtgattgaaggcgacacggagctcggtctgtacgtcaaaaatttaatggatgccattgagctggagcagatgccgaaagcgctgcgtatgatgttgatgcaaatggcagatttcgttgaggccgggctaaaaaccccgccggacagtaaacacacttcagtaggtgaaccatgctga

SEQ ID NO: 1971 - DNA, 492 bp, Enterobacter cloacae
ctgggctttacgccctttttttatgtcttgggggtgggcttgtccacattagagcaaaaattaacagagatgattactgcgccggtcgaagcactgggctacgaactggtcggcatcgaattcgttcgcggccgtacatccacactgcgcatctatattgatagtgaagatggcatcaatgttgatgattgtgctgatgtcagccaccaggtgagtgcggttcttgatgttgaagatccgattaccgttgcgtacaacctggaagtttcctcacctggcctcgatcgtccgatgttcacggccgagcactacgtgcgctttaccggtgaagaagtggctctcgttctgcgtatggccgtacagaatcgccgtaaatggcagggaattatcaaagccgttgatggtgaaatgatcacggtgacagtcgaaggcaaagatgaagtgttcgcgctgagtaatatccagaaggcgaacctggttccccacttttaa

SEQ ID NO: 1972 - DNA, 1011 bp, Enterobacter cloacae
acagcaaggcgagtaaggttgccatttgccctccgcgcaggcggagggcttattatcaggcaggacgccttgttaagccgccgggggacaggacgttcatccaatagttgtcttcgggagtgggaaatgaagccttttttgcgctggtgtttcgttgcgacagctttaacgctggcaggatgcagcaactctgcctggcgtaagagcgaagtcctcgcagtgccattgcaaccgactttgcagcaggaagtcattctggcacgcatggaacaaatacttgccagtcgggctttaaccgatgacgaacgcgcacagcttttatatgagcgcggagtgttgtatgatagtctcggtctgagggcactggcgcgaaatgatttttcacaagcgctggcgattcgacctgatatgcctgaagtattcaattacttaggcatttatttaacgcaggcaggcaattttgatgctgcctatgaagcgtttgattctgtacttgagcttgatccaacttacaactacgcgcacttgaatcgcggtatcgcattgtattacggcggacgtgataagttagcgcaagatgatctgctggcgttttatcaagacgatcctaatgatcctttccgcagcctgtggctttacatcgttgagcagaagcttgatgagaagcaggccaaagaagcactgaaacagcgcttcgagaaatcggacaaggaacagtggggatggaacattgtcgagttctacctgggcaacattagcgaagcaacgctgatggaacgcctcaaggcggacgcaacggataacacctcgctcgctgagcatctcagtgaaaccaacttctatttaggtaagtactacctaagtctgggggatatggacagcgctacggcactgttcaaattagcggttgctaacaacgtacataacttcgttgagcaccgttatgcattgttggaattatcgctcttgggccaggagcaagacgacctggcagaatcggaccagcaatag

SEQ ID NO: 1973 - DNA, 1935 bp, Enterobacter cloacae
gtagactggccgccattaatatcgaggcacttgtactacatggctgaattcgaaaccacttttgcagatctgggcctgaaggctcctatccttgaagcccttaacgatctgggttacgaaaaaccatctccgatccaggctgagtgtatcccacacctgctttctggtcgtgacgtgctgggcatggcccagactggtagcggtaaaaccgcagcattctcgctgccgctgctgaacaacattgatccggacctgcgcgcgccgcagatcctcgtcctggctccaacccgtgaactggctgttcaggttgctgaagccatgacggaattctctaaacatatgcgcggcgtaaacgtggtagccctgtacggcggccagcgttatgacgtgcagttacgcgccctgcgccagggtccacagattgttgtcggtacgccgggccgtctgctggatcacctgaagcgcggtaccctggacctctctaaactgagcggtctggtactggacgaagccgatgaaatgctgcgtatgggcttcatcgaagacgtagaaaccatcatggcgcagatcccggaaggtcatcagaccgctctgttctctgcaactatgccagaagcgatccgtcgcattacccgccgcttcatgaaagagccgcaggaagtgcgcattcagtccagcgtgaccactcgcccggacatcagccagagctactggtctgtatacggcatgcgcaaaaacgaagcgctggtccgtttcctggaagcggaagattttgatgcggcgattatcttcgtacgtaccaaaaacgcgaccctggaagtggctgaagccctggagcgtagcggctacaacagcgcagcgctgaacggcgacatgaaccaggccctgcgcgagcagaccctggagcgtctgaaagacggtcgtctggatatcctgattgcaaccgacgtggcagcacgtggtctggacgttgagcgtatcagcctggttgtaaactacgatatcccaatggactccgagtcttacattcaccgtattggacgtaccggtcgtgcgggtcgtgcgggccgtgcgctgctgttcgttgagaaccgcgagcgtcgtctgctgcgtaacattgaacgctccatgaaactgaccattccagaagctgagctgccaaacgcaaaactgctgggcaaacgccgtctggaaaaattcgccgcgagagtacagcagcagctggaaagcatcgatctggatcagtaccgtgcgctgctgtcccagatccagcctgtcgctgaaggcgaagagctggacatggaaaccctggccgcagcactgctgaaaatggcgcagggcgaacgtagcctgatcgtgccacctgatgcgccgatgcgtcctaagcgtgagttccgtgaccgtgacgatcgtttcgaacgtcgtggcgaccgtaacgaccgtggtccacgcggtgaccgtccagagcgtggtggtgaagaccgtccacgtcgcgagcgtcgtgacgctggcgaaatggaactgtatcgcattgaagtgggccgtgatgatggtgttgaagttcgtcacatcgttggcgcgatcgctaacgaaggcgacatcagcagccgttacattggtaacatcaagctgttcggttcccactccaccatcgagctgccaaaaggcatgccgggcgaagtactgcaacactttactcgcacccgcatcctgaacaagccgatgaacatgcagctgctgggcgatgcacagccacgtcctgaccgtggcggcgaacgtcgtggcggtggtcgcggtttcggtggcgagcgtcgtgaaggcggtcgcagcgaaggtcgcggtggtgaaggccgtcgtttctccggtgagcgccgcgaaaaccgtggtccacgccgtgaagaaggtgccagccgtcgtcgtttcggtgacgcgtaa

SEQ ID NO: 1974 - DNA, 723 bp, Enterobacter cloacae
atacttaccggtaacagacttttaagtgtggtagagcaggcccagaacgcaaacggacaattctgtaaaggggataagatgagtcaggtattgattaccggcgcaaccgggctggtgggtggacatctgctgcggctgctgatccaggatcggcatatcaactatatcgccgccccgacgcgtcgcccgctgttggatatcaccggcgtctataacccgcacgatccacagctcaccgacgcgctggcgcaggtgcaggatcccattgatatcgccttttgctgccttggcaccacccgacgggaagcgggcagtaaagaagcttttgtccatgcggattacacgctggtggtggataccgccctgacggcgaaaaagctgggcgcaaaacatttcctggtggtcagcgcgcacggcgcgaacgcaggctcgccgtttttttacaaccaggtgaagggcaaaatggaagaagcgttaatcgcgcagaaatgggagcgcctgaccatcgcgcggccttccatgctgatggggcaccgtgacgaacgtcgttttaacgagtcttttttcgctccgctgtttcgcattctgccgggtaactggaagtccatcgaggcgcgggatgtcgcgctggcgatgctaaaagaggcgctggctccgtcgcaggagggggttaatattatcccttcggcaaaactgcgtgaaatcgcgcagggcgaggcgtaa

SEQ ID NO: 1975 - DNA, 1518 bp, Enterobacter cloacae
ggtgaaaagcccgcgatgaacaaagaaattttggctgttgttgaagccgtctccaacgagaaatcactgccgcgtgagaagattttcgaagcgctggaaagtgcactggctacagcaaccaagaaaaaatacgaacaagagatcgatgttcgcgtagaaatcgatcgtaaaagcggtgacttcgatacattccgtcgttgggtaatcgttgaagaagtgacccaaccgaccaaagagatcaccctggaagcggcacgttttgaagacgaaagtctgaacgtgggtgactacgttgaagatcagattgaatctgttaccttcgaccgtatcaccacccagaccgcgaagcaggttatcgtgcagaaagttcgcgaagccgagcgcgcgctggttgtcgatcagttccgcgatcaggaaggcgaaatcatcactggcgtggtgaagaaagtgaaccgcgacaacatctctctggagatcaaatccgaaggactgccgggtaacgctgaagccgtcatcctgcgcgaagacatgctgccgcgtgaaaacttccgcccaggcgatcgtattcgtggtgtgctgtatgccgtacgtcctgaagcgcgtggtgcacagctgttcgtgacgcgttctaaaccagaaatgctggttgaactgttccgtatcgaagtgccggaaatcggcgaagaagttatcgaaatcaaagcggcggcccgcgatccgggctcccgtgcgaaaattgcggtgaaaaccaacgacaagcgtatcgacccggtcggtgcttgcgtcggtatgcgtggcgcacgtgttcaggcggtttctaccgaactgggcggcgagcgcattgatatcgttctgtgggacgacaacccggcgcagttcgtgatcaacgcaatggcaccggctgatgtggcgtctatcgttgttgacgaagacaaacacaccatggatatcgctgtagaagcgggcaacctggcgcaggcgattggccgtaacggtcagaacgtacgtctggcgtcacagctgagcggctgggaactcaacgtgatgaccgttgatgaccttcaggccaagcatcaggctgaagcccacgcggcgatcgataccttcaccaaatacctggacattgacgaagacttcgccactgtgctggttgaagaaggtttctctacgctggaagaactggcctacgtgccaatgaaagagctgctggaaattgacggtctggatgaaccaaccgttgaagccctgcgtgaacgcgctaaaaacgcactgaccaccctggcgctggctcaggaagaaagccttggcgataagaagccggctgatgacctgctgaatctggaaggtcttgatcgtgcgattgcgttcaagctggctgcccgtggtgtttgtacgctggaagatctcgctgagcaaggcgttgatgacctggccgatatcgaaggtttaaccgacgagaaagccggcgaactcatcatggccgcacgtaatatttgctggttcggcgacgaagcgtaa

SEQ ID NO: 1976 - DNA, 2709 bp, Enterobacter cloacae
actgtagcaggaaggaacagcatgactgatgtaactgtaaaatcgctggctgctgagattcagacctccgtggaccgcctggtacagcaatttgctgatgcagggatcccgaagtccgctgatgactcggtgaccgcgcaagaaaaacaaaccttgttagcgcacctgaaccgtgaacacggctctacgcctgacaagttaacgctacagcgtaaaacgcgtagcacgttgaatatccctggtaccggtggcaaaagcaagtcggtacaaattgaagtccgcaagacgcgcacctttgtaaaacgtgatccgcaagaggcagaacgccttgccgcggaagagcaggcacagcgtgaagcggaagaacaagctcagcgtgaggcagaagccactgccaaacgtgaagcagaattaaaagctgaacgtgaggccgcagaaaaagcgaaacgcgacgccggtgaaaaagcgaagcgtgacgctgcggaaaaagacaaagtgagcaatcaacagaccgacgaaatgaccaaaactgcccaggctgaaaaagcccgccgtgaaaatgaagctgccgagctgaagcgtaaagcggaagaagaagcccgccgcaagcttgaagaagaagctcgccgcgtcgccgaagaagcgcgtcgcatggcagaagaaaacgagaagaatggtgtgaatactgctgaaccaactgaagataccagcgattatcacgtcaccacgtctcagcatgcgcgtcaggcagaagacgacaacgaccgcgaagtagaaggtggtcgtggtcgtactcgcagtgcaaaagctgcgcgtcctgcgaaaaaaggtaacaaacacgctgaatcaaaagctgaccgtgaagaagcgcgtgcagcggttcgcggcggtaaaggcggcaagcgtaaaggttccgctctccagcagggcttccagaagcctgctcaggccgttaaccgtgacgttgtgatcggcgaaactatcaccgttggcgaactggctaacaaaatggcggtgaaaggctctcaggtcatcaaagcgatgatgaaactgggcgcaatggccaccatcaaccaggtcatcgaccaggaaaccgcacagctggttgccgaagagatgggccacaaagttatcctgcgtcgtgaaaacgagctggaagaagcagtaatgagcgaccgtgatacgggcgcagcggctgaaccgcgcgcaccggttgtgaccatcatgggccacgttgaccacggtaaaacctctctgcttgactacattcgttctactaaggttgcctccggcgaagcgggtggtattacccagcacatcggtgcttaccacgtagaaaccgaaaacggcatgatcaccttcctggataccccaggccacgcagcgtttacctcaatgcgtgctcgtggtgctcaggcaacggatatcgttgttctggttgttgctgccgacgatggcgtgatgccacagaccattgaagctatccagcacgcgaaagcggcgcaggtgcctctggttgttgcagtcaacaaaatcgataagccagaagccgatatggatcgcgtgaagaacgaactgtcccagtacggcgttatgccggaagagtggggcggtgaagcacagttcatccctgtatctgcaaaagcgggtaccggtatcgacgacctgctgaacgccatcctgcttcaggctgaagttctggagctgaaagcggttcgtaaaggtatggcgagcggcgcggtaatcgaatccttcctggataaaggtcgtggtccggttgcaaccgttctggttcgcgaaggtactctgcacaagggcgacatcgttctgtgtggtttcgaatacggtcgcgttcgtgcgatgcgtaacgaactgggtcaggaagtgctggaagcgggtccgtccattccagtggaaatcctggggctgtccggtgttccggctgccggtgacgaagtaaccgtcgtacgtgacgagaagaaagcgcgtgaagtcgctctgtatcgtcagggtaaattccgtgaagtgaagctggctcgtcagcagaaatctaaactcgagaatatgttcgccaacatgaccgaaggcgaagttcacgaagtgaacgttgttctgaaagcggacgttcagggttctgtggaagcgatctccgactccttgctgaaactgtctaccgacgaagtgaaagtgaagatcatcggttctggcgtaggtggtatcaccgaaaccgacgcaactctggcagcagcgtccaacgcgatcctggttggcttcaacgttcgtgctgacgcatctgcgcgtaaagtgattgatgctgaaagcctggatctgcgttactactccgtcatctataacctgattgacgaagtgaaagcagcgatgagcggcatgctgtctcctgagctgaaacagcagatcatcggtctggctgaagtacgtgacgtgttcaaatcaccgaaattcggtgcgatcgcgggctgtatggttaccgaagggaccatcaagcgtcacaacccaatccgcgtactgcgtgacaacgtggttatctacgaaggcgagctggaatccctgcgccgctttaaagatgacgttaacgaagtccgtaacggcatggaatgtggtatcggcgtgaagaactacaacgacgttcgcgttggcgatatgatcgaagtgttcgagatcatcgaaattcagcgtaccatcgcgtaa

SEQ ID NO: 1977 - DNA, 978 bp, Enterobacter cloacae
cccggcggacgacagcaaggaggactgatgagtcgtcctcgtcgtcgcggtcgtgacgtgcatggcgtgctcttgctggataaaccacagggcgcatccagcaacgacgtgctgcaaaaagtgaagcgtatttataacgccaaccgagcagggcacaccggcgcgctggatccgctggcaaccggcatgctgccgatctgcctgggggaagcgacaaagttttcccagtacctgctggattccgataagcgctaccgcgtgattgccaaactgggccagcgtacggatacctccgatgcagatggccaggtggtggaagagcgcccggtgaccttcagcgcagagcaacttgatgcggcgctggacagcttccgtggtgatacgctacaggtgccgtcgatgtattcggcgctgaaatatcagggcaaaaagctctacgaatatgcacgtcagggcattgaggttccgcgcgaagctcgtccgattaccgtgtatgagctgctgttcattcgtcacgaaggtgatgaactcgagctggaagtacactgttcgaaagggacctatatccgcaccatcattgatgacctcggtgaaaagctgggctgcggcgcgcatgtgatttatctgcgtcgtctggcggtcagcaaatatccggtcgaacgcatggtgacgcttgagcatctgcacgccctgattgagcaggcgcaagcgcagggcgttgcgccggccgatctgctggacccgctgctgatgccaatggacagtccggcagtggacttcccggttgttaatcttcctttaacatcgtccgtttactttaagaacggaaacccggttcgcacaacgggggcaccgcttgagggcctggtacgcgtgacggaaggtgacgaagggaaattcatcggtatgggcgaaatggacggcgaagggcgtgtggcgccgcgtcgtctggtcgtcgaatatccggtcgaagcgtga

SEQ ID NO: 1978 - DNA, 2220 bp, Enterobacter cloacae
tcgcgaggatgcgaagaaggtcgggttaaatcgtcagcacacctgaggtgtgctttcaaacatttaagaaaggacagaactttgctgaatccgatcgttcgtaaattccagtatggtcagcataccgtcacgctggaaaccggcatgatggcgcgtcaggctactgctgccgttatggtaagcatggatgacactgctgtattcgttaccgtagttggccagaaaaaagctaaaccaggtcaggacttcttcccgctgaccgttaactaccaggagcgtacctacgctgccggtaaaatcccaggtggcttcttccgtcgtgaaggccgtccaagcgaaggcgaaaccctgatcgcgcgtctgattgaccgcccggttcgtccgctgttcccggaaggcttcgtgaacgaagtgcaggttatcgcaaccgttgtttccgttaacccgcaggttaacccggacatcgttgcgatgatcggtgcgtctgctgccctgtcactgtctggtattccattcaatggtccaatcggtgctgcgcgcgtgggttacatcaatgatcagtacgtgctgaacccaactcaggaagagctgaaagagagtaagctggacctggttgtcgctggtactgaagccgcggtgctgatggttgaatccgaagctgaactgctgagcgaagaccagatgctgggcgctgtggtcttcggccacgaccagcagcaggttgttatccagaacatcaacgacctggtgaaagaagccggtaaaccacgttgggactggcagccagaagcggccaacgacgcgctgaacgcacgcgttgctgcactggcagaatctcgtctgagcgacgcataccgcatcaccgacaaacaggagcgctatgctcaggttgatgtgatcaaatctgaagtgaccgcgaccctggttgccgaagacgaaacgctggacgctaacgaaattggcgaaatcctgcacgctatcgagaaaaacgttgttcgtagccgcgtactggcaggcgagccgcgtatcgatggccgtgaaaaagacatgatccgtggtctggacgtgcgtactggcgtactgccacgtactcacggttctgcgctgttcacccgtggtgaaacgcaggcgctggtaaccgcgaccctgggtactgcacgtgacgcacagatcatcgacgaactgatgggcgagcgcactgacagcttcctgttccactacaacttccctccgtactctgtgggcgaaaccggtatggttggctcaccgaagcgtcgtgaaattggtcacggtcgtctggcgaagcgcggcgtgctggcagtgatgccagaagcagacaaattcccgtacaccgtacgtgtggtgtctgaaatcactgaatccaacggttcttcttccatggcttccgtgtgtggcgcttctctggcgctgatggatgcaggcgtgccaattaaagccgccgttgcgggtatcgcaatgggtctggtgaaagaaggcgacaactacgttgttctgtctgacattctgggtgatgaagaccacctgggtgatatggacttcaaagtggcgggttcccgcgacggtatctctgccttgcagatggatatcaaaattgaaggtatcaccaaagagatcatgcaggttgctctgaaccaggctaaaggtgcgcgtctgcacatcctgggcgtgatggaacaggctatcaacgcgccacgcggtgatatctctgaattcgctccgcgtattcacaccatcaagatcaatccagacaagatcaaagatgttatcggtaagggcggttccgttatccgtgcactgaccgaagaaacgggcaccaccatcgaaatcgaagatgacggtactgtgaagatcgcagcaaccgacggcgagaaagcgaaatacgctatccgtcgtatcgaagagatcacggcagaaatcgaagtgggccgtatctacaatggtaaagtgacccgtatcgttgactttggcgcattcgttgccatcggtggcggtaaagaaggtctggtacacatctctcagatcgctgacaagcgcgttgagaaagtgaccgattacctgcaaatgggtcaggaagtaccggtgaaagttctggaagttgaccgccagggccgtatccgtctgagcattaaagaagcaaccgagcagtctcagcctgctgcggcgccggaagctccggctgctgaacagcaaggcgagtaa

SEQ ID NO: 1979 - DNA, 1251 bp, Enterobacter cloacae
  unsure (1159)
ggccgcatggcaacactaaccaccacccaaacgtcaccttcgctgcttggcggcgtggtgatcatcggcggaaccatcattggtgccgggatgttttccctgcctgtggtcatgtccggtgcgtggttcttctggtcgctggcggcactggttttcacctggttctgcatgctccattccgggctgatgatccttgaagcaaacctgaactatcgcattggctccagcttcgacaccctcacccgggatctgttgggcaaaggctggaacctggtgaacgggctgtccatcgcgtttgtactctatatcctgacctacgcgtacatttcagcgagcgggtcgattctgcatcacaccttctcagagatgtcgctgaacgttccggcgcgtctggcgggtctctgcttcgcgctgggcgtggcgtttatcgtctggatgagcaccaaagcggtcagccgcatgacggcaatcgtgctgggcgcaaaggtcatcaccttctttcttaccttcggcagcctgctggggcacgtcacgccggccacgctgtttaacgttgccgaaacgaacacctcttatacgccgtacctgctgatgaccctgccgttctgtctggcgtcgtttggctaccacggtaacgtaccgagcctgatgaagtactacggcaaggatccgcgcaccatcgtgaaatgcctggtttacggcacgctgctggcgctggcgctgtatgtgatctggctgctggggacgatgggtaacatcccgcgtccggaatttatcggcattgcgcagaagggcggtaacattgatgtgctggtacaggcgctgggcggcgtgctgaacagccacagcctggatctgcttctggtggtcttctcgaactttgcggtggcgagttcattcctcggcgtgacgctgggcctgtttgactacctggcggatctgtttggttttgatgactctgcgacggggcgcttcaaaacggcgctgttgaccttcctgccgccgattgtgggcggcctgctgtggccgaacggtttcctgtacgccatcggctatgcgggactggcggccaccatctgggcggcgattgtaccggcgctgctggcgcgcaaatcacgtaagcgcttcggcagcccgaaattccgcgtctggggcgganagccgatgattgcgctgattctggtatttggtatcggcaacgcggtggtgcacgtgctgtcgagttttaatctgttgcctgtgtatcagtaa

SEQ ID NO: 1980 - DNA, 507 bp, Enterobacter cloacae
accatgctgattcgagtcgaaattgggattgatgcgccgggtatcgatgcgttgttacgccgctcttttgcaggcgacgccgaagcccaactggttcacgatcttcgcgaagatggcctgattacgctgggcctggttgccactgacgatgaagggcaggtggtcggctacgtggccttcagcccggtgattgtgcagggtgaagagttgcagtgggtcggcatggcgccgttggcggtggatgaaaactaccgtggccagggcctggcgcgccagctggtctatgaaggactggattcactgaatgaatttggctatgccgctgtcgtcgttctgggcgatccggcgttctacgaacgtttaggttttgagccagcgtccagatacgatctgcgctgccactggccgggcacggaaacatctttccaggtgcatcctctggcagatgatgcgctcgacggcgttaccggtctggtggagtaccacgatcatttcaatcgtttttaa

SEQ ID NO: 1981 - DNA, 447 bp, Enterobacter cloacae
gagagagcgaaaatggaaacactggccgccattaaccgctggctggcaaagcagcatgtcgtgacctggtgcgtctgtaaagacgaggagatgtggtgcgcaaatgccttttattactacgatcccgagcgcgtggccttttacgtaatgagcgaagacaaaacgcggcatgcgcagatgacgggccagcaggcaaaagtggcaggtacggtaaacggtcagcctaaaactgttgcgctgatccgcggggtccagttcaaaggtgaaattcgtcgcctggaaggggaggagagcgacgcgcaacgtaaacgctatacgcgccgcttcccggtggctgcggcgctaaaagccccggtgtgggaaatccgccttgatgagctgaaatttaccgacaacaccctgggctttggtaaaaagctgcactggttacgcgccgagcaggcgtag

SEQ ID NO: 1982 - DNA, 738 bp, Enterobacter cloacae
caccttccggggaatggtatgactggtcagtcttcatctcaggcggcaacacctgttcagtggtggaagcccgcactcttctttctcgtggtcatcattggcctctggtatgtgaaatggcagccgtactacggtaaagccttcaccgccgccgacacccacagcatcggtaaatcgattctcgcgcaggccgattccagcccgctacgcgcggcgtgggattacgcaatggtctattttcttgccgtctggaaagcggcagtattaggcgtattgctgggctcgctgattcaggtacttatcccgcgtaactggctggtgaaaaccctgggacagccgcgcttgcagggcacgctgctggggacgattttctccctgccgggcatgatgtgttcctgctgcgccgcaccggtggcggcgggtatgcgccgacagcgcgtgtcgatgggcggcgcgcttgccttctggatgggtaacccactgctgaacccggcaacgctggtgtttatgggcttcgttctcggctggcatttcgcgtttatccgtctggcggctggcctgctgacggtggtgcttgtcgctacgctggtgcagcacctggtgaaagacaacgaggccggatctgcttccgttgagctggacgtcagcgagccgcagggcagtttctttgctcgctggggcaaagcgctgtggcagctttttctggagcaccattccggtctatatcctggcttttga

SEQ ID NO: 1983 - DNA, 363 bp, Enterobacter cloacae
tggcggccagtgtttccattttcgctctctctcatgctatggtgcgttcaccttaacatactgaatctgtttactgtgtgctggtttctctatcttgtccgaaccgctgataacgcactctacaccgggatcactaccgatgtggcacggcgttttttacaacatcaaacggggaaaggggcgaaagcactgcgggggaaaggtgaacttcagttagcgttttcagccgccgtgggcgacagatccctggcgctcaggctggaataccgcatcaagcagttgacaaagcgccagaaagagcgtctcgtcaacggggacggctctttcgaggcgctactcgaaagcctgcttaaaaacgattga

SEQ ID NO: 1984 - DNA, 1038 bp, Enterobacter cloacae
gccaggtggcaaaggtgtggcgtcaggccatcgaccgctgcatggcggacccgcaaaactacgctccgcaggcggcatggatggagacgctcggcgcgatgtccgaaggcacccaaaccacgctcggcgcgtatcaccgtaaatggcagtgagataatcatgaaatattcattagggccggtgctttactactggccaaaagagacgctggaagatttttaccagcaggcggctaacagcagcgccgatgtgatttacctcggcgaagcggtgtgcagcaagcgccgcgccaccaaagtgggcgactggctggatatggcgaaaagcctggccggcagcggcaagcaggtggtgctctcgacgctggcgctggtgcaggcgtcctctgaactgggcgagctgaagcgctacgtcgaaaacggtgagttcctgctggaggcgagcgacctgggcgtggtgaacatgtgcgccgaacgtaagctgccgtttgtcgccggacatgccctgaactgctataacgccgtgaccctgcgcctgctgctcaaacaggggatgacccgctggtgcatgccggttgaactctcccgcgactggctggccaacctgcttacacagtgcgaagagctgggcattcgcaacaagtttgaagtggaagttctgagctatgggcatctgccgctggcctactctgcccgctgcttcaccgcacgttccgaagatcgtccgaaagacgagtgcgaaacctgctgcattaagtacccgaacggacgcagcatgctgtcgcaggagaatcagcaggtgtttgttcttaacggcattcagaccatgagcggttacgtctataacctcggcaacgaactggcgtcaatgcacgggctggtggatatggtgcgtctttcgccgctggataccggcgtattcgccatgctggacgccttccgcgccaacgaaaatggcgctgctccgctgcctctgacggcaaacagcgactgcaacggttactggcgacgtctcgccgggctggaattgcaggcataa

SEQ ID NO: 1985 - DNA, 1014 bp, Enterobacter cloacae
gctgttatgactgacaaaaccattccgttttcggtgctggatctggcgccgatcccacaaggctcctcggccagagaagccttcacgcactctctcgatcttgctcagcttgccgaaaagcgcggctatcaccgctactggctggcggagcaccacaatatggtgggcatcgccagcgccgccacctcggtgctgattggctatctggcggcgaataccaccacactgcacctgggctccggcggtgtgatgctgccgaaccacgccccgctggtgatcgccgagcagttcggcacgctgaataccctctatccgggccgtattgatttagggcttggccgtgcgccgggcagcgatcagccgaccatgcgcgccctgcgccgccatatgagcggcgatatcgacaacttcccgcgcgatgtggcggagctggtgggctggttcgacgcgcgtgacccgaacccgcacgtgcgcccggtaccgggttacggcgagaagatcccggtatggctgttgggctcaagcctctacagcgcgcagcttgccgcccagctggggctgccgtttgcgtttgcctcgcatttcgcaccggatatgctgcatcaggcgctgcatctctaccgcacgcacttcaaaccgtccgagcgtctggagaaaccgtacgcgatggtgtgtatcaatatcattgccgccgacagcaaccgcgacgcggaattcctgttcacctccatgcagcaggcgtttgtgaagctgcgtcgcggtgagacgggccagctgccgccgccggtagagaatatgcatcagctatggtcggcctccgagcagtatggcgtgcagcaggctctgagtatgtcgctggtaggtgataaggcgaaagtgcgtcacgggctggagtcggtgctgcgtgaaacccaggcggatgagattatggttaacggccagattttcgatcaccaggcgcgtctgcattcgtttgatttggcaatgcaggtgaaagaggagttggtggggtag

SEQ ID NO: 1986 - DNA, 456 bp, Enterobacter cloacae
accggaatggtgctccagaaaaagctgccacagcgctttgccccagcgagcaaagaaactgccctgcggctcgctgacgtccagctcaacggaagcagatccggcctcgttgtctttcaccaggtgctgcaccagcgtagcgacaagcaccaccgtcagcaggccagccgccagacggataaacgcgaaatgccagccgagaacgaagcccataaacaccagcgttgccgggttcagcagtgggttacccatccagaaggcaagcgcgccgcccatcgacacgcgctgtcggcgcatacccgccgccaccggtgcggcgcagcaggaacacatcatgcccggcagggagaaaatcgtccccagcagcgtgccctgcaagcgcggctgtcccagggttttcaccagccagttacgcgggataagtacctgaatcagcgagcccagcaatacgcctaa

SEQ ID NO: 1987 - DNA, 540 bp, Enterobacter cloacae
agcgaaaacaacggaggaagcatgggtaaaaaaatcgcagtcttgattaccgacgagtttgaagattcagaatttacatcgccagcagaggcattccgcaaggcgggccacgaggtggtcaccatcgagaaagaagcgggtaaaaccgtgaagggccataagggcgaagccagcgtgaccattgacgaatccattgataacgtcagcccgtcggatttcgacgccctgctgttaccgggcggccattcaccggattccctgcgcggagacgagcgtttcgtcacctttacccgtgacttcgtcggcaccggtaaaccggtatttgccatttgccacggtccgcagctgctgatcagcgccgaggtggtacgcgggcgtaagctcaccgcggttaagtcgatcgttatcgatctgaaaaacgcgggagccgagttctacgatcaggaagtggtgaacgataacgatcagctgatcaccagccgtacaccggacgatctgccggcgtttaaccgtgaagcgctacgcctgctcggcgcgtaa

SEQ ID NO: 1988 - DNA, 1125 bp, Enterobacter cloacae
gcagctggtccccggaagggattgccgcgatcccagtgcggtgctttccataacactaccggcggcctgacctatttcaataccaccccgctgggtcgtgccgtcaccggcactatgctggtcgccgccatgaaagaagatggcgtgaacatctggggggacggtagcacctataaaggcaacgatattgaacgtttctatcgttatggcctgctgaccaacgccgagttgcagatctacaaaccgtggctggataccgacttcatcgacgagctgggtggccgtcatgaaatgtctgagtttatgattgcctgcggctttgactacaagatgtcggttgagaaagcctactcaaccgactccaacatgctgggtgcgacgcacgaagcgaaagacctggaattcctgaactccagcgtaaaaattgttaacccgatcatgggcgtgaagttctgggatgagaacgtgaagatcccggcggaagaagtgaccgtgcgtttcgaacgtggtcatccggttgccctgaacggtaaaacgttctccgacgatgttgaactgatgctggaagcaaaccgcatcggcggtcgtcacgggctgggtatgagcgatcagatcgaaaaccgtatcatcgaagcaaaaagccgcggcatttacgaagctccagggatggcgctgctgcacatcgcttatgagcgtctgctgaccggtattcacaacgaagacaccattgagcagtatcacgctcatgaccgtcagctgggcaaactgttgtatcagggtcgctggtttgatccacaggcgctgatgttgcgtgacgccatgcaacgttgggtggcaagcgccatcaccggcgaagtgaccctggaactgcgtcgcggtaacgaatactccatcctgaacaccgtgtctgacaacctgacctataaagcagagcgtctgaccatggagaaaggtgagtcagtattctctccggacgatcgtattggccagctgaccatgcgtaacctggacatcaccgatacccgtgagaagctgttcaactatgttgagaatggcctgctctccgcgaattccggtaatggtctgccgcaggttgagaacctggaacacagcgataagaagtaa

SEQ ID NO: 1989 - DNA, 999 bp, Enterobacter cloacae
attatggagctgctctgccctgccggaaaccttccggcgcttaaggcggccatcgaaaatggggccgatgcggtctatatcgggctgaaagatgataccaacgcccgccattttgcgggtcttaactttacggagaaaaagcttcaggaagccgttaacttcgtccaccagcaccggcgcaaactgcatatcgccatcaatacctttgcccatcctgatggctatgcccgctggcagcgcgccgtggatatggcggcccagctgggcgccgatgcgctgatcctggccgacctcgccatgcttgagtatgcggcagaacgttatccgcatattgaacgccatgtctctgttcaggcatcggccaccaatgaagaggccgtccgtttttatcatcgacactttgacgtggctcgcgtagtgctgccgcgcgtactctctattcatcaggttaagcaactggcgcgcgtcacgccagtgccgctggaggtttttgccttcggcagcctgtgcatcatggccgaaggccgctgctatctttcctcgtatttgaccggcgaatcgccaaataccgtcggcgcctgctcgcctgcccgcttcgttcgctggcagcaaacgccgcagggactggagtcacgcctgaatgatgtgttaattgaccgctatcaggacggtgaaaacgcgggctacccgacgctgtgcaaaggccgatatctggtggacggcgagcgctaccacgcgctggaggagcccaccagcctcaacacgctggaactgctgccagagctgctggccgccaatattgcctcggtgaaaatcgaaggccgccagcgcagcccggcctacgtgagccaggtggcaaaggtgtggcgtcaggccatcgaccgctgcatggcggacccgcaaaactacgctccgcaggcggcatggatggagacgctcggcgcgatgtccgaaggcacccaaaccacgctcggcgcgtatcaccgtaaatggcagtga

SEQ ID NO: 1990 - DNA, 321 bp, Enterobacter cloacae
tcagtcaatcaagcagggttttattatatgacgacgattctcaagcatctcccggtaggacaacgtattggcatcgctttttctggcggcctggataccagcgctgcactgctgtggatgcgccagaagggagcggttccttatgcatatactgcgaacctgggtcagccggacgaggaagattatgacgcgatccctcgtcgtgccatggaatatggcgcagagaacgcacgtctgatcgactgccgtaagcagctggtccccggaagggattgccgcgatcccagtgcggtgctttccataacactaccggcggcctga

SEQ ID NO: 1991 - DNA, 474 bp, Enterobacter cloacae
actgtaatcgccatggcggccaggaagtctatcatattcatatgcatctgctgggtggacgtccactgggaccgatgctggcacataaaggtctttaatatgttaactgggcgtattgcagcgctgatcgtgacgctggtaatggttgggtgcagcgcgcgtcccgccatcccggtcagtgaagaacagacgctggtgatggagtcctcagtgcttgctgcgggcatcacggcggagaagccttcgctgaccataagcgaaatccagtcttcagcctcttctacgctctataacgaaaggcaagagccagtgacggtgcattatcgcttctactggtatgacgtgagaggtcttgagatgcacccgcttgaggcgccgcgcagcgtgaccatcccagcaagatcgtcggtcacgctctacggcagcgccagctatctgggtgcacataaggtgagactttatctttatttgtaa

SEQ ID NO: 1992 - DNA, 270 bp, Enterobacter cloacae
aggtataaaatcatgaaaaacgttaaaaccctcatcgctgccgccgttctgagttcactctctttcgcaagcttcgctgctgttgaagtgcaatccactccagcagaccagcagaaagtcggtaccatctctgccactgccgggactaacctgggctctctggaagatcagctggcgcaaaaagctgacgaaatgggtgcgaaatcattccgcatcacctctgtgaccggtcctaacaccctgcacggtaccgcagttatctacaaataa

SEQ ID NO: 1993 - DNA, 1269 bp, Enterobacter cloacae
actgacgctgatgggagcggagtaatggcttcaccgttatcgttactcatcgggttacgctttagccgcggtcgtcgccggagcgggatggtttcccttatctccgtgatctccaccatcggtatcgccctgggcgtggcggtgctgattgtgggcttaagcgccatgaacggctttgagcgtgaactgaataaccgcattctggccgttgtccctcacggtgaaatcgagccggttaaccagccgtggtccaactggcaggattccctgaacaaagtggaaaaggtgcccggtattgcggcggctgcaccttacattaactttaccgggctggtagagagcggggtaaacctgcgcgccattcaggtgaaaggggtaaatcctcgtcaggaagagcgtctgagcgcgctgccgcgctatgtgcaaaatggcgcatgggcaaactttaaggccggcgagcagcagattatcatgggcaaaggcgttgccgatgcgctgaaggtgaagcagggcgactgggtctcgatcatgatcccgaacgccagcgctgatcacaaattgcagcagcctaagcgcgtacgtctgcacgtcaccggtattttgcagctgagcggccagctcgatcacagcttcgcgatggtgccgctggaagatgcacgccagtatctggatatgagcgacagcgtgacgggcattgccattaaggttaacgacgtcttcaacgccaataaactggtgcgtgacgctggcagcgtgacgaataactatgtctacatcaaaagctggatcggcacttacgggtatatgtatcgtgatatccagatgatccgcgcgattatgtatctggcgatggtgctggtgattggggtggcgtgttttaatatcgtctcgacgctggtgatggccgttaaggataagagcggcgacatcgccgtgctgcgtaccttaggggcgaaagacggtcttattcgtgccatcttcgtctggtacggtttactggcggggctgtttggcagcctctgcggcgtggcgatcggcgtggtggtttcccttcagctgacgccgattatcaacgggattgaagcgcttattggccatcagttcctgtcaggcgatatctattttattgacttcctgccgtctgaactgcactggctggacgttatttatgtgctggttacagcacttttactgagtctgctggcaagctggtatccggcgcgtcgcgctagccgaattgatccggcgagggtattaagtggccagtaa

SEQ ID NO: 1994 - DNA, 966 bp, Enterobacter cloacae
tttcgtcatggtttagcggtcttttggccgctgaatcaaacagaggaatgcatcatgtattacggatttgatattggcggcaccaagattgcgctcggcgtgttcgataaagatcttaagctacaatgggaaacccgcgtccccacgccgcgcgaaagctacgatgaatttttaaccgccattgccgcactggtggcgcaagcggatgaacgctttggcgtcaaaggcagcgttggcattggtattccgggtatgcccgaaaccgacgatggcacgctgtacgcggccaacgtgcctgccgccagcggcaaaccgctgcgggccgatctctccgcgctccttgaacgcgacgtgcgcttagataacgatgccaactgcttcgcgctctctgaagcctgggatgatgaattccgtcgcttcccgctggtgatggggctgatcctcggaacgggcgtcggtggcgggattgtcattaacggtaagcccattaccgggcgcagctatattaccggcgaatttggccatatccgcctgccggtggatgctctggaggtcgtcggacgtgatttcccgctgacccgctgcggctgtgggcagcacggctgtattgagaactacctatcaggccgcgggtttgcatggctttacgaacacttctatcatcagaaacttgaggcccctcaaatcattaccctgtgggagcagggggatgcgcaggcgcgtgagcacgtcgagcgctatctggatctgctggcggtgtgtctggggaatatcctgactatcgtcgatccggatctgctggtgatcgggggagggctgtcaaatttcactgcgattacggaacagttgtccgggcgtctgacccgacatttattgccggtcgcccgcgtgccgcgcattgagcgtgcgcgacacggggacgcaggaggcatgcgcggagccgcattccttcatctcaccgattag

SEQ ID NO: 1995 - DNA, 651 bp, Enterobacter cloacae
accttgattaaaacaatgagccgttatgcgctcctgagtgcctttgcactctttctggcgggttgtgtgacgcgaacggaagaacctgcaccggtggatcaggcgaagccgggaacggaacagccaacaacgccagcgcagcctgttccaaccgtgccgtctgtaccgaccattccggcgcagcctggcccgatcgaacatccggacgacaccgcacagcctgcgccgcgagtacgccactatgactggaatggcgcaatgcagccgatggtgggcaaaatgttgcaggcacagggtgttacgcccggcagcgtgctgctggtggacagcgtgaacaaccgtacaaacggttccctgaatgcgggagaagcgacggaaaccctgcgcaacgcgctggcaaacaacggtaaatttacgctggtctctgctcagcagctcgcggtcgccaagcagcagcttggtctgtcgcctcaggacagcctgggttcgcgcagtaaagcgattggtattgcccgcaacgttggcgcgcagtatgtcctttattctaacgcgacaggcaacgtgaacacgccgtcgttgcagatgcagttaatgctggttcagaccggcgaaattatctggtcaggtaaaggtgccgttacgcaacaataa

SEQ ID NO: 1996 - DNA, 1068 bp, Enterobacter cloacae
tgcctggcgtcagttacaaacgaaaggataagagaggttggtgtgggtccagtaatgttggatgtcgaagggtttgagctggatgcggaagagcgcgaaattctggcgcatccgctagtaggggggctgattcttttcacccgcaattatcatgatccggagcagttgcgtgagctggttcgccagatccgtgcggcgtcgcgcaatcacctggtggtggccgtagaccaggaaggtgggcgtgtgcagcgtttccgcgaagggtttacccgtttacccgccgcgcaatcttttgctgcgctgctggggatcgaagagggcggtcaactggcgcaggatgccggctggctgatggccagcgagatgatcgccatggatatcgacatcagcttcgccccggtgctggacgtaggacacattagcgcggcaattggtgagcgttcgtatcatgacgatccgcgtattgcgctggcaatggcgacgcgctttattgacggtatgcatgctgcgggcatgaaaaccaccggcaaacatttcccgggccacggggcggtgacggcggattcccataaagaaaccccgcgcgatccgcgcccggaagcagacattcgcgctaaagatatgtcggttttccgctcgctgatcgctgataacaagctggatgccatcatgcctgcgcacgtcatctacagtgaggtcgatccgcgtccggccagcggctctccacactggcttaaaaccgtgctgcgtcaggagttaggcttcaatggcgtaattttctctgacgatttatccatggaaggggcggcgattatgggtagctatgccgaacgtgggcaggcttcgctggatgcgggttgcgatatgatcctcgtctgcaataatcgtaaaggggcggtgagcgtgctggataacctgtcgccgatcaatgctgaacgtgttacacaattgtatcataaaggttcatttagtcgtcaggagctgatggactcggcgcgctggaaaacggtaaacgcccggcttgaagccctgaacgagcgctggcaggcacataaagcagccctttaa

SEQ ID NO: 1997 - DNA, 1320 bp, Enterobacter cloacae
tttgagggggtcacgttgactacgccattgaaaaagatagtgattgtcggcggtggtgctggcggactggagctggcgacgcagctgggtaagaaactgggtcgcggtaagaaagccaaaatcacgctggtggatcgtaaccacagccatctgtggaagccgttactgcacgaagtggcgaccgggtcgctggatgagggcgtggatgcgctcagctatctggcgcatgcgcgtaaccaccacttccagttccagctgggttcggtggtggatatcaatcgtgaaaacaaaaccatcacgctggctgagctgcgtgatgataaaggcgagttgctggttcctgagcgcaagctggcctatgacacgctggtgatggccctgggcagtacctccaatgatttcaacaccccaggcgtaaaagagcactgcatcttcctggataacccgcatcaggcgcgtcgtttccatcaggagatgcttaacctgttcctgaagtacaccaacaacatgggtgctaacggcaaggtcaacattgctatcgtgggcggcggcgcaacgggcgttgaattatcggcggagttgcacaatgcggtcaaacagctgcacagctacggctacaaagggctgactaacgaagcgctgaatgtgacgctggtggaagcaggtgaacgcattctgcctgcgcttccgccgcgtatttccggcgcggcgcacaacgagctgactaaactgggcgtgcgcgtgctgacccagaccatggtgaccagcgcggatgagggcggcctgcataccaaagacggcgagtacatccaggccgacctgatggtctgggctgcggggatcaaagcgcctgatttcatgaaagatatcggtgggctggagacaaaccgcattaaccagctggtgacagagccgacgctgcaaaccacgcgcgatccggacatcttcgccatcggcgactgtgcctcctgcgcacgtccggaaggcggatttgtaccgcctcgcgctcaggctgcgcaccagatggcaagcctcgtgctgcataacatcctggcgcagataaaaggcaaaccgatgaaagcctatgtctacaaagaccacggctctctggtgtcgctctcaaacttctccaccgtgggcagcctgatgggtaacctgatgcgcggctccatgatggtggaagggcgcatcgcccgcttcgtgtacatttctctgtaccgtatgcaccagattgcgttgcacggctacttcaaaaccggcctgatgatgctggttggccgcatcaaccgcgtgatccgtccacgcctgaagctgcactaa

SEQ ID NO: 1998 - DNA, 1944 bp, Enterobacter cloacae
  unsure (1064)
cggattcgcttatatactcgtgggtctgctatcagcaaacagacggatttcatgtatcaacctgtcgcactctttataggcttacgttacatgcgtgggcgcgccgcggaccgcttcggtcgctttgtctcctggctttcgactattggcattacgcttggcgtgatggcactggtgacggtgctttccgtcatgaacggcttcgagcgcgagctgcaaaacaatatcctggggctgatgccgcaggccgttctctcttccactcagggttccgttaatccgcaacagctgccggaaagcgcggtgaagttacagggtgtcacgcgcgttgcgccgctcacgacgggcgatgtggtgctgcaaagcgcccgtagcgtggcggtcggggtgatgctgggtatcgatcccgcgcaaaaagatccgctgacgccgttcctggtcaatgtgaaacaaaccgacctggaagcgggtaaatacaacgtcatcctcggcgagcagcttgccgggcagctcggggtcaaccgtggcgatcagctgcgcgtgatggtgccgtcagccagtcagtttacgccgatggggcgtctgccaagccagcgcctgttcaacgtgattggcacgtttgcggcgaacagcgaagttgatggttaccagatgctggtgaacattcaggacgcctcgcgtctgatgcgctaccccgcgggaaatattaccggctggcgtctgtggcttgatgcgccgctgaaggtggataccctcagccagcagacgctaccggaagggacgaaatggcaggactggcgcgaccggaaaggcgaactgttccaggccgtgcgcatggagaaaaacatgatggggctgctgctgagcctgatcgtggccgttgccgcgtttaatatcatcacctcgctcgggctgatggtgatggagaagcaaggcgaagtcgccattctgcaaacccaggggctgactccgcgccagatcatggcggtatttatggtccatggcgccagcgccggcatcatcggcgcgctgctcggcgcggcgctgggggcgctgctcgccanccagctcaacaatctcatgccgattatccgcgcgctgcttgatggcgcggcgctgccggtggctatcgagccgctcaagtggtccgtattgcgctggccgcgatggccaatgcgctgcttgctacgctttatccttcctggcgggctgccgccactcaacccgctgaggctttacgttatgaataagatcctgttgcagtgcgacaacctgtccaaacgctatcaggaaggcactgtgcagaccgacgttttgcacaatgtgagttttagcgtgggcgaaggcgagatgatggcgattgtcggcagctccggctccggtaaaagtacgctgttgcacctgcttggcgggctggacacgccaaccgaaggcgatgtgatcttctccgggcagccgctgagtaaaatgtcgtctacggcgaaagccgagctgcgtaaccgtgagctgggttttatctatcagttccaccatctgctgccggactttacggcgctggaaaacgtcgcaatgccgctgctgattggtaaaaagaaacccgcggaaattaatgcccgcgccagcgacatgctaaaagcggtagggctgggtcatcgcgggaatcaccgtccgtctgagctttccggcggtgagcgtcagcgtgtggccatcgcccgtgcgctggtcaacaacccgcgcctggtgctggcggatgaaccgacaggtaacctcgatgcgcgtaacgcagacagcattttccagcttctcggcgaactgaacgccgcgcagggaaccgcgtttctggtggtcacccacgatttacaactggctaagcggatggggcgtcagctggaaatgcgcgacggtcgtctgaatgctgaactgacgctgatgggagcggagtaa

SEQ ID NO: 1999 - DNA, 372 bp, Enterobacter cloacae
aaggaaaaggtcatggctgaagaaacgattttcagtaaaattatccgccgcgaaattccgtcggatattgtctatcaggatgaactggtcacggctttccgcgacatttctccccaggcgccgacgcacatccttattattcccaatattctgatcccgaccgttaatgacgttaaaaccgagcatgaagtggcgctgggccgtatgctgacggtggccgcgaaaatcgctgagcaggaagggattgctgaagacggataccgtttgatcatgaactgtaatcgccatggcggccaggaagtctatcatattcatatgcatctgctgggtggacgtccactgggaccgatgctggcacataaaggtctttaa

SEQ ID NO: 2000 - DNA, 864 bp, Enterobacter cloacae
tgctggttcagaccggcgaaattatctggtcaggtaaaggtgccgttacgcaacaataagcgcacgcgtcatgatgtcctgacgcgttatttccctcaataccatgttatcgcgccgcaagcccccgccgggcttggcggcgcgagttgcattattgagcatggcgaccatcggctggttttacgtcagcatcacgatgccgccgcgcctgcctcccattttcgtcgccagttccgcgccctgaagcgcctgcccgccgaccttgcgccacaacctcatctctttatcagagactggatggcggtggcgtttatagcgggtgagatcaaaagcgagcttcccgatacgcctgcgctgacagccatgctgtatcatctgcatcgccagccgcgtctgggctggcgggtaacgttacttcctttgctggatcactactggcagcaggctgcgcctggacgacgcacgccctactggctggcgcagcttaagcggttgcgtaaagcgggagagccgcaggcgttacgtctggcgccgctgcatatggatgtccacgcggggaatatcgttcataccacggcaggcgagaaacttatcgactgggaatatgccggagacggtgacgtggcgctcgaacttgctgcggtctggatgcctgatgaggcgtcgcgcaagcagctgataaccgcctatgcccgaaacgccaacatcaatgcgctcacccttgcgcggcaggtcgcgcgctggcgtccgtgggtgttgatgctgatggcgggatggtttgaaatgcgccttcagcagacaggtgacaaacaatttattgcgctggcaaatgatgcctggcgtcagttacaaacgaaaggataa

SEQ ID NO: 2001 - DNA, 555 bp, Enterobacter cloacae
cgtggtgagacgatgatcatctatttacacggttttgactcaaacagtcctggtaatcatgagaaagtgctgcaattgcagtttatcgatccggatgtccggctgatcagttacagcacacgtcatccgaagcatgacatgcagcatctgcttaaagaagtggataaaatgttgcagctcaatatcgacgatcgcccgctgatctgcggcgtggggttaggaggatactgggcagagcgcatcggttttttgtgcgatatccgtcaggtcatttttaatcctaacctgtttccgaacgaaaacatggaaggcaaaatcgatcgcccggaggagtacgccgacatcgccaccaaatgcgtgagcaatttccgtgaaaagaaccgcgatcggtgtctggtgatcctctcccgcaacgatgaagcgctgaacagctcccgcgccgccgagcttctgcaccattactacgaaattgtctgggacgaagagcagacccacaagttcaaaaacatttccccgcacttgcagcgtattaaagcctttaaaacgctgggctga

SEQ ID NO: 2002 - DNA, 612 bp, Enterobacter cloacae
tcctttatcttattggcgaagcgtttattgcgctgcaaaattgctaccaattgcaacaaaggaggaagtcccgtgaataaatcaatgttggcgggtatagggattggcgtcgcagctgcgttaggtgtggctgccgttgccagtctgaacgtacttgatcgtggcccgcagtatgcgcaggtggtttccgctacaccgatcaaagagacggtcaagacgcctcgtcaggagtgccgtaatgtttctgtcacccatcgtcgtccggttcaggatgaaaaccgtatcgctggctccgtgctgggcgcggttgctggtggggtgattggtcatcagtttggtggcggccgtggtaaggatgtcgcgacggtggttggtgcgctgggtggcggttatgccggtaaccaggtgcagggcgcgatgcaggaaaatgatacctacaccacaacgcagcagcgctgtaaaaccgtgtatgacaagtctgaaaaaatgttgggctacgacgtaacctacaaaattggcgatcagcagggcaaaatccgcatggataaagatcctggtacgcagatccctctcgacagcaatggtcagctgatactgaataacaaagtgtaa

SEQ ID NO: 2003 - DNA, 900 bp, Enterobacter cloacae
gcgtgcgcgacacggggacgcaggaggcatgcgcggagccgcattccttcatctcaccgattagtttacgaggttattatgctgtcgcgtcgccagggtcgactcagccgttttcgcaaaaataaacgccgcttacgtgaacgcctgcgtcagcggatctttttcagagacaggatgatgccagaagcgatggataaacccagagtggtggtgttgaccggggcggggatctccgccgaatccggtattcagactttccgcgcagcggatggactgtgggaagaacaccgagttgaagatgtggcgacgccggaaggtttcgcccgcgacccggcgctggtgcaggcgttctacaacgcccgccgtcgccagcttcagcagccggagattgcgccgaatgcggcgcacctggcgctggcaaagcttgaggaagcgctgggggatcgttttctgctggtcacgcagaacatcgacaatcttcacgaaagggcaggaaaccacaacatcattcacatgcacggcgaactgctcaaggtgcggtgcgcatggagtggtcaggtgctggagtggaaagaggacgtgctggacgaagaccgctgccactgctgtcagttcccttcgcgtctgcgtccgcatgtggtctggtttggcgaaatgccgctgggaatggatgagatctacagcgccctggccatggcggacgtctttatcgccattggtacttcaggacatgtctatccggcggcgggatttgttcacgaagcgcgacttcaaggtgcccatacggtggagcttaatctggagccaagccaggtcgggagtgagtttgaagagaaacattacggtctggcgagcgaggtggtgccagcctttgtggataaattcctgaaggggctataa

SEQ ID NO: 2004 - DNA, 279 bp, Enterobacter cloacae
cgcaatatttgcgttttgctgcttaatgataatgttgtcacaaaaagtgagggtgactgcatggataaactacttgagcgtttcttacattacgtttcgctggatacccaatctaagccgggggtccgacaggtgccaagcaccgaaggccagtggaagctgctaaatctgctgaaagagcagctggaggctatggggttggttgacgtcacgctcagcgaaaaagcgaccggtcttcacgcccggactggccggatccgcgcttatgtatgtgcaccc

SEQ ID NO: 2005 - DNA, 1059 bp, Enterobacter cloacae
aacaaaatctcaggggacacagaaatgaaaaaaatgcttgccgctgcggcactggtgctcggaatgggcgctgcgcatgctgatgacagcaaaacgctctatttctacaactggaccgagtatgtgccgccgggcctgctggagcagttcaccaaagagacaggcatcaaggtgatctattcgacctacgagtcgaatgaaaccatgtacgccaagctcaaaacctataaagatggcgcgtatgacctggtggtgccgtcgacctatttcgtcgacaagatgcgcaaagaaggcatgatccagaagatcgacaaaacgaagctaacgaatttttctaacctcgatcctgagatgctaaacaagccgttcgacccgaacaacgactactccattccgtacatctggggcgcgacggcaattggcatcaacagcgatgccattgatcccaaaacggtttcatcctgggctgacctgtggaagccggaatacaaaagcagcctgctgttaaccgacgatgcgcgcgaagtgttccaggtggcgctgcgtaaactcggctattccggcaacaccaccgatccgaaagaaatcgaagcagcgtataacgaactgaaaaagctgatgccaaacgtggcggcgttcaactcggataacccggctaacccgtatatggaaggtgaagtgaatctggggatggtctggaacggctctgcgtttgtggcgcgtcaggccgggacgccgcttgaggtggtctggccgaaagagggcggcatcttctggatggacagcctcgcgatcccggcgaatgcgaaaaacgtcgagggtgccctgaagctgatcaacttcctgctgcgcccggatgtggcaaaagaggtggcggaaactatcggctacccgacgccaaacctggccgcacggaagcttttaagccctgaagtggcaaatgataaatcgctttatccggacgctgaaaccatcagcaaaggggaatggcagaacgacgtcggtgacgcgagccgcctgtatgaagaatattatcagaagctaaaagcaggccgttaa

SEQ ID NO: 2006 - DNA, 1155 bp, Enterobacter cloacae
tacagactgttacccattacatcagggcttcattttacaacaatcggcgtttcgtttatggcaacaaggtcgtcacgcaccatgaaacaaaaagcattatggattaaccagataaaaggcctgtgcatctgcctggtggtaatttaccactcggtgatcaccttttatcctcaccttgacgggctacagcatccgttatcgggcctgctggccaaatgctgggtctactttaatctttaccttgccccgttccgtatgccggtgtttttctttatctccggctatttgatccgtcgttatatcgacgaggtgaactggcgcactagtctcgacaagcggatctggagcatcgtctgggttttggccctgtggggcgtcctgcaatggcaggcgctgacccatctgaatgcctggctcgcccccgagcgagaactggcgacagcatccaatgcggcctacgccgattccgtttcagggtttgtactgggaatgctcacggccagcaccagcctgtggtatttgtacgcgttagtggtctactttacgctctgtaagctgctgagccgctggaaactgccgatgctggggattctggcgctggcaagcatcgccatcaacttcctgccgttaccgtggtggggaatgaacagcgtggtgcgcaacatgatctactacagcctcggcgcatggtacggcgcgcagttgatggcgtggatgaaagggatgaatttgcgccgcagctggctggtacttctcgcctctggcgcggtgtcggtagtgctgtggttcgctaatgttcctctgccgctctcactgctgtcgatcgtggtcatcatgaagctcttttacagcttcgagcagcgttatgccgttcatcccaataatctgctgaacgtcatcggttcaaacaccatcgcgatttataccacccaccgcattttaattgaggcgtttagcctgctcctgattcgcgaaatgaatgcggcgtactggccgatctgggcggagttaacgctgattctggtctatccgtttatcagcctgctcgtctgcacgctggttgggctgggggcacgtaagctctcaaccgccctctttggcgaccttttcttctcccctcccgcgcggctttctccacagactgctacccgttaa

SEQ ID NO: 2007 - DNA, 1212 bp, Enterobacter cloacae
aatgtccgccctcattacgagtcaccaaggtggttacacacaaaccccgcttcagtctgctgcctgaggcgtctatatgggacagcgcgaaaattgaatacacaaccccgttccctttcaccgctggtgcaactggaacgaattcgtaaaagtttcgatggcaaagatgtcatttccgaccttaatctgaccatcaatgacggtgagtttctcacgctgctcggcccctccggctgcggcaaaaccaccgtcctgcgccttatcgccgggctggaaagcgtcgataacggccatatccatcttgagaaccaggacattacccaggttcctgccgaagatcgccacgtcaataccgtcttccagagctatgccctgttcccgcacatgaccgtgtttgagaacgtggcgtttggcctgcggatgcaaaaaacaccggccagcgagatcccgcctcgggttaccgaagccctgcgcatggtgcagctggaggcattcgcccagcgcaagcctcatcaactttccggtggtcagcagcagcgtgtggccattgcccgcgccgtggtcaacaaacctcgcctgctcctgctggatgaatccctctccgcgctggactacaagctgcgcaagcagatgcagaacgagctgaaagcacttcagcgtaagctcggcattacgttcgtgtttgtcacgcacgatcaggaagaagccctgaccatgtcagaccgtatcgtggtgatgcgcgacggcaagattgagcaggatggcaccccgcgtgaaatttacgaagagccgaaaaacctgttcgtcgccagcttcattggtgaaatcaatattttcaacgccacggtgattgagcgtctggacgagcagcgcgtgcgcgcgaacgtggaaggccgcgaatgcaacatcacggtgaactttgccgtggaaaaggggcaaaggctcaacgtcctgctgcgcccggaagatctccgcgttgatgagatccacgacacggctgacgtcgaaggtctgatcggttacgttcgcgaacgtaactacaaagggatgaccctcgaatccgtggtcgaactggaaaacggcaaaatggtgatggtcagcgaattctttaacgaggacgatccggacttcgaccactcgctggatcagaaaatggtcatcaactgggtagaaagctgggaggttgtactggctgatgaagaacacaagtaa

SEQ ID NO: 2008 - DNA, 807 bp, Enterobacter cloacae
gaaggtggagctggaatgatcggtcgactgcttcccgctggttttatgaccgccatttatgcgtatctttatattccgataatcattttgatcgtgaactcctttaacagctcgcgcttcgggatcaactggcaagggtttaccaccaaatggtatggcctgctgatgaacaatgacagcctgctacaggccgctcagcactcgctgacgatggcggtattctctgccaccttcgcgacgctgattggctcgttgaccgccgtggcgctgtaccgctaccgttttcgcggtaagccgttcgtcagcggtatgctgtttgtggtgatgatgtccccggatatcgtgatggccatttcactgctggtgctgtttatgctgctgggcgtccagctcggtttctggtcgctgctgttctcgcatatcaccttctgtctgccgtttgtggtggtaaccgtctacgcgcgtctgaaagggttcgacgtacgcatgctggaagcggcgaaagatctgggtgccagcgagatgaccattctgcgcaaaatcattctgccgctggcgatgcccgccgtggcagcaggatggctgctcagctttaccctgtcgatggacgacgtggtcgtgtcctccttcgtcaccgggccgagctatgaaattctgccgttgaagatctactcaatggttaaagtcggtgtttcacccgaagtgaacgcgctggcgactattctgttggtgttatcgctggttctggtgattgccagccaggttattgctcgtgataaaacaaaatctcaggggacacagaaatga

SEQ ID NO: 2009 - DNA, 3513 bp, Enterobacter cloacae
agacattgcgtatcagtgatatgccccaatactgttggtatatccccaagagactctgacatagccatgcctgaacactatcgtttttccttgcctgtaaaagcaggtgaccaacgccagctgggcgaactgacaggcgcggcctgcgccacgctggtggcggaaattgccgagcggcatccagggccggtggtgctggttgccccggacatgcaaaacgccctgcgcctgcacgacgaaattcgtcagttcaccgacagtctggtattcagcctggccgactgggaaacgcttccctacgacagtttctctccgcaccaggagatcatctcctcgcgcctgtcgacgctgtatcagctccccaccatgcagcgcggcgtgctgattgtgccggtgaataccctgatgcagcgtgtctgcccgcacagctatttgcacggccatgcgctggtgatgaaaaaaggccagcgcctgtcgcgcgatgccctgcgcgtgcagctggatggagccggctatcgacatgtcgatcaggtgatggagcacggcgaatacgcgacgcgcggtgcgctgcttgatctctatccgatgggcagcgatcagccgtaccgtctggatttcttcgatgatgagatcgacagcctgcgcgtgttcgacgccgacacccagcgcacgctggaggaagtggactctattaatctgctgcccgcccatgagttcccgacggataaaaccgccatcgaactgttccgcagccagtggcgcgacaggttcgacgtgaagcgtgatgccgaacatatctaccagcaggtcagcaaaggcacccttccggccgggatcgagtactggcagcccctgttctttaacgaaccgctgccggcgctgttcagctacttcccggcaaatacgctgattgttaacaccggggatatcgacgccagcgccagccgctttgaaagcgaaacgcgcgcccgctttgaaaaccggggcgttgacccgatgcgtccgctgctgccgccggaaatgctgtggctgcgtaccgacgagctcaacgccgagctgaaacgctggccgcgtatgcagctcaaaaccgattcgcttgccgataaggccgccaacactaacctcgccttccggatgctgcctgacctggccgttcaggcgcagcagaaatccccgctcgataatctgcgcaagtttcttgagtccttcaccgggccggtggtcttctccgttgaaagtgaaggtcgccgtgaagcgctgggcgaactgctgggaaggatcaaagtcgcgccaaagcgtattcttcgcctgagcgaagcgaccggaaatggccgttacctgatgatcggcgccgccgagcacggattcattgatacgctcaataacctggcgttgatatgtgaaagcgacctgctgggcgagcgcgtcgcgcgccgtcgtcaggacagccgtcgcaccatcaacccggacaccctgatccgcaacctggccgaactgcaccccggtcagccgattgttcacctggaacacggtgtgggtcgctatcaggggatgaccaccctcgaagcaggtggcatcaaaggtgaatacctgatgctgacctacgctaacgacgccaagctgtatgttccggtgtcgtccctgcatctgatcagccgctacgccgggggcgcggaagagaatgcgccgctgcacaagctgggcggcgatgcctgggcgcgtgcacgccagaaagcggcggaaaaagtgcgcgacgtggccgccgagctgctggatatttacgctcagcgtgcggccaaagagggctatgcgtttaagcatgataaagagcagtaccagctgttctgcgacagcttcccgtttgaaactacgccggatcaggcccaggccatcaacgccgtgctgagcgacatgtgccagccgctggcgatggatcgcttagtctgcggcgacgtgggcttcggtaaaaccgaggtggcgatgcgcgccgctttcctggcggttgagaacaacaagcaggtggcggtgctggtgccgaccacccttcttgcccagcagcacttcgacaacttccgcgaccgcttcgccaactggccggtacgtatcgaaatgttgtcccgcttccgcagtgccaaagagcagacgcagatcctggaacaggcaagtgaaggcaaaattgatattctgatcggcactcacaagctgctgcaaagtgacgtgaagtggaaagatctggggttgctgatcgttgacgaagagcaccgcttcggggtgcgccacaaagagcgcatcaaagcgatgcgcgccaacgtcgacattctgaccctgaccgcaacgccgatcccgcgcaccctgaacatggcgatgagcggcatgcgcgatctgtcgataatcgctaccccaccggcgcgccgtctggcggtgaaaacctttgttcgcgagtacgacaatctggtggtgcgcgaggcgatcctgcgcgaagtgctgcgcggtggccaggtctattacctgtacaacgacgttgaaaatattcagaaagccgccgacaggctggcagagctggtgccggaagcgcgcatcgccattggtcacggccagatgcgcgagcgcgagctggagcgggtaatgaacgatttccaccaccagcgctttaacgtgctggtgtgtaccaccatcattgagaccggaatcgacattccgacggcgaacaccatcatcatcgaacgggcggatcacttcggcctggcccagctgcaccagctgcgcgggcgggtcgggcgttcgcaccatcaggcctacgcctggctgctgacgccgcatccgaaggcaatgaccaccgacgcgcaaaagcgtctggaagcgatcgcctcgctggaagatctgggcgctggctttgcgctggcgacccacgacctggagatccgcggcgccggtgagctgctgggtgaagaccagagcggctccatggaaaccatcggtttctcgctgtatatggagctgctggaaaatgccgtcgacgcgcttaaagccggacgtgaaccgtctctggaagatctcaccagccagcagaccgaagtggaactgcgcatgccttccctgctgccggatgattttattcctgacgtgaatacccgtctgtcgttctacaaacgcattgccagcgcgaaaagcgaaggcgagctggaagagatcaaagtcgaactgattgaccgttttgggatattgcccgatgcggcgcgcaacctgctggatattgcccgcctgcgtcagcaggcgcagaagctgggcattcgcaaacttgaaggcaatgagaaaggcggcgtaattgagtttgccgaaaagaaccacgtcgatccgatgtggctgattggcctcctgcaaaaacagccgcagcatttccgtcttgatggccctacgcgtctgaaatttactcaggatctgacggaacgtaaaacccgcatggactgggtgcgtaactttatgcgtcagttggaagagaacgccatcgcataa

SEQ ID NO: 2010 - DNA, 1020 bp, Enterobacter cloacae
ttatcattaacgccttataaaacaataaccttatcatttgtatggattatgataatgatgatttcttcgcgttttacccgctggttaactctggttgcgctggccgcgacggttgccgtcgcgctccctgctcgcgccaatacctggcctcttccgcccgccggcagcaacgtcgtaggtgaaaaccgctttcacgtggttgaaaacgatggcggctcgctggaagcgattgccaaaaaatataacgtcgggttcctggcgctgttgcaggccaacccgggcgtagatccgtacgtgccccgggcgggcagcgtactgacgattccgctgcaaaccatcctgccggacgcgccgcgtcagggcattgtgattaacctcgccgagctacgtttgtattactacccgccgggcaagaacgaagtgaccgtctaccctatcggtattggtcaactggggggcgatacgctcacacctaccatggtcaccaccgtctctgataagcgcgctaatcctacctggaccccgacggcaaacattcgcgcccgttataaagctcaaggtatcgacctgcccgccgtggtacctgctggcccggataatccgatggggcatcatgcaattcgcctggcggcatatggtggggtttatcttctgcacggaacgaatgcggatttcgggatcgggatgcgcgtcagctccggctgcattcgcctgcgcgatgacgatatcaaaacgctctaccgcgtgatcgcccctggcacgaaagtgaatatcattaatacgccgattaaagtatctgaagagccaggtggcgtccgtctggttgagatccaccagccgctatcgaaaaacatcaatgacgatccgcagacgttgccgattaatctgaatgcctcgatggtgagctttaaaacgaatgccaacaccgatggcgcagtgatggagcgggcgatggaagcacgttcggggatgccaaccgatgttacgcggcatcatgaggttgctcagcagtcaatgtaa

SEQ ID NO: 2011 - DNA, 882 bp, Enterobacter cloacae
aaagctgggaggttgtactggctgatgaagaacacaagtaagttccagaatgtggtgattgccacgatcgtcggttggcttgtgttgtttgtctttcttcccaacctgatgatcatcgtgaccagcttcctgacccgcgacgacgcgaacttcgtggcgatggtctttacgctggacaactacgcgcgcctgctcgatccgctctattttgacgtgctgctgcactcgctcaatatggcgctgattgccaccctcgcctgcctggtactggggtatccgttcgcctggttcctggcccgcctgccgcaaaaagtgcggccgctgctgctgtttttactgattgtgccgttctggaccaactcgttaatccgcatctacgggctgaaaatcttcctcagcaccaaaggttatctgaacgagtttctgctgtggctgggggtgatcgagacgccgatccgcatcatgttcaccccgggcgcggtgattgtcggcctggtctatatcctgctgccgtttatggtgatgccgctctactccagcattgaaaagctcaataaaccgctgctggaagcagcgaaagacctgggcgccagtaagttacaaacctttgtccgcatcattattccgctgaccatgccgggtattatcgccggctgtctgctggtcatgctgcctgcgatggggctgttctacgtctcggacctgatgggcggggcgaaaaacctgctgatcggtaacgtgattaagagccagttccttaacattcgcgactggccgttcggctcggccaccagcataacgctgacggtggtgatggggctgatgctgctggtttactggcgtgcctcacgcctgctgaataagaaggtggagctggaatga

SEQ ID NO: 2012 - DNA, 669 bp, Enterobacter cloacae
ctattcaacaaaacaacagaggaccaacggcacatgacaaccgatgtcacgcgttgcgcaaagaaaagccgtggccgaccaaaagtgttcgacagggatgcggcgctcgataaggccatgacgctcttctggcagcatgggtatgaagccacgtcgctttccgatctcgtggaagctacgggtgctaaagcccctaccctgtacgcagagttcaccaacaaagaaggcttattccgggccgttctggacagatacatctcgcgcttcgcggcaaaacatgaagcccagctattctgtgaagaaaaaacggttgagcaggcattacaggattatttcacggcaatcgcgacctgctataccagcaaggacacgcctgcggggtgttttatgatcaacacctccgcgaccctcgcggcatcgtctaaagagattgccaacacggtcaaatcgcgacatgcgatgcaggaggagacgctcagcacgtttctggctcagcgtcagctgcgcggcgaaatcccggcgcattgccgtccgcaggagctggcccagtatctgagctgtattttacaggggatgtccatcagcgcccgtgaaggcgcgacgctggaaaaattgcaggggattacgcacacaacgctgcgcctgtggcctgaacttcttaaactctga

SEQ ID NO: 2013 - DNA, 846 bp, Enterobacter cloacae
catggaggtcaatcagtacaaagactcacaaagcggatcggaagaaaaatgaatatcgcaacggcttctctctcccgccaggggacgcgcgccagcaaccaggatcagacgggagaaaccatcggggaacgttcagcctgctttgtcgtctgtgacggcatcgcgggcctgccgggcggcgaggtggccgctgagctggcccgcaacagcattatttcccgctttgacggcgacaagcaccttaatgcgcagcatattcgtgactacgtccaaacggcgaaccgcaccatcctcagcgaacaacaggccgtgcaggactatcgccggatgggcaccacgctggtcagcctgtttatcgacagggattaccgtctggcttactgggcgcacgccggagacagccgcctgtacctgtttcgccgcggctggctgtggcatgtcaccaccgatcacagcctcgtccagcagatgaaagatgccgggcatcagaccgacgatctcaacagcaacctgctgtatctggcgctgggtattgagaatggcggaccggaagcgagctacagcgatgtcgtgcaggtcgaggacggtgatgccttcctgctctgcaccgacggtttctggcacggcgttagcgaagagcagatgaagcagtcgctgcacatggtcaatacgccacaggagtggctgaccttaatgaaccaaatcattcaaaagaatgccgaacaggagggcaatgctcaggataactataccgccgtggcggtgtggatgggcaaccctcaggacaccactttgctgcatacgctctctgacgcagcacaatttcttccctgcggaactgattag

SEQ ID NO: 2014 - DNA, 2742 bp, Enterobacter cloacae
cgccgggcgattagggtacaacacctggctcggccttcagcctcagcctgttccgcgtggcgatctggtgtatcgcgcagagcgataatccttccgtataccgaatcattgttaatggaaactaacatgtcagaaattagccgtgccgtgcttttcggcaaactggatacgctgttatttacctctctggaaagcgcgactgccttctgtaagctgcgcggcaacccgtacgttgagctggtgcactggctgcatcagctgatgcagcagcaggatggcgatctgcaacaggtcatccgtcacttcgcccttgatgaacagcagctgacgcgcgatatcgtggcggcgctggatgccctgccgcgtggcgcgagttccgtgtctgatctttccgagcatatcgacagcgccgtcgagcgcgcctgggtctacggctcgctgaaatttggcgtcagccgcatccgcggcggccatttgctgatcggcatattgaaaacgtggaatctggctaacgtgctgaaaagtatttcggcgcagttcacccgtcttaacgttgaggtgctggtcgagcagttcgacgccatttgcgccagcagcaaagagagccagcaggccgccgccgctgcggacgcgcctgccggggcagtaccggctgcgcagggcacgctggcgcagtatggtcaggatctgacggcgcgcgcccgggaaggcaagattgacccggtggtggggcgcgatgaagagatccgccagatggtcgatatcctgatgcgtcgtcgccagaacaaccccttgctgaccggggaagccggcgtcgggaaaaccgcagtggtggaagggctggcgctgcgtatcgccgacggcgacgtgccggagccgctgcaaaacgttcagctgtggctgctggatatcggcatgcttcaggccggagcgggcatgaaaggggaatttgaggcgcgcctccaggcgctgattaacgaggtgcagtccagcgccacaccaattattctgtttatcgatgagatccacaccctgattggcgcaggcggacagcagggcaccggcgatgccgctaacctgctcaagccagccctggcgcgcgggcaactgcgcaccatcggcgcgaccacctgggcggaatacaaaaaatacattgagaaagatcctgcgctgacccgccgcttccagacggtgcaggttcacgagccggatgaagcgaaagccgtactgatgctgcgtagcaccgtgtcgccgctggaaacccatcatcaggttttactcctcgacgaagcggtcagcgcggcggtgaaactgtcgcatcgctatatccctgcgcgtcagctaccggataaagcggtggcgctgctggataccgcctgcgcgcgcgtggccgtcagccagagcgcgccgcctgctcagctggaagactgtctgcgtcacctggcggccctggacgtggagctggagattgctgaacgcgaagcgcgcgtgggggcgggcgatccggcgcgtgtggcgaccttaaccgccgaacgtgacgcattcgaaacccaacgcgaagctctggcccgtcgctgggaagaagagcgcacgcgggtgcaggagattatccgtctgcgtgccgcgctgtttgcggcgggagatgaggatacggctgaactgcgcggccagctggcagaacagcagcaggcgcttaagatcttacagggtgacgaaccgctgctgtttgccgcggtggatgaaaacgtggttgccgcggtggtctctgactggaccgggatcccgctgggccggatggtgaaaaacgagatcgacgcggttctgaaccttgccgacacgctgaaccagcgtgttattggccagcgtcacggtctggatctgattgcccgccgcgtgaaaacctcgcgggcgaagcttgatgatccgaacaagccggtgggcgtctttatgctgtgcggtccgtccggcgtcggtaaaaccgaaaccgcgctggcgctcgccgaatccctgtacggcggcgagcagaacgtcatcaccatcaacatgagcgagttccaggaagcgcacaccgtctccaccttaaaaggtgcgcctccggggtacgtagggtatggtgaaggcggggtattaaccgaggccgtccgccgccgtccatacagcgtcgtgctgctggacgaaattgagaaagcgcacccggacgtccacgagatcttcttccaggtcttcgacaaaggctggatggaagacggcgaggggcgccatattgatttccgcaacaccattattattctgacctccaacgtcggcaccgagctgattagcgccatgtgcgccgatccggacctcatgccggagcctgaggccttaagcggcgcgctgcgccagccgctgctggaggtgttcccaccggcgctgctgggccgtctgctggtggtgccgtactacccgctcagcgacgagatgctggggcagattgtgcgtcttcagctcaggcgcattcagcgtcgtctggaagagaatcacaacattatttctgaatttgacgacagcgtggtcgaacagattgttcagcgctgtaccgaggttgagtcgggcgggcgtatggtggatgcgattctgaccaatacgttgctgcctcagatgagccagattttacttaccgccagccgcagcgaccagcagtaccgacgtctgcatgtcacctgcgagcagggcgagttccactgtcagtttgccgcgtaa

SEQ ID NO: 2015 - DNA, 1437 bp, Enterobacter cloacae
aagatgacggataatgataacaatcggactgtcccaaacgcgctcccggtcgggtaccgtttcaatgagtttgagataaaagaggtgattggcggcggcggattcggcatcgtctatcgcgcctgggatcaccagctcgaacgcactatcgctatcaaagaatttatgccttcctccctcgccgtgcgcggcgaggatatgacgctggtgctgcgcagcgagcgcttcggcaaagcgttttctgccggtctgaacagcttcatccaggaagcccgcctgctggcgcgctttaaccacccgaacctgctgcacgtactgcgtttctgggtgcaaaacgacacggcctatatggggacgctgttttacagcggtaccacgctgtcgcgtctgcgcgaagagaaaccggagctgattaacgaggcgtggatccgccgcatgctgccaatgctcttcggcgccatcaaaacgatccacgacgagggttatctacaccgcgacatctcgctggataacattcagattcaggataacggcctgccggtgctgctcgatttcggatcggcacgccgcaccatcggtaatctctcggatgagacggaaaccatgctgcgtccgggcttcgcgcctatcgagcagtataccgacgacaatgaaagcgagcaggggccgtggacggatatctacgcgctcggcgccgtattgcgcaccctcatcgtcggctctccgccgccggtcagcgtggtgcgttcgattcaggacacctgcaaaccactggtggagctgatgccgcagggttattccattccgctgcttcaggccatcgacaaggcgctggcgctgcatatggaagaccgtccgcaatccattgaggagtttgcggcgctgatcgagatgcccgtcgccggtatcgacgaggtgctgactgcgaagaagaccggcacgatgctggtgccggtggaagaggaggcatctgcttccgcgctggactggcgacgttacaagcttccggggctggtggccgcgggcgtgctggttggggtggttgccggtgcgatgctgttcggcggcggcagtcaggaaacgccagagcagacggcgcaaacccctgccgtgagccctccggctgagacctcatcccaatcggaaaccagaccggcaacggcagacgtgagcgagccggtagcgccacctgctacggcgcagcagagtgcgccgcctgtcgacgccagcccggtcgcgctggtctacatccgcatgcttgatggcgagacgctgaaggtgaacggcgagtctaaagcgctgcgtccggggaataacggttacgcatcgctgaaattgcctgcgggcgagacccgcattgaactggaaggcaatggaagaacgcgtacccagacgctggatattgcgaagccaggcacctggctggtgaatccgtaa

SEQ ID NO: 2016 - DNA, 789 bp, Enterobacter cloacae
ggatatttcgataatcgggagtcgattgtgaaaaaagggttgatggcttttgtcgcgttatgttttttattcatgattcaggggtgtaagcaggatatggaccttaatccacaggactacttcagcggtcagcagcttgaactggcgaaagcgattgaagaaggcgatgtcgacgcggtgaagacgcttgcaccagacagcgatcttaataaaccgggaaagcaggatatgaccctgcttttttgggccatcggcaacgcgattaatgataaaaagacatcgccccatttaaaggtgattacgttgcttgttaaggctggcgcagatccgctccagcctcgaccgcagggaaaaagcagtcctgccgaatttgccctaaagggagacagtgcggactggatcgacgcgatgctggacggtggcctctcacccaacgtgaaagataaggttttccacgaaccgatcgtcttccagtcgcttaaagcgaaaaatacagagacgctggaagccatgctcaatcgcggtgctgacgtcaactcaaccaactcactgggtaaaacgctggtgtttgatgcgctggataaccaggcttacgatcatgtcttgttgctgctcgatcgtggagcggatccgtcaattaaggccaaaaatggctggtcgatgagcaatgcgctcgcggacgcgcttaatggacttgagcgaggcagtgagcaatacgagaaattaaacgaaataaaagagaagctcatccagaaggggggcgaatggccacccgcgccggttaagtga

SEQ ID NO: 2017 - DNA, 1194 bp, Enterobacter cloacae
agagtaagacggccaataaccagaacattcacgtttaaaaagccttgcgttaaaaatattctcagcataaaccattacggaataaagattatgctcaaccgaattaccgttcagctcccggttgaggggctgcttttctggaaactctccggccgcgaggcgatgtccgagtcgttcgcgctgacgctgaccctgctcggcacggatgcgcgcattgaccgcagcaggctgctcggtcagccggtcacggtgaccatccccacgcagagcctgcttactccccgctttatcaacggcaaggtgacgcgcgtggcggtgagcgccgttgagctgacgggcacccgctacgcggtgtaccagctgacggtggagccggacctgtggccaatgaagcgcgaccgcaacctgcgtatcttccagggccagacggtgccgcagattgtcaaaaccctgctgggtgagcatcaggttaacctcgaggacaaactcaccggcagctaccgggtgtgggactactgcgtgcagtatcaggagtcgagcctggacttcatcagccgcctgatggagctggagggaattgcgtactacttcagccacgaggccgacaaacacacactggtgctcaccgacgccgccccccagcaccagcctttcagcggctatgaggtcattccttaccaccagacgccgtccggcggcagtacggacgaagagggcatcagccagtgggcgctggaggacagcgtgacgccggggatttacagcctcgacgactatgacttccgcaagccgaacgcgtggctgttccaggcccagcagtacccggcgtcaccgaaaccgggcagcatcgacgtgtacgactggccggggcgctttgtggagtcggcccatacggaaatttacgccagcttccctcgggagctctggcaattggagcatcagcagattcaggcatcaacatggcgcaggggcgttacgccatcttcctcaattccggcgatgtgttccatgaaaatgtggcgctgtttgcccgtcagctggcgcgccagaaagaagatgccatgtttatcggtgatgcgctgcttgatttcggcgaggggaaaaaagtgctgcgcggtgcgaaaccaggctggtatatctaccacagcctcccggccagccatcaggctattttcttcccaaggcgcggtctga

SEQ ID NO: 2018 - DNA, 1797 bp, Enterobacter cloacae
tcataccagcaggaatacgccatgcgattcacgattatttctacgaaacccggtcatcagccgccgcaaagcagctgtgatttttatgccccgggcggcaccattgggcgcggtacggataacaatctggtgctgccggacaatgaccgcactatctcgcgtttgcaggccatcgttcacgtcgacgccagtggcgaatgccgcgtcacgaaccgcggcagcgttacccgcgtggtactgaatgatatcccgctggagcgtgggcgtcaggttgagcttcaggatggggatattctcggtattgatgattatcgcattgaagtcagcgaactcattcatgacacccagcccgtaagccgcatggcggccagcatgcagcaggcgcgcccagcggcgacacctgctccggcgccacaaccgaaaccggccagcgccgcgcctcgcggaaaagctgaacctacggccgtgccgtcggaaatctgggacagcctgatgcaggagttttccatctccgacagcatctccagcaaccgggcaaaaccacagcccgcggcatcccacgatccgttctctcagcctgcggccccggagcggaatgccgaagatccgctggcaatgtttaacgacgccgaaccgtcgcttgaacgtaaaaacgttgacccggacacgctgttcagcgatgaagcgttgtttaaaaaagagagcatctttgacgatgtcaccccttcaacgctggtacagccggacgaaagcaaacctgcccagccaaaggaagaggcgtcggacgaactcgatccgttagccctgtttggcgggtcggcgagcgcacctgccgcgcgtcacgatgaccctctcggcctgatgggcggcgcgccgttaacccatccggatgaaatcgtggccgataagccggagccaaagcctgaagcgcaagccgcacaggaagaggatgcgctggccagctcaccgctgttcgatccggaaccgactgaaccacaggatgcgccgcgcgcggaagaagagcccgcgcgtcccgattacgctggcttcaccatgccaacgccgcaggccgtggcgcgcagcaacgcgcaggcgcctaaaggccgcctgcgtatcgacccggttaaaaacgctgcttcgcctgctgcctccgcgcagaccggcgagcggggcgaggtgcttcagggcgaactgctggaggcgctgctggagggcatgggcctgagcgaaatgcagccggtaccgcaattcgaccgggaaaatatgcgtcagctggggcagatcctgggcatgttctcgcaggggaccgtggcgctgctctcctcgcgctccatcctcaagcgtggggtgaaagccgatatgaccatggtgctcgacgatgcgaacaacccgttcaaactgttgccgaccgggaaaacggtgctgatccagatgttcggcacgccgatgccgggctttatgccgccgaccaaatcggtgcgtgatgcgctaatcgatctccaggcgcaccagctggggatgatctccggtatccgcgccattatcgccgccatgctgcaatcctttaatccggaacagctggaagagcaggcgaagcagaacgggatgacgtcacgcctggcgctgccgggcagccgtaaagccgcgctgtgggattatttcgttcgcagctatggcgagacggcgggcgagatcgaggacgacttccataccctgtttggcgaagccttcctccatgcctatgacatggaggtcaatcagtacaaagactcacaaagcggatcggaagaaaaatga

SEQ ID NO: 2019 - DNA, 453 bp, Enterobacter cloacae
cttccgcaagccgaacgcgtggctgttccaggcccagcagtacccggcgtcaccgaaaccgggcagcatcgacgtgtacgactggccggggcgctttgtggagtcggcccatacggaaatttacgccagcttccctcgggagctctggcaattggagcatcagcagattcaggcatcaacatggcgcaggggcgttacgccatcttcctcaattccggcgatgtgttccatgaaaatgtggcgctgtttgcccgtcagctggcgcgccagaaagaagatgccatgtttatcggtgatgcgctgcttgatttcggcgaggggaaaaaagtgctgcgcggtgcgaaaccaggctggtatatctaccacagcctcccggccagccatcaggctattttcttcccaaggcgcggtctgaagttttcaatgcgccggtgccgatcaattgtattttag

SEQ ID NO: 2020 - DNA, 1164 bp, Enterobacter cloacae
actgggggtttcagcggcagtaacagtaaacctaacgcaaaaagttttaccgttactacatatttcttttacttctttccaacatctgccgttccacgctttcacccggcacgcctcatttgtctctgcgacggtgtttgtctgccgcttgacttattttgtgataaaggtacttttcaggacatgaagaagatcctgattatcgtacctgacggtggcatgttgtttgaggctgccggtatcgccgacattctgatgcaggccaaccggctgcacccggacggcctggcgcagccccgctactgcatcattatcgccaccacccagcctcacctggtgatccacggccagtccggcttaaacctgctggcggactatcgcctgccggagctggatccgcgcgagccgctggatacgatcatcattaccggtcgtggcatgaatgaacaggaaagcaccgcggtggtggactggctgcacctggccgcgccgcatgcgcgccgcgtcgcctctgtctgcggcggggccctgctgctggcacaggccggactgctcgatgggcgccgggcgacgacccactggcggctgctggaaaccctgaaaacccgctatcctgcggtcaacgttgagggcggcccgctctatattcaggatggccccgtctggacgtccggcggcgtcagttccgggtttgatctgacgctggcgctggtggaggatgattacggcttcaccctcgcccgcaacgtggcgcaggatatggtgatgtacctgcgtcggcctggcggccagctacagttcagccgctataaactggagcagtccggcgcgaccggaccggttagcgaactgcaaagctggatcctgcaaaacctcaccgcagatttgtgcgtcgaaaggctggccgaacgggtcgccatgagtccgcgcaatttcacccgcgtgttcacgcgtgacgtcggtgtacctccggcccgttatgtcaccgaagcgcgcctggccgccgcacgacagcttctggagcagacctcgtatccgcttgaggtcattgccgaaaaaagcgggtttgggaccagcatcaacctgcgccgcgtttttgaaaagcagcttcatctcacgccgggcgaatatcgccagcgcttccactgccgcagaatggcgtaa

SEQ ID NO: 2021 - DNA, 1089 bp, Enterobacter cloacae
tctgatccttttttgtcatttacgccatccgacctgacgcctaaagtcactccagacaacacagataaggagtgcatcatggttaaggtcggtattaacggtttcggccgtatcggacgtaatgttcttcgcgcggcgctgggcaacccggatctccagattgtggccattaacgatctgacggacagtagaaccctcgcccatctgctgaaatatgactctctgctcggcacgctgccggtgcccgttgaagcggcggacggcgcgctacaggttgacgggcaacgcatcaccgtattcagtgaacgcgacccggcaaacattgcgtggaaagacgctggcgttgaggtggtaatcgaagccaccggcttcttcaccgaacgtgaaaaagcagcggtgcatatcacgagcggcggcgcaaaacgcgtcattatttccgccccggctaaaaatgatgatctgacggtggtaatgggcgtgaaccacacgctgtacgatccggcccagcattttgtggtcagcaacgggagttgcaccactaatggtctggcgccagcggcgcaggtgctgcaccagcagtttggcattgaacacgggctgatgaacaccacgcatgcctacaccaacagccaggcgctgcatgaccagccggaaaaagatctgcgcggcgcgcgcgcggcagcattatccattgtgccttactccagcggagcggcaaaagcgctcgggaaagtgatccccgaacttgacggtaaactcaccggatattccctgcgcgtaccggttccggtggtgtcgattgtcgatctgacggtgacgctgagccgcaacgtgaccgccgaagaggtgaatgacgcgttccgtcaggccgccatcagcgggccgctgaaaggcatcctgggctacagcgatgaaccgctggtctcccgtgattatcagggcgacccgcgctcatccatcatcgacgggctttcaacgctggtgattggcgggaatatggtgaagatcctgtcgtggtatgacaacgaatggggcttctcgaaccgtctggtggatctggcggtgcttatggataaaaaagggttgtag

SEQ ID NO: 2022 - DNA, 1725 bp, Enterobacter cloacae
caacagcggtcacgctgctcagtgaagacaggagacgaaccgatgataagacctcgcgcacgacgccccgcttttttaccccttgcgttggcaggcgcactactcggtgttaccgcatttggttatgctgaagaccagccaacgagccagcaaagctcacctgatattcttcttggccccctctttaatgacgtacagagcgccaaactgttcccggatcagaaaaccttcgcggatgccgttcccaaaagcgacccgctaatgatcctggcggattaccggatgcagcatacccagtccggttttgacctgcgccactttgtggagatgaactttatcctgccgaaggagggtgagaagtatgttccccctgagggccagagcctgcgcgaacacatagacgatctgtggcctgttctgacccgcaccaccgacaaagcgaacaaatgggactccctcctgcctctgccaaaaccctatgtcgtgccgggaggacgcttccgcgaagtctattactgggacagctatttcaccatgctggggctggccgagagcggccactgggataagatcggcgacatggtggacaacttcgcttacgagcttgatacctggggccatatccctaacggtaaccgcacctactacctgagccgctctcagccgccgttcttctcgctgatggtggaattgctggccacgcatgacagcgacgcgttaaagaaataccgtccgcagatggaaaaagagtatgcctactggatggagggggctgatgggctccagcctggtcaggcgaacaaacgcgtggtgaagctggatgacggctcgatcctcaaccgctactgggacgatcgggacacgccgcgccctgagtcgtggctggatgacgtcaccaccgccaaaaataaccctaaccgtccggccaccgagatctatcgcgatctgcgctctgccgcggcctcgggctgggatttcagctcccgctggatggacgatcctcagaagctaggtaccatccgcaccaccagcatcgtgccggtggatctgaatgcgctgatgtttaagatggaaaaactgctggcccgtgccagccaggaagacggggataccgccagcgcaagtaaatatgacgcgctggcctccgcacgtcagaaagccatggagagccacctgtggaacgataaagagggctggtatgcggattacgatctgaaaaccaggaaggtgcgtaatcagctgactgccgcggccctcttcccgctgtatgtgaaggccgcatcacaggatcgcgccgataaagtggccgcagccgcatcgtcgcgcctgctgaaaccgggcggtatttctaccaccaccatcaacagcgggcagcagtgggatgcgccgaacggctgggcgccgttgcagtgggtagcggtggaagggttgcagaactatggtcagcagaaagtggcgatggacgtgacctggcgtttcctgaaaaacgttcagcatacctacgatcgcgagaagaaactggttgagaagtacgatgtctcttcgaccggtaccggcggtggcggcggtgagtatccgttgcaggacggtttcggctggagtaacggcgtgacgctcaggatgctggacatggtctgcccgaaagagaagccatgcgacaccgtaccggagaatcagcctgcggcaaacgatgatgttgcacctgcgaaacaggcggcgcagtag

SEQ ID NO: 2023 - DNA, 1725 bp, Enterobacter cloacae
acgagatcttgcgttatgcccggggcgtttccaacggaggtgcgcgggagcacctcttacatgagcgagtacaaaatccgcgggttcaacgtcgatcaggagttttacaacggcctgcaacttccctataacgtcaccgggaacaccaaagcgcgaatcgatccgctgctgattgagagcgtcgatatcctgaaggggccgtcatccgtgctgtatggcggcggctcaccgggcgggctggtcaatattcagagtaaaaagccgcagaaagaggcgaaaacggaactgggctttaataccggaaaccgcaatctgaaggagggatacctggactccacggggcagatcgcgaacagcgactggaactatcgcctgctgggcaaagcgacggaaagtgacgaacaggcgcacaccacgcgctatgaaaactatctggtggccccctccgtgacctggcagcctgatgacaaaacgcgcctgaccattgacgcgctggcgcaaaatacgccgagcctgacgccgtctgatccgatgccgctaagctatctgcggtctaaatacgccgatcgtcgtgactatgccggggatgagtggagcggctttaagcagcgccagtggatgctgggatacagctttgagcatgagtttgacagtggctggggctttaaccagaaagcgcgctactttgacgtggacacccaccagcgcagcgcctattccaccgggacgggcagcgaggtctaccagcttaaccgcttcgcctataccacggatgaagatttgcagagcttcaatattgataaccaggtcacccgaaccgtcgcgctgggggactggaaacatcatctgctggcgggctttgactaccagaagctgaactctcacttccattatcgttacgcctcatccaccccgggtatcgatatgcgtcatccggatcactcgcagatcgataacgatgcgctggggcttgaaaccgcgcagaaaaaccgactcagctatcagcagaatggctattacctccaggatcagattgcgtttggcgggctgaacgtgctggccagcctgcgctatgacgactaccgttccgtcaccactaactatctgcaaaacggtgacaaagcctgggtatcgcaggatcgcctcaccaaacgactgggcgcgctttatgccttcgacaatggactctcgccgtttatcagctattcagaagggttcgccccagtatcgccgcagggcacgctgaccgcgaaagacgttaagcccaccaccagcaagcaggtggaggggggggtgaaatacctgctggcggaatacgcaaccaccttcaccgcctcggtgtttaacattcgtcagaaaaatgtggtgaccagcgatccgggcttcctcaactatcgccagaccggggaagtggaatcgaaaggcgcggagctttccgctatgagtcgtccaacggataacctgacgctgattgccaactatgcctacacccacgccatcaataccgaagatgacaagtaccagggcaaaggaccgacgcaggtccctgagaacgcctttaatctgtggggcgattacaccttcgacagcacgccgctgaaaaggggtaacgctggggggaggcgcacgctacaccgggccgatggagatctcgccagccaacgacgcaggcaagctgggcggtacgacgcagtacgatctggcggcatcttaccgcatgggtga

SEQ ID NO: 2024 - DNA, 3666 bp, Enterobacter cloacae
caatacccaggccgagctgaacggattgccgcaaggaaactaaggatgctgactactctactttctatactgaccaatcgcattctgtggagcttcctgggcgtaacggcgctcgcggcggtcatctggatgattggcccgctgttgtccatcgtagatacccgcccgcttgaatcagagcagaaccgcgtcatcagcattgcggtggtctacctgatttgggcccagagccatattctgccacggctgtataacgcctggctgaaccgtaagctgatggacaagctcaacgaaaataccaccagcccggaggcggccgatccgcagaaacgtctgaacagcgaggagcagatccttgccgggcgtttcgatgaagccgcccagatgctgaaaaaagcccacttcagcaaagcgggacatggcgcacagtggacgcagcgcttcagcacgcaatacctctatcagctgccgtggtacgtcattattggcgcgccggggtccggtaaaaccaccgcgctggccaactccgggctgcaattcccgctggcggatcgcttcggtaaaaccgcgctgcgcggcattggcggcacgcgcaactgtgactggtggtttaccaacgaggcggttctgctggataccgcggggcgctataccactcaggagagtgagcaggttcaggacgccggggagtggctggaatttatcaacctgctgcgtaaataccgccgtcgccagcccatcaacggcgtgattattactatcagtatttccgacctgctttcgcagtccgctgaggcctcccgacagcaggcggtcaacctgcgccagcgtctctccgagctgcatgaacagctgggtattcgcttcccggtttatgtgatggtgaccaaagcggacctgcttaaaggcttccgcgcctggtttgcggattacgacaaagcccagcgcgaccagatctggggctttacgctgccgtgggagcagaccaaacacgccgattacgatcttatgggcaacttccatcaggaattttccctgctgcaacagcgtctggatgcgggccttccggaaaccatgctcaaagagcatgacgccaaaacccgtgcggaagcctatctcttcccgcaggagttcgccgcgctgcgtccgctgctggcagactacctgagcacggtctttgcccgctcaaacttcgaaaccgaattttcgccgcgcggcatctacttcgccagcggcacccaggaagggatgccgtttgaccgcgtgatgggcgagctgaaccgcgcgctctccttacctgaaggggaggaaagcacgcgctgggattcggtgagcaaagaggcgccgataccgggcgcgaagggtcaaagcttcttcattaagaacctgctgcaaaacgtgattttccaggaagcgggtatcgccggggaaaaccgctggtgggagcttcgcaaccgcgccgtgatgtggtccggctacgcggcgctgctggctctgctggtgatcctgggtggcctgtggctgaccagctacgctaaaaataaagcctatctggaagaagtggacgcaaaagtgccgatgctggagcagcagagcaaggcgctgcaaaaccagccccagcgcgatctgtttgcgcttctgccgctgcttaacagcctggtggatctgccgaaaagcgatgccttcgacgttaacgacccgccggtttcccgccgcatggggctttatcgcggggatgacgtcagcgatgcctcgcagtctctgtatcagaaggcgctggatcagatgctgctgcctgccgtggcgatgcacattaccacctggctgcgcaacgacaacggcagcgacgtggaatacagctatgaggcgctgaaagcctatcagatgctctaccagccgaagcactatgacggcaaattcctgcactcgtgggtgatgctcaacctgcaacgcaacctgccgcagaacgtgacgcaggcgcagcttcaggagctggaatggcacctgacccagctgctggagccaaaaattcaggcttcaccgtatgcgcaggatgaggatctggtggcccgtgaaagggcgctcatcaaccagcagccgctctcaacacgcgtatatggccgcctgaaacgtctgctggagcatgatgagaacctgaagccggtttcgctttcagatctcggcggcccgcagagcgagctggtgttttcccgtaagagcggcaagccggtgagtgagggcgtgccggggctctatacgccggacgggtactggaagagttttaacgaccagatcgacagcgtgaccaccgccctgcacgaggacgatgcctgggtgctgggagcagccaccgcccaggaagataaacagcagatcgataacgccgtgcgccagctctacatgcgcgactttatcgtcaactgggatcgctttctcgctgacattcagctcaacaacagcgccgatctttcccagcgcatcaacaccgcgcgcctgctttcaggcaccaactcgccgctgcgccgtctggtacttaacctgggcaaggtgctgaccctgtcgcgcactgcgcctgccccggaagatgcgcagaaagcggaagaccaaagcaaccgcgccactcgtacgctggaagcgctgttcagcaacggtgacaatgccccgacgcagggcgcggttgtgacgcaggcgcctgagcaactggtgaccgaccactatgcgccgatgattgagctggcgcagccgctggagaagggcggtaagaccatcgtctttgatgattttctcaagcaggttgacgagctttatcgctacctgacagccgttcaggatgcagcaaacagcggtatgcccgcgccgggcggcgatgccatcagccgcctgcaagccagcgcgggccgtctgccgggcgggctgcaaaccatgttcagtaatatggccgtgggcgccagcagcgatacccagcgtcgcgatctggagaacgtgcgtaagcgcattaacgtggaagtgggtgggttctgccgtcaggcgattgccgggcgttacccgctggtgcgtagcgccagcaccgaagtgacgccggacgatctcgcccgcatgttcgcgccgggcaccggactgatggacacctttttccgcgacaacctgaccaacaaggtggacaccacccaggcgaactggcgctttatgccgggcattgacggtaaaacgctgccgggcagtgaagggctgctgcgtccgttccagcaggcgcagtctgtccgcgatgcctttttcgccaacggcgcgaccacgccatcctttaaggtgacggtgcgcaccgtgcggatggacaacaccattctgaacctgacgctggacgtggacggccaactgctgcgctacagccacggtccgcaggcggtgcagatcatgacctggccggggccgggcgggacgaaccaggtgcgtatgcagctcggtctggccaatggcagcaccgcaacgctggtgactaacggttcctgggcgctcaaccgctttttcgacaaggcgcgcaccagccctggcgcgggtagcctgagccgtcaggccacgttcaacgtcgacggacatcaggtcacgctggagtttgccccgaacagcatccgcaacccgttccagcttccccgtttctcatgcccataa

SEQ ID NO: 2025 - DNA, 270 bp, Enterobacter cloacae
aaaggggtaacgctggggggaggcgcacgctacaccgggccgatggagatctcgccagccaacgacgcaggcaagctgggcggtacgacgcagtacgatctggcggcatcttaccgcatgggtgaactggcgccatcgctggaggggctgacgctgaaagcgagcgcgcagaacgtcaccaacaaagagacgctcacttgctatgacgcgaccaactgctggataggccgcgaccgcactttccaggtcggggcgagttacagcttctga

SEQ ID NO: 2026 - DNA, 1269 bp, Enterobacter cloacae
cccgacagaataataaagcgagcgcttaatatgcaggaacgacaggataccggcagtgatgccgtgtttaccggagccagtgggaacaatcagctggtggcggccgccaatccgctgctcaatgcgattccgcaaatccgtcattcggtttcccacgacgatcaggtcgggctgcgccagcgcctgattgacgaaattcgccgtttcgaggtgcgatgccagcaggcgggcttaccgtatgaagtgattgtcggcgcgcgctactgcctctgcacggcgctggacgaagccgccgcgctgactccctggggaagcagcggcgtctggtcaagcaatggtctgctggtgacgtttcataacgaaacctggggcggcgagaagtttttccagctgctggcgcgtctgtcgcagaatccgcgcgaacacattctgctgctggagatgatcaactactgtctgctgctcggctttgaaggccgctaccgcgtgctggacaatggccggacccagcttgaaaccatcaaacagcgcctgtggcagatgatccgtggcgtgcgcggcagctacccgccgccgctctcgccgcacccggaagatcgccccgttctgcgcaagctctggcggccgatgatcccactctgggcgtgcgtggcgctggtcggctttatcgcctgcctgttctatatcgtgctgaactggcgtctgggtgataacaccagcccggtgctggcgaaaatttaccagtcccaactgccggaaaccacgatccagcagcctgcgcgtcagctgccggcggtgctgaacctgcgcggcttcctgaaaccagaaattgatgccggtctggtggccgttaaggatgaggcggatcgcagcgtggtgatcctgaaaggggacggactctttgcctcggcctcaacggtggtgcgcgatcgctatgagccggtcatcgaccgcatcgcccaggcgatgaataacgtcagcggcaaaattctggtggtggggtacagcgacaacgtgccgatccgcagcgcacgcttcgcctccaactatgaactctcgcttgagcgcgcccgttcggtgcaaaaacagctccagggtagcctctcgcagcctgagcgcgtcaaagccgaagggcggggcgagatcaacccggtagcgcctaacaccacgcctgaaaatcgcgcccgtaaccgccgcgtggagattacgctgctggtgtcgcctgacaatacccaggccgagctgaacggattgccgcaaggaaactaa

SEQ ID NO: 2027 - DNA, 1032 bp, Enterobacter cloacae
tccaggcggaagaagagcgtgtggtggataaccgcatgcatgaccgctattgtgaacttcgcgccgctgcgggccatccctgtgaagggggtaaaccgctggtcatcaacggtgcgtaccatgagatcctttttgaaaaggacgctatgcgctcagtcgcgctcaacgccattgttgaatttttcaacaggcataactgattattgttttccaccagaggttgaaatccctatgtaccaggttgttgcatctgatttagatggcacgctgctttcccccgaccacaccctgtcgccttatgcgaaagagaccctaaaactcctgactgcccgtggcgtgaacttcgtgttcgccactggccgccaccacgtggacgtggggcagatccgcgataacctggagatcaagtcgtacatgatcacctccaacggtgcgcgcgtacatgacacggacggcaacctgatttttacccataatctcgatcgtgacatcgccaccgatttgttcggcattgtgcataacaacccggatatcgtgactaacgtttaccgcgacgacgagtggtttatgaaccgccatcgcccggaagagatgcgcttcttcaaggaagccgtattccagtactcactgtacgagccgggtctgctggagccggaagggatcagtaaggtgttcttcacctgtgtaaatcatgaggagttactgccgctggagcaggcgatcaacgcccgctggggcgaccgcgtgaacgtgagcttctccacgctgacctgtctggaagtgatggcgggcggggtgtccaaaggtcacgcgctggaagcggtcgcgaagcgtctgggctttgatctgaaagactgtatcgcctttggcgatggcatgaacgatgccgagatgctctccatggcgggtaaaggctgcatcatgcagaacgcgcaccagcgcctgaaagatctgcacccggagctggaagtgattggcacgaacgcagacaacgcggtacctaagtatctgcgcaaactgttccttgaataa

SEQ ID NO: 2028 - DNA, 660 bp, Enterobacter cloacae
cggcgggtgtcgtcgcgctgcatcgtggttacaagttctgagtggaggtttcctgtgcccattaaacccttagtcaccgcaggcatcgagaacgtactgaatgcctttctgtatcgcgctccggcgctgaaaaccgcacgtcagcggcttaacggaaaggtgctgcgcatcgtgttaaaggagttctcgacgccgcttgtgctggtcttcagcgaacgccagcttgacgttctgggggagtgggaaggcgaagctgattgctcggtaattacgcacatgagcgtcttaccaaaactgcgtgaccgtcagcagatgacggcgcttattcgcagcggtgagctggaggtcgaaggcgatattcaggtggtacagaacttcgttgcactcagcgatcaggctgaattcgacccggcggaactgctggcgccctatatcggcgacatcgcggctgaagggataagcaaaacgctgcgcacggggtccgctttcctgcgtaaaggtctgctccgtcaacagcgctatgctgccgaggtgctgaccgaagagtggcgtatggcgccggggcctttagaagtcgcctggtttgcagaagagaccgcggcagttgagcgcgcagttgatgcgttaaccaaacggctggaaaaactggagggcaaatga

SEQ ID NO: 2029 - DNA, 282 bp, Enterobacter cloacae
ttaatcatctatcactggggaacacgcatgggtggtatcagtatctggcagttagtgatcattgccgtcatcgttgtgctgctgtttggcacgaaaaaactcggatcgattggttccgacctgggcgcgtcaatcaaaggcttcaagaaagccatgagcgatgatgagaataagcaggaaaaaaccagtcaggatgctgattttaccgctaaatccatcgccgataagcaggacgaagccaaaaaggaagaggctaaacgtcacgataaagagcaggtgtaa

SEQ ID NO: 2030 - DNA, 546 bp, Enterobacter cloacae
ttcgtgttcgacattggttttggtgagttactgctggtctttgtgattggtctgattgtgttggggccgcagcgtttacccgttgcggtgaaaaccgtcgtgggctgggtgcgggcacttcgctcgctggcaactaccgtgcagaacgagctggcacaggagctgaagcttcaggaatttcaggacagcctgaaaaaggttgaaaaggcgagcatggataacctgacgccggagctgaaagcatcaatggatgagttacgcgaagcggctgaatccatgaagcgctcatacagcattaacgatcctgagaaggcgagcgatgaagcaaacaccatccataatccggtggtgaagggcagcgaagagcagcgcgagggtgtgacgccttccagcgcggagcatcaggccgcttcgccagagcaatcgccgcaggagcccgaagtgaaaaagcaggtgccgccggaagagcccgtggtcaaaacggctgaggtaaaacccgccgcgcctgtttccgaatcatccccctcgtcgagtgataaagcgtaa

SEQ ID NO: 2031 - DNA, 520 bp, Enterobacter cloacae
aaactctatcttgcaaggctgacctggactatccttgtcagcgttgggcacgcgtgtgccggtgtgcgctttttgggtgaaaggagtaataaaatggcgacaggaaagtcctgctctcgctggtttgcgcctattgcggcgttattgatggttgttagcctgagtgggtgtttcgataaagaaggcgatcagcgcaaagcgtttatcgattttctacagaatacagtgatgcgtagcggcgagcgtttaccaacgctgactgcggatcagaaaaaacagtttggtccattcgtgtcggattacgccattctgtatggctattcacagcaggtaagccaggcgatggattccggtattcgcccggtagtggatagcgtgaatgccatccgtgttccacaggattatatgacccagcgcgaaccgctacgccagtcaaatggcgcgcttggggtactgagccagcagctgcaaaatgcccaaatggaggctgatgccttccgtcccgcgttgaagcagggcc

SEQ ID NO: 2032 - DNA, 912 bp, Enterobacter cloacae
gagacaagcattgtggcgctactcattatcaccactatcctgtgggccttctcctttagtctgattggcgaataccttgccggatcggtcgacagctacttttcggtgctgatgcgcgtggggctggcggcactggtgttcctgccgttcctgcgtacccgcgggcaatcgctaaaaactattctgctgtacatgctggtaggcgcgatgcagcttggcatcatgtacctgttcagcttccgggcttacgtctacctctccgtctcggaatttctgctctttaccgtgctgacgccgctctacatcacgctgatttatgacttgctcagcaggcgccgcctgcgctggggatacctgctgagcgctgcgctggcagtcattggcgctgcgattattcgctatgacaaggtaagcgatcacttctggaccgggctgatgttcgtccagctcgctaatatcagctttgccatcgggatggtgggttacaaacgcctgatggagacccgcccgatgccgcagcataacgcgtttgcgtggttttatatgggcgcggcgattgtcgcgattgcggcatggtttatgctcggcaacccgcaaaagctgccgaccacccccgtacagtggagcgttctggtctggctgggcgtggtggcctcggggctgggctattttatgtggaactacggcgcgacgcaggtagacgccggaacgctggggatcatgaacaatgtacacgtgccggcggggctactggtgaacctcgccatctggcaggaacagccgcactggccgagtttccttattgggggaacggtgatcctggcttcgctgtgggtacatcgccgctgggtcgctccgcgctccgcacaaacggaagatggtcgcacgcgtggttccgcgctgagcgaataa

SEQ ID NO: 2033 - DNA, 2289 bp, Enterobacter cloacae
ataacgaatttctacaaggggtatgccatgacaatccgcactcacactctcggtttccctcgcgttggtctgcgtcgcgagctgaaaaaagcgcaagaaagctactgggcgggtaacgccacccgcgaagaactgctggcggtgggacgcgagctgcgcgcgcgtcactgggatcagcaaaaacaggcgggcgtagacctgctgccggtgggcgatttcgcctggtacgaccatgttctgaccaccagcctgctgcttggcaacgtgccggctcgtcatcagaacaacgatggatcggtggatatcgataccctgttccgcatcggccgtggccgcgcgccaacgggtgagccagcggcagcggcggaaatgaccaagtggtttaacactaactatcactatatggtgccggagttcgttaagggccagcagttcaaactgacctggacccagcttctggatgaagtggacgaagcgctggcgctgggtcaccaggtgaaacccgtgctgctggggccggtcacctacctgtggctgggcaaagtgaaaggtgagcagttcgaccgcctcagcctgctgaacgatattctgccggtttataagcaggtgctgattgagctgggtaagcgcggtattcagtgggtgcaaatcgatgaaccggcgctggtgcttgagctgccgcaggcgtggctggatgccttcaaaccggcgtatgacgcgctcacgggccaggtgaagctgctgctgaccacctatttcgagggcgtaacgcctaacctcgacaccattactgcgctgccggttcagggtctgcacgttgatctcgttcacggcaaagacgatgtggcagagttgcacaagcgtctgcctgcggagtggctgctctctgccggtctggtgaatggtcgtaacgtctggcgtgccgatctcaccgagaaatatgcacaaattaaggacattgtcggtaaacgtgaattgtggatagcctcttcctgttccctgctgcacagcccgatcgacctgagcgtagagacccgactcgaccctgaggtgaaaagctggtttgcctttgccctgcaaaagtgtgaggagctggctctgctgcgcgacgcgttgaacagcggcgacacggctgcgattacccactggagcgctccgatccaggcgcgccgtcactcgacgcgcgtgcataacccggcggtggaaaaacgtctggcggccatcactgcccgggacagccagcgccagagcccgtatgaagtgcgcgccgaagcccagcgtgcgcgctttaacctgcccgcgtggccgaccacaaccatcggctccttcccgcagactaccgagatccgcggcctgcgcctggacttcaaaaagggtaatctggatgcgaatcactaccgcaccggcattgcggaacacatcaaacaggcgatcgtcgagcaggaacgtctgggtctggacgtgctggtgcacggcgaggccgagcgtaacgatatggtggaatacttcggtgaacacctggacggctttgtctttacccagaacggctgggtgcaaagctacggctcccgctgcgtgaagccgccggtggtgatcggcgacgtcagccgcccggaagcgatcaccgtggagtgggcgaagtatgcccagtctctgaccgacaaaccggtaaaaggcatgctgacggggccggtgaccattctctgctggtcgttcccgcgtgaagatgtatcccgggaaaccatcgccaaacagatcgccctggcgctgcgtgatgaagtggcggatctggaagcggcggggattggcatcattcagatcgacgaaccggcgctgcgtgaagggttgccgctgcgtcgcagcgactgggatgcttacttacagtggggcgtggaggcgttccgcctcaacgcggccgtcgcgaaggacgacacgcagatccacacccacatgtgttactgcgaatttaacgacatcatggactccattgccgcgctcgacgccgatgtgatcaccatcgagacctcgcgttcagacatggagctgctggagtcgttcgaagagttcgactacccgaacgaaatcgggccgggcgtgtatgacattcactcccctaacgtgccaagcgtggagtggattgaatcgctgctgcaaaaagcggcccagcgcatcccggcggaacgtctgtgggtaaacccggactgcggcctgaaaactcgcggctggcctgaaacccgcgcggcgctggcgaacatggtgcaggcggcgcagaatttgcgtcaggcgtag

SEQ ID NO: 2034 - DNA, 810 bp, Enterobacter cloacae
agtaccgttttacttcttctgacaaaccgacccacagaggagtcacctatgtctaagtctgatgtttttcatctcggcctcactaaaaacgatttacaaggggctacgcttgctatcgtccctggcgatccagagcgtgtggaaaagatcgccgcgctgatggataagccggttaagctggcagcgcatcgcgaattcaccacctggcgcgcagagctggacggtaaagcggtgatcgtgtgctctaccggtattggtggcccgtctacctctatcgccgttgaagagctggcgcagctgggcattcgtactttcctgcgcatcggcaccacaggcgccattcagccgcacatcaacgtgggcgacgtgctggttaccaccgcatccgtgcgtctggacggggcaagcctgcactttgcaccgatggaattcccggcagtggctgatttcgaatgcaccaccgcgctggttgaagccgcgaaatccgtgggcgccaccacccacgtgggcgtaactgcctcttccgataccttctacccgggccaggagcgttacgacaccttctctggtcgcgtggtgagccgtttcaaaggctccatggaagagtggcagtcgatgggcgtcatgaactacgaaatggaatctgcgacgctgctgaccatgtgcgcgagccagggtctgcgtgccggtatggtggcgggcgttatcgtcaaccgtacccaacaggagatcccgaacgctgaaaccatgaagcagactgaaagccatgcggtgaaaatcgtggttgaagcggcgcgccgcctgatctaa

SEQ ID NO: 2035 - DNA, 831 bp, Enterobacter cloacae
agaataaaaccaaccgcccgtcagggcggttgtcatatggggatacgtatgtttgatatcgggcttaatctgaccagcgcccagtttgcgaaagaccacgatgaggtggttgcgcgcgcctttgccgccggcgtgagcgggctgttactgacgggaacgaatctgcatgagagtgagcaggcacggcagctggcgcaacgctatcaacactgctggtccaccgcaggcgtgcatcctcatgacagcagccagtggacgcatgaaagcgctgaggcgcttcatcgtctggcggctacgccagaagtggttgccattggcgaatgcgggcttgatttcaaccgtaacttctcgacgcctgaagagcaggagaaggcatttaccgcccagcttgcgctggcagcagagctggagatgccggtgtttatgcactgtcgcgatgcgcatgaacgttttatggcgctactggaaccctggctggagaaactgccgggcgcggtgttgcactgctttacgggctcccgtcaggaagcgctggattgcctgaaccgcgggctttatttgggtatcacgggctgggtctgcgatgagcgtcgtgggctggaactgcgtgagctgttacccgttatcccggccgatcgtttgctgctggaaacggatgcgccgtatctgttgccccgggatatgcagcccaaaccgccatcacgacgtaatgaaccggcctacctggggcatattgctgagcgagtggcgcactggcggggagaagatgcgcagtggctggcagcacaaaccgatgataacgtgcgtcgtctgttcggcgtgcagttctaa

SEQ ID NO: 2036 - DNA, 1515 bp, Enterobacter cloacae
agcgcttacagagaggccatgattaactgcatgaaataccacgatctacgcgacttcctggcgctgctggaaaagcagggcgaactcaaacgcattacgcttcctgttgatccgtatctggaaatgacagaaatcgctgaccgcaccctgcgcgcgggcggcccggcgttgctgtttgaaaacccaaaaggctacaccatgccggtgctgtgcaacctgtttggcacacctcgccgcgtggcgctggggatggggcaggaagatgtcacggcgttacgtgaagtgggcaaactgctggcctttctgaaagagccggagccgccaaaagggttccgagacctgttcgacaaactgccgcagtttaagcaggtgttgaatatgcccaccaaacgcctgcgcggtgcgccgtgccagcaaaaagtgctggaaggcgatgcggtggatctgaccaaaattcccatcatgcagtgctggcctgaagatgccgcaccgctgatcacctggggcctcaccgtgacgcgtgggccgcataaagagcgtcaaaacctcggcatttaccgccagcagctgattggcaaaaacaagctcatcatgcgctggttgtcccatcgcggcggggcgctggatttccaggagtggtgcgcggcccatccgggcgaacgcttcccggtttccgtcgcgctgggtgccgatccggcaaccatcctgggcgcggtgacgcctgttcctgatacgctgtctgaatatgcctttgcaggactgctgcgcggcaccaaaaccgaagtggtgaagtgcatctccaatgacctggaagtaccggccagcgcagagattgtgctggaaggttacattgaacagggcgagctggcacccgaagggccgtacggcgaccacaccggctattacaacgaagtggataactttccggtgttcaccgtcacccacattacccagcgtgaagatgccatctatcactccacctataccggccgtccacccgacgaaccggcggtactgggcgtggcgctgaacgaagtgttcgtgccgatcctgcaaaagcagttcccggaaatcgttgatttttatctgccgccggaagggtgttcgtatcgcctggcggtggtgacgatgaagaagcagtatgccggtcacgctaagcgcgtgatgatgggcgtatggtctttcctgcgccagtttatgtataccaagtttgtgattgtctgcgatgatgacgtcaatgcccgcgactggaatgacgttatctgggccatcaccacgcgtatggatccagcgcgtgatacggtgttagtggaaaacacgccgattgattacctggattttgcctcgccggtttccggacttggctcaaaaatgggactggatgccacgaacaaatggcctggcgaaaccgaccgtgaatggggtcgcccgatcgaaaaagatcctgccgtgaccgcgcgaattgacgcgatctgggacgagctggccataatgaataacggtaaggcagaataa

SEQ ID NO: 2037 - DNA, 723 bp, Enterobacter cloacae
acttcccgacagagagagcgaatgacaaccttaagctgtaaagtgacgtcggtagatgctattaccgacaccgtatatcgcgtccgtttggttcctgaagcggcattctcattccgtgccggtcagtacctgatggtcgtgatggacgagcgtgataagcgtcctttctctatggcctcaacgccagcagagaaggaatttattgagctgcatattggtgcgtctgagcttaacctgtacgcgatggccgtgatggaccgcatcctgaaagagcgtgaaatcgtggttgatattcctcatggcgaggcctggctgcgtgaagacgaagaccgtccgctgatcctgattgccggtggcacgggcttctcctatgtccgctctattctgctgacggcgctggcgcgtaatccaaatcgcgatatcaccatctactggggcggccgtgaagagaagcacctttacgatctgtctgagctggaggcgctgagcgtaaatcatccaaacctgcgcattgagccggttgtcgagcagccggaagagggctggcgcgggcgcagcggtacggtgctgactgcggtattgcaggatcacgggacgctggccgggcacgatatctacattgccggtcgctttgaaatggcaaaaattgcccgcgacctgttctgcaacgagcgtgacgcgcgggaagatcgtctgtttggcgatgcgtttgcgtttatctga

SEQ ID NO: 2038 - DNA, 1638 bp, Enterobacter cloacae
tttcattcaggagtgcttatggctcattttgcgcagtccccctcttttattttgcatcaggtcacctgtcagtttgcgacgggcgatatcctttttggtccactgaatctttctctggatgcgtcagtgtgcgcgctggttggccgcaacggcagcggtaaaacacgccttctccggttgctggcaggagttgatgaacccgccagcggtcatattgaacgctttggtacacacgtctacgtggcgcagcagcaggatatttctgcggataccacgcttgccgaactgcttggttacgacgcgatctttgcggcgcgcacgcgcatcgacagcggtcattatgaacccgacgatctcgacacgctcgacggttattgggatctggctgaacggctgagccaggcttttatcgctgcaaaacttcccccttttgacccgagtaaacgcgcggcagagttgagcggtggcgagcgcattcgtgccttgctgtgcagcgcattcaccgcggatgctgactacctgctgctggacgaaccgaccaaccacctcgacaggcaaggccgcaagtggttctacgagcagctttccaggtatcagggcggggtgctggtggcctctcacgaccgtgagttgctagcccaggtaccgcgaatccttgaactgagcgcgttgggcttgcgcagctacggtgggaattatgctgactatcgaacccagcgtgatgctgaacagctggctgcccgcgccgcgctggagcatgctgccaccgagcgcaagcgtacccgcgcccgtatgcataaagagcatgacgacagcctgcggcgttcagccaaaacgcttcgcacggtcgacagccttaacatcgcctcgtttgaacgggtcaaatacaaaggggcggcgaaagagcgtattggttcctggaaaaaacagcatagcgttcaaaaccatgctctgaacgctgcggtcaaccaggcacgcgagcgggttgaagaggataatgcggtgatgtttaccctgccgggcagtgaaatcccggaagggaaacaggtgctggtgctggaagaactggtgcttccgcacgtgcctgtcccaccgataaactggcgaatggatggcccgatgcgcgtggcgctacgcgggccgaacggctgtggaaaatccacgctgttgaaagtgatgttgggcgaaaccgcccctgttacgggaacctgtaaggtctctgtcaggtgtgcttatctcgatcagcatctttcccggctggatctgtcgcagtcggtgatgactcaccttagcctgggcaatacgccgctcgaagagggggcgctgcgtacccgtttagcgcagcttcaactgggcgcagagaaagtgacactaccactggccgaactgagtggcggcgagcgcctgaaggccgcgctggcctgcgtattgtggcgtgaagcggcaacgcagctgttgcttctggatgagccgaccaaccacctcgatctggcctctgttcaggccattgaagcggccttagccgattaccccggcgcgctgctggtggtgtcgcacgatgaagcttttctggcagggctgaagctgacgcatgaactggtgtgggaagagacgggatggcgatgtgaaagcctgtaa

SEQ ID NO: 2039 - DNA, 228 bp, Enterobacter cloacae
gcggatgatgacacgcggacgctcctgatccaggcggaagaagagcgtgtggtggataaccgcatgcatgaccgctattgtgaacttcgcgccgctgcgggccatccctgtgaagggggtaaaccgctggtcatcaacggtgcgtaccatgagatcctttttgaaaaggacgctatgcgctcagtcgcgctcaacgccattgttgaatttttcaacaggcataactga

SEQ ID NO: 2040 - DNA, 1602 bp, Enterobacter cloacae
tctaattctctcttcagtgctaaaaggccgacatgctcggccttttctttttgcgtaacgcctcgcaggaaaaccctttcaaactggacgttcatacagcacaattctattttgtgcgggttagacgtggatgcagggggcattgtggatatttcaatcctggtttatgcggtagttgcgctggtgagcgtggggattggctggctcatttgcggctaccagcatgcgcagcagaaagccgatcagctggcagagcgcgaagagatcgtcgccgaactcagcgcgacgaaacaacagcttgcgctgagtgaccactggcgcgatgagtgtgaactgctcaataacgaactgcgcaatctgcgcgacattaacacctcgctggaggccgatctccgggaagtgaccacccgccttgagtccacccaactgcacgccgaagacaaaatccgtcagatgatcaacagcgagcagcgtcttagcgagcagtttgagaacctcgcgaaccgcatttttgagcacagcaatcgccgcgtggatgagcagaaccgtcagagcctgaacagcctgctgacgccgctgcgtgaacagctggacggctttcgccgtcaggtgcaggacagctttggtcaggaggcccgcgagcgccacacgctggcgcatgaaattcgtaatctccagcagctgaatgcgcagatggcgcaggaggcggttaacctgacgcgcgcactgaaaggtgataacaaagcgcagggaaactggggcgaagtggtcatgacgcgcgtgctggaggcctctggcctgcgcgaaggatacgaatacgaaacgcaggtcagcattgaaaacgatgcgcgctcgcggatgcagccggatgtcattgttcgtctgccacagggcaaagatgtggttatcgacgccaaaatgacgctggtggcctatgagcgctacttcaacgcggaagatgactacacccgcgaaacagcgttgcaggagcacatcgcctccgtgcgtaaccatatccgtctgctgggcagaaaagattatcaacagttgccggggctgcgatcgctggattatgtgctgatgttcattccggttgagccagccttcctgctggcgctcgacagacagcccgaactgatcaccgaagcgctgaaaaataacattatgctggtcagccccaccacgctactggtggcgttacgtaccattgccaacctgtggcgctatgagcaccaaagccgtaacgcgcagcagattgccgatcgcgccagcaagctgtacgacaaaatgcggctgtttgtggacgatatgtcctcggtggggcaaagcctggatcgcgcgcaggataactaccgccaggcgatgaaaaaactctcctccgggcgtggcaatttgctggcgcaggcggaggcgtttcgcagcctgggggtggaagttaaacgcgagattaatccggaactggtggagcaggctaccgctcaggacgaagagtttcgtctgcgtgaaggcgacggtgagcaaaatagccgcaatgaagacaacggtttagcggcgagtttatcccccgaagcgcagccggcacgtttctttcacggtggttga

SEQ ID NO: 2041 - DNA, 771 bp, Enterobacter cloacae
ttagcaggctctgagatggttgacgattcacaagacacaacgcactttggctttcagactgtcgccaaagcgcagaaagctgacatggtggcccacgtatttcattccgtggcggcgaagtacgatgtgatgaatgatttgatgtcattcggcattcatcgcttgtggaagcgcttcactattgattgcagcggcgtgcgccgtggacaaacggtgctggatttagccggaggcacaggggatctgaccgctaaattctcccgtctggttggcgaaaccggccgcgtggtgctggcggatatcaacgactccatgctgaaaatgggacgcgaaaagctgcgtaacatcggcgtggtaggcaacgttgaatatgttcaggccaacgccgaagcgctgccgttcccggataatacgttcgactgcatcaccatctctttcggtctgcgtaacgtgaccgataaagataaagcgctgcgctccatgtaccgcgtgctgaagccgggcggccgactgctggttctcgagttttctaaaccgattatcgacccgctgagcaaagcttacgatgcctattccttccacgttctgccgcgcatcggcgagctggtggcaaacgatgcagaaagttaccgttatctggccgaatccatccgaatgcacccggatcaggacacgctgaaagcgatgatgcaggatgccgagtttgaaaacgtggaatacttcaatatgacggcgggtgtcgtcgcgctgcatcgtggttacaagttctga

SEQ ID NO: 2042 - DNA, 1677 bp, Enterobacter cloacae
tgcgttaaccaaacggctggaaaaactggagggcaaatgacgcctggtgaaattcggcgcctctattttatcgttcgcacctttttgagctacgggctcgacgagcttatccccagaatgcgtatcaccctgccgcttcggctttggcgtcgcacgctcttctggatgccgaatcgccataaggatcaggagctgggcgcacgcctgcgtcttgcgttgcaggagctgggaccggtctggatcaagtttgggcagatgctctcaacacgtcgcgacctttttccaccgcagattgccgatcagctcgcactattgcaggatcgcgtcgctccgtttgacggagagagagcgaagaaacaaatcgaagaagcgatgggcaatatccccatcgagacctggtttgatgatttcgatattcagcctctggcctctgcctctattgcgcaggttcatactgcgcgcctgaaggaaaatggcaaagaggtggtcattaaagtgattcgtccggatatcctgccggttatcaaagcagacatgaagctgatttatcgcctggctcgctgggtgccgcgtctgttgccggatggccgccgtctgcgtccgctggaagtggtacgggaatacgaaaaaacgctgattgatgagcttaacctgctgcgtgaatcggcgaacgccattcagctgcgtcgaaactttgaagacagcccgatgctgtatgttcctgaagtctattctgactattgcagtcagaacatgatggtgatggaacgtatctacggtattccggtctcggacgtgacggcgctggaaaaacagggcaccaacatgaagttgctggccgaacgtggcgtgcaggtcttctttactcaggttttccgcgacagcttcttccatgctgacatgcatccgggcaacatttttgtcagctatgagcacccggaagatcctaaatacatcggcatcgactgcggtattgtcggctcgctgaataaagaggataagcgttatctcgccgagaactttatcgctttcttcaatcgcgactaccgtaaggtggccgagctgcacgtggattcaggctgggttccgccagataccaacgtggaagagtttgaatttgcgatccgcaccgtctgtgagccgatttttgaaaagccgctctcggagatctctttcggacacgtccttctcaacctgttcaacaccgcacgccgtttcaatatggaagtgcagccacaattagttttacttcagaaaacattactttacgttgagggcgtaggccgccagctctatcctcagttagacttgtggaaaaccgcgaaaccgttcctcgaatcctggattaaggatcaggtcggtattccagccctggttcgctcgcttaaagagaaaggcccgttctggattgaaaaaatgcctgaaattcctgaactggtttacgacagtttgcgtcagagcaagaaccttcagcacagcatggataaaatcgcgcacgagcttcaatccagtcgcgtgcgtcaggggcagtcccgctatctcttcggaattggcgcgacgctgctgataagcggcacgttgctgttgatcaatcgtccggactgggaaatgatgccagcctggattatggctgccggtgtggttgtctggcttgctggctggcgaaaaacgcgctga

SEQ ID NO: 2043 - DNA, 780 bp, Enterobacter cloacae
agcgtaaacatggcagtagatgatactcaaccgctgattgcgcacctcattgagctgcgtaagcgcctgttaaactgcattattgcggttttcctcatttttttatgtctggtctattttgccaacgatatctatcaggtggtttccgcaccgctgattaaacagatgccgctgggcgcgacgatgattgcaacggacgttgcttcaccgttctttacccccatcaagctgaccttctgggtatcgttgattgcctctgcgccggtcattttgtatcaggtctgggcatttgtggcgcccgcgctgtacaggcatgaacgcaagctggttattccgctgctggtgtccagttcgctgctgttttacatcggcatggcgttcgcctacttcgttgtcttcccgctggccttcggcttcctgacgcataccgcgccggaaggggtacaggtttcgacggacatcgccagctacctcagcttcgtcatggcgctgtttatggcctttggtgtcgccttcgaggtgcccgtagcgattgtcctgctctgctgggtaggggtgaccacgcctgacgatctgcgtaagaagcgcccgtacatccttgtgggggcatttgttgtaggtatgctgttaacgccaccggacgtcttctcgcaaaccttactggcgataccgatgtactgcctgtttgaagtcggcgtattcttcgctcgtttctacgtcggaaagggacgtacccgggacgaagaagacgagccgtctgaagagaccactaaagaataa

SEQ ID NO: 2044 - DNA, 318 bp, Enterobacter cloacae
tcccgatgtgtgatttatgaggagttctcaatggaattaaaagatcctgagtttgagctgctgagcagcctggaacagattatttttaaagatgtaccgccgacggttaccctgaatcaaaagtccaatccttttagtgaatttgagcgtttacgcaaaggatcgggcctgaaaacagatgaattcgcaagagcgatgggtgtcagcgtagcaatggtgctggagtgggagtcaaaacgtgaaaaacctaccccagccgagctaaagctgatgcgcctgatccaggcaaaccctgaccttcgcaagcagttagcctga

SEQ ID NO: 2045 - DNA, 546 bp, Enterobacter cloacae
cgatcccgccagggttttggtatgcttgcgccccgaacaatgggaagagtgattatgcaggcctggtatttactgtattgcaaacgcgggcaacttcagcgcgcgcaggaacatcttgaacgtcagtctgttaactgcctgacacccgtgatcacgcttgaaaaaatgcagcgtggaagacgcacgaccgtcagtgagcctctgttcccgaattacctgttcgtcgaattcgaccccgaagtgatccacaccacgacgatcagtgccacgcgcggcgtcagccattttgtgcgttttggcgcccatccggcaagagtaccgtcatcggttattcatcagctttctgtctaccagcagcctgaagatattaccgatccggaaaccccttatgccggcgacagcgtggtgatcaccgaaggcgcctttgaaggcttacaggccatcttcgctgagccggacggtgaagcgcgctccatgctgctgctcaacctgctgaacaaagaggtgttgcagagcgtgaaaaacaccgatttccgcaaagtttag

SEQ ID NO: 2046 - DNA, 861 bp, Enterobacter cloacae
cctggtgtctatatttatctttgcgctaatccattcattggtacggagaatgccatgactgaaaaaaccggttttgcacctgctgcggccccgcacgcttcaaccatcgtctcaacccctgaagaagccattaccgcaggcgagacctccattccctcccagggagagaacatgccagcgtaccacgcgcggccaaaatctgccgatggcccgctgcccatcgtgatcgtggtgcaggaaatatttggcgttcatgaacatattcgcgacctctgccgccgtctggcgctggaaggttacctggccgttgcgccggaactctatttccgtcagggcgatccgaatgattacagcgacatcccgacgctgttcagcaacctggtcagcaaagtgccggacgcgcaggtactggccgatctcgaccacgttgccagctgggcggcgcgcaacggtggcgacccgcaccgtctgatggtgaccggcttctgctggggtggacgcattagctggctgtatgccgcgcacaatccgcagttgaaagcggccgtggcctggtacggcaaactggtgggcgaaaagaccctgaactcgccgaaacatccggttgatatcgccaccgatttaaatgccccggtgctagggctgtatggcggtcaggataccggcattccgcttgataccgtcgagaccatgcgccacgcgctgcgggcggcaaacgcgaaggccgaaatcgtggtgtacccggatgcgggacacgcgtttaatgccgattatcgtccgagctatcacgcggaatccgcgaaagatggctggcagagaatgctggcgtggttcagccagtacggcgggaagaaagcgtaa

SEQ ID NO: 2047 - DNA, 444 bp, Enterobacter cloacae
ggctgtatggcggtcaggataccggcattccgcttgataccgtcgagaccatgcgccacgcgctgcgggcggcaaacgcgaaggccgaaatcgtggtgtacccggatgcgggacacgcgtttaatgccgattatcgtccgagctatcacgcggaatccgcgaaagatggctggcagagaatgctggcgtggttcagccagtacggcgggaagaaagcgtaataccaaaagcccggtggcggctacgccaaccgggcaatccagccccactacgcctgacgcaaattctgcgccgcctgcaccatgttcgccagcgccgcgcgggtttcaggccagccgcgagttttcaggccgcagtccgggtttacccacagacgttccgccgggatgcgctgggccgctttttgcagcagcgattcaatccactccacgcttggcacgttag

SEQ ID NO: 2048 - DNA, 963 bp, Enterobacter cloacae
aggactttcatgatcgagattaaacacctgaaaacgctacaagcgttgcggaactgcggttctcttgcggcggcagcggccacgctgcaccagactcagtctgccctttctcaccagttcagcgatctggaacaacgcctcggctttcgtctttttgtgcgtaagagccagcctttgcgctttacgccgcagggcgaaattttgcttcagctggcgaaccaggtgctgccgcagattgccagcgcgttgcagtcctgcaacgagccgcagcagaccaccctgcgcatcgccattgagtgtcacagctgtattcagtggctgacccccgcgcttgagaacttccgccagaagtggccgcaggtggagatggacttcaaatccggcgtcacgtttgatccgcagccgtcgcttcagcagggtgagctggatctggtgatgacctcagatattctgccacgcagcggtctgcactattcgccaatgtttgattttgaggtgcgtctggtgctggccccggaccatccgctggccgccaaaacgcgtatcacgccggaagatctggcaacggagacgctgctgatttacccggtacagcgcagtcgtctggatatctggcgccatttcctgcaacccgcgggcatcagcccacagctgaaaagcgtggataacacgctgctgttaattcagatggtggcggccagaatgggaattgcggcgctgccgcactgggtggtcgagacggttgaacgccagggtctggtggttaccaaaaccctgggtgaaggactgtggagccggctgtacgccgccgtgcgcgatggcgagcaacgtcagccaattacggaagcgtttattcgctcagcgcggaaccacgcgtgcgaccatcttccgtttgtgcggagcgcggagcgacccagcggcgatgtacccacagcgaagccaggatcaccgttcccccaataa

SEQ ID NO: 2049 - DNA, 1506 bp, Enterobacter cloacae
aaagaaccaccaggttatgtttttctggtaccacgaggaggaatgatgaatataccgggtgatgagctatacaccttgctccatgctgcgctgaaaaaacgtgggacagagacgctccagcgcgcgctctatcttgctttgcgggaggccatactgtgcggaaggcttcgttccggcagccatttgcccggttcacgaacgctggcgcatcagatctcggtgtcccgaaataccgtcaacgcggcgctggaccagctcacgctcgaaggttatttgctgcgtagccgccagggcacgcgggtggggcaattcgctcctcgtacgattgcccggacattaccggacccggacgtcaggctgacaaaacgtgtcgcccggctgcccgcgcctgtgccgcgtgacactccggtgatggcgtttacgccgggaacgcctgccatcaactatttccccttgccgctgtggcggcggttgtacgatcgcgtcctgcgcgaggagggaagcgccctgttagggtatggcgaccctgccggcgagccgtcgctacgggccgccattgcccgccatcttgcgctctcccgcggcattgactgtgacgccagccagatagtgataaccgaaggggcgctggagggcgtcaatctgtgcacaatgctgttaagcgagccgggggatgtcgcctgggtggaaaatcccggctatagcggcgccaaaagcgcttttgtcaaaaccggtctggcgatgaccggcataccggtggatgacgaggggatgtgctgggaagggctgtgtgcgccttcacccacgctgatttttacctcgccatcgcatcagttcccttacggaagcgtactcagcgcgcggcggcgtctggcgctgctggaactggcccggcagcacaacgcgtggatcattgaggacgattacgacagcgaattccgttataccggtgagcccgtcccggcgatgctgggtatggtcaacaacgcgcccgttgtgtatctggggacgttcagcaaaacgctgtttccgtcgctccgaatggggttcatggtgttaccgccagcgctggcgaaggcggcacgtcccgccatcggctcgctgctgcgcggcgggcatcgcgctgaacagcgcaccctggcgctgtttattgaggaaggccactatgcgcgacatcttgccgccatgcgccgactttatcgtaagcgataccgccaactgcgagaggtgctaagcgcagagcttcatacgccgcaccgtgttcttgccggagaaggagggatgcacctggcgctggcgattgacggtatcgacgaccagcggctggtggagcaggcaagagcgtttcagctggcacccgctgcgctgagcggatattaccttgagacgaagcaggggcaaaccggtctggttttaggttacggcaatacctctgcttcgcagtttgcgccgggtatccgacgtcttcaggcgttaattacgcagcagtggggcgggaaagggtaa

SEQ ID NO: 2050 - DNA, 666 bp, Enterobacter cloacae
attcatcaacgtatggcacgaaaaaccaaacaacaagcgctggaaacccgacaacacattctggatgtggcaatgcgtttgttctcacagcagggtgtttcggcaacctcgctggcacagattgctcaggccgcgggcgtcacgcggggagcgatttactggcatttcaaagacaagtccgatctgtttggtgaaatctgggagctttcagagtccagcattagcgatcttgagagtgagtatcgggcaaaattccctcacgatccactctctgtgttaagagaaattctagtatatatccttgaagcgacagttgttgaagagcgccgccgtctgatgatggaaatcatcttccataaatgtgagttcgttggcgaaatggcggtggttcagcaggcgcaacgcgacctgtgtctggaaagctacgatcgcatcgaacaggtcctcacggagtgcatgcaggccaaaatgcttcctgctaccttactcacccgccgggcggcgatcctgatgcgcagctatatttccggcctgatggaaaactggctttttgctccggagtcgttcgatctcagatcagaggcgcgcagctatgtcgacatttttcttgagatgtgccagctctgtccgacccttcaaagtaagcatcacccccgttctacctga

SEQ ID NO: 2051 - DNA, 618 bp, Enterobacter cloacae
acaactgttactttgaccgactcgtcgcgcgccgtgagtaacactgtttcatttaggcacaaaccgatgaccgcaactgcacagcagcttgaatatctgaaaaatagcatcaaaagtatccaggactatccaaaacctggcattcttttccgcgatgtcaccagcttgctggaagacccgaaagcgtacgccctcagcattgaactgctggttgagcgttataaaaacgccgggatcaccaaagtagtaggtactgaagcccgtggcttcctgtttggcgcaccggttgcgctggcgatgggcgtgggttttgtgccggtgcgtaagccgcgcaaactgccgcgtgaaaccattgctgagagctatgagctggaatacggcaccgatcagctggaaattcacgttgatgctatcaagccaggcgacaaagtgctggtggtggacgatctgctggcaaccggcggcaccatcgaagcgaccgtgaagctgatccgtcgtctgggcggggaagtgaccgacgcggcattcatcatcaacctgttcgatctcggcggcgagcagcgtctggaaaaacagggtattaccagctacagcctggtgccattcccgggacattaa

SEQ ID NO: 2052 - DNA, 354 bp, Enterobacter cloacae
cgtgaaagaagagagaagcctatgtttggtggaaaaggcggtctgggtggcctgatgaagcaggctcagcagatgcaggaaaaaatgcagaagatgcaggaagagatcgctcagctggaagtcacgggtgaatccggtgccggtctggtcaaggtgaccatcaacggtgcgcataactgccgtcgcgtggaaatcgacccgagcctgctcgaagacgacaaagagatgctggaagatctggttgcagccgcgtttaacgatgccgctcgccgtatcgacgaaacccagaaagagaaaatggcctctgtttccagcggtatgcaactgccgccgggctttaagatgccattctga

SEQ ID NO: 2053 - DNA, 1974 bp, Enterobacter cloacae
cattcccctccattaattcaccttccagcgttgcagagcctgcccatgagttatcaggtgttagcccgtaaatggcgaccacaaacctttgctgacgttgtcggtcaggaacatgtgctgacggccctggcgaacggcttgtcgctaggtcgcatccatcacgcctatcttttttccggcacccgcggcgtcggtaaaacctctattgcccgtctgctggcaaaaggtctgaactgcgaaaccgggatcaccgccaccccgtgcggcgtgtgcgacaactgtcgtgagatcgagcaggggcgttttgtcgatctgattgagatcgacgccgcctcgcgcaccaaagtggaagacacccgcgatctgctcgacaacgtgcagtacgccccggcgcgcggccgcttcaaggtctatctgatcgatgaagtgcacatgctgtcgcgccacagcttcaacgccctgctgaaaacgctggaagagccgcctgcgcatgtcaaattcctgctggcgaccaccgatccgcaaaagctgccggttacgatcctctcacgctgcctgcaattccatctgaaggcgctcgacgttgagcagatccgcgctcagcttgagcatattctcgatgaagagaacattgttcatgaaccgcgcgcgctgcaactgctggcccgtgcggcggacggcagcctgcgcgatgcgctaagcctgaccgaccaggcgattgccagcggtgacggtaaactctccaccgacgcggtcagcaccatgctcggcacgctggatgacgatcaggcgctgtcgcttattgaagcgatgatcgccgccaacggtgagcgggtgatgacgctcgtcaacgatgccgccgcccgtggcattgaatgggaagcgctgctggtcgagatgctcagcctgctgcaccgcgtggcgatgctgcaactgtccccgtcggccattggcgcagacatggcgaccattgagcagcggatgcgtgaacttgcgcgcaccgtgccgccggctgacgttcagctttattatcagacgctgctgatcggccgcaaagagctgccgtttgcaccggatcgccggatgggcgttgaaatgacgctgctgcgcgcactggccttccatccgcgcaagccactgccggagccggaaacgccccggcagtcctttgcgccggttgcgccgaccgcggtaatgtcaccgcagcaggtgccaccgcaaccggcatcgccgccgccgcaaaacgtgccgctgtcggatgccaccagttcggtgcttgccgcacgaagccagttgcaacgtgcacagggagcaaccaaaccaaaaaagagtgaaccggcagcgcctgcaagagcgaggccggtgaacaacgccgcgcttgaacgactggcctcggtaacggagcgcgtgcagtcgcgtccggcaccgtccgcgctcgagcaaaaagccccggcgaaagaagaggcataccgctggaaggcgactaccgttgttgaaacggtcaaggaagtggtcgccacgccaaaagcgctgaaaaaggcgctggagcatgaaaaaacgccggagctgtccgcgaagcttgcggaagagtccatcgagcgcgacgcctgggccgccgaggtcagcaaactccagctgccgaagctggttgagcaggtcgcgctgaacgcctggaaagagcaggacggtaatcaggtgcgtctgcacctgcgccctgggcagcgtcacctcaactcccctggcgcgcaaaaggcgctggccgaggcgcttaccgcattacagggtgtgccggttgaattgactatcattgaagatgataatccggcggtgaaaacgccgctcgagtggcgtcaggccatttatgaagagaagctcgcacaggcgcgcgaggcgataattgcggataacaacatccagaccctgcgccggtacttcgacgccgatctggatgaagagagtattcgccccatttga

SEQ ID NO: 2054 - DNA, 1875 bp, Enterobacter cloacae
atgaaaggacaagaaacccgtggtttccagtcagaagtaaaacagcttctgcacctgatgatccattccctgtattccaacaaagaaattttcctgcgtgagctgatttccaacgcctccgatgcggcggacaagctgcgcttccgcgcgctgtctaacccggatctgtatgaaggcgacggcgaactgcgcgtgcgcgtctcgttcaataaagagaaccgcaccctgacgattgccgataacggcatcgggatgaaccgcgacgaggtgatcgaccacctcgggaccatcgccaaatccggcaccaaagcgttccttgagtccatgggctctgaccaggcgaaagacagccagctgattggtcagttcggcgtaggcttctactcggcgttcatcgtggcggacaaagtcaccgtgcgcacccgcgccgcgggcgacagcgccgagaacggcgtgctgtgggaatccaaaggggaaggcgagtacaccgttgatgacatcaccaaagcggatcgcggcaccgaaatcaccctgcacctgcgtgaaggcgaatacgatttcctgaacgactggcgcgtacgctccatcatcagcaagtattccgaccacatcgcgctgccggttgagattgaaaaacaggaagagaaagacggcgaaaccgtggtttcctgggagaaaatcaacaaggcgcaggcgctgtggacgcgtaacaaagctgaaattaaagacgacgagtacaatgagttctacaagcacattgcccacgacttcaccgatccgctgacctggagccacaaccgtgtggaagggaagcaggagtacaccagcctgctgtacattccggcgcaggcaccatgggacatgtggaaccgcgatcacaagcacggcctgaagttgtacgtgcagcgcgtgttcattatggacgacgccgagcagttcatgccgaactacctgcgctttgtgcgtggtctgatcgattccaacgatctgccgctgaacgtctcgcgtgaaatccttcaggacagcaccgtcacccgtaacctgcgtaacgccctgaccaaacgtgcgttgcagatgctggaaaaactggcgaaggacgatgcggaaaaataccagaccttctggaaacagtttggcctggtgctgaaagaaggtccggcggaagacaccgcgaatgtggaagctatcgctaaactgctgcgcttcgcctctacgcacaacgactcctccgcccagaccgtgtcgctggaagagtacgtctcccgcatgaaagaagggcaggagaagatctactacatcaccgccgacagctatgcggcagcgaagagcagcccgcacctggagctgctgcgtaagaaaggcatcgaagtgctgctgctgtctgaccgcatcgacgaatggatgatgaactacctgaccgagttcgacggtaaggcgttccagtccgttgccaaagctgacgagtccatcgacaagctggcagatgaagtggacgaaagcgcgaaagaagccgagaaggcgctggagccgttcattgagcgcgtgaaaaccctgctgggtgaccgcgtgaaagaggtgcgcttcacgcaccgtctgaccgatacgccagccattgtcaccaccgatgcggacgaaatgagcacccagatggcgaaactgttcgctgcggcgggccaggccgtgccggaagtgaaatatatctttgagcttaatccggatcatccgctggtgaaacgcgcggcggatacccaggacgacgcccgctttgcggagtgggttgaactgctgctggatcagtccctgctggccgagcgcggtacgctggaagatcctaacctgttcattaaacgtgtgaatgcgctgctgctggcgtaa

SEQ ID NO: 2055 - DNA, 678 bp, Enterobacter cloacae
aaaattgaatcgacatttgaggggattttcgcaatgcgtattattctgcttggcgctccgggcgcgggtaagggaactcaggctcagttcatcatggagaaatacggtattccgcaaatctctactggtgacatgctgcgtgccgctgttaaatctggctccgagctgggcaaacaagctaaagacatcatggacgcaggcaagctggtgaccgacgaactggttatcgcgctggtaaaagagcgcattgctcaggaagactgccgcaatggtttcctgctggacggcttcccgcgcaccattcctcaggctgacgccatgaaagaagcgggcatcaacgtggattacgtgctggagttcgacgtaccggacgagctgatcgttgaccgtatcgttggccgtcgcgtacacgctgcttctggccgcgtttaccacattaaattcaacccacctaaggttgaaggcaaagacgacgtgaccggcgaagagctgaccacccgtaaagacgatcaggaagaaaccgtgcgtaaacgcctggtggaataccatcagatgaccgcaccgctgatcggctactacaccaaagaagcgcaggcgggtaacaccaaatacgcgaaagtggacggcaccaaagccgtggctgacgtacgtgcagagctggaaaaaattctcggctaa

SEQ ID NO: 2056 - DNA, 1410 bp, Enterobacter cloacae
acacatcgacatgatggtgtcactggtcaccacccgccgctgatcgcgttacgggccgggtttgtgctaccattcccggcccgtattctttgcacagttcagaccatgaaatttcccggtaaacgtaagtccaaacactatttccccgtcgatgcccgcgatccgctgttacagcaaattcagcaggaaagcgaaaccagcgctgcctgggtggtcggtatcgatcagacgctggtggacattgaagccaaagtggatgatgcgtttgtcgcacgttacggtctgagcgccgggcactcgctggtaattgaggatgacgttgctgaagcgctgtatcaggagctggtgcgcgaaaatcttatcacccaccagtttgccggcggcactatcggcaacaccatgcacaactactccgtactggcagacgaccgctcggtgctgcttggcgtgatgtgcagcaatatcgaaatcggtggctacgcctaccgctacctgtgcaatacctccagccgcaccgatctgaactatttacagggcgttgacgggccgattggccgctgctttacgctgataagcgattccggcgagcgtacctttgccatcagccccggccatatgaataagctgcgcgctgaaagtatcccggaagaggtgatcgcgggcgcgtctgcgctggtactgacctcctatctggtgcgctgcaagccgggcgaaccaatgccggacgcaaccatgaaggcaattgagtacgcgaagaaatacaacgtgcctgtggttctgacgctgggcaccaaattcgtcattgccgacaacccggagtggtggcaggccttcctgaaagaacacgtctcgattctggcgatgaatgaagaagaagccgaagcgctgaccggcgaaagcgatccgctgctggcgtctgataaggcgctggactgggtggacctggtgctctgcaccgccgggccggtcgggctgtacatggcgggcttcacggaagaagagagcaagcgtaaaacccagcacccgctgctgccgggcgcaatcgccgaatttaaccagtatgagttcagccgcgctatgcgtcataaagactgcatcaacccgctgcgtatcttctctcacatcgcaccgtatatgggtggccctgagaagatcatgaacactaacggcgcgggcgacggcgcgctggccgcgctgctgcacgacattaccgccaacgcctaccacaaaaccaacgtgccgaattccagcaaacataccttcgactggctgacctattcctcgctggcgcaggtgtgtaagtacgcgaaccgcgtgagttatcaggtgctgaaccagcattctccgcgcttaacgcgggggctgccggaacgggaagacagcctcgaagaggcttattgggacaggtaa

SEQ ID NO: 2057 - DNA, 3483 bp, Enterobacter cloacae
gcatcacccccgttctacctgatcgggtacgggaaaaatcgtagaccctttccgtcgtactattctgcttcagccgggcgtgatatccttcatgcccgactatttccggtcatttctcacatcacattcacaactatgctgcacatcaatcgctcgcaacatcttgttctggccctgtttttgatcctgctgttttactttgcagccgcgccgctttcctgggcccgtgcagacaacggcagtgacattcccacgcgtgctgatgttcaggcgcaactcgacaccctgaataagcagaaagatctgtccgccctggaaaaacttgttcagcaggacctgacggaaaccctggaaacgctggacaagatagagcgcatcaaagccgaaacggcccagctgaggcagaaggtcgctcaggcgccggaaaacatgcgtaaggctacggaggcgctgaatgcgctcagcgacgtcgacaacgacgatgaaacccgaaaaacgcttgccacgctgtcgttgcgccagcttgagtcgcgcgtggcgcagctgctggacgatctgcaaacggcgcagtccgatctctcaacctataacagccagctggtttcgctgcaaacccagcctgagcgcgtgcagaacgccatgtactccgcatcgcaacagctacagcagatacgtaaccgtctgaatggcgtcaccgttggggaaggggcgcttcgccccacccagcaaacgctgctgaatatccagcagacgctgctaaacgcggagattgaacagcagcgtaagagcctggaaggcaacacggtgctacaggatgcgctgcaaaaacagcgtgactacgtgaccgcgaatatcaaccggcttgagcatcaacttcagctgttgcaggaagcggtaaacagcaagcgcctgaccctgactgaaaaaacggcccaggaagcggtctcgccagacgagacggcgcgtattcaggccaacccgctggtgaagcaggagctggagattaaccaccagctgagcgaacgtctgatccaggcgactgaaaacggcagcgcgctggtacagcagaatatcaaggtcaaaaactggctggatcgcgcgttgcaggccgagcgtaacgtcaaggagcagattgccgtcctgaagggcagcctgctgctgtcgcgcattctctaccagcaacagcagacgctgccgtccgccgacgagctggaagacatgaccaatcgcattgcggatttgcgtcttgaacagtttgacgtcaaccagcagcgcgatgcgctattccagagcgataccttcgttgccaaagtggaagagggccattcaggtgaagtgaacgctgaagttcacgacgcgctgttgcaggtggtggacatgcgccgcgaactgctcgatcagctcaacaagcagctgggcaaccagttgatgatggcgattaacctgcaaatcaaccagcagcagctggtgagcgtttctaaaagcctccaggagatcctgacccagcagattttctgggtgaacagcaataaacccatggactgggactggtttaaatctttcccggaaacgctgaaatcccagataaaaagcatgaaaattaccgtgaactgggagaaagcctggcctgcggtaatgattgccttcctggcgggactgcctttgttgctcatcgctggcgtaatacgctggcgtttgaaatggctgaaacagtaccaggcgaagctggcctcggaagtggggcaactgcgtaacgacagccagctgcacaccccgaaagcgatcctgatcgatctgatccgtgctctgccggtctgcctgttgatactcgccgtgggcctgatcctgctgaccatgcagttgaatatcagcgatctgctgtgggcgttcagcaagaagctggcgctgttctggctggtgtttggcctgtgctggaaagtgctggaaaaagatggcgtcgccgtccgccacttcaacatgccggaaaaactcaccagccactggcgtcgccagattgtacgcatcagcctcgcgctgctgccgctgcacttctggtcagttgtggccgagctttcgccgctgcatctgatggatgacgtactggggcaactggtgattatgctgaacctgctgctgattgccgtccttatgtggccgatgtgccgcgacagctggcgggataaagagtcccataatcttcgtctggttaccgtaacggtgctggcgatcattccgctggcgatgatggtgctgacggcgacgggttacttctataccacgctgcgtctgtcaggccgctggatcgaaacggtttatctggtgattgtgtggaacctgctgttccagaccgtgctgcgtggtttgagcgtagcggcgcgccgcattgcgtatcgtcgtgctgttgcccgtcggcagcatcaggtgaaagagggggctgaaggggcagagccgcaggaagagccgactatcgccctggagcaggtcaaccagcaaacgatgcgtattaccatgctggtgatgatcgccctgtttgcggtgatgttctgggccatctggtctgatttaattaccgtcttcgcctacctcgacagtatcacgctctggcaatacaacggtaccgaagcgggcgctgcggtaatgaaaagcgtcaccatgggcagcctgctctttgcgctggtgtcgtcagtggttgcctgggcgttgatccgcaacctgccgggtctgctggaagtgctggtgctctcaagactgaacctgcgtcagggggcgtcgtacgccattactaccatcctgaactacgtcattattattgtcggggcgatgacggtattcggttcgctgggcgtctcgtgggataaactccagtggctggcggcagcgttgtcggtgggtctcggcttcggcttgcaggagatcttcggtaactttgtctctggcctgattatcctgttcgaacgtccggtgcgtatcggcgataccgtcaccatcggcaccttctccgggaccgtcagcaagatccgcatccgtgcgaccaccattaccgacttcgatcgtaaagaggtgatcatcccgaacaaagcctttgtgaccgagcgcctgatcaactggtcgctctcggataccaccacccgcgtggtgatccgactcggggtggcctacggttcagatctggataaagtgaaagaggtcctgctggaagcagcgaaatcacatcctaaagtgatgcacgatcctgcgcctgacgtgttcttgaccaccttcgggccaagcacgctggatcatgagctgcgcctgtacgtacgcgaactgcgcgatcgcagctacaccgtcgatgagctgaaccgcaccattgaccgtctgtgtcgtgaaaacaacattaatatcgccttcaaccagcttgaagtgcacctgcgtaacgagaaaggtgacgagcatacggaagtgaagcgcgaaattaagggggacgacccgactcccgcctga

SEQ ID NO: 2058 - DNA, 405 bp, Enterobacter cloacae
ccgttcagtttgataacgattcgcattatgcagcgtactattttaatcatcattggctggctcgcggtagtgctgggtacgctgggtgtggttttgcccttgctgccgaccaccccgtttatcctgttggccgcctggtgcttcgcccgctcgtcgccgcgttttcaccactggcttctgtaccgctcgtggttcggcggctacctgcggcactggcaaaaacaccgggctatgccgcccggggccaagccgcgcgccattgccttcatcctgatcaccttcgccgtctcgttatggctggtgaaaatgatgtgggtgcgcattctgctgctggcgatcctggttagcctgctgctctttatgtggcggatccccgtggttgatgaaaagcaacaaaagcactga

SEQ ID NO: 2059 - DNA, 618 bp, Enterobacter cloacae
gatgccattctgatgcaaaccagtccgctgctcacgcagttgatggaagcactgcgctgcctgccgggcgttggcccgaagtcggcgcagcgtatggcgtttacgctattgcagcgcgaccgcagcggcgggatgcgcctggcgcaggctctgacccgcgccatgtcagaaattggccactgtgcggattgccggacctttaccgagcaggacgtatgcaacatctgcacgaacccgcgtcgtcaggaaaacggtcagatttgcgtggtggagagtccggcggacatctacgccatcgaacaaaccgggcagttttccggccgctattttgtgctgatggggcatctctccccgctggacggcatcggcccggacgatatcggtctcgatcgtctggagcagcgcctggagtcggaaaccatcaaagaggtgatcctcgccaccaaccccacggtggaaggggaggcaaccgccaactacatcgccgaactgtgcgcgcagtacggcgttgacgccagccgcatcgcccacggcgtgccggtcggcggtgagctggagatggtcgacggcaccacgctgtcgcactcgctggccggacgtcacaagattattttctga

SEQ ID NO: 2060 - DNA, 963 bp, Enterobacter cloacae
atgagtcaggcgaaaaccggcatcctgcttgccaatctgggcaccccagaagcacctactccagcggcggtaaaacgctacctgcgacaatttttaagcgacacgcgcgtcgtggataccccaagactgctgtggtggccactgctgcgtggcgtcattctgccgattcgttccccgcgtgtggcaaagctctatcagtccgtgtggatggaagagggctcgccgctgatggtgtacagccgtcgtcaggagaaggcgctggccgcccgcctgccggacatgcccgttgcgctcggcatgagctacggtaagccgtccctggaaagcgccgttgactctctgctggcgcagggcgttgaacacattgtggtgctggctctatatccgcagtattcgtgctccacggtagctgccgtctgggacgaactggggcgcattctggcgacccgccgccgtataccgggtatcacctttatccgcgactacgccgataacgagctgtacattcaggcgcttgccagcagcgtgcgcgcgtcgtttgaaaaacacggcgagccggatctgctgctgctctcctatcacggtattccgcagcgtttcgcgaacgaaggggacgattacccccagcgttgccgcgataccacccgcgagctggtctccgccctcggcctgccgcctgagaaggtgatgatgaccttccagtcgcgcttcggccgtgaaccttggctgaccccgtatactgatgaaacgctaaaaatgctgggcgagaagggcgtgaagcacattcaggtgatgtcgccgggcttctcggcggactgtctggaaacgctggaagaaattgccgtccagaacaaagagttctttatggaggcgggcggaacgaaatacgaatacattcctgcgcttaacgactcccctgaacacatcgacatgatggtgtcactggtcaccacccgccgctga

SEQ ID NO: 2061 - DNA, 270 bp, Enterobacter cloacae
ccggcgaaagcgatccgctgctggcgtctgataaggcgctggactgggtggacctggtgctctgcaccgccgggccggtcgggctgtacatggcgggcttcacggaagaagagagcaagcgtaaaacccagcacccgctgctgccgggcgcaatcgccgaatttaaccagtatgagttcagccgcgctatgcgtcataaagactgcatcaacccgctgcgtatcttctctcacatcgcaccgtatatgggtggccctgagaagatcatga

SEQ ID NO: 2062 - DNA, 792 bp, Enterobacter cloacae
atgaggatcagcgggtcgaacagcatcccgacggagacgaagaacagcaccgcgaatgcatcccgcagcggcagggtatcgtgcgcggcgcggtggctcagctcggactcgttcagcaccatcccggcgaagaacgcgcccagcgcaaaggagacgtcaaacagctcgacggcgccaaaggcaatgcccagcgccagcgcaaggactgaaagcgtgaacagttcacgcgagcccgtggcggcgctgcgggacatgatccacggcaccagacggcggcccaccagcatcatgatggcgataaacgccacgactttaccgatggtaatgctcatatccagtgccagcgaggcgaagccgatattctctttttccatcatcccggcgacggcgggcagcagaaccagcgtcaacaccattaccagatcttcaacaatcagccagcctatcgcgatttgcccgcgctggctgtctatcagctgcctctcttcaagcgcgcgcagcagcaccacggtactggcggttgaaagacacagcccaaatacgataccggtcatgattgaccagcccagcaccgccgaaagcgccatgcccagcagcgtcgccacccctatctgggcgatcgctcccggtatggcgatcgactttaccgccatcagatccttcagggaaaaatgcagcccgacgccaaacatcagcaggatcacgcctaattccgccagctcaggcgccagtttggtatctgcgacaaaacccggcgtaaagggccctgccagcacgcccgccagcaaatag

SEQ ID NO: 2063 - DNA, 312 bp, Enterobacter cloacae
tacccggtatacggcggcgggtcgccagaatgcgccccagttcgtcccagacggcagctaccgtggagcacgaatactgcggatatagagccagcaccacaatgtgttcaacgccctgcgccagcagagagtcaacggcgctttccagggacggcttaccgtagctcatgccgagcgcaacgggcatgtccggcaggcgggcggccagcgccttctcctgacgacggctgtacaccatcagcggcgagccctcttccatccacacggactgatagagctttgccacacgcggggaacgaatcggcagaatga

SEQ ID NO: 2064 - DNA, 519 bp, Enterobacter cloacae
gcagcggactggtttgcatcagaatggcatcttaaagcccggcggcagttgcataccgctggaaacagaggccattttctctttctgggtttcgtcgatacggcgagcggcatcgttaaacgcggctgcaaccagatcttccagcatctctttgtcgtcttcgagcaggctcgggtcgatttccacgcgacggcagttatgcgcaccgttgatggtcaccttgaccagaccggcaccggattcacccgtgacttccagctgagcgatctcttcctgcatcttctgcattttttcctgcatctgctgagcctgcttcatcaggccacccagaccgccttttccaccaaacataggcttctctcttctttcacgttaaggattacaaccgtaagtcagactcacgatcaaatggggcgaatactctcttcatccagatcggcgtcgaagtaccggcgcagggtctggatgttgttatccgcaattatcgcctcgcgcgcctgtgcgagcttctcttcataa

SEQ ID NO: 2065 - DNA, 555 bp, Enterobacter cloacae
acggctactttaccactggagagcgccttgaaaacagcactgcttcttgagaggctgcaaaatcagctgatcgcgctgcgggcgcaggccacaccgctgatgggccacgccacgctgaaaccgcgctttgaccggcagctcttccgcacccgcagcaccgtcattcaggattaccttgctgaagcgcagaccaacctcgacgagcttcgccacgcggttgagagtgaacagcaggaacaggtcgcgtggcttgcggagcatcttaccgagcagatcaccgccctgcaccgggaaatcgccgcctggccgctacgggcgtgggacagcgcctcgccgggactgggaaaatggcagcgcaagcggctggagaaccaggagtttgagcgccgtctgtttgagatgaagcgtgagcgcgaagcccgcctgaacatcagcgaaacgctggaagagcagcagttattaatgcgtgaaatcagcgcgctggaaggccgcatcgtccgctgccgtcaggcgctggatgagattgaacgcgtcattgaacgcctgacccgttaa

SEQ ID NO: 2066 - DNA, 189 bp, Enterobacter cloacae
caggagccgctgatgtcactggaaaatgcccccgatgaggtcaaactggccgtcgatttaattatgctgctggagaatcatgcgatcccggctgagacggtgctgaaagcgctggagattgtgcggcgggattttgaggggaaacttccccctcaccctgccctctccccagaggggagagggaaataa

SEQ ID NO: 2067 - DNA, 1266 bp, Enterobacter cloacae
tataaacgcagcaatgggtttttagactcaggacccttgatcaatttgaaatcggacactcgaggtttacatatgaacaaaaacagagggttaacgcctctggcggtcgttctgatgctctcaggcagcttagcgcttacaggatgtgacgacaaagaggctcaacaaggagctcagcaggtgccagaagttggcgtcgtgacgctcaaatccgaacctctccagatgacaacagaactaccgggccgcaccagcgcctatcgcattgcggaagtgcgtccgcaggtaagcggtatcatcctgaaacgtaacttcaccgaaggcggtgatgtcaaggcaggtgagtctctgtatcagattgatccagcaacctaccaggcgtcttatgagagcgctaaaggcgatctggcgaaagcagaagcggcagccaaaatttcgcagctgacgttgaatcgttacaagaagctgctcggcacgcagtacatcagccaacaggattatgattcagccctggccgatgcgcagcaagccaacgcggccgttgtggcggcgaaagcggcggtagaaaccgcgcgtattaacctggcctacaccaaagtgacctcccctatcagcggtcgcattggtaaatctgccgtcaccgaaggtgcactggtgcaaaacggtcagaccaacgcactggccaccgtgcagcagcttgacccgatctatgttgacgttacccagtccagcaacgatttcctgcgtctcaaacaggagctggcaagcggtcaactgaaacaggaaaacggtaaagccaaggttgaactggttaccaacgacggtatcgagttctcgcagaccggtacactggaattttctgatgtgaccgtcgatcagaccaccggctcaatcaccatccgggccattttcccgaatccggataaaaccctgctgccgggtatgttcgtacgcgcccgtcttgaggaagggactaacccaagcgccattctggttcctcagcagggtgtgacccgtacgccacgcggcgatgcgagcgcgctggttgtgggtgccgataacaaagtcgaaatgcgcaatatcactgcaacgcaggcgattggcgataagtggctggtgacggaaggtctgaaagatggcgatcgcgtgattattactggtttgcaaaaagttcgtcctggcgcgcaggtcaaagcgcaggaagtgaaatctgacgacaaacaacaagcgtcggccgctggccagtcagaacaaaccaagtcttaa

SEQ ID NO: 2068 - DNA, 201 bp, Enterobacter cloacae
agcaaattgatgaatacctggacgacacctttatgttgttcagcagctacggcattaacgcacaggatttgcagaaatggcgtaaatcaggaaaccgcctatttcgctgcttcactaatgtcagcagagctaatccggttagtctttcctgttaaaattattacaattactaaggtgaatttatgtctgataaaccattaa

SEQ ID NO: 2069 - DNA, 573 bp, Enterobacter cloacae
aacgattccagagaggttcccatgagtgaagaaaaacagaagatgattgcaggtgaatattaccgccctggcgatgacacgctgagggctaaccgtttacgcgcgcgtcatcttgttcaccgctataaccataccgcacccgatgagaaggccgaacgtcgcgccttattagctgacctgctgggtcaaagcgaaggcgcctatatagaaccgagcttccgctgcgactacgggtataacatctatctgggcaaaaatttttatgccaactttgactgcgtcatgctggatgtctgccctgtccgcattggcgataactgtatgcttgcgccgggggtgcacatttatacggccacgcatcctctggatgcgaccgaacgtaacagcgggctggagtacggtaaaccggtcaccattggtgataacgtctggatcggcggacgtgcgatcattaacccgggcgtaaccattggcgataatgcggttatcgcttccggcgcggtagtgaccaaagacgtgccggccaatgctgtcgtgggcggcaatccggcgaaaatcattaaaatgctctaa

SEQ ID NO: 2070 - DNA, 278 bp, Enterobacter cloacae
  unsure (15)
gtttacactattttncgctcttggcaattataggttttgtcctcgcatcggcattttcagtcatcctggtctacgcgcaggagctgctgccgggacgtatcggtatggtttccggcctctttttcggttttgcctttggcatgggcggccttggcgcagccgttttagggatggttgccgaccacaccagcatcttcctggtctataaaatctgcgctttcctgccacttctggggatgttgaccatattcctgcctgacaaccgtcataaagcgtaa

SEQ ID NO: 2071 - DNA, 3114 bp, Enterobacter cloacae
gacatgcctaatttctttatcgatcgccccatatttgcgtgggtgatcgccattatcatcatgctggccgggggacttgcgatcctgaagctgcctgttgcgcaatatccaacgattgcgccaccggcagtaacgatctccgcaacctacccgggcgctgatgcgaaaacggtgcaggataccgttacgcaggttatcgaacagaacatgaacggtatcgataacctgatgtacatgtcctcaaacagtgactcaaccggtacggttcagatcaccctgacctttgaatccggtacggatgcggacattgcgcaggttcaggtgcagaacaaattgcagctggcgatgcctctgctgccgcaggaagtacaacagcagggcgtgagcgtcgagaaatcgtccagtagcttcctgatggttgtcggcgtgatcaacaccaacggcaccatgacgcaggaggatatttccgactacgtgggcgccaacatgaaggacgccatcagccgtacgtcaggtgtgggtgacgttcagctgtttggttcccagtacgccatgcgtatctggatggatccgaataaactgaacaacttccagctgacgccggttgacgtgattaacgccatcaaagcgcagaacgcccaggtggcagccggtcagttaggcggtacgccgccggtcaagggccagcagcttaacgcctcgatcatcgcgcaaacccgtctgacctccgcggatgagttcagcaaaattctgctgaaagtgaatcaggacggttcgcaggttcgcctgcgtgacgtagcgaaagtggagctgggcggcgagaactacgacgttatcgcgaagttcaacggcaagccggcatctggtctgggtatcaaactggcgaccggcgctaacgccctggacaccgcgacggctattcgtgcagagctgaagaagatggaaccgttcttcccgtcaggtctgaaaatcgtttatccgtatgacactacgccgttcgtaaaaatttcgattcacgaagtggtaaaaaccctagttgaggcgatcatcctcgtcttcctggtaatgtacctgttcctgcaaaacttccgcgcgacgctgatcccaaccatcgccgtaccggttgtattgcttgggaccttcgcggttctggcgatatttggctactcgataaacaccctgacgatgttcgggatggtgctcgccatcggcctgctggtggatgacgccatcgtggtggtcgaaaacgtcgagcgtgtgatggcggaagaaggcctgccgccgaaggaagcaacccgtaaatctatgggccagatccagggcgcgctggtcggtatcgcgatggtactgtccgcggtatttatcccgatggccttctttggcggctctaccggtgcgatttaccgtcagttctccatcaccatcgtttcggcgatggcgctgtcggtactggttgcgctgatcctgacgccagccctgtgcgcgacgatgctgaagccgattcagaaaggcggacacggcgagcataaagggttcttcggctggttcaaccgcatgtttgataagagcacgcaccactacaccgacagcgtgggtaacatcctgcgcagcaccggtcgttacctgctgctctatatcatcatcgtggtggggatggcattcctgttcgttcgtctgccaagctcgttcctgccagatgaagaccagggcgtgttcctgagtatggcgcagcttccggccggtgcgacgcaagagcgtacgcagaaagtgctggatgagatgaccgactacttcctgaccaaagagaaagacaacgtcgaatccgtgtttgcggttaacggctttggcttcgcgggtcgtggtcagaacaccggtatcgccttcgtttctctgaaagactggtctgaacgtccaggtgcagagaacaaggtagaagccattaccggccgcgcgatgggcaccttctcacagattaaagatgcgatggtcttcgcctttaacctgccagcgattgttgaactgggtacggcgaccggcttcgacttccagctgattgaccagggcggtctgggccacgaaaaactgacgcaggcgcgtaaccagctgtttggcgaggtggcaaaacaccctgacctgctggtgggcgtacgtcctaacggtctggaagatacgccgcagtacaagatcgatatcgaccaggaaaaagcgcaggcgctgggtgtttccatcagtgacattaataccacgctgggcgccgcctggggcggtagctacgttaacgacttcatcgaccgtggtcgcgtgaagaaagtgtacgtcatgtccgaagcgcagtaccgcatgctgccgaacgatatcaacaactggtacgttcgcggtagcgatggccagatggtgccgttctccgccttctcaacctcgcgctgggaatacggttcgccgcgtctggaacgctataacggtctgccatcgatggaaatcctcggtcaggcagcgccaggccgaagcaccggtgaagccatgaacctgatggaagaactggccagcaaactacctgcgggtatcggctacgactggaccggcatgtcctatcaggaacgtctgtccggtaaccaggcccctgccctgtacgccatttctctgattgtggtgttcctgtgtctggcggcattgtatgagagctggtcgattccgttctccgttatgctggtggttccgctgggggttatcggtgcactgcttgccgcgaccttccgtgggctgaccaacgacgtttacttccaggtgggcctgctgacaaccattggcttgtcggcgaagaacgcgatactcatcgtcgaattcgccaaagatctgatggagaaagaaggaaaaggcctgattgaagccacgctggaagccgttcgtatgcgtttgcgtccaatcctgatgacgtccctggcgtttatcctccggcgttatgccgctggttatcagctccggcgcgggctccggcgcacaaaacgcggtaagtacgggtgtaatgggtggtatggtcacggcgaccgttctcgccatcttcttcgtaccggtgttcttcgtggtggttcgtcgccgcttcagccgcaaaaatga

SEQ ID NO: 2072 - DNA, 1740 bp, Enterobacter cloacae
actattaatcggctttttggtatttgcaccaaaaatggatcacccatcgcaaaaggagacggaatgcaccacgccacaccgcttatcaccaccattgttggtggacttgtgctcgcttttattctcggcatgattgccaataaactgcgtatttcgcccctggtaggctatttgctggcgggcgtgctggcagggccctttacgccgggttttgtcgcagataccaaactggcgcctgagctggcggaattaggcgtgatcctgctgatgtttggcgtcgggctgcatttttccctgaaggatctgatggcggtaaagtcgatcgccataccgggagcgatcgcccagataggggtggcgacgctgctgggcatggcgctttcggcggtgctgggctggtcaatcatgaccggtatcgtatttgggctgtgtctttcaaccgccagtaccgtggtgctgctgcgcgcgcttgaagagaggcagctgatagacagccagcgcgggcaaatcgcgataggctggctgattgttgaagatctggtaatggtgttgacgctggttctgctgcccgccgtcgccgggatgatggaaaaagagaatatcggcttcgcctcgctggcactggatatgagcattaccatcggtaaagtcgtggcgtttatcgccatcatgatgctggtgggccgccgtctggtgccgtggatcatgtcccgcagcgccgccacgggctcgcgtgaactgttcacgctttcagtccttgcgctggcgctgggcattgcctttggcgccgtcgagctgtttgacgtctcctttgcgctgggcgcgttcttcgccgggatggtgctgaacgagtccgagctgagccaccgcgccgcgcacgataccctgccgctgcgggatgcattcgcggtgctgttcttcgtctccgtcgggatgctgttcgacccgctgatcctcattcagcagccgctggccgtgctgggtacgctggcaatcatcatctttggtaagtccgttgccgccttcttcctggtgcggatgttcggtcactcgccgcgcacggcgctgaccatcgccgccagcctggcgcagattggcgagttcgcctttattcttgccggtctggggatggccctgaacctgctgccacaggctgggcaaaatctggtgctggcgggggcgatcctctccatcatgttgaacccggtattgtttgccctgctggagaaatatctcgagaagaccgaaacccttgaagagctgacgctggaagaggcgacagaagaagagaaacagatcccggtggatatctgcaaccacgcgctgctggtcggttttggccgcgtcggcagcctgctgggtgaaaaactgatggctcagggcattccacttgtagtgattgaaacgtcacgcacccgcgtcgacgaacttcgcgagcgcggcatccgcgcggtgctgggcaacgcggctaacgaagagattatgaatctggcgcatctggactgcgctcgctggctgctgctcactatcccgaacggttacgaggctggcgagattgtcgccacagcccgtgaaaaatgcccgcatatcgaaatcattgcccgcgcccattatgatgacgaagtggagtacatcaccgagcgcggcgcgaatcaggtggtgatgggtgagcgtgagattgcgaatacgatgctgacaatgctgacgaaaccgccggttgaagaggcagtaacggggtaa

SEQ ID NO: 2073 - DNA, 414 bp, Enterobacter cloacae
tgttcggtgagtaaaaaatcactcagaaggggatgcgctatggacgagtactcgccaaaaaggcatgatatcgcgcagttgaaatttctctgcgaatccttgtaccatgactgccttgccaatcttgaagaaagtaaccatggctgggtgaacgatccaacgtctgctatcaatttacagcttaacgagctgatcgagcatatcgccaccttcgcacttaattataaaattaagtacaatgaagataataagttgatagagcaaattgatgaatacctggacgacacctttatgttgttcagcagctacggcattaacgcacaggatttgcagaaatggcgtaaatcaggaaaccgcctatttcgctgcttcactaatgtcagcagagctaatccggttagtctttcctgttaa

SEQ ID NO: 2074 - DNA, 228 bp, Enterobacter cloacae
ggtgaatttatgtctgataaaccattaacaaaagtcgattatttgatgcgcctgcgacgctgccagtcaattgacaccctcgaacgtgttattgaaaaaaataaatacgagctctctgataatgaactggcggtattttattcagctgccgaccatcgtctggctgaactaaccatgaataaactgtatgacaagatcccctcttcggtatggaaatttgttcgttaa

SEQ ID NO: 2075 - DNA, 477 bp, Enterobacter cloacae
aggcaaaaaatgacagagatacagcgcctgcttaccgccaccatcgacgatctcaatactcgcgaaaagcgcgacaatcgcccgcgctttagcatcagctttattcgcaaacaccccgggttgttcgtcgccatgtacgccgcctggctggcaacgcttatcgtcatgctgaagtctgaaacgctggtcgattccgtctggctgctggtagtgctgttcgtggtgtttaacgcgtttttctttttcgacgtcaatccgcgttaccggtatgaagatatcgacgtactcgatttccgcgtgtgctacaacggggagtggtacaacacgcgttacgtgccgaaggagctgatcgacagcatcctgcactcgccggctgtcgaagccgggcaaaaagagaagttgcagaaaatggtcaccaccaagggccagctctctttttatgatgtctttaccctttcccgccccactgctgcgtaa

SEQ ID NO: 2076 - DNA, 744 bp, Enterobacter cloacae
tctggagatcttcttaacatcatggaaataaagatgaatacattcaatgagtttggtcaacctgtaggggaaagccttatcgactggcagcctcggccgcacccgtcccgggtggtacttcagggtcgctattgtcggcttgagccgctgcgcatggagcatgcccacgcgttgttctctgcgtattccgtggccggagatacccgaagctggacgtggctgctgcgtgagcccgatgccaccgcagaggagtttgccgaatgggtggcgagcgtaagcgaattagccgatcccatccactttaccgttatcgataaccagacccagtctcctgtcgggacgctgtccctgatgcggatcgatcctaaaaacggcgtcgtggaagtgggacatgttcacttctcgtcactgttaagccgcacgcccatgtcgacagaagcgcagtatctgctgatgcggtacgtgttcgataccctgggctaccggcgttatgaatggaagtgcaatagcctgaacgaaccctcccgcaaagcggccctgcgtcttggctttcagtttgaagggcgttttcgccaggcgctggtcattaaaggccgaaaccgggacaccgactggttttcaattctcgacaaagagtggccagcgctggcgagcgcctttgaaagctggcttgccaccgacaattttactgccgatggcaaacagaaaagatccctggaaagctggcgagaaacgcgcgtctag

SEQ ID NO: 2077 - DNA, 798 bp, Enterobacter cloacae
cgatacgcacaggagcttcaaatggcacgttcatgggtacgccttttcgcaggggcaacgctgactctatcactcaccggccacgcgctggcggatgaaggaaaaatcacggtctttgcggcggcgtcgctgactaacgcgatgcaggatattgctgcggtatacaaaaaagagaaaaacgtcgaggtggtctcgtcgtttgcctcctcgtccacgctggcccgccagattgaagcgggggcgcccgcggatctgttcatctctgccgatcagaaatggatggattacgcggtggagaaaaaatctgttgatacggctacccgcgaaacgctgctgggaaatagcctggtggtggttgcacccgcaaacagcaagcagggcgacatcgccatcaacaaacagacggactggacccgtctgctcaacggtggtcgtctggcggtgggcgatccggagcatgttcctgccgggatttatgcgaaagaagcgctgcaaaaacttggcgcatgggaaaccttatcgccgaagctggctcccgcagaagatgtgcgtggcgcgctggcgctggtggagcgtaacgaagtgccactcgggatcgtttacggctccgatgccgtcgccagtaaaggcgtgaaggtagtgggtaccttcccggaagactcgcataagaaagtggaatatcctgttgcgatagttgatggacataaaaatgcgagcgtgacggccttcgttgactacctgaaggggccggaagcgtccgctatctttaaacgttacggatttacgactcacgaatga

SEQ ID NO: 2078 - DNA, 1008 bp, Enterobacter cloacae
tcaggagtattcatgaaacaaaccgtttataccgccagtcctgaaagtcagcagatccatgtctggcgtttgaatacagaaggttcgcttacgctggttcaggttgttgatgtgccaggccaggtgcagccgatggtcgtcagcccggataaacgttttctttatgtcggcgtacgccccgaattccgcgtactggcataccgcatctccccggatgacggcgcgctgacctataccgcagaagccccgctgccgggcagcccgacccatatttccactgaccataaaggcaactttatcttcagcggctcctacaatgcaggctccgtgagcgtcacccgcctggaagacggtattcccgttgaaaccgtcgacgtggtagaagggctcgaaggttgccactcagccaacatttcgccggataaccgcacgctgtgggtgccagcgcttaagcaggaccgcatctgcctgtttaccctgagcgatgacggccatctggtcgcgcagagcccggcggaagtcaccaccgttgaaggcgcaggcccgcgccacatggtcttccatccgaatcagcagtatgcctatgtcgttaacgagctgaacagctcggtagacgtgtgggagctgaacgatcctaacgggcagatcgagtgcgtacagacgctggacatgatgccatctgatttctctgacacacgctgggcggcagacattcacatcacgccggatggccgtcacctgtatgcctgtgaccgtacctccagtctgatcaccgtcttcagcgtctctgaagacggcagcgttctggcagttgaaggcttccagccaactgaaacccagccgcgcggctttaatgtcgaccacagcggcaagtacctgattgcggcggggcagaaatcccaccacattgcgctctatgaaatccagggcgtgcagggtctactggaagagaaaggacgctatgcggtcggacaagggccgatgtgggttgtgattaacgctcattga

SEQ ID NO: 2079 - DNA, 1257 bp, Enterobacter cloacae
atgtctatacaacccatgacaagtggaaggcacatgcagcagcttaatcccgatgatgttatatggcgaaatgcgcgactggcaaccctggcgacaggcgaggcggaaccctacggcctgagagaacaacatgccctcgttgtgcgcggccagacgattctggccattattcctgaatccgagatcccctccgggcattgtcagtgtgtcgatctcgacgggcgtctggttactcccggcctgatcgattgccacacccacctggtgttcggcggcgatcgtgcagcggaatgggagcaacggcttaacggcgtgtcatatcagaccattagcgcgcagggcggcggaattaacgccacggtcacggccacccgcaacagttcgccggaaacgctcctgacggtggcgcagcagcgactccagcggctgatgaatgaaggcgtaacgaccgttgaaataaaatcaggatacggtctgaatgccgaagccgaagagaaaatgctgctggttgcccgccagctcagcctgaataatctggtcgatatcagcccgacgttgctggccgcgcatgccgttcctgccgagtaccgacaagatccggatgcctatctggcgctggtctgtgagcagatcatgcccacgctgtggcaaaaagagttatttgaagcggtggacgtgttttgtgaaaacgtcggctttaccccggcgcaaaccgagcgcctgttccgggccgccgccgcgctcgggatcccggtaaaagggcatgtagaacaactgtcgaatcttggcggcgcggcgctggtcagccagtataaagggctgtcggccgatcatattgagtatctcgatgatgcaggtattcaggcgatggcgcaaagcggcacggtggcggtattgctccccggcgcgttctattttcttcaggagcgccagcgtccaccggtggcgcagctcagagagcagggtgtgccgatggcggtggctaccgactacaacccgggcaccagtccgtttgccagcctgcatctggcaatgaacatggcctgcgtccagtttggcctcacgccggaagaggcctgggctggcgtgacgcggcatgcggcgcaggcgctaggacgtgctgcgacgcacgggcagttaaagcccggttatgtggctgatttcgtcgtctgggaggcgaatcatccggttgagatggtttacgagccggggcggaatcctttgtatcaacgcgtgtttcgggggcaggtagcatga

SEQ ID NO: 2080 - DNA, 888 bp, Enterobacter cloacae
ttgagcgtatctgccgaagcggtaaactacaggcggcggatctggtggaatttaatccgcactacgatcgggacggtcagggggcgaagcttgccgcccgactggcctggcaaattgctcactggtgggcataaccacattcaaggagtcatgatgttttcacgctcgcccctgccgcagccgagccctcccgcgcctttttacgaaaaggtgaagcaggcgatcagcgaaaaaatcgccgccggcgtctggcgcccgcatgaccgtattccctccgaagccgaactggtcgcgcagtttggctttagtcgaatgaccattaaccgggcgctgcgggagctgaccgatgaagggttgctggtgcgcctgcaaggggtcgggacatttgtggcggagccaaaaggacagtcggcgctgtttgaaatccgcagcattgccgatgaaattgccgcccgcaaccatcagcaccactgcgaggtgctggtgcttgaagagacgcaggccagcgccgaacaggccatcgagctgaacgttaccgagggcacccggattttccattcggtgatggtgcactatgagaacgacattccggtccagattgaagatcgctgcgtcaacgcggagcggataccggactatctgaatcaggattacacccaaaccacaccgcatgcgtatctctcgctcgtcgccccgctgacggaaggggaacatatcgtggaagccgtgcgcgccacgccgcaggaatgcgagctgttgcgtattaaagagcacgatccctgcctgctgatccgccgtcgtacctggtcgtcctcgcaaattgtgtcgcatgcgaagctgctgttcccgggaaatcgctaccggttgcagggccactttatgtcataa

SEQ ID NO: 2081 - DNA, 1581 bp, Enterobacter cloacae
ttgtgccaaagagcagggcctgaacctgccgatgatccccgccacacaaggaaagcctgcatgaacgcgttaacacttactcccggctcgctgacgctcaaacagctgcgtcacgtctggcgtcagccggtgacactctcccttgatgaaagcgcccaccgtgccattaacgacagcgtggcctgcgtggaggcgattgtggcggaggggcgcaccgcctacggcatcaataccgggtttggcctgctggcgcagacccgcatcgccacgcacgatctggagaatttacagcgttcgctggtgctgtcgcacgcggcgggggttggccagccgctggacgatgagatcgtccgcctgatgatggtgttgaaaatcaacagcctggcgcgtgggttttccggcattcgtctgagcgtgatccaggcgctgatggcgctggtcaatgcggaagtttatccgtggatcccggcgaagggctccgtcggcgcctccggcgatctggcgccgctggcgcatatgtcgctgctcctgctgggtgaaggccaggcgcgctggcaaggggagtggctgcctgcgaaagaggcgctgaaaaaagccggtttaacgccgatcaccctcgcggcaaaagaggggctggcgctgctcaacggcacgcaggcgtcgaccgctttcgcgctgcgcggtctgtttgaagcggaagatctgttcgcctcggcggtggtgtgcggtgcactgaccactgaggcggtgctcggctcgcgtcgtccgttcgatgcccgcatccacgaggtgcgcggccagcgcggtcagattgatgccgctgccatgtaccgccacgtacttaccgataccagcgacattgccgaatcacaccataactgcgagaaggtgcaggatccgtattccctgcgctgccagccgcaggtgatgggcgcatgcctgactcagctgcgccaggcggcagaagtgctgctggtggaggccaatgcggtgtccgataacccgctggtgtttgcccaggaaaacgaggtggtttctggcggcaacttccacgccgagccggtggcgatggcggcagataatatcgcgctggcgattgccgaaatcggggcgctgtctgagcgtcgaatcgcgctgatgatggataagcacatgtcccagctgccaccattcctggtgcgtaacggcggcgtgaactcgggctttatgatcgcccaggtcaccgccgcggcactggcaagcgagaacaaggcgctgtcgcacccgcacagcgtggacagcctgccaacctcagccaaccaggaagatcacgtgtcgatggccccggctgccgggcgtcgtctgtgggagatggcctctaacacccgcggcgtgctggcggtggagtggctggcggcgtgtcagggtattgatttgcgcgaagggctaacatccagcccgctgctggagcaggcgcgtcatacgctgcgcgagcacgttacgcactacgatgacgaccgcttctttgcgccggatattgataaggcgatgcagcttctggaagaagggcggctggtggggttattgccttccgtgctgtga

SEQ ID NO: 2082 - DNA, 1194 bp, Enterobacter cloacae
cgccgacaccgaccagttctacaacgcggcagccatatgacctggcaggcacgtatcaggaccgcgctcgacgagcggcgggcggcggatgcgtttcgggtgcgcagggtagtggaaaacggtgcaggccgttttctcacccgggaaggagagcggttctgtaatttctccagcaacgattatctgggactgagccagcacccgcagatcgttcgcgcctggcagcagggcgcggatcgttacggcgtgggcagcggcggctccgggcacgtcagcggctacaccacggcgcatcaggcgctggaggaagagctggccgactggctgggctacccgcgggcgctgctgtttatctccggttttgccgcgaatcaggcggtgattgccgccctgatgggcaaagatgaccgcatcgtcgcggaccgcctgagccacgcgtctctgcttgaagcggccagtctcagcccggcgcagctgcggcgttttgcccataacaatgcctctcagctgaacgttctgctgggtaaaccctgttctgggcttcagctggcggtgacggaaggggtattcagcatggacggcgacagcgcgccccttgccaccttgcatgacgtcgcaaaacagcagaacgcctggctgctggtcgacgatgcacacggcattggcgtcaccggcgaggaggggcgcggaagcgcgcaccagcaacgcgtcaggccggaactgctggtggtcaccttcggcaaaggcttcggcgtcagcggcgccgcggtgttgtgcagcgagccggtggccgattacctggtgcagttcgcccgtcacctgatctacagcaccagcatgcccccggcgcaggccgtggcgctctctgcgtcgcttgcggtgatccgcggcgaagacggcgctgaacgccgggcgcgcctggccgaccatattcagcgttttcgccgggggataagcgagctgtcttaccggcttaccgactcgcacagcgccattcagcccgtaattgtgggtgaaaaccatcgggcgctgatggtggcacaggcgctacgagaacgcgggcagtgggtcacggcgatccgcccacccaccgtgccaccaggcaccgcgcgcttgcgtctgacgctcacggcagcgcatgagccgcaggatatcgatacgcttctggaggcactgtatgtctctcgtcaataa

SEQ ID NO: 2083 - DNA, 1077 bp, Enterobacter cloacae
acggatggggaaatcgtgatgctggaactcaactttacgcaaaccctgggcagtcacaccctgacgctgaacgaaacgctgcctgccagcggtatcaccgccatttttggcgtgtccggggcggggaaaacgtctctgattaatgcgattagcggcctgacgcgtccccagtctggccgtattgtgctaaataaccgcgtcttaaatgacgcggagaagaaggtctgcctgtcaccggacaaacgccgtatcggctatgtgtttcaggatgcgcgcctgtttccgcactacagcgttcgcgggaacctgcgttacggcatggcaaaaagcatggccggacagttcaataagctggtggcgctgctgggcatcgaaccgctgctggatcgtctgccgtcgtcgctgtcgggtggtgaaaaacagcgtgtggcgattggccgcgccctgttaaccgcgccggaactgctgctgctggatgagccgctggcctcgctggatattccgcgcaagcgcgagctgctgccgtatctgcaacgtctggcgcgggaaatcaatgtgccaatgctctacgtcagccattcgctggatgagattttacatatggccgacaaagtgctggtgctcgaagcgggcagggtgaaggcattcggcaatctggaggaggtgtggggcagcagcgttatgcatccatggctgccaaaggagcagcagagcagcattctgaaggtgagcgtgctggagcaccatccgcactacgcgatgaccgcgctggcgctgggcgatcagcatttgtgggtgaataaaatcgatacgccgattcagtccacgttacggatccgcattcaggcgtcggatgtctcattggtcctgcaaccgccgctgcaaaccagtatccgcaatattttgcgcgcaaaagtggcgcagtgttttgatgataacggccaggtggaagtgcagctggaagtgggcagcagaacgctgtgggcgcgcatcagcccgtgggccagggatgagctgggtatcaagcctggcctgtggctttacgcgcaaatcaagagcgtttccataaccgcctga

SEQ ID NO: 2084 - DNA, 354 bp, Enterobacter cloacae
tccgccctgcgattcaacgaactgggtcagacgccttcctttgctgttgcctttgcgggcgatatccacctgatcgtgccaggaccattcacattccagacccagcgtatgctcgacaagttttgcgaaggtattcagtttggcggtgtcttcatcggtcagggcaaatttccagattgcttcgacgtcttccgccgcctggcgcagggaggaaacctgagtaaacaccggacgctgcgcttccggcagagacagagcccagttgctggtgcggatcacatggccggtagggcgttcatacaccatggcgttatccacatacatcaggccgtgaatggcgtgctcatccagtaa

SEQ ID NO: 2085 - DNA, 1761 bp, Enterobacter cloacae
atccgaccttgtgtgtgcttgtctatacaagtatatctaaatgcatcatctgtcccttatgaggaacacacaatgtcgtcagataaataccgcaagcaggatgtccgcgccgcgcgcggcaccacgctcaccgcaaaaagctggctcaccgaagcaccgctgcgcatgttgatgaacaaccttgatcctgaggtagcagaaaatccccacgagctggtggtctacggcggcattggccgcgccgcacgcaactgggcgtgctatgacgcgattgtcgagtctttgacgaatctcgaaaacgacgaaacgctgctggtgcaatccggcaaaccggttggcgtattcaaaacccataaaaatgcgccccgcgtgctgattgccaactccaacctggtgccgcactgggcgacgtgggaacacttcaacgagctggacgcaaaagggctggccatgtacggccagatgaccgcgggtagctggatctacatcggcagccaggggattgtgcagggcacctatgaaaccttcgtggaagcgggccgtcagcactataacggctcactgaaaggccgctgggtgctcaccgccggactgggcggcatgggcggcgcgcagccgctggccgcgacgctggcgggcgcgtgctccctgaacattgagtgccagcagagccgcatcgatttccgtctgcgtacccgctatgtcgatgaacaggccgacaacctcgatgacgcgctggcgcgcatcaaaaagtacacctctgaaggcaaagccgtgtcggttgccctgtgcggcaacgcggcggatattctgccggaactggtggcgcgcggcgtgcgtccggatctggtcaccgaccagaccagcgctcacgatccgctccacggctatctgccaaaaggctggacatgggaagactaccagcaaaaagcagaaaccgatcctgagggcacggtactggcggctaaacgcgctatggcggaacatgtctccgcgatgctggccttcagtaagatgggtattccgacctttgattacgggaataacatccgccagatggcgaaagaaatgggggtgaataacgcctttgacttccccggcttcgtgcccgcctatatccgtcctctgttctgccgcggcattgggccgttccgctgggttgccctgtccggcgatccggaggatatctacaaaaccgatgccagagtgaaagagattgtcgccgatgacgaacacctgcatcgctggctggatatggcgcgcgagcgcattaacttccagggcctgccggcgcgtatctgctgggtcgggctggagtggcggcaaaaactcggcctcgcctttaacgaaatggtgcgcagcggcgaagtctccgcgccgatcgtcattggccgcgaccacctggactccggctctgtcgccagtccgaaccgtgaaaccgaagccatgcgcgacggctcggatgcggtctccgactggccgctgctgaatgccctgctgaacaccgccagcggcgcgacctgggtgtcgctgcaccacggcggcggcgtcgggatgggcttctcccagcactccgggatggtcatcgtctgtgacggaactgatgaagcggccgcgcgtatcgctcgcgtgctgcacaacgacccggcaaccggcgtgatgcgtcacgcggatgcgggttacgagattgccattgattgtgccaaagagcagggcctgaacctgccgatgatccccgccacacaaggaaagcctgcatga

SEQ ID NO: 2086 - DNA, 1080 bp, Enterobacter cloacae
accgaaccgacaattaacaaaaccctttggagaagcccgatggctcaccacgcacgctggacgatgtcgcaagtcactgaattattcaataaacctttcctggagctgatgtttgaggcgcaacaggtgcaccgccagcacttcgatccgcgtcatgttcaggtcagcacgctgctgtcgatcaaaaccggggcttgcccggaagactgcaaatattgcccgcaaagcgcgcgctataaaaccggtctcgaatccgagcgcctgatggaagtcgagcaagtgctcgactccgcgcgcaaggccaaaaacgctggctcgacccgcttctgcatgggcgcggcgtggaaaaatccgcatgaccgcgacatgccctatctggagcagatggtgaagggggtgaaggagatggggcttgaagcctgcatgaccctgggtacgctgaacgaagagcaggcgcagcgtctctcggcggcggggctggattactacaaccacaaccttgatacctcgccggagttctacggcaacatcatcaccacgcgtacctatcaggagcgtctggacacgctggataaagtgcgtgatgcggggatcaaggtctgttccggcgggatcgtgggactgggcgagacggtaaaagatcgtgccggcctgctgttacagctggcaaacctgccgaccccgccggaaagcgtgcccatcaacatgctggtgaaggtaaaaggcacgccgctggcggataacgaggacgtggatgccttcgatttcatccgcaccatcgcggtggcgcgcatcatgatgccgacctcttacgttcgcctctctgccggtcgtgagcagatgagcgagcagacccaggcgatgtgcttcatggccggggccaactccatcttctacggctgcaaactgctgaccacgccaaacccggaagaggacaaagatgtccagctgttccgcaagctggggctgaacccacaccagaccggggtacaggtgggggataacgagcaacagcagcagctggagcagcagatttttaacgccgacaccgaccagttctacaacgcggcagccatatga

SEQ ID NO: 2087 - DNA, 810 bp, Enterobacter cloacae
cgctcacggcagcgcatgagccgcaggatatcgatacgcttctggaggcactgtatgtctctcgtcaataaacaggccgttgccgccgcgtttggccgggcagcgcaaagctattcacagcacgatgagctgcaacgcctgagcgcccgcgggctgctggccgcgctcggtgacgggcgttttgcgcaggtgctcgacgcaggctgcgggccaggcggcaatagccgttactggcgcgcaacaggtagccacgtcacggcgctggatttatccgcgcagatgctggatgaagcccgccagcagcagtcagcagaccgttatctggtggccgatatcgaggccatcccgctggaggatgcgctgtttgacctcgtctggagccatctggcggtgcagtggtgcgccagcctgccgcaggccctacgcgagttataccgcgtggcgcggcccggcggagcggtggcctttaccaccctgctggaaagttcgttgccggagctgaatcaggcgtggagggcagtggatgcacagcctcatgccaaccggtttctctcgcacgaacaggtcactcaggcgctggcaggctggcgctatcgcagcgtggtccagaccgtcaccctcgaatttagcgatgcgttaagcgccatgcgatcgcttaagggcataggcgcgacgcacctgcacgccggacgggagaagaaaccccttacccgcggtcaactccagcgtctcgagctggcctggccgcaggagcggggccggttcccgctctcttatcatctttttcatgggattattgaacgtgactga

SEQ ID NO: 2088 - DNA, 717 bp, Enterobacter cloacae
acgttacggatttacgactcacgaatgatattgaccgaacctgaatggcaggccgtgctgctgagcctgaaagtctcttccctggcggttgcgctgagtttgccctttggggtgttctttgcctggttactggttcgcgtgaagtttccaggcaaagccctgctcgacagtgttcttcatcttccgctcgtcttgccgcctgtggtggtcggctatctgctgctgatctccatggggcgacgcggcgttattggcgagtggctgtacgactggttcggactgacctttgctttcagctggcgcggcgcggttctggccgcggcggtgatgtctttcccgctgatggtgcgcgctatccgcctggcgctggaaggggtggatatccggttagaacaggccgcccgcacgctgggcgcaggccgctggcgggtattcctgaccattacgcttccgcttacgttaccgggcattatcgtcggtacggtgttagccttcgcccgctcgttgggtgagtttggcgcgaccatcacctttgtgtcgaacattcccggcgagacgcggaccatcccgtcggccatgtataccctgattcagaccccgggcggcgaaggtgcggcggcccggctgtgtattatttcgattgtgctcgctctggtctcgctgctggtgtctgagtggctggcgcgcctcagccgtgaacggatggggaaatcgtga

SEQ ID NO: 2089 - DNA, 270 bp, Enterobacter cloacae
ataaaatcgatacgccgattcagtccacgttacggatccgcattcaggcgtcggatgtctcattggtcctgcaaccgccgctgcaaaccagtatccgcaatattttgcgcgcaaaagtggcgcagtgttttgatgataacggccaggtggaagtgcagctggaagtgggcagcagaacgctgtgggcgcgcatcagcccgtgggccagggatgagctgggtatcaagcctggcctgtggctttacgcgcaaatcaagagcgtttccataa

SEQ ID NO: 2090 - DNA, 999 bp, Enterobacter cloacae
gatggtttacgagccggggcggaatcctttgtatcaacgcgtgtttcgggggcaggtagcatgaaactgtggcatcccgtctccccgcaggtctggcaggggcgtgacgacagcgccgagtccagcaccgcgaaacgtctcttccagaccatacagcagcgcgaacacttttctcccgtgccgtcaggcattgccctgctgggctttgaatgtgatgaaggggttaagcgtaaccagggcaggcccggtgctgcacaggcgcccgatgtgttgcgcggcgcgctggcgaatatggcgagccatcaggggcatgcgcgcctcgtggatatgggttctgtttatgttgaaggacacgcgctggaggcggcacagcaggcgctgagcgaggccataaccgcgtgccagcaatccgggatgcgtactctggttttcggcggtggacatgaaaccgcctgggcgcacgggcgcggcgtgctggacgcctttccgaacgatcgcattgcggtgatcaacctggatgcgcacctcgatttacgcaaggctgaacgggcaacgtccggcacgccgttccgccagctggcgcactactgcgcgtctcagtctcgggtgtttcactacgcctgcctgggggtaagccgtgcggcgaatactcaggcgctgtgggaggaagctgagcggttgaacgtgacgctggttgaagatctcgattttcgccgggatgcgctatccgcgctggatagcgtgcttacgcaggcagaccgggtttatctcaccgttgacctcgatgtgctgcctgccgcagaaatgcccgccgtgtccgcccctgcggcgttggggatcccggcgctggatctgttcccggtgattgagcgtatctgccgaagcggtaaactacaggcggcggatctggtggaatttaatccgcactacgatcgggacggtcagggggcgaagcttgccgcccgactggcctggcaaattgctcactggtgggcataa

SEQ ID NO: 2091 - DNA, 837 bp, Enterobacter cloacae
gcgcgacgcacctgcacgccggacgggagaagaaaccccttacccgcggtcaactccagcgtctcgagctggcctggccgcaggagcggggccggttcccgctctcttatcatctttttcatgggattattgaacgtgactgaacgttattttgttaccggcacggacactgaagtcggtaaaacggttgccagcgccgcgctgttgcaggcggcgcgtctgctggggaaaacaactgccgggtataagcccgtagcctccggcagcgagatgacgccggaaggcttacgcaataccgatgcgctggcgctacagcgtaatagcagccttgcgctggcctattctgcggtgaacccctatacctttgctgaacccacctcgccgcacatcgtcagcgccgatgaagatcgtccgattgatttttcggtgctctcttccgggttacgcgacctggaaacgcaggccgactgggtgctggtggagggggctggcggctggtttaccccgctgtccgacgagcagacatttgctgactgggtgcaggccgagcagctttcggtcattctggtggtcggcgtgaagcttggctgtatcaatcacgccatgctgaccgctcaggccgtgcagcaggccgggttgcgtctggcagggtggattgccaatgacgtggttgcgccgggtaaacgtcatgctgagtacctggcgacgctgaagcgggggctgcctgcgccgtttctcggcgagatcccgtggcttgccgacggcgcagagcaggcggaaaccggacgctatcttgaccttagcgccttatgtcccgcgccatccagtgcgcaataa

SEQ ID NO: 2092 - DNA, 351 bp, Enterobacter cloacae
  unsure (56)
  unsure (129)
  unsure (130)
aattactcacctgccgcttattctgtcatcaggtcgtcgcccatgagtaaaccgtntaaactgaattctgctttccgtccttccggggatcagcccgaggctattcgtcgcctggaaaaagggctgganngacggctggcgcaccaaactctgctgggggttaccggttcgggcaaaaccttcaccattgccaacgtcattgccgatctccagcgtccgacgaatgtcctcgcgccgaaaaaaacgctggcggggccactgtatggtgagatgaaagagttcttccccgaaaaacccgggggaatattccgtcttccacttacgactactaccaaccccggaagcctacct

SEQ ID NO: 2093 - DNA, 828 bp, Enterobacter cloacae
gttattcctaaaaatggcctttttttaatcattatgaagttcctggcaggcgttttgcagacatcactctgtgcatcacccccacacatttttaaggagagaaagatgttgagtctgcgtgctgtaaatcagttttacggaagccaacatacgctatggaacgtgaatatcgatttcccgcaaggcatctgtacgggcattgttggcctgcctggcatgggtaaatccacgctcatgaactgcattaccggaaaggtgcccgttgagagcggcaccatcatctggcatgaggctggcgcgccgccgcgtaatttgctcagccctgcgtcagcattcacggcgccgccgacgataggctacgtcccgcaggatcggcggatattttcccagctgaccgtcgatgaaaatctgcatatcgctatgcgggcgacagggaaacctgacccgacatcaaaaagtgacgtgtatgccctgtttccggagctctatccgctgcgacagagccgtgcctcttcgctgtcccctgacgaccagtatcagctggccctcgccagtgcgctggttaatcgcccgcgcgtgttgattctggatgagcccatgcatggcgcagggcacggtttcgcgcgcaggctggggcagctgctggtgcggctgaatcgggagctgggaatgacggtgctgttagctgagcaacagctgtcgtttatccgccgggtagcggatcgtttctgcatgctctatcgcgggcgtaacgtggcacagggccacgttaacgagctggatgacgaccttattgcgcactggatggcgcgggacataaggcgctaa

SEQ ID NO: 2094 - DNA, 498 bp, Enterobacter cloacae
gtgagtaacgaggaaaatcggatgaaaatcatcagtaaagatttgcgcgacggcgaaaagctgccggaacgtcacgtgtttaacgggatgggttatcagggggataatatctctccccatctggcgtgggacgatgtgccagcgggaaccaaaagttttgttgtgacctgctacgatccggatgcgccaaccgggtcgggctggtggcactggatcgtggcaaacctgcccgccgacacgcgcgtattaccgcagggctccggttccgatctggttgctctgcctgacggtgcgattcagacgcgcactgactttggcaaagcgggctacggcggcgcggcgccgccaaaaggggaaacgcaccgctatatcttcaccgtgcacgcgctggatgttgacaagattgaggtcgacgaaggggcgagcggcgcgatggtaggctttaacgtgcatttccattcgctgggtagcgcgtcgattacggcgatgtattcgtaa

SEQ ID NO: 2095 - DNA, 1137 bp, Enterobacter cloacae
agcgaagaacttcacccgtgcgcactatttctcggcgatggatcccaatgcagcaccgtggacgctttttttattaacctgccgaaacagccagacttcgttgtcggcccggccggggcgcagggcgttacacacacctctattcaggcagccgttgatgccgcaatcaccaaacacagcgcatctcgtcagtacattgccatcctgccgggtgaatacgaaggaaccgtttatgttccggcggcaccgggaagcattacactttacggcctgggcgaaaaagcggtcgacgtaaagattggcctggcgattgattcagagatcgacagcaccacctggcgccatctggtaaacccggccggtaaatacatgccaggtaaaccggcgtggtatatgtttgataactgccagcgcaagcgtgccgccaccattggcgtgatgtgttcggcggtattctggtcacaaaacaatggcctgcaattgcaaaacctgaccattcagaacaccctgggcgacagcgttgacgcaggtaatcatcaggccgtggcgctgcgtagcgatggcgacaaggtacagattaacaacgtcaatatcctgggccgccagaacaccttcttcgtgaccaacagcggcgtgcagaatacccttcagaacaaccgtctgacgcgtactctggtcaccaacagctacattgaaggcgacgtggatatggtctctggccgcggcgcggtggtatttgataacaccgacttccgcgtggtgaattcacgtacgcagcaggaaggttacgtctttgcaccggccacgcagtctaacctgttctatggcttcctggccgtgaatagtcgctttactgctgctggcgatggcgtggcgcagcttggtcgctctctggacgtggactccgccactaacggccaggtagtgatccgcgacagcgtgattaacgaaggctttaacatggcgaaaccgtgggcggatgcggcgatctcgaaacgtcctttctccggcaacaccggcacggtggatgataaagacaacgtgcagcgtaacctgaacgacgctaacttcaaccgcatgtgggaatacaacaaccgcggtctgggtagcaaagtggttgctgagccgaagcagtaa

SEQ ID NO: 2096 - DNA, 1350 bp, Enterobacter cloacae
ttgtcggttcggtttatacttgtaaacctaaaacttttcaaaatggtttacaagtcgattatgacccaggacgatctcgccttcgacaagcagcatatctggcacccttacacctccacgacccgcccccttcccgtctatccggtagcctctgcccacggctgcgagctgcatctcgccagcggcgagcggcttgttgacgggatgtcctcctggtgggcggcgatccatggctacaaccacccgcgtctgaacgcggcgatgaaagcgcagattgaccagatgtcacacgtgatgtttggcgggatcacacatcagcccgcggtggatttatgccgtcgcctggtagcgatgacgcctgaatcgctggagtgtgttttcctggccgactccggctcggtggccgtggaagtggcgatgaaaatggcgttgcagtactggcatgcgaagggcgaaacgcgccagcggttcctcaccttccgcaacggctatcacggcgacaccttcggggcgatgtcggtgtgcgatccggacaactccatgcacagcctgtggaaaggctacctgccggaaaacctgtttgcgccagccccgcagagccgcttcgacggcgaatgggacgagatggacatggtgggcttcgcgcggctgatggcggcccatcgccacgagattgccgccgttattctcgaaccgattgtgcagggcgcgggcggaatgcggatctatcaccccgagtggctgaagcgcattcggaagatgtgcgaccgcgaaggaattttgctgattgccgatgagatcgccaccggctttggccgtaccgggaagctgtttgcctgcgagcatgcggggatcgcgccggatattctgtgcctggggaaagcgctcaccggcggcaccatgacgctctccgccacgcttaccacgcgccaggttgccgacaccatcagcgacggtgacgcgggctgctttatgcacggcccgacgtttatgggcaacccgctggcctgcgccgtggcaagcgaaagcctcgccattctggagagcggcgcgtggcagacgcaggtggcggcgattgaggcgcagctgaagcagcagttaagcgcggcggcggaggcggaatacgtcgcggacgtccgcgtactgggcgccatcggggtaatcgagacaaagcatccggtgaacatggccgcgttgcagcgcttcttcgttgaccagggcgtgtgggtgcgacctttcggtaagctgatttacctcatgccgccgtacagcatttctgcggatcagctccgcaagctgaccggggcagtggttgaagccgttaacacttcagcgcatttcgcgatttaa

SEQ ID NO: 2097 - DNA, 501 bp, Enterobacter cloacae
tataaaaaagcaggctatttcgtctatccagataagacttgcatacccaggagcattaccttgaatatttccaggatttcccgtctggcgttggcactcgcctttggcgtgactttatccgcttgcagttcaacaccaccggatcagcaaccttctgagcaggttgctccgggcaccgcttcccgtccgatcctgtcagcggctgaagcgaagaacttcacccgtgcgcactatttctcggcgatggatcccaatgcagcaccgtggacgctttttttattaacctgccgaaacagccagacttcgttgtcggcccggccggggcgcagggcgttacacacacctctattcaggcagccgttgatgccgcaatcaccaaacacagcgcatctcgtcagtacattgccatcctgccgggtgaatacgaaggaaccgtttatgttccggcggcaccgggaagcattacactttacggcctgggcgaaaaagcggtcgacgtaa

SEQ ID NO: 2098 - DNA, 903 bp, Enterobacter cloacae
attgtagtccgggattttgcagggttccgctctcggtgtaccatcccgacagaccttaaattcaacattaacccggaagaaaaaatgacctcgcgagtgattgccctggatttagacggaacactgcttacccctcagaaaaccctgctcccctcttctcttgaggccctcaaacgagcccaggaagcggggtatcaacttctcatcgtaacgggtcgacatcacgtagccattcatcctttttatcaggcactgggcttagatacacctgcaatttgttgtaatggcacctatttgtatgattatcaggcaaaaaaggttttagcctccgatccgcttcccgttacgcaggcgctgcaattgattgatttactggatgagcacgccattcacggcctgatgtatgtggataacgccatggtgtatgaacgccctaccggccatgtgatccgcaccagcaactgggctctgtctctgccggaagcgcagcgtccggtgtttactcaggtttcctccctgcgccaggcggcggaagacgtcgaagcaatctggaaatttgccctgaccgatgaagacaccgccaaactgaataccttcgcaaaacttgtcgagcatacgctgggtctggaatgtgaatggtcctggcacgatcaggtggatatcgcccgcaaaggcaacagcaaaggaaggcgtctgacccagttcgttgaatcgcagggcggatcaatgcaggacgtaattgctttcggcgataactataacgacatcagcatgctggaagcggccggaacgggcgtggcgatgggtaatgccgatgacgcggtgaaagcgcgcgctgacgtggtgattggtgataacaccaccgacagcatcgcgcagtatatctatacccacctgctgtga

SEQ ID NO: 2099 - DNA, 555 bp, Enterobacter cloacae
tgggaggcttgctctaccgctggtgaaaaactgggtgtcgcatggctggcgtcgccggcattggcgcaggaagcgccggctgccggtccgatcgaggcgcagaccccgcccgtcgatgctgaaccgaacgatgtcgtcgtcacgggttcgcgcattccgcagccgaaccttgagggcgccagcccggtcacggtggtgaacagccaggatctcaagctccagggtaccacccgcgtcgaggatctgctcaacagcctgccgcaggtgttcgcgggccaggccagcacgctttcgaacggcgcggacggaaccgcgaccgtcgatcttcgcggcctcgggccgacgcgtacgctggtgctggtcaacggccgtcgcctgatgccgggcgacccgaccacgtcggcggcggatctgaactccatccccgcggcgctgatcaagcgggttgaagtgcttaccggcggtgcatcgtccacctatggcgcggacgcggtggccggcgtcgtggacctcatgtcttcactccgagggaggccgatccccccatatacgccc

SEQ ID NO: 2100 - DNA, 258 bp, Enterobacter cloacae
tttgatttttggagaatagacatgtcccgagtctgccaagttactggcaagcgtccggtgaccggtaacaaccgttcccacgcactgaacgcgactaaacgccgtttcctgccgaacctgcactctcaccgtttctgggttgagagcgagaagcgttttgtcaccctgcgcgtatctgctaaaggtatgcgtgtaatcgataagaaaggcatcgatacagttctgtccgaactgcgtgcccgtggcgaaaagtactaa

SEQ ID NO: 2101 - DNA, 775 bp, Enterobacter cloacae
gagagtgagaaaatgtttaaaataacggtctgcttattaacgtttaactccgaaagaacgttgcacgatgttattcctcctcttttaaaaatagcggatgaattcgttgtagttgattccggaagtacagacgcaacgatatatatttgccagagttatggattgtcggccatattcaaaaaatatagctggcacggcgagcagatgaaccatgccgtatcccatgcgcacaacgactgggtgctgtgcatggacagcgacgaaatactcgatcaagaaaccgttgatgctattttaaaattaaaaatgggcgatgaacccgaaccggatatggcgtggcggatatgtcgtcactggtttgttctgggagaaaatgtccgaacgatttatcccgtctcatcaccggattatccggtgcgtctttttaaccgtacgcagtcgcgatttaataaccggccagtagacgatcaggtcgaaggttttctccattctgaacgtattcctggctatgtcagacatgatacattttattcactgcatgaacttttcaataaattaaacggatattccactcgcctggttcaatatcagacgatacgtccctctcttggtcgcggtgcgatcagcgctatcggcgcatttttcaaatggtatctgtttagtggtgcctggcgtcagggcaaagtgggtgtggtgacagggttttatgccacggcgtacagttttttgaagtatttcaaggcctggtatcagaatcgggaaaagaaagattccg

SEQ ID NO: 2102 - DNA, 183 bp, Enterobacter cloacae
agaggaaataaatcatggctaaaggtattcgcgaagaaaatcaagctggtttcttctgctggtacaggtcacttctacaccaccacgaagaacaaacgtactaagccggaaaaactggaactgaaaaaattcgatccagttgtacgccagcacgtactgtacaaagaagctaaaatcaaataa

SEQ ID NO: 2103 - DNA, 876 bp, Enterobacter cloacae
tctccttgtattgaaaaaccccgcaactgcggggttttttgcattctgcatctcaacggaggaaccatgcctgaattacctgaggtagagaccagccgccgcggcattgagccccatctggttggcgcgactattcttcatgctgtcgttcgcaacgggcgtctgcgctggccggtgtccgatgagatccacgcgttaagtgacaaacccgtcctgagcgtgcagcgccgcgcgaaatacctgctgctggagctgcctgacggctggatcattatccatctgggcatgtcgggaagcctgcgtattcttaccgaagagttgcctgcggaaaagcacgaccacgttgatctggtgatgagtaacggcaaagtgctgcgttacaccgacccgcgtcgctttggcgcatggctgtggaccaaagagctggaaggacacaacgtgctggcgcatctcggacctgagccgctctcagaggcgtttaacgcagattatctcaaagagaagtgcgcgaaaaagaaaaccccgattaaaccctggctgatggataacaagctggtggtgggcgtggggaatatctacgccagcgaatcgttgtttgccgccgggatccatcccgatcggctggcctcctcgctgtcggcgcaggagtgcgagctgctggtcagagttattaaagcggtactgctgcgctcaattgagcagggcgggacgacgctgaaggatttcctgcaaagcgacgggaagccgggttattttgcgcaggagttgcaggtttatggccgtaagggtgagccgtgcagagcctgcgggacgccgattattgccacgaagcacgctcagcgcgccacgttttactgccgtcagtgtcagaagtag

SEQ ID NO: 2104 - DNA, 1395 bp, Enterobacter cloacae
agtatgagtcggggaatatcccgaacgctaatctctttatcatatcatcacaatgctcaggcttcagccattcaccgatatgcagcaggggtacgcgtgatttatgctgcaaaaacgagaagagatactgcgtcatctcgtcatgaactattggtttgggtaatatgtgccaaaatttgccgagtctggagaattgcaatgcgtggtgatttttacaaacagttaaacagcgacctcgagaccgcacgtgcggaagggttgttcaaagaagagcgtattatcacgtctgcccagcaggcggacatcaccgttgccgacggcagccatgtgatcaacttttgcgcgaacaactacttaggtcttgcgaatcaccctgagctgattgccgcggcgaaaaacggcatggacacccacggtttcggtatggcctccgttcgctttatctgcggtacccaggacagccacaagcagcttgagcaaaagctggcgaacttcctcggaatggaagacgcgattctgtactcatcctgcttcgacgccaacggcggtctgtttgaaaccctgctcggcgcagaagatgcgattatctccgacgccctgaaccacgcctccatcatcgacggtgttcgcctgtgtaaagcgaagcgtttccgctacgccaacaacgacatggttgagctggaagcccgcctgaaagaggcccgtgaagccggtgcccgccacgtgctgatcgccaccgacggcgtgttctccatggatggcgtgatcgccaacctgaagggcgtgtgcgatctggcggataaatacgacgcgctggtgatggtggatgactctcacgcggttggctttgtcggcgaaaacggtcgcggctcccacgaatactgtgacgtaatgggccgcgtggacatcatcaccggtacgctgggcaaagcgctcggcggcgcgtctggcggttataccgctgcgcgtaaagaggtggttgagtggctgcgtcagcgctcccgcccgtacctgttctccaactccctggcgccggcgattgtggctgcctctattaaagtgctggagatggtggaatccggcgctgaactgcgcgagcgtctgtgggctaacgcccgcctgttccgtgaaaaaatgagcgcagcagggttcaccctggccggtgctgaccacgcgatcattccggtgatgctgggtgacgcggttgtcgcacagcaatttgctcgtgagcttcagaaagaagggatttacgtgaccgggttcttcttcccggtggtaccaaaaggtcaggcgcgtatccgcacccagatgtctgcggcgcactcgcctgaacaaattgaacgtgcggtggaagcctttacccgcatcggcaaacagctgggcgtaattgcctga

SEQ ID NO: 2105 - DNA, 1038 bp, Enterobacter cloacae
ggacgtgtgatgaaagcgttatccaaactgaaagcggaagaagggatttggatgaccgacgtaccggagccggaagtcggtcataacgatctgctgatcaaaattcgtaaaaccgccatctgcggtactgacgttcacatctacaactgggaccagtggtcgcaaaaaactattcccgtgccaatggtagtcggccacgaatatgtcggcgaagtagtcggcatcggccaggaagtgaaaggcttcaacattggcgaccgcgtctccggtgaaggccacattacctgtggtcactgccgcaactgtcgcggtgggcgtacccacctgtgccgcaacaccgtcggcgtgggcgtgaaccgtccgggctgcttcgcggaatacctggtgatcccggcgtttaacgcgttcaaaatcccggacaatatctctgacgatctggcctccatcttcgacccgttcggcaacgcggtacatacggcgctctccttcgacctggtgggggaagacgtgctggtctccggcgcaggccccatcggtattatggcggcagccgtggcgaagcatgtgggtgcgcgcaacgtggtgatcaccgacgtgaacgaataccgcctgtcgctggcgcgcaaaatgggcgtcacccgcgcggtggatgtctcgaaagagagcctgaccgacgtgatggaagagctgggcatgaccgaaggctttgacgtgggtctggagatgtccggcgcgccacccgcgttccgcaccatgctcgacaccatgaaccacggtggtcgtatcgcgatgctgggtattccgccgtcagatatgtccatcgactggaacaaagtcatcttcaaggggctattcattaagggcatctatggccgcgagatgtttgagacctggtacaagatggccgcgctgatccagtctggtctggatctgtccccgattatcactcaccgtttctccatcgatgagttccagcagggctttgacgcgatgcgttccggccagtcagggaaagtgatcctgagctgggataaataa

SEQ ID NO: 2106 - DNA, 1137 bp, Enterobacter cloacae
cctgcgcgccgcaggctacgacaagccgttcaagaccgttgccgaaggcgtaacggaatatatggcctggctgaaccgcgacgcataagtatgaaaattctggtgatcggcccgtcatgggtgggcgacatgatgatgtcgcaaagtctctatcgcacgctcaaggcgcgttatccccaggcgataatcgacgtgatggcacccgcatggtgccgtccgctgttatcgcgtatgccggaagtgaacgaggcgatcccgatgccgctcggccacggggcgctggaaatcggtgaacgccgcaaactcggccacagcctgcgcgagaaacgctatgaccgcgcctacgtgctacctaactccttcaaatctgcccttgtgcccttctttgcgggcatcccgcatcgtaccggctggcgcggtgaaatgcgctacggcctgctgaacgatgctcgtgtgctggataaagaggcctggccgctgatggtcgagcgctacgtggcgctggcctacgacaaaggcgtgatgcgcagcgcgaaagatctgccgcagccgctgctgtggccgcagctccaggtaagcgatggggagaaatcccacacctgcaacgcatttggcatttcgtccgaacgcccgatgattgggttctgccctggcgcggagtttggtccggcaaaacgctggccgcactatcactatgcagagctggcgaaacagcttatcgatgaaggctatcagattgtgctgtttggctcggcgaaagatcatgaggcgggcaatgaaattctcgccacgctcagtaccgagcaacaggcctggtgccgaaacctggctggggaaacgcagctcgagcaggcggttattttgattgccgcctgtaaagccgtggtgacgaacgactccggtttaatgcacgtcgccgccgcgctggatcgtcccctggttgcgctgtatggcccaagcagcccggacttcacgccgccgctgtcgcacaaggcgcgcgtgatccgtttaatcaccggctaccacaaggtgcgtaaaggcgatgccgcagaaggctatcatcagagcctgatcgacatcacgccgcagcgcgtccttgaagaactcaacgcattgctgttgagcgaagaaggataa

SEQ ID NO: 2107 - DNA, 987 bp, Enterobacter cloacae
cggatgcgggtattgatcgttaaaacctcctcaatgggtgatgttctgcatacgctgccgtcgctgacggacgccatgcgggccattcccggcatccgttttgactgggtggtggaagaaggcttcgcgcagatccccacctggcatgaagcggttgatcgcgtgatcccggtggccattcgccgctggcgcaaagcgtggttctccgcaccgattaaagccgaacgcaaagccttccgcgaagcggtgcaggcccggcgttacgacgcgatcgtcgacgcccaggggctggtgaaaagcgccgcgctggtcacgcgtctggcgcacggcgtaaagcacggcatggactggcaaaccgcccgcgaaccgctggcgagcctgttctataaccgtcgacaccatattgcgaaacaacagcacgccgtggagcgcacccgcgagctgttcgcgaaaagcctgggctatgcaaaacctgaagcccagggtgactacgctattgcacagcattttttgcgcgagacggaggagcatgccgagccgtatctggtgttcctgcatgccacaacgcgcgacgataagcactggccggaaacgcactggcgaaggcttattgaactaatgcaaccttgcggtatccatattaaactcccgtggggcgctgaacatgagcgtcagcgtgcggagcgtctggcagccggtttttcccatgtcgaggtgctacccaaactcacgctggcgcaagttgccgcacagctggcgggcgcaaacgccgtcgtttctgtggatacagggttaagccatttaaccgccgcactggatcgacctaatatcacgattttcggcccgaccgatccggggttgatcgggggttacggtaaaaaccagcatcagatggtcagccctacgcaacaaacgaaggatattagcgcagatgctattttttcatttttacagggcagccatcggctttccaacagggatatttaa

SEQ ID NO: 2108 - DNA, 1113 bp, Enterobacter cloacae
cccatgagttatgtatttctgctgattttactctttccggtgaaactcatccggaagctgtttcgaaaggacacgggcaagaaccttgtcattcaaacagccaaaatcggtgactttattaatgcgacgcctcttctggcctggctgcaaaaaagcgatgtgttgatcagtcgcagcgttggcgcgctggcgaagcatgatgagactatcgagcagatctattttattgagcagcataagcgcaacctgtggcgtaaactgtgcttcgcgtgcaggatcatgaaccgctacgacaacgtctacctgctacagcccaacagcgtgaacctcttttttgccgccgtctgcaatgccaaaaacaaacaatttttaagcatttacacgcgcaggtggtatcacgggattttctatctcgcggccgacggtaccgttgagcatggcaaaaaaacgctttcggtggcgaactacctgaaactggccgaccgctcgctcacatggcaagactctcccaagcacgccacaaagccgctcttcaagccgacgacctggccggctattcttgataaacctgacgttatccgcatcggcatcagtattgcggcaggcaataaagccaaaaccgtccctccggttatctggaagcggattgttgatcaactcgctgatttaccctgcgagttttatgtcttcggcgcgccaaacgaacagtcgtggatggatgatatcacccgcctttacggtgaaatccctaattttattaatcttattggcaaaatttcgctagaagagcttccctgggccatttcaaagatggactgctatatcgcgtctgactcggggaatgtctatatcgcagacgccgtcggcgtgccggtggtcctgctgtttggaccgtgttgtcattacgaacagcgtccgcttggcaatgtgatgctgatcgggaatgacgacaacatttgttcttatgtgtttgaaacgcgctattacttcccgcaagaacgggaagcgctattctctgtcactgactccgcgttacacgatcttcagcagtttgtccgtacattacccaaagcccgctcactggctagcgctaccgacgctcaaggaaactaa

SEQ ID NO: 2109 - DNA, 1086 bp, Enterobacter cloacae
tacaacgccgataagatgatgatgaataacttacctgacacgcctgatttgcgcattttactgatcaaacttcgccatcatggcgacatgttactcaccacccccgtcatcaattcattacgccagaaatggcctgaagcccaaatcgacgtgcttctctatgaagagacgcgagacatgctcgccgcgcatccggcaatcgggacgatctatggtatcgatcgtaaatggaagcagctggggacgctgaagcacctgcaaaaagagtggcagttgcttcgtgctttacgcgctcagcattatcatctggtgatcaatcttgccgatcagtggcgcagcgcgattgttacccgcttcaccggcgcaccggttcggctcgggttcgcttttaacaagcgcaagaatgccttctggcgtttttgtcacagtgaactggtctcggtcgccagccatcagtcgctgcacaccgttgaacaaaatctctccatactgtcagcgctgccggtaatggccaaccctaccgtcaccatggcttacagcgcggatgactggcgccatgctcaccaaaagctgacacaaaagggcgtgggagaccgctacatcgttattcaacccacgtcacgctggttctttaagtgctgggacgaaggcaaaatggcgcaaactatcgccgcgttgcagcaggacggccacactatcgtccttacggcgggaccggataagaaagagctggcgatgattgaccgcattcttgccgcctccccgcagacgggtgttgtatcgctggcagggcagttaaccctgcgccagctggcctcgctaatcgatcacgcgatcctgttcattggcgttgactccgtacccatgcacatggccgccgcccttcagacgccctgcgtggcgctgtttggcccgtcaaaattgacgttctggtcgccatggcaggttaacggcgaggtcatctgggcaggtaactacggcccgcttcccaaccctgacgccattgatacaaaaacgacggaacgttatctcgacgccatccccgttgatgctgtcgtctccgccgcaaggagatacctgcaatga

SEQ ID NO: 2110 - DNA, 1047 bp, Enterobacter cloacae
cgccatttgccagcaatacattgctttggtcgacaaccaaaaataatcaggtttcatatgcaaaattcagcgcctttattaagcgtggtggttgccgtttataacggtgaagcttttctcgatcagttctttacctgccttgtaaatcaacacatcgacagtatggaagtcatcatcgtgaatgacggctccactgaccgctcgatgcagattgtcgaaaaatggcgcgaaaagctgccacagatgcaggttattgaacaacctaatcagggcgtgtccatcgcgcgtaataccggcctggcggttgcgaccgggcagtatctctctttcccggatattgatgatgtcttcaaacccggcatgtaccagcgtctgctggatatggccgtcacgcagaacctggatgtcgccacctgcaatggcaactacgtctgggaaaataacaaaaaaccgtctcgccctatcttccctgaagttaagctcgcctcgacgggcgtcatgaatggtgcggtatggttaaaaaaggcgctggattcacgtaagttcctgcatgtgacctggctgaatatctatcgtcacgattttattcgtcagcacggcttccgtttcgagcctggcctgcgccatcaggatattccgtggacgactgaggtgctgcttgctgcggaacgcgttcagtacaccagcgaacgcttttacgactactacattcactccgcctcggtatcgcacaccccggataatgacgacacgctgattcgctctgcgcgccattacatgaagatactgaagatgcttgatgccattaaccagcgctacccggataaagtgaaaaatatcccggcctgccactggcaaatcgccaaagagggtctgggaattattcataccttcgacaacatgaaggatgaggcgaagaaagcaatgataatcaaagagttcttcgacaccgggatctggaagctcatctggaaaagtgccaaaagcccgcgtttgcgctggcgcctgggccgacgctacttccgtttaaaacggtatctggcataa

SEQ ID NO: 2111 - DNA, 1311 bp, Enterobacter cloacae
aatttcccggccgaaactaaaaaaacggataatcgcttggaattgttgtataccgccctgctctacatcattcagccactggtttggctgcgactgttgcttcgtagccgtaaagcgcctgcgtaccgtaaacgctgggccgaacgctatggctactgccgcaataaagtggcgccggacggtattctgctgcattccgtgtcagtcggggaaacgctggccgccattccactggtgcgtgccctgcgccaccgttatccgtcactgcccatcaccgtcaccacgatgacgccaaccggctcagagcgcgtgatgtctgccttcggtaaagacgtgcatcacgtctacctgccgtacgatctcccctgcgccatgaaccgtttcctgaataccgtgcgccctaaactggtgatcgtcatggaaaccgaactgtggccgaatatgatttccgccctgcatgcccgtaaaattcctttggttatcgccaacgcgcgtctgtcggaacgctcggctaaagggtacggcaagctgggtaaatttatgcgtcgcctgctcagcaaaatcacgctgatcgccgcgcagaacgaagaagatgccgcgcgctttatcgccctaggtctgaagcgcaaccagcttgcggtcacgggtagcctgaagttcgatatttccgtcacccctgaactcgccgcccgtgcggtaacgctgcgtcgtcagtgggcgccgcgtcgccaggtctggattgccaccagcacccatgacggcgaagaagccattatccttcaggctcaccgccagctgctggaaaaattccctgatttactgctgattctggttcctcgccatccggagcgttttaaagatgcccgcgagatggtgcaaaaaggcggtttcagctttaccctgcgcagcagcggcgaaatcccctctggcagcacgcaggtggtgattggcgatacgatgggcgaactgatgctgctgtacggcattgcagacctcgcctttgttggaggtagcctggtggagcgaggtggtcataacccgctggagccggcagcccacgccattcccgtgctgatgggtccacacacgtttaacttcaaagatatctgcgcgaaattgcagcaagccgatggcttaatcaccgtgaccgatgcggactcggtggtcaaagaggtctcaacccttctgactgacgaagattaccgcctgtggtacggtcgtcacgccgttgaagtcctgcatcagaaccagggcgcactgacccgtctgctgcaacttctgcaaccttatctgccgcagcggagccactaa

SEQ ID NO: 2112 - DNA, 1221 bp, Enterobacter cloacae
catacggattcagacatgccgcaaaaacgtaaaatcctcctcctggacacgggcaaagaatgggggggaggtaccaacagtatgcttgagcttctgaagcgaatcaaccgcgaaaaattcgacattacttgttgtttttacagtgattatagtcgtgctgaaggtgaaacgataggccaggtgctcaatagcattgggatacctctactcgttatccctcaacgtaagcaaccggcatgggcaaaactcctgaaagaagcgggacgtggtctgctgtttttctcgcgttcagcgcgcaaagcatttacgcggcatatcgataccctgtggcgcattcgccccaacgtcagcaagatcgagaccattttcagggaaggtggattcgatacgctgtatatgaacaaccagccaggctctaacgaagaagggtatctggcgggcgcaaacctgcatgcgcggataatccagcactgccggattgaaccggtgctaaccccgccgctggtgaagctggtgaatacccatgccacaaaaatcatcgccgtctcgcacggcgttgaacgtgtgctacttcagcatggcgtccggccagcgctgtgtaccacggtcaacaatgccatcgacatccaccagcctttgcccgaccgacgcgcgatgcgccagcgcctgaacattgatgacgacacgtttgtgttcggcagcgttggctcgttaatccctcgcaaggccaatcatcacacgctggaggcgctggcccagttcaaccagaggcacccgcaggcaaaatggaagatggtgctggtcggtgaaggggctgagcgcggcgcgctgacggcacaggctgacgcgctggggattgctgaacacgtgatttttaccggtttccagaacacgccttttgactaccttgctacctttgacgcgtttattctggcctcgaagagcgaaggtctgccgcgcgtcgtgctggaggcaatgctgctgaacatcccagtgattggttcaaaggtgaccggcacggcagaattgatcgaccacgagtcgaccggcctgctgtttccgtggagcgacgtgtcgcaacttgctcaacatctggataatatctggcaggatcctgctctgcgcgcccggctcgccgctgccgcacaccagaatgtctgcaacatgtatgccattgaaagctatgttaacggtgtcgaggccgttcttggcgcgcaataa

SEQ ID NO: 2113 - DNA, 975 bp, Enterobacter cloacae
cgttcgggatattccccgactcatacttcaaaggttacagttatgatcatcgttactggcggcgcgggctttatcggcagcaatattgttaaggccctcaatgacaaaggcatcaccgacattctggtggtggacaacctgaaagacggcaccaagttcgtgaacctggtggatctgaacatcgctgactacatggataaagaagacttccttatccagattatggcgggtgaagagttcggcgagatcgaagccatcttccacgaaggtgcgtgctcctccaccaccgagtgggacggcaagtacatgatggataacaactatcagtactccaaagagctcctgcactactgcctggagcgtgaaattccgttcctgtatgcctcttccgcggcaacctacggtgggcgcacttcagatttcatcgaatcccgcgaatatgagcagccgctgaacgtctacggttactccaaattcctgtttgatgagtacgtgcgtcagatcctgcctgaagcgaactcgcaaattgtcggcttccgctacttcaacgtctacgggccgcgcgaaggccacaaaggcagcatggcgagcgtggcgttccacctgaacacccagttaaataacggcgaaagcccgaaactgttcgaaggcagcgacggcttcaagcgtgacttcgtctacgtgggcgacgtggcggcagtgaacctgtggttcctggaaaatggcgtgtccggcattttcaacctgggcaccggccgcgcggaatccttccaggcggtggcagacgcgacgctggcgtaccataagaaaggcagcatcgagtacattccattcccggataagctgaaaggccgctaccaggcattcactcaggcggatctgactaacctgcgcgccgcaggctacgacaagccgttcaagaccgttgccgaaggcgtaacggaatatatggcctggctgaaccgcgacgcataa

SEQ ID NO: 2114 - DNA, 1218 bp, Enterobacter cloacae
ggcattatggaaaaaataaaaccacggctctatcaactgacgatcgctttgagcctcatctctttgatactggctttagtcagttcagggaagcaaagagagtttttctatattgctatttacgtcagtattattggcctggctttcgaatataaaaaaatcactctgcgaccttttactatagcgctgcccattctgctgattggattacttaacctcggctggtatttactctatgagtatcataacgagggactcaacctttacagcgactatctcggtgccagcaaaaaattaattttagcgagtgtcctgattttctatattgaccgctttaagttttatatcgataaggacaccttcaggaaatttttcttcttcgcaacggccttagggtttgtgctcgccacagggtatggcttgtggcaggcctcacaaggtatgactcgcgttgagatggcaattaaccgtgccaccgtttcagcctatgtttattctgtcctgtcactggctttcgtatacagtctttaccttcaacagaacgtgaagctgtatgttgttgcgggcttcactatattaatctcttacttcgtcatactgttgacggggacccgtgctgcgatgggtttatatctgcttctggcaattgtgctcacgctttatcatttcagaaagattcatcttaaatccgccctcatctttctatgcattgttgcaggcgttgtaatcgttagctacaagccattgatttcgtcgaaaattaaacaaacccaacgtgaggttgaacgttatcaacaaggttttgaccgcacgtcattgggcgcacgtttttcgatgtggactgtcgggatcgagaatggtcttgcgcatccgttagggcaatcgctggaacagcgtgaagcgtggacgcggcagtatattaaagacggacatccgcaccttggcagtgcactcgaatacatcaaagtccatctgcataatgaatttattgagaaatactctttgcaggggatccccggcgtaacggtaatgctctttttcttcgtttcgatgattgcgtatgccctacgaaacagaaacgcgctgctgctaacgtcaatgcttcttttgcttttgtatggactgacggatgtcatactgctcagttcagaagccttaatcttctttatgattttgtttgcgttaagtacacctttctcacaaacaaagcagcaataa

SEQ ID NO: 2115 - DNA, 1152 bp, Enterobacter cloacae
aaaactatcaagtcagcttatttcgctttatcaaaaattactggattaataatgcgcatcctaatgattattgatggtttacccggtggaggagccgaaaaaacggttctcaccctctccagcggactgacagaactggggcatcaggtcacccttttctccttacggaaggtgtgcgactacgccattccggaaggcatcgattttcagattgtgcaggatacctgtaaaaaaccctggcggaagctgaccgagatcccgcgtcgcgcccgtttgctggatcgcgccatcgagaatgcagaacgcagcggtaaatttgacgtcgtgttctcgcatctgcataaaaccgaccgtatcgtggcgcacagccgcgtgctggatcgggataaggtctggttctgcgttcacgggatgttctccttctcctatttgcgccatcgcagcgggctttctcgctggtttaagcattataaaattcggcatacctatgaaaaccgcaacgtggtggcggtttccggcgccgtgctgcacgacctctctcaagtactcgcgatccccctgcggcgcaaagcggttatccataacccctttgatatccctgaaattcagcgtctggcggaagcgccctttgagatgcaggggcaggattacattatccacgttggccgttttcatgaacacaaacgtcacgaccggctgctgcgggcgtttgcgctgagcaagatcgacgcatcgctggtgttgatgggcaaaggttctgacgcgaaaataaaccagctcaaacagcttgccgctaagctgggaattgaaaacaagatcgtcttccgcccgttcgaaaccaacccctacccgtggatcaaaggggcacgccttttagtgttaagttccgactgcgaaggttttggtaatgtactggtagagtccattatctgtcagaccccaccggtgagtacaaactgccctggcggtcctgctgagatccttactggccccctggcgcgaggtctgacagcgttaaccgacgaatcactggcgaaaacactggcagaattgtatgcctctccgccagttgttgatcgcgaaacgatcgcatcgttcggtattaacgccatttgccagcaatacattgctttggtcgacaaccaaaaataa

SEQ ID NO: 2116 - DNA, 576 bp, Enterobacter cloacae
atgcccttaatgaatagccccttgaagatgactttgttccagtcgatggacatatctgacggcggaatacccagcatcgcgatacgaccaccgtggttcatggtgtcgagcatggtgcggaacgcgggtggcgcgccggacatctccagacccacgtcaaagccttcggtcatgcccagctcttccatcacgtcggtcaggctctctttcgagacatccaccgcgcgggtgacgcccattttgcgcgccagcgacaggcggtattcgttcacgtcggtgatcaccacgttgcgcgcacccacatgcttcgccacggctgccgccataataccgatggggcctgcgccggagaccagcacgtcttcccccaccaggtcgaaggagagcgccgtatgtaccgcgttgccgaacgggtcgaagatggaggccagatcgtcagagatattgtccgggattttgaacgcgttaaacgccgggatcaccaggtattccgcgaagcagcccggacggttcacgcccacgccgacggtgttgcggcacaggtgggtacgcccaccgcgacagttgcggcagtga

SEQ ID NO: 2117 - DNA, 930 bp, Enterobacter cloacae
cgctaccgacgctcaaggaaactaatttttatggcttttttaagcgtcattattgctgcgcataacgctgaagctacgctgcacgccacgctttcaagcctgctggcagcaatcggtcaggacactgaagtcattattttcaatgacaattctgaggatgccacgcaggcaataattgaagagtggtcgccgaaatttcctcagatcatcacgcgcaccgtgaactttcgtaacgtaggccgggtacgaaacagcgctgtcgcgctggcatcgggagagtatattacgatgctcgacagtgacgattgcttaaagccgggcagcctcggggacgcaatagccttcctgaaagcgcaacgtccggatatgttactgacacgtttgcttgagattcgcgatccccggaaaatgacttcagactggcagggatttaatcctgtgccattgccacgaaatgaagcagtcgctcgtttcttacgccataaagactttcaggcacatctcattggccagtttattcatcgtagcctgtacgagagtaaccctattcctccgatgttatgttatgaggatttcgctgtcttccctggaatgctgatgcaatcgaacaaaatagtctatcaacgccaggggcattattattacatcaagcgtcgcgacagtttgtcgagcactctggacgccagcaaaatttcaacgcttgtcgaatgcacgttacagatggaaagaacatttccgtcaagctacaagcatctcgtcaattgccactggtttgatatttacagcaaccatcggtcctgtcttacagaccaacaattgcagctcgtgaaacaacgcgtaaaggccatgtatacattgtcttttttcctctccaccgatgttcgttttagctataaaaaaagggttattgaggcattatggaaaaaataa

SEQ ID NO: 2118 - DNA, 1161 bp, Enterobacter cloacae
tgctgtcgtctccgccgcaaggagatacctgcaatgaagcttcatcgtctggccattgtgcgccaaaaatatcgtccggatggaggagcagaacgttttgtctccagggcacttaccgcgctgagcaatcaaaatcttgagctcaacgtcatcacccgcgagtggcagggcgaaaagcaggacgactggcatattcatatttgcgatccacgaaagtggggccgcatcagccgtgagcgcggctttgcacacgccgcacgcgcgctgtggcagcaacagcagtttgatattgtccagagccacgaacgtattccgggctgcgatatttaccgcgccggggatggtgtacatcgacgctggctgctacagcgtacgcgtattcttcccgcctggcgtgcgaagctgcttatgcacgatcgttatcaccgctacgtgatgaacgcagaacgtgaaatgtaccaggctcccgagttgaaagccgttatctgtaatgcggagatgatcaaacgcgaaatcgtcgaagactttgatattgacgcaaaaaagatacatgtgatttataattcaatagattccagccgcttcgttccggcagaagagagacaacgcgctgtactgcgtcagcaatttggcttacccgctgatgccgtcattttctgcttcgtgggttcagggtttgaacgcaaggggctggcaagcgctattcgggctatagcaggaacatcggcatggctggttgtggtcggtcaggataaagcggaaagccgttatcgcgacctcgcccgttcattaggctgtgaggggcaaatccgtttcctggggatgcaaaaagagacgctgccattttatcagctttctgatggtttactgctgccgacgctgtatgatcctttccctaacgtcatacttgaagcaatggcctgtggattgcccgtcattacgtcagagagttgcggtggttcagaatttattgagcaaggccagaacgggttttactgtgatgcacttgatatccacacattgaaggaggccgtcatgtccatcccttcactggaaaaaaataataatatggggcttgcggcgcgtgaacgcgtcagagaagcaacccctgaaaaactatcaagtcagcttatttcgctttatcaaaaattactggattaa

SEQ ID NO: 2119 - DNA, 849 bp, Enterobacter cloacae
agtcctgcatcagaaccagggcgcactgacccgtctgctgcaacttctgcaaccttatctgccgcagcggagccactaatgtcaacgcgtctgtcggtcgtgatgatcgccaaaaacgccgccgacctgcttccggattgcctggcctctgttgcctgggctgacgaaatcgtcattctcgactccggaagtacggacaatacggcggacgttgcccgtgcagccggggcaaaagtctttaccgacaccgactggcagggctacggtattcagcgtcagcgtgcgcagggttacgccacgggcgattacgtgttgatgatcgataccgatgagcgcgtcaccccagaactccgacaggccattcaaacggtgcttgccgcgccacagcctggcgcggtctacagtatcgcgcgtcgtaactatttcctgggccgctttatgcgccacagcggctggtaccccgaccgcgtgatgcgcctctatgcccgcgagcgttatcagtacaacgataacctggtccatgagtctctggcctgcgataacgctcaggtcatccccctgacgggcgatctgcttcatctgacctgccgcgatttcgccagcttccagcgtaaacagctgaactatgccaccgcctgggcacaggagcggcatgcgcgcggcaagaaggccacgctgaccggcatcttcacccacacgctgggcgcgtttctgaaaacgctgctgctgcgtggcggcgtgctggacggcaaacagggctggttactggccgtagtgaatgcccagtatacttttaacaaatacaccgagctgtgggcgctgaaccgcggctactcagagaaaacgtga

SEQ ID NO: 2120 - DNA, 483 bp, Enterobacter cloacae
gccatgagcacaaaagcgatttatccgggtaccttcgatccgatcactaacggtcatattgatatcatcacccgtgcggcgtgtatgttcgacaaggtgattatgaccatttccgccagcccgagcaaaaagccgatgttcgacctgaacgaacgcgtgcagcttgccaccgatgcgatttcgcatctgtcgaatgttgaggtcgtcggattcagcgacttgatggcaaactttgcccgtgaccggcatgccaatatcctgatccgcggtcttcgcgcggtagcagacttcgaatatgagatgcagctggcacacatgaaccgccatctgatgccggagctggagagcgtattcctgatgccctccaaagagtggtccttcatctcttcttcgctggtgaaagaggtggcgcgccatcatggggacgttacccacttcctgccggttaacgtccaccaggcgttgatggaaaagctaaagtaa

SEQ ID NO: 2121 - DNA, 402 bp, Enterobacter cloacae
tctgtgaatcgtcagcggggcatgtcatcgctggcgctggtcctgctattgctggtgctcggcacgctgatcctcaccggattaaatcagcagttgcaaacctttagcacgctggtaagtggcgagagtttgtctgttcgccagcaggctgccgtgcaatctgcactggagtgggggcgcgttcaggaatgggctttacagccagaggttcagtgcaaacagacacagcgtttgcgggtctgtgtaaggctgtttggggagcgtgttttgcttattgccggcaatgacgatctgttgctatggcaaggcggggacatcgcggaagggcagatacgcttttccgcccacggctggagtgatttctgcccccttaaggaaagtacgctatgtcagttaccctga

SEQ ID NO: 2122 - DNA, 2907 bp, Enterobacter cloacae
tgtagccgtgataaagaggtcgtaatgccaggcagcaccttgttcaaagcgtttgttttgtttatcgccctttgggctcccgtcactcaggccgattccggttggcaacctgtcaaggaaacaatccgtaagagcgataaggacacccgtcagtatcaggcgattcgtcttgataacgggatgaccgtactgctggtttccgatcctcaggcggtgaaatcgctctccgcgctggttgtgccggtgggttcgctggaagatcctgacgcccatccgggactggcgcactaccttgagcacatgacgctgatgggatctaaaaaatacccacagcctgacagcctgtccgaatttctgaaaatgcatggcggcagccacaacgccagtaccgcgccgtatcgcaccgcgttttacctggaagtggaaaatgatgcgcttgatggggcggtggaccgtctggcggatgccatcgccgcaccgctgctggataaaaaatacgctgaccgtgaacgtaatgccgtgaacgccgaactgacgatggcgcgcacgcgagacggtatgcgcatggcgcaggttagtgctgaaaccatcaatccggcgcacccgggttcgcgcttctcaggcggcaaccttgaaacgctgagcgacaagccaggtagcccggtgctcgatgcgctgcatgcgtttcgtgaaaaatactattccgccaatctgatgaaagcggttatctacagcaataaaccgttgccgacgctggcaaacatggccgcgcagacctacggcagggtgccaaataaaaatatcgatctgccgcagattaacgtgccagttgtcacggacgcgcaaaaaggcattgttattcactatgtgccggccttgccgcgcaaggtgttacgcgttgaattccgtattgataacaacacggcgcagttccgcagcaaaaccgacgagctggtgacgtatcttatcggcaaccgcagcccgggtacgctctccgactggctgcaaaagcaggggctggtggaaggtattcgcgctgactccgatcccgttgtaaatgggaatagcggcgtgctggccatctccgcgacgctgaccgataaagggctggctcaccggaacgacgtcgttgcggccattttcagttatctctctctgctgcgcgacaaaggcgtcgataaacgctactttgacgagctggcgcacgtgctggatctcgatttccgctatccctctatcacgcgtgatatggactacgttgagtggctggcagataccatgatccgcgtgccggtggaacatacgctggatgcggtaaatattgccgaccagtttgacgccggagcgctcaaagcgcgtctggcgatgatgactccgcagaatgcccgcgtctggtatatcagcccgaacgaaccgcataacaaaatggcctacttcgttgatgccccgtatcaggttgaaaaaatcagcgaacagaccttcgcgggctggcagaaaaaggcgggggaaattgcgctgaagttaccggagcttaacccctacatcccggacgatttctcgctgatcaaacccgcaaaggcgtatccgcacccggagctgattgttgatgagccgacgctgcgcgtggtctacaccccaagccgctatttcgccgacgagccaaaagcggatgtcagcgtggtgctgcgtaaccccaaagcaatggacagcgccagaaaccaggtgctgtttgcgcttaacgattatctggccggtattgccctcgatcagctcagcaaccaggctgccgttggtggtatcagtttctccaccaacgccaataacggcctgatggtgaatgccaacggctatacccagcgtttgccgcagctgttccaggcgctgctggacggttatttcagctatacgcctacggaagaacagctcgagcaggctaagtcctggtatgcccagatgatggattctgccgagaagggtaaagcctacgatcaggcgattatgccagcacagatgctgtcgcaaattccgtacttccagcgcgaagatcgccgcgcgatattgccctcagtcaccttaaaagaggtgctggcttaccgtgatgcgctgaaaaccaatacccgtccggagttcctggttgtagggaatatgagcgaagatcaggctaaaacgctggcgcaaaacgtccgtgcgcaactgggttcaaaaggcgatgagtggtgccgtaaccaggatgtgctggtagagaaaaagcagaacgtgatcttcgaaaaagcgggaagcagcacggattccgcgctggccgcggtgtttgtccctgtcggttatgacgaatttaccagctctgcccagagtgctgtgcttggtcaaattattcagccgtggttttacaaccagctgcgcaccgaagagcagctgggctatgcggtgttcgctttctccatgaatgtgggccgtcagtgggggctgggcttccttctgcaaagcagtgacaagcaacccgcttacctgtggcagcgttatcaggcgttcttcccgcaggcggaagcaaaactgcgcgccatgaagccggaagagtttgcccaaatccagcaggcggttatcgcccaggtgatgcaaccgccgcagacgctgggtgaagaggcctcgcagctgagcaaagattttgatcgcggtaatatgaaatttgattcgcgtgataaaatagtggccgaaataaaacagctgacgccacaaaaggttgccgatttcttccatcaggcggtagtaaaaccgcagggtatggccatcctgtctcaggtttctggcagccagaacgggaaaacggactacgtaaaatcaaaagagtggaccgtctggaagagcgtcagcgcgctgcaacaaacaatgccctggagtaagaaagaatga

SEQ ID NO: 2123 - DNA, 1338 bp, Enterobacter cloacae
atgacagtttatgcgtcattcgttaaagttttcggtcaatttgggcgttttgttcatcaatcagatttcttgctcgggagaagcatgtcgggatccaattcagcaataagccgccgccgcctgttaaaaggggccggggcgatgtggttgcttagcgtcagccaggtgggtcttgccgccacaagccaggtagtcgcggtgcgcgtctggccgtcgtcgacctatacgcgcgtgacggtcgagtccaatcgcgtgctgaaatacaagcaatttgccctcagcaatcctgaacgtgtggtggttgatctcgaaggtgtgaacctcaactccgtgcttaaaggcatggcagcacaaatccgtggcgacgatccgtttatcaaatcggcgcgcgtcgggcagttcgatccgcaaaccgtgcgcatggtgtttgagctgaagcagaacgtgaaaccgcagctctttgcccttgcgcctgttgccgcctttaaggagcgtctggtgatggatctctatccggcgaatgcgacggatattcaggatccgctcctggcattacttgaggattacaacaaaggcgatctcgacagccaggttccgccagcgcaaagtggtccaaagcctggcaaggcggggcgcgatcgcccgattgtgatcatgctcgatcctggccacggcggagaagattccggcgccgtcgggaaatatcgcacccgcgaaaaagatgtggtgctgcaaattgcccgtcgtctgaaggcgttgatcgacaaagagggcaatatgcgcgcctatatgacgcgcaacgaagatgtctttattccgctgaaggtccgcgtggcaaaagcgcaaaagcagcgcgcggatctgtttgtctctattcatgcggatgccttcaccagccgccagccgagcggatcctcagtgtttgccctgtcaacaaaaggggcgaccagcaccgcggcgagatacctggcggacacgcagaacgcctcggatttaatcggtggtgtgagcaaaagtggcgaccgttacgtcgaccatacgatgtttgatatggtgcagtcgctgactattaccgacagcctgaagtttggtaaagcggtgctgggcaaactgggccgggtcaacaagctgcacaaaaacagcgtcgagcaggccggatttgcggtactgaaagcgccggatattccttccattctggtcgaaaccgcgtttatcagtaacgtggaagaggaacgtaagctcaagacggctaaattccagcaggaagtggcggagtcgattctggcggggattcgggcctacttctcagacggggaaacgctggcgcggcgggggtag

SEQ ID NO: 2124 - DNA, 879 bp, Enterobacter cloacae
cagatgaacagtggttatctgcattttccggaattcgatccggttattttctcaataggacctgtagcgctgcactggtacggtctgatgtacctggtgggcttcgtttttgccatgtggcttgctggccgtcgcgccagtcgtccgggcagtggatggacgaagaacgaagtggaaaacctgctttatgccggcttcctcggcgtattcctgggaggtcgcatcggttatgtcctgttctataatttcccggtattcctgaacgacccgctctatctgttccgcgtctgggacggcggtatgtccttccacggcggactgattggtgtgatcctcgtgatggtgatcttcgccagacgcaccaaacgcaacttcttccaggtggctgattttattgcgccgttaatcccgtttgggctgggcgcagggcgtctgggcaatttcatcaacggtgagctgtgggggcgtgtcgatccgagcgtgccgtttaccatgctgttcccgggctcccgcgcagaggatatcgcgctgctgccttcgcatcctgagtggcagtccattttcgatacctacggcgtcctgccgcgccatatgtcacagctctatgagctggcgctggaaggcgtggtgctgttcatcatcctgaatctttatatccgcaaaccgcgtccaatgggggctgtctccggtctgttcctgattggctacggcgcgtttcgtatcatcgtcgagttcttccgccagccggatgcgcagtttaccggtgaatgggtacagtacatcagcatggggcagatcctctccatcccgatgattgtcgcgggtgccattatgatgatttgggcgtatcgtcgtcgtccacagcaacaactttcctga

SEQ ID NO: 2125 - DNA, 801 bp, Enterobacter cloacae
ggaatcatgaaacagtatcttgaattgatgaaaaaagtgctcgacgagggcacgccgaaaaacgaccgcaccggcaccggtacgctctccatttttggccaccagatgcgcttcaatctgcaagaaggctttcctctggtgacaacgaagcgctgccatctgcgctcgatcattcatgaactgctctggttcctgcaaggcgataccaacgttgcttatctacatgaaaacaatgtctccatctgggacgagtgggcagatgagaacggcgacctgggtccggtctacggcaagcaatggcgcgcgtggcctaccccggacggccgtcatatcgaccagatcacgaccgtcataaaccagctgaaaaatgatccggactcgcgccgtatcattgtctctgcctggaacgtgggtgaactggataaaatggcgctggcgccttgccacgcgtttttccagttttacgtggcggacggcaagctctcctgccagctctatcaacgctcctgcgacgtgttcctcggcctgccgtttaacatcgccagctacgcgctgttggtgcatatgatggcgcagcagtgcgatcttgaagtaggcgattttgtctggacgggcggtgatacccacctctacagcaatcatatggaacagacgcatctccagctgacgcgcgaaccgcgtgcattgccgaagctggtgatcaaacgtaaaccggactcgatcttcgattaccgttttgatgatttcgagattgagggttacgacccgcatcccggcattaaagctcctgtcgccatctga

SEQ ID NO: 2126 - DNA, 579 bp, Enterobacter cloacae
tgccgcaggagaaggtgcatgccagtaaatcgaaaagggttttccctgctggaagtgctgattgcgatgacgataagcagcattctgttactcagcacgtcacgttttttaccggggctacagcggggggttttactgcaatccgggcagcaggagctggaggatgaggtctggcaacgtctgttcgcggtcggtaaacagtttcagagagcaggatactgtgcagggcattgccagggacaggggatgatcatcggcaggcaaggacgatgtgcgattgtgcaatgggatgcgaacagcaacggccagtgggatagcaccgcgtcggaaaacgacagtacgggattccggcttgagtccggatcgcttgaaacgctgcggggcgccacatcctgtgacggtaagggatgggataagctcaccgacccggatcgggtcctgatagagcaatttatggtcactaaaaccgatcgtgctggctttgcgccggtcatcagtatcgagctgcgtgcccgccgtaaaggtgaactgaccgcccccttttcggctcgccataccgtaacggggtttaatctgtga

SEQ ID NO: 2127 - DNA, 1851 bp, Enterobacter cloacae
cctgtttgcagcaaacacggaggagatggcatgacgatgcaggacttattgctggatgcggtagagcaacgcgtgctgcgtcagctggacgtgcagtttgccatgatgattgccgctgaccagcccgccgtgatgcttgccgctgccctgttgagtaaagatgccggagaggggcatgtgtgtctgccgctctcgcgtctggtggttgacgagaaaatgccgcctgtcctccagtcctgctttgcgctgctgggagataaggtggactggcagaaaatcttgcgggaatcgtcagccgttgggccgggagacaaccaggcaccgctgatcctgacgggggagcgcttatacctgaaccgcctgtggcgaaatgaactgacggtagcgcgtttctttagtgagaccaatgcgccgcttccctgcgacgaagcacagcttcgccagacgctggacaggctgtttgactccggtgaggacacagactggcagaaagtggcggcggccgtcgccctgacgcggcggatctcggtgatatccggcggcccgggaacggggaaaacaacgaccgtcgcaaagctgctggcagccctgatacagctttcaggagagcagcgatgccgtattcgtctggcggcgcccaccgggaaggctgcggcgcgtctgaccgaatcactgggcggcgcgatgcaacagctgccgctcactcaggagcagcttgcgcttttcccgggtgaagcaagtactctgcaccgtctgctcggcgcgcagccgggtagccagcggctgcgctaccatgcgggtaatccgctgcatctggacgtgctggtggtggatgaagcctccatgatcgacctgaccatgatgtcgcgcctgattgatgctctgccaccccatgcgcgggtggttttcctgggcgatcgcgaccagctcgcctctgtagaagccggggcggtgctgggagatatctgtacctacgccagttacggttataccgccgcgcgggcgcaggagctcgcccgtctgaccggctgctcgcttgaacccgatcacacgccgatcgcgggcgcactgcgtgacagcctgtgcctgctgcaaaaaagctaccgtttcggtagcgactccggcatcggccagctggctgcggcggtcaaccgtggcgacaggcacgccacgcgcacggtgtttgacggtaccttcactgacattgaaaagaaatcgctgcaaagcggggaagagtatcaggctatgcttgaggaggctctccagggataccagcattttctgagctgcgtgcagcagtgcagtcagcccggacaggtcatcgccgcatttggcgaataccagcttctgtgcgcattgcgggaagggccgtttggcgtcacgggcctgaacgacaggctggagcagttgctggtgcagaaacgcaaaattaaccgtcagctgcattcgcgatggtatgaaggccggccagtgatgatctcccgcaacgacagtgcgctggggctgttcaacggggatatcggcattgcgctcgatcgcggtaacggtctgcgcgtctggttccagctaccggacggtagcgtgaagtccgtccagcccagccgcctgccagagcatgaaacggcatgggcgatgacggtacataaatctcagggctccgagttcaaccatgcggcgctgatcctgccgacacagctgtcgccggtagtgacccgcgaactggtctacaccgccattacccgtgcgcgccagcgcctgtcgctgtatgcggatgagcgcgtgttgagccaggctattgccacccgtaccgagcgcagaagcggattaagcgcgatatttgaatctgtctga

SEQ ID NO: 2128 - DNA, 360 bp, Enterobacter cloacae
cgcggatccttccggccccgtggtgaagatctggcttcgacccgcaactggttgcgttacaagttaccgaaacgtttggtgcgttgggacacaaagccggtttgtatcggccagaaacagaagtggtttcttttgcagttggtgggcaacgattcagatatcaatatgcaaaccagcagcacgccagagtttgatggctggcgctgggtaagctactggtatccggttcgtcaggtcgtgtcatttaagcgcgatgtatatcgtagggtgatgaaagagttcgcaagtgtcgtgatgcagcttcaggagacgcctccgaagccacagagcgcacctgcctggcgacgtaaaagaggttaa

SEQ ID NO: 2129 - DNA, 2259 bp, Enterobacter cloacae
gctacgcaaatcatgctcacccgcttgcgagaaatagttgaaaaggttgccagtgcgcctcgcctcaacgaggcgctgaatattctggtgacggacatctgtcttgcgatggaaaccgaggtctgttcggtctacctggccgatcatgaccgacgttgctactacctgatggcaacccgcggtttaaaaaaaccacggggacgtaccgtcacgctcgcgtttgatgaaggtattgttggcctggtcgggcgactggcggagccaatcaaccttgccgatgcgcaaaaacaccccagcttcaaatatatcccttccgtcaaagaggagcggttccgcgctttccttggcgtgccgattattcagcgccgccaactgcttggcgtgcttgttgtccagcaacgagagttgcggcagtacgacgaaagcgaggagtctttcctcgtcacgctggcaacgcagatggctgctatcctctcccagtctcagctggcagccctttttgggcagtatcgtcatacccgcatccgcgcgcttccggcctcgccgggcgtcgcgattgccgaaggctggatggatgccacgctcccgctgatggagcaggtctacgaagcctcgacgctggatgaagcgcttgagcgcgaacggcttaccgctgcgctggaagaggcggcgaatgagtttcgtcgctacagcaaacgctttgccgctggcgcgcaaaaagagacggcggctattttcgatctctactcacacctgctttccgatgcgcgtttgcgtcgtgagttatttgccgaggtcgataaagggtcggtggcagaatgggcggttaaaaaggtcattgaaaaatttgctgagcagtttgcggtgctgactgacggttatctgaaagagcgcgccggcgatttacgcgcgcttgggcaacgtctgctgttccacctcgatgatactattcagggggcgaacgcctggccgaaccggtttgtgctggtggccgatgaactctcagcgacgacgctggctgaattaccgcaggacaggctggcgggcgtggtggtgcgcgatggcgctgctaactcccatgccgccattatggtgcgcgcgctcggtattccgaccgtgatgggggcggatattcagccctccgtactgcatcgccgtacgctggtggtggacggatatcgtggtgagttgctggtggatcctgaaccggttctccttcaggagtaccagcgtcttatcagcgaagagaatgaattaagcaagctggcggaagatgacgtcaacctgcccgcgcagctcaagagcggtgagcgggtgaaggtgatgctcaacgctggcttaagccccgagcatgaagagaagctcggcagccgcatcgatggcatcggcctctaccgcactgaaataccgtttatgctgcaaagcggcttcccgtcagaagaggagcaggtggcgcagtatcagggcatgttgcagatgtttaatgacaaacccgtcacattgcgcaccctggacgtcggcgcggataagcaactgccctatatgcccatcagtgaagagaatccctgcctcggctggcgtgggatccgcataaccctcgatcagccggaaatcttccttatccaggttcgtgccatgctgcgtgccaacgcggccacggggaatctcagcattttgctgccgatggtcaccagtattgacgagatcgacgaagcgcggcggttgatagaacgtgcagggcgcgaagtggaagagatgatcggctatgcgatccctaaaccccgtatcggcgtgatgcttgaagtgccttcaatggtctttatgttgccgcagctggcgacccgcgttgattttatctccgttggtaccaacgacttaacgcaatacattctggcagtcgatcgcaacaatacgcgtgttgccagcatctacgatagcctgcatccggcgatgcttcgtgccctggcgatgatcgcccgcgaagccgagcagcataatatcgacctgcgcctgtgcggtgaaatggccggcgatccgatgtgcgtggcgatcctgattggtctcggtttccgtcacctgtcaatgaacggacgttccgttgcgcgtgtgaaatacctgttacgtcacatcgaacaagatgaggcgcgcgaactggccgcgcgtagcctggaagcacagctggcagccgaagtgcgccatcaggtggctgcgtttatggagcgacgcggcatgggcggtttgatccgcggtggccgctga

SEQ ID NO: 2130 - DNA, 516 bp, Enterobacter cloacae
agttctggtttgacgctcgcaccgtttctgctattcctccacactcccgccatgaaaaacgaacaaggctttacgcttatcgaaacccttatcgccgtttcgctggcagtgatcctcagcgccacaggactctatggctgggacagctggcagcagcggcagcggctttggcaaaccgcctgccaggtgcgggattacctggtgtttttgcgcaatgacgccaaccgtcacaacagcgagcacaggatcgcgctgtataacgacggtgaaaagaactgtctgaccagttcagcggtgaccggttgtgacagcggcggaccgttcgtgatgaagccgatgtggccaggggtcacgataagcgacataacacctgcgctgggattttacggtttaagagataccgcgtgggccggacatatccgggtgcagagccgcgctggtgggtggtgggttattgtctcaaatggcggacgtatcaggctgtgtaatgccgcaggagaaggtgcatgccagtaa

SEQ ID NO: 2131 - DNA, 336 bp, Enterobacter cloacae
ggaaagtacgctatgtcagttaccctgagcagacaaaaaggatttagcatggttgaggttttgctggcaatgatgttgctggttgtggttgtgacggcgttatccggatatcatcgcgcgctggcagcccggtatgcggcgcttagccagtatcgtcagctatggcatcatgcgtggaatcaatcgcagatctcaacattaacgctcccgccgggctggcaagtcagtcgggggcagacaacacagtccggatgtgtcagcatcacggtcacacttatttctcctatggggcggcagggcgcgttaacgcgtctgcactgcccggttagccgctag

SEQ ID NO: 2132 - DNA, 3387 bp, Enterobacter cloacae
tcgggagcgtttatgctaagggtttaccactcaaatcgtctggatgtgctggaagcactgatggagtatatcgttgagcaagagcgtcttgacgatccgtttgagccagaaatggtgctggtgcagagcaccggtatggcgcagtggctgcaaatgtccctttcgcagaaatttggcattgcggcgaacatcgattttccgctgcccgcgagctttatctgggagatgtttgttcgcgtcctgccggacatccctgagcagagcgccttcaacaaacaaagcatggcctggaaactgatgacgctgctgccggacatgctggcgcgtgatgagtttgccatgctgcggcactacctgaatgacgacaccgacaagcgtaaacttttccagctggcctcacgtactgccgacctctatgaccagtatctggtttaccgtgcagactggctgattcgctgggaagcgggagaattagtcgatgggttaccggaagcgcaaatctggcaggcgccgctctggaaagcgctggtcgagcataccgggaaactcggtcagcctaagtggcaccgtgctaacttgtacgatcgctttatctcgatacttgagaacagcgcagaacggccagcccgtttgccgtcacgcgtgttcatttgcggtatctccgcgttgccgcctgtctacctgaacgcgctaaaagcgctcggtaagcacactgatatccatatcctctttaccaacccgtgtcggcactattggggggatattcaggatccgcgctggctttcacggctggtcacccgtcagagaaaacgtctctttgaagaacgcgcggtgccgctgtttaaagacagtgaaaacgcggcgcagctttttgatgaagaggggattcagaacctgccgaacccgctgcttgcctcgtggggcaagctcggacgtgactatatttatctgctttcagatatcacctcctcgggagaaggggatgtggatgcgtttgccgatattacgccggatagcctgctgcacaatattcagcttgatattctggatttagagaaccgtgccgttgccgggatcactgccgaggagtttgcgcgaagcgataagaagcgaaaactggatcctgacgatcgtagtatcgcgatccacgtttgtcacagcccacagcgtgaagttgaaattcttcatgaccgcctgctggccatgttgcaggacgacccaaccctgacaccgcgcgatatcgtggtgatggtggcggatatcgacagctacagcccgtttattcaggcggtatttggcagcgcaacgggcgaccgctatctgccctacgcaatctctgaccgtcgcgctcgtcagtcacacccggcgctacaggcctttatcagcctgctttcgctgcctgatagccggtttatctctgaggatgtgctggcactgctggatgtgccagttctggccgcacgtttcaacattaacgaagaggggttgcgctatctgcgccagtgggtcaacgaatccggtgtccgctggggtatcgacgatgataacgtccaggagttcgaactgccagcaaccggccagcatacctggcagtttgggctgacgcgcatgctgctggggtatgcaatggagagcatccacggcgaatggaatgacgtgctgccgtacgatgaatccagtgggttgatcgcggaactggttggtcacttagccacgctgcttatgcagctcaaccgctggcgccgtgcattgatgcagccccgcctgctcgaagagtggctgccagtttgccgcgaaatgctgaatgatttcttcctgccggacagcgaaactgaagccgccatggcgcttatcgagaagcagtggcaggccatcgttgatgaaggggttaattcgcactatcacgaggcggttcccctttcgcttctgcgtgatgagctgacgcaacgtctcgatcaggagcgcatcagccagcgcttccttgcggggccggtgaatatttgtaccctgatgccaatgcgttcaatcccgttcaaagtggtctgtctgcttggcatgaacgacggtatttatccgcgtgcgctgccgcctctgggctttgatcttatgagcgcacaaccgaagcggggtgaccgcagccgccgcgatgatgaccgttatctcttccttgaggcgctgatgtctgcgcaaagcaggctgtatatcagctatatcggacgttcaattcaggataacagcgagcgtttcccgtctgtgctggtgcaggagctggtggactacattggacagagccactatctgccgggcgatgaagcctgcaactgcgacgaaagcgaacgtcgggtgatagcgcatatcacttgccaccatagccgtatgccgttcgatcctgtcaactacgttcctgatgaactgcaaagctatgcccgcgagtggcttcccgccgcgaagaaagcggggacgccgcaaaccgattttattcaggcgctcgaaccgcgcgctatagacaccctcacgtttgagcagctacagcgcttttgggcacacccggttcgggcgtttttccagcaacgcttgcaggtgaatttccgctctgaagagagcgaaatccccgatgcggaaccgtttattcttgatgggctggagcgttttaagcttaattcccagcttctgaatgcgctggttgacgaagaagacgccagtaaactgttccgacgttacagggcgtcgggattacttccgtatggtgcattcggcgaaatcgtctgggatgcccagtgcgaggagatgcgagcgctagctgaccgcgttatcgcgtgtcggcagccggcgagcagcattgaaatcgatctcgattgtaacggtatgcaccttagcggctggctcacgcacgtgcagtctgacgggctgctgcgttggcgcccatccatgctcagcgtttcacatggcctgcaactctggctcgaacatcttgtctacagtgcgagtggtcacgaaggtgaaagccggttgtttgtacgtaaggacggcgaatggcgcttcccgcggatggagcctgagcaggcgttgatgtacctgtcgctttatattgaaggttaccgtcagggcatgaacaaacccctgcttttgctgcctgaaagtgggggggcatggataaaagcctgttatgacgcgcagaatgatgccatgttaacggatgaggcttcgctccagaaagcgcgcagcaagtttttgcaggcctacgaagggaacatgatggtacgtggcgaaggtgacgatgtctggtatcaacgtttatggcgaacgctggagccagaatatttcgacattatcacccaggaggcgcaacgctacctgttaccgttatacaaatttaatcagtcctga

SEQ ID NO: 2133 - DNA, 3549 bp, Enterobacter cloacae
gaaagaatgacccataccgctgagccgcttgatcccctaagtttacctctacagggtgagcgactgattgaagcctcagcgggaacgggaaaaacctataccatcgccgcgctctatctgcgtctgctgttggggctcggcggcaacgccgctttttcgcgcccgttaagcgtggaagagctgctggtggtaaccttcaccgaagcggccactgccgagctgcgtggccgtattcgcagcaacattcatgagctgcgcattgcctgtctgcgtcagacgacggataaccccctctacgcgagcctgctggacgagattgcggataagcaacaggctgcgcaatggctgctgctggccgaacggcaaatggatgaagcgtccgtcttcaccattcacggtttttgtcagcgcatgctgagcctgaatgcgtttgaatccggcatgctctttgagcagcagcttattgaagatgaatccgagcttcgctatcaggcctgtgcggatttctggcgtcgacactgttatccgttgcagcgcgacattgccgaagcggttcacgccctgtggaaaggtccggaagagcttcttcgcgccatcgaccgttacctgcaaggcgaggcgccggtcattaaatctcctccgcctgccgatgaaacgctggcctcgcgccatgaaaagatcgtcgccaaaattgccgcgcttaagcagaagtggaatgagtcggtcggtgaaattgatgcaatcatcgaaaactcaggcatcgacagacgcaagttcaaccgtgggaaccaggggaagtggatcgaaaagatcagcgcctgggcccaagaggagacgcggggctaccagcttccggacgcactggaaaaattttcgcaacgctttttgaccgagcgaaccaaagccgacggtattgtgcctgagcatcccctgtttgtggcgattgaagcgctgcttgcggagccattaacgctcaatgacctgatgatcacccgcgccatgacggagatccgccaggccgtcgcgcgcgaaaaacgtcgccggggcgagctggggtttgatgacatgctgagccgcctggacgaagccctgtccagcgagaatggtgaagcgctcgccagcgcgatccgtacccgttttccggtggcgatgattgacgaatttcaggacaccgacccccagcagtaccgcatttttcgccgcatctggcgacagcagcccgacactgccctgttgttgattggcgaccctaaacaggcgatttacgccttccgtggggcagatatcttcacctatatgaaagcccgtagtgaagttgtcgcgcattacacgttagacaccaactggcgttccgctccggggatggttgagagcgtcaatgcgctgttcagccgtatggagacggcgttcatgttcaaggaaatcccttttctgccggtgaaatccgccccaaaaaacgcatccctgcgcttcgaagtcagtggcgcggagcagcccgccatgaccttctggctgcttgaagaggaaggctatggcgttgctgattatcaggcggcgatggcccagcactgcgccgcgcaaatccgtgactggctgagcgcaggcaaccgcggcgaggcgctgctgtggaagggggaacaggcaaatcctgttaaagcctctgatattaccgtgctggtgcgcagtcgtcaggaagcggcgttaatccgcgatgcgctaacattgctggatattccgtcagtgtatctctctaaccgtgacagcgtgttcgacacgctggaagcccaggaaatgctctggctgcttcaggcggtactggcgccggagcgcgaaaatacgcttcgaagcgcgctggccagctctatgctgggtttgaacgcgcgcgatattgatgagctcaaccatgacgaaaacgcatgggatgcggtggtggaagagtttgtccattaccgtgaacgctggcaaaaacgcggcgtcatggcgatgctgcgcgaattgatgacgcggcgtcagattgccgaaaatatgctggcgtcatccggcggtgaaaggcgtcttaccgatattttacacattagcgaactgttgcaggaagccggcacccagcttgaaagtgaacatgccctcgtgcgctggctggcgcagcaaatcgcggatccaaacagtaacgcctcaagccagcagatgcgtcttgagagcgataagcatctggtgcaaatcgtcaccattcacaaatcgaaaggtctcgagtatccgctggtctggctgccctttatcgccaactaccgcgttcaggatcaggcctattatcatgaccgcgagactttcgatgcggtgctcgatctcagcaaggcggaaaccagcgttgagctggcggaagcggagcgtctggcggaggatttgcgcctgctttacgtggcgctgacccgttctgtctggcattgcagcctgggcgtcgcgccggttttccgccgtcgcggggagaaaacaggggagagcgatttccatttaagcgccttagggcggcttattcagcatggtgagccgaaagatgcggcggggttgcgcctctgtatcgagtcgctttgcggagacgatatcgccctgcatatcccttctctgccagacaacagccgctgggaaatggcgcaagagcccgtgaccgatcttaacgcgcgccagatcacacgggtgcttgccgacgactggcgcgtcaccagctactctggcctgcaacagcacgggcaaagtattgcgcaggatctcatgccgaagctggacgtggatgccgcaggggtaggcgatgttccggttgaaccgacgttaactccgcatcagttcccacgcggcgcgtcgccgggcacctttttgcacagcctttttgaagagcttgatttcacccagcctgtcagtgaggagtgggtgctgaagatgttgcagagcggaggctatgacgcgcactggcagcccgttctcactgactggatcaacgccattttgcaagcgccgctgacggcgcagggcttctctcttcgccagttaacggccaaaaataagcaggttgagatggagttttatctgcccgtcgcaggcccgcttaaggccgacgcgctcgatgcgcttatccgtcagtacgatccgctgtcagccggttgcccgccgctgaacttccgtcaggtgcagggcatgctgaaagggtttatcgacctggtcttccgtcacgaaggacggtactacctgctggattacaaatcaaactggctgggcgagaacagcgcagcctatacccagcaggcgatggcggccgccatgcaaatgcatcgctacgatctgcaatatcagctctataccctggcgctgcaccgctatttgcgccaccgtattgcggattaccgctacgacgatcattttggcggcgtcatctacctgttcctgcgcggggttgacgctgccgatccgcgctccgggatcttcagcactcgtccggatgcggaattgattaataaaatggataacctgtttgcagcaaacacggaggagatggcatga

SEQ ID NO: 2134 - DNA, 1353 bp, Enterobacter cloacae
acattcactaagggttgtatcatggttaaggaacgcagaaccgaactggtccagggattccgccattctgttccctatatcaacacccatcggggaaaaacgtttgtcatcatgcttggcggcgaagccattgagcatgaaaacttttccagcatcgtcaatgatatcggcctgctgcacagcctcggcatccgtctggtggtggtgtatggcgcacgtccgcaaatcgaagccaacctggccgcccatcaccatgagccgatctaccacaaacacacgcgcgtgacggatgcgaaaaccctcgaactggtcaaacaggcggcgggtctgttgcagctcgatatcaccgcccgcctgtcgatgagcctgaataatacgccgttgcagggcgcgcacattaacgtggtgagcggcaactttatcatcgctcagccgctcggcgtggacgatggcgtggattactgccacagcggccgcatccgccgtattgatgaagacgccattcaccgccagttagacaatggcgcgatcgtcctgatggggcccgttgccgtctccgtaacgggtgaaagttttaatctgacctcagaagagattgccacccagctggccatcaagctgaaagcggaaaaaatgatcggcttttgctcctcgcagggtgtcgtgaacgatgagggcgtgattgtgccagaactttttccgaatgaagcccaggcgcgcgtggaagcgctggaagcagaaggcgattactattccggtaccgtgcgttttctgcgcggcgccgttaaagcgtgccgcagcggggtgcgccgcagccacctgatcagctatcaggaagacggtgcgctgttgcaggaactgttctcccgggacgggatcggtacgcagatcgtcatggagagcgccgagcagatccgccgtgccaccatcaacgatatcggcggcattctggagctgatccgtccgctggaacaacagggcattctggttcgccgctcccgggagcagctggagatggagatcgacaagttcaccatcattcagcgcgataacctgaccattgcctgtgcggcgctttatccgttcccggaagagcagattggcgaaatggcgtgcgttgccgtgcacccggattaccgtagctcctcgcggggggaactgctgcttgaacgcgtggcggcacaggcgcgccagatgggtctgagcaagctgttcgtgctcaccacgcgcagcattcactggttccaggagcgcggcttcacgccggtggatattgattccctgccggaaagtaagaaagagatgtacaactaccagcgccgctcgaaggtgttaatggcggacctgggataa

SEQ ID NO: 2135 - DNA, 726 bp, Enterobacter cloacae
  unsure (53)
tcatctgacggggatctgcgatacttatcgtttatccccttaacagagttgantatgcagtacccgattaacgagatgttccagacccttcaaggcgagggttactttaccggcgttcccgctatctttattcgtttacagggatgcccggttggctgcgcctggtgtgataccaaacatacgtgggataagctcgcagatcgggaagtgtcgctgttcagcattctggcgaaaaccaaagagagcgataaatggggcgcgggcagcgcggaagatctgcttgccattattggtcgtcagggctggacggcgcggcacgtggtgatcaccggcggggaaccctgcattcacgatctgatgccgctcaccgaactgctcgaaaagaacggctatagctgtcagattgaaaccagcggtacccatgaagtgcgctgctcccattcaacgtgggtaacggtttcaccgaaagtgaatatgcgcggcgggtatgacgtactatcgcaggcgcttgagcgtgctgatgagatcaaacatccggtggggcgcgtgcgtgacatcgaagcgctggatgaactgctggcgacgctgacggacgaaaagcagcgcgtgatcgcgctacagcctatcagccagaaagacgatgcgacccgtctgtgcattgaaacctgtatcgcccgcaactggcgcctgtcgatgcagacgcacaaatatctgaacattgcctga

SEQ ID NO: 2136 - DNA, 1752 bp, Enterobacter cloacae
gctgcgcgtagagcgccgttatcagcgagatgtctactaatgagcgaaaaacatcctggcccactggtggtcgaaggcaaactgtctgatgccgagcgcatgaaggtagagagcaactacctgcgcggtaccattgccgaagatttaaatgacggcctgaccggcggtttcaaaggcgacaacttcctgctgatccgtttccacggtatgtaccagcaggacgaccgcgatatccgcgccgaacgtgccgagcagaagctggagccgcgtcacgcgatgctgctgcgctgtcgtctgccgggtggcatcatcaccaccaaacagtggcaggcgatcgataagtttgcccatgacaacacgatttacggcagcattcgtctgaccaaccgtcagaccttccagttccacggcattctgaagaagaacgtcaagccggttcaccagatgctgcactccgtgggtctggacgcgctggcgaccgccaacgacatgaaccgtaacgtgctctgcacctcgaatccgtacgagtccgaactgcacgccgaagcgtacgagtgggcgaaaaaaatctccgaacatctgctgccacgtacccgcgcctatgcggagatctggctcgatcaggagaaagtcgccaccaccgatgaagagccgatcctcggtcagacctacctgccgcgtaagttcaaaaccacggtggtgatcccgccgcagaacgatatcgacctgcacgccaacgacatgaacttcgtggcgattgccgaaaacggcaagctggtcggctttaacctgctggtgggcggcggtttgtccattgagcatgggaacaagaaaacctacgcccgcaccgcgagcgagttcggcttcctgccgctggagcacacgctggctgtggctgaggcggtggttactacccagcgcgactggggtaaccgtactgaccgtaaaaatgcgaaaaccaaatacactctggagcgcgtaggcgtcgagacgttcaaagaagaagtggagcgtcgcgcgggcatcaagtttgagccgatccgcccttacgaatttaccggtcgcggcgatcgcatcggctgggttaaaggtatcgataataaatggcacctgacgctgtttatcgaaaacggccgtattcttgattatccgggccgtccgctgaaaaccggcctgctggaaatcgcgaagatccacaaaggcgagttccgtatcaccgctaaccagaacctgatcgtcgccagcgtgccggaaagcgaaaaggcgagaattgaagagctggcccgcgagcacgggttgatgaatgcggtgagcgtgcagcgtgaaaactcgatggcctgcgtgtcgttcccgacctgtccgctggcgatggccgaagccgagcgtttcctgccgtccttcactgataaagtggaagcgattctggaaaaacacggtattccggacgagcatattgttatgcgcgtgacgggctgcccgaacggctgcggccgcgcgatgctggccgaactcggtctggtagggaaagcgccgggtcgctataacctgcacctgggcggtaaccgtatcgggacgcgtattccgcgtatgttccgcgagaacatcaccgagccggaaattctcgattccctcgacgtgcttatcggacgctgggcgaaagagcgcgaagcgggtgaaggcttcggcgactttacggtacgtgcgggcatcattcgcccggtgctcgatcccgcaagggatttctgggagtaa

SEQ ID NO: 2137 - DNA, 750 bp, Enterobacter cloacae
ccacgagaggtaattatgtccgtactcgatctaaacgcgcttaacgcattgccaaaagtcgaacgcattctggcactcgcagaaactaacgcccaactggaaaagctggacgccgaagggcgcgtggcgtgggcgctggaaaacctgccgggagactatgtgctttcgtcgagctttggcattcaggcggcggtcagtctgcatctggtgaatcagatccgtccggacattccggtgatcctcaccgataccggctatctgttcccggagacctatcagtttatcgacgagctgacggataagctcaggctgaacctgaaagtctaccgtgcgacggaaagcgcggcctggcaggaggcgcgttacggcaagctgtgggagcagggcgttgagggcattgagaaatacaatgagatcaacaaggtcgagccgatgaaccgggcgctaaaagaactgaacgctcagacctggtttgcgggcctgcgccgcgagcagtccgggagccgggcaacgctgccggtgctggcggtgcagcgcggcgtgttcaaagtgctgccgatcatcgactgggataaccgcacggtgtaccagtatctgcaaaagcacgggctgaagtaccatccgctgtgggatcaaggctacctgtcggtaggcgacacccacaccacgcgtaaatgggaaccgggaatggcggaagaagagacgcgattctttgggctgaagcgcgagtgcggattgcacgaagggtga

SEQ ID NO: 2138 - DNA, 375 bp, Enterobacter cloacae
aaccccgcagtagagtccagcggaaagttatgggatgatgatgccgttttttcagggggcaggatgggtaaactaacgctgctgttgctggctttgctggtctggctgcaatattcgctgtggttcggcaaaaacggactgcacgactacagccgggtgagcgatgacgtcgcggcacagcaggcgacaaacgccaaacttaaagcgcgtaacgatcaactttttgctgaaattgatgacctcaatggcggccaggaggcgattgaggagcgcgcacgcaatgaactcagtatgactaagccgggcgaaacgttttatcgcctggttccggatgcgtctaaacgcaatcagggctccgcacaaaacaatcgataa

SEQ ID NO: 2139 - DNA, 558 bp, Enterobacter cloacae
tataaaagtgacgcgcccggaagacttacagctcgcggaattttatcttacccgtacgacccctcaggagaaggcataatgcgtattggacacggttttgatgtacacgcctttggcggcgttggcccaattatcattggcggcgtgcgcattccttacgaaaaaggtctgctggcgcattctgatggcgacgtggcgctgcatgcgctgaccgacgcgctgctgggtgccgccgcgctgggcgacattggcaaactgttcccggacaccgatcctgcttttaaaggcgcagacagccgcgaactgctgcgcgaagcctggcgtcgtattcaggccaaaggctacacccttggcaacgttgatgtgacgatcattgcccaggcaccgaagatgttgccgcacatccctcagatgcgcgtgtttatcgctgaagatctgggctgccatatggacgacgtcaacgtcaaagcgaccaccacggagaaactgggctttaccggtcgtggcgaaggcattgcctgtgaagccgtggcgctgctggtgaaggcggccaaatga

SEQ ID NO: 2140 - DNA, 843 bp, Enterobacter cloacae
ccgtcgagttacgcttctggctgccggcaggtagctttgccaccagtgttgtcagggaacttatcaacacgtcgggtgattatgcgaatattgctgagtaacgatgacgggatccatgcgccaggtattcagacgctggcgaaacacctccgcgaatttgcggatgtgcaggtcgtggctcccgatcgtaaccgcagtggcgcgtctaactcattgacgctggagtcttcacttcgcacctttacctttgagaatggcgatattgccgtccagatggggacgccgaccgactgcgtgtttttgggcgtaaatgcgctgatgcgccctcggccggatgttgtggtctccggcatcaatgccgggccaaatcttggcgatgatgtgatttactccggcaccgtggccgcggcgatggaagggcgtcacctgggtttcccggcgctggcggtctcgttaaacggccacacccactatgacactgccgccgcggtgacctgctccattctccgtgcgcttggccgcgagccactgcgtaccggacgtatccttaatattaacgtgccggatctcccactggacgagattaaagggatccgcgtgacgcgctgcggcagtcgccacccggccgatcaggttattccccagcaggatccccgcggcaataccctgtactggatcggcccgccgggagataaatgcgatgccgggccagacaccgactttgctgcggtggatgagggttacgtttccgttacgccgttgcacgtagatttaaccgcttatagcgcgcatgatgtggtgtcggactggttagatcgggtcggagtgaacgcgcaatggtaa

SEQ ID NO: 2141 - DNA, 199 bp, Enterobacter cloacae
  unsure (86)
  unsure (157)
cgccagattcccgggtgctggaaattggcaccggttcagggtatcagaccgcgatcctggcccaccttgtgcaccatgtctgttcncgtggaacggattaaagggttgcagtggcaggcgcgccgtcgcctgaaacagctcgatttacataagtttngtcttcaaccgcccagggcatggaaggaccatgcctgggtat

SEQ ID NO: 2142 - DNA, 642 bp, Enterobacter cloacae
  unsure (611)
cggggttcaggtcatctatggcccgcacgtcaccattatcaaaaacgaagtggaagagatcttatcgtaatgaaaactgtactggataacctgaaaggaaaactggtcgtctcctgccaggcgctggaaaacgaaccgctgcacagcccgtttattatgtcgcgaatggcgctggcggcggcccagggcggtgccgctgcgatccgcgccaatagcgtggtggatatcgaggctatcaaagggctggtctcactgccggtcatcggcatcatcaaacgagactatccggacagcgaggtgttcatcaccgcgacgctcaaagaagtggatgagctgatggcggtcgccccggagatcgttgcgctggatgcgaccgcccggaaacggcctggtggcgtatcgctggacatgctgatcgcgcagatccgcacccgttacccttcgctgctgctgatggcggatattgccaccgtgcaggaggccgtgaccgcgcaggcgctggggtttgattgtgtcggaaccaccctttacggttatacggcggagaccgcgggccattcgctaccggaaaatgactgcgcgtttttgaaagagttgcgttctgcggtcangatccccggtgattgccgaaaggtaacgtga

SEQ ID NO: 2143 - DNA, 1812 bp, Enterobacter cloacae
cgacgcatgacaacacaggccccaccttcaaatttgcttccccttaacccggagcaactggcgcgcctccaggccgcgacttccgatttttcacccacccagctcgcctgggtctccggctatttctggggaatgctgaaccagcagccgggtgctgtggctggcgtcccgccaacggccgttgaaattcctgccatcacgcttatctccgcttcgcaaacgggtaatgcccgtcgtgtggccgaagcgctgcgtgatgacctgctcgccgcgaagctgaacgttaacctggtcaacgccggggattataaattcaaacagatcgcgtcagaaaaactgctggtggtggtggcgtcaacgcagggtgaaggcgagcctgcggaagaagccgtcgcgctgcataagttcctgttctcgaaaaaagcgccaaagctcgagggcaccgcctttgccgtcttcggcctcggtgacacgtcctatgaatttttctgccagtccggtaaagatttcgacagcaagctggcggagctgggtgcagagcgcctgctggatcgcgtagacgctgatgtcgaataccaggccgccgccgccgaatggcgggcgcgcatcgttgaggtgctgaaggcccgcgtcccgaaagagacgccagcgcaggccgccgttaccgcagcgggcaccgtcaacgaaatccacaccagcccttacacgaaagaggcgccgctgacggcgagcctgtcggtaaaccagaaaatcacgggccgtgattcggaaaaagacgtgcgccatatcgaaatcgatctcggtgactccggcctgcgttatcagcctggcgatgcgctgggcgtctggtatcagaacgatccggcgctggtgaaagagctggtcgaactgctgtggctgaaaggcacggagccggtccaggtggagggtaaaaccttaccgctctctgaggcgcttcagtggcatttcgagctgacggtgaataccgccaacatcgttgaaaactacgccaccttaacccgcagcgaatcgctccttccgctggtcggggataaggcgaagttacagcaatacgcggcgacaacgccgattgtcgatatggtgcgtttctcaccggcacagctggatgccgacgcgctgatcggcctgctgcgtccactgacgccgcgtctttactccatcgcctcctcacaggcggaagtggaaaacgaagtccacatcaccgttggcgtggtgcgttacgacatcgaaggccgcgcgcgggcgggcggggcctcgggcttcctggccgaccgcgtggaagaagagggcgaggtgcgcgtctttatcgagcacaacgacaacttccgtctgccggcgaacccggaaacgccggtgatcatgattggcccgggcaccggcatcgcaccgttccgcgcctttatgcagcagcgtgcagcggacgaggcaccgggtaaaaactggctgttcttcggcaacccgcattttaccgaggatttcctctaccaggttgaatggcagcgctacgtcaaagagggtgtgctgacccgcatcgatctggcctggtctcgtgaccagaaagaaaaagtatacgtacaagacaaactgcgcgaacagggcgcagagctgtggcgctggatcaatgacggtgcccacatttatgtctgcggcgacgccaatcgcatggcgaaagacgttgagcaggcactgctggaagtgattgccgaattcggcggtatggatgccgaaacggcggatgaatttttaagtgagctgcgcgtagagcgccgttatcagcgagatgtctactaa

SEQ ID NO: 2144 - DNA, 651 bp, Enterobacter cloacae
gcacttcccgcactggggcgcacgcgatctgctgggaggcaagtgatggccgcccatgatgagaacgtcgtctggcatcctcatccggtcaccgtcgcccagcgcgaacagctccatggtcaccgtggggttgtgctgtggtttaccgggctgtctggctccggtaaatccacggtggcaggcgcactggaagaggcgctgcatcagcagggggtgagcacctacctgctggacggcgacaacgtgcgtcacggcctgtgcagcgatttagggttcagcgatgaagatcgtaaagagaacattcgtcgggtgggggaagtcgccagcctgatggcggatgccgggctggtggtgctgacggcgtttatctcaccgcaccgcgccgaacgtcagatggtgcgtgagcgcgtggggcagaatcgctttattgaagtgtttgtggataccccgctggcaatctgcgaagcgcgcgatcttaaagggctgtacaaaaaagcccgcgcgggagagctgcgaaacttcaccggcattgactccgtttacgaagcgcctgaatcccctgagattcatctggaaggtcaacaattggtaacaaatttagtaagccaattattagacctgctcagacgggacgatattatcagatcctga

SEQ ID NO: 2145 - DNA, 810 bp, Enterobacter cloacae
ctaagccgggcgaaacgttttatcgcctggttccggatgcgtctaaacgcaatcagggctccgcacaaaacaatcgataatcaggcccaggattacgacatggcagcaactttttcggacgtctgtgccgtggtgccggccgcaggttttggccggcgcatgcagacagaatgtcctaagcagtacctctcaattggcgataaaacgatcctcgagcacgccgtggcggcgctgctggcgcattctcgggtgaaacgcgttgttattgccatcagccccggcgatgcactttttgctcagctcccgctggcgaatcaccctcagattaccgtcgttgacggcggcgcagagcgggctgactccgttctggcgggcattcaggctgccgggaacgcgcagtgggtgctggtgcacgatgccgcgcgtccctgtctgcatcacgacgatctgtcacgtctgctggccctgagcgaaaccagtaacgtgggcggcattctggccgccccggtgcgtgacaccatgaagcgtgccgaaccgggtaaaccggcgattgcccacaccgtcgagcgcgtcgatctatggcacgcgctgacgccacaattttttccccgcgaattactccacgactgcttaacgcgtgcgcttaaagaaggtgcgaccattacggacgaagcctcggcgctggagtattgcggtttccaccccacgcttgttgaagggcgcgctgataatataaaagtgacgcgcccggaagacttacagctcgcggaattttatcttacccgtacgacccctcaggagaaggcataa

SEQ ID NO: 2146 - DNA, 273 bp, Enterobacter cloacae
gaaaaggaggcgttggctgacgaggataccctgccgcaaagcgagcgcgccgcggcggtgatcgccgggctgggaggaaaagacaatctggatgacgttgactgctgcgccacgcgccttcgcgtcacggtgaaagacggtagcaaagtcaatgaatctgcactgaaagcgaccggcgcgcgcggcgtcatcgtgcgcggtaacggggttcaggtcatctatggcccgcacgtcaccattatcaaaaacgaagtggaagagatcttatcgtaa

SEQ ID NO: 2147 - DNA, 2397 bp, Enterobacter cloacae
caaaaaagagcaggtcattatttgtctttggtgaggggtaagatggcgcaacggggagatgagttttggatagagattcaggacattcgccactgcgtggaggatgaaggcgatacgctaacgttgctctggatgctggaagggcgggcagagctgaacaccgatgcgggacgtgacaccctggaggccaatacccttgccatcataaaccgtcatcggcgctggcagttcacgagcgaaacggcaaatgtcaccctgcgcgtaaccctttccgggcgctgggtcgtccagctatgcaatgatttttttgcccatgattatgctgtaccggcagaagccggaggcgtctggccccagtgcgatgcgcttcgcgatctgctgcgccagcttcttgtggtcaccctcatcaacgacccgcaccgctaccggctggaggcgtaccgctggctgagcgagattttgctgttgctgaccagccgctttcaacagcccgcccgtatgctgtcccgggaactttcctcagcgcacagcaaacgcatcgcccgggtgatagagcggatcaatgccagttattcccgccgtattacgcttgcggaaatcgccgcgagtgaatatgtttctgaagcctggctctctcgtctctttcgcaaggaggtggggatcagtttcatgcagtacatcacccgcctgcggctggaaaaggcggccaacgctctccggctgacgaaccgaccgctgcaccagattgcgcttgagcagggtttcgccagcacgcgcatgatgagcgatcggttcaggcgtgttcacaatatgtctccgggtgagtttcgtaaggcccgacgccagcacccggaggcggcacgtgttcgggcggacaggcgtgagcagcgctatccggtcgccgtggacaagctgtttagcctgctcaatgaaccggtggcgcgcggttggggtgcctcgccgctcgtcgttcacccgcagcaggagcagagactggatcttgagcagctcaatcctctttctgcctcgctgcgccgtatgcgggtggtcattaccctgcgtgagctcgacgatttgctccgtgaggacgttcgacaaaatctggaggcgataaatgaggctattcccattgagggaattgatatcgccgaaccttttctcagcagtcgtctgtttgctaccgggtgggatgacccccagatggcaggctacgcctgctggtacaatctgcatcagctcttcacctggctggcaaaaaagcagtggacggtgctactgcacaccggcgtaacgacccgccgcgatcttctcacccgctttttacaacagtcggttaatcattttgcgccagagatcaccgcgggctggcacttcgtcatgcactggtcaacacaggcgagtgaggagacccgggagcaggtctggctggcccagcaaaaggcaatacgaacttatcttccgcaggcaaagtttggtttatggcaccgatttgcccccgtcagcgcgggcgtaagcgacgataccctgttcagttcagccatcctgatgcaggccgattttcttgcctgttctgccgatgccaatgaacttctcgatcccgcgcagctggaggtaacccctctctcctcaacggaaaattatccgatactgaaggtccgccagatcctcgctgcccttcgcctgcgaaaatgttcgcttcccgtctggcttctctcctggaataccctcaccggcaacacgcgggcgacaaacggctggttttttcgtggggcgctgctgatgcagaacctgctcgggctttcggagcaggtctggctggcgggattctggctcaattcgggtcttcagggagaagcccgtgcgaacaacaccatcgatacctcaagccttgcgctacagtataaccatggtctgccgcgtccggtttattgggtactctggctctggcaacgtctgcggggcgaggtgctggtcaatgataagcgtgtcctgcttacgcgccatcgcaatggttatcagctgttgctgcgtaatgtggtggtttttaatccactcctatccagtgaagaagccttcatccagcgttttcgccagcagtatcatttacacctgaagggaatgcgcggtaaatggcgaattaaatgccatctgtttgatcagcacaacggcgcgctctatccgttgcttgaaggggttggtagcgaaagcggccctgatgaagagatgtggcgctggatagcgcataaagcgcgtccaacgctttccgtacgcgatgaacgcctttatgacggctggcaactgagtgaatcactggagagtaatgcgctggtgctctacgagtttacgccgctcgtgcctcatgaggccgaaacggaggagattcactccccgcggtag

(The sequence listing continues in the following parts.)

What is claimed is:

1. An isolated nucleic acid comprising a nucleotide sequence encoding an *E. cloacae* polypeptide wherein the nucleic acid comprises SEQ ID NO: 1394.

2. A recombinant expression vector comprising the isolated nucleic acid of claim 1 operably linked to a transcription regulatory element.

3. A cell comprising the recombinant expression vector of claim 2.

4. An isolated nucleic acid encoding a polypeptide which comprises SEQ ID NO: 7056.

5. A recombinant expression vector comprising the isolated nucleic acid of claim 4 operably linked to a transcription regulatory element.

6. A cell comprising the recombinant expression vector of claim 5.

7. An isolated nucleic acid consisting of SEQ ID NO: 1394.

8. A recombinant expression vector comprising the isolated nucleic acid of claim 7, operably linked to a transcription regulatory element.

9. A cell comprising the recombinant expression vector of claim 8, wherein the cell expresses the polypeptide encoded by SEQ ID NO: 1394.

* * * * *